US007612194B2

(12) United States Patent
Andersen et al.

(10) Patent No.: US 7,612,194 B2
(45) Date of Patent: Nov. 3, 2009

(54) **NUCLEIC ACID SEQUENCES FROM *DIABROTICA VIRGIFERA VIRGIFERA* LECONTE AND USES THEREOF**

(75) Inventors: Scott E. Andersen, St. Louis, MO (US); Glenn R. Hicks, Castro Valley, CA (US); Joseph E. Huesing, Chesterfield, MO (US); Charles P. Romano, Chesterfield, MO (US); Clayton S. Vetsch, North Stonington, CT (US)

(73) Assignee: Monsanto Technology LLC, St. Louis, MO (US)

( * ) Notice: Subject to any disclaimer, the term of this patent is extended or adjusted under 35 U.S.C. 154(b) by 473 days.

(21) Appl. No.: 10/205,189

(22) Filed: Jul. 24, 2002

(65) Prior Publication Data

US 2007/0050860 A1    Mar. 1, 2007

Related U.S. Application Data

(60) Provisional application No. 60/307,512, filed on Jul. 24, 2001.

(51) Int. Cl.
*C07H 21/04* (2006.01)
*C12N 15/82* (2006.01)
*C12N 5/10* (2006.01)
*C12N 15/74* (2006.01)

(52) U.S. Cl. ............... 536/24.5; 435/320.1; 435/419; 435/468; 435/471

(58) Field of Classification Search ............... 536/23.1, 536/23.2, 24.3, 24.33
See application file for complete search history.

(56) References Cited

U.S. PATENT DOCUMENTS

| | | | | |
|---|---|---|---|---|
| 4,948,734 | A | 8/1990 | Edwards et al. | 435/252.5 |
| 5,107,065 | A | 4/1992 | Shewmaker et al. | 800/298 |
| 5,231,020 | A | 7/1993 | Jorgensen et al. | 800/281 |
| 5,283,184 | A | 2/1994 | Jorgensen et al. | 800/285 |
| 5,629,469 | A * | 5/1997 | Deluca-Flaherty et al. | 800/301 |
| 5,759,829 | A | 6/1998 | Shewmaker et al. | 800/286 |
| 6,326,193 | B1 | 12/2001 | Liu et al. | 435/320.1 |
| 6,506,559 | B1 | 1/2003 | Fire et al. | 435/6 |
| 7,348,410 | B2 * | 3/2008 | Gaines et al. | 530/350 |
| 2002/0048814 | A1 | 4/2002 | Oeller | 435/455 |
| 2003/0018993 | A1 | 1/2003 | Gutterson | 800/286 |
| 2003/0061626 | A1 | 3/2003 | Plaetinck et al. | 800/8 |
| 2003/0150017 | A1 | 8/2003 | Mesa et al. | 800/279 |
| 2003/0175965 | A1 | 9/2003 | Lowe et al. | 435/455 |
| 2004/0029283 | A1 | 2/2004 | Fillatti | 435/468 |
| 2006/0174380 | A1 | 8/2006 | Carrington et al. | 800/285 |
| 2007/0050860 | A1 | 3/2007 | Anderson et al. | 800/278 |

FOREIGN PATENT DOCUMENTS

| | | |
|---|---|---|
| WO | WO 94/01550 | 1/1994 |
| WO | WO 98/05770 | 2/1998 |
| WO | WO 99/49029 | 9/1999 |
| WO | WO 99/53050 | 10/1999 |
| WO | WO 01/37654 | 5/2001 |
| WO | WO 2004/013169 | 2/2004 |
| WO | WO 2005/049841 | 6/2005 |
| WO | WO 2005/110068 | 11/2005 |

OTHER PUBLICATIONS

Cordonnier-Pratt et al., NCBI, Accession No. AW671389, Jul. 19, 2000, p. 1.*
New England Biolabs Catalog 1996/1997, p. 111.*
Gill et al., Arch. Insect Biochem. Physiol., 1998, vol. 37, pp. 8-90.*
Beegle et al., "Invitation paper (CP Alexander Fund): history of *bacillus thuringiensis*Berliner Research and Development," *Can. Entomol.*, 124:587-616, 1992.
Dalmay et al., "An RNA-dependent RNA polymerase gene in *Arabidopsis* is required for posttranscriptional gene silencing mediated by a transgene but not by a virus," *Cell*, 101:543-553, 2000.
Database EMBL, "*Drosophila melanogaster* RE24065 full length cDNA," Database accession No. AY071192, 2001.
Dow et al., "Molecular genetic analysis of V-ATPase function in *Drosophila melanogaster*," *J. Exp. Biol.*, 200(Pt. 2):237-245, 1997.
Dow, "The multifunctional *Drosophila melanogaster* V-ATPase is encoded by a multigene family," *J. Bioenerg. Biomembr.*, 31(1):75-83, 1999.
Elbashir et al., "Analysis of gene function in somatic mammalian cells using small interfering RNAs," *Methods*, 26(2):199-213, 2002.
Elbashir et al., "RNA interference is mediated by 21- and 22-nucleotide RNAs," *Genes Dev.*, 15:188-200, 2001.
Feitelson et al., "*Bacillus thuringiensis*: insects and beyond," *Bio/Technology*, 10:271-275, 1992.
Feitelson, "The *Bacillus thuringiensis* family tree", In: Advanced Engineered Pesticides, Kim Ed., Marcel Dekker, Inc., New York, pp. 63-71, 1993.
GenBank Accession No. L09234, Jun. 12, 1993.
GenPept Accession No. NP_001682, May 10, 2002.
Gill et al., "The mode of action of *Bacillus thuringiensis* endotoxins," *Annu. Rev. Entomol.*, 37:615-636, 1992.

(Continued)

*Primary Examiner*—Ashwin Mehta
(74) *Attorney, Agent, or Firm*—Timothy K. Ball, Esq.; Sonnenschein Nath & Rosenthal LLP

(57) ABSTRACT

Expressed Sequence Tags (ESTs) isolated from the Western Corn Rootworm, *Diabrotica virgifera virgifera* LeConte, are disclosed. The invention encompasses nucleic acid molecules that encode *D. v. virgifera* protein homologs and fragments thereof. In addition, antibodies capable of binding the proteins are encompassed by the present invention. The disclosed ESTs have particular utility in isolating genes and promoters, identifying and mapping the genes involved in developmental and metabolic pathways, and determining gene function. The ESTs provide a unique molecular tool for the targeting and isolation of novel genes for plant protection and improvement. The invention also relates to methods of using the disclosed nucleic acid molecules, proteins, fragments of proteins, and antibodies, for example, for gene identification and analysis, and preparation of constructs.

12 Claims, No Drawings

OTHER PUBLICATIONS

Hamilton et al., "A species of small antisense RNA in post-transcriptional gene silencing in plants," *Science*, 286(5441):950-952, 1999.

Hofmann et al., "Specificity of *B. thuringiensis* delta-endotoxins is correlated with the presence of high-affinity binding sites in the brush border membrane of target insect midguts," *Proc. Natl. Acad. Sci. USA*, 85:7844-7848, 1988.

Kennerdell et al., "Heritable gene silencing in *Drosophila* using double-stranded RNA," *Nat. Biotechnol.*, 18:896-898, 2000.

Kennerdell et al., "Use of dsRNA-mediated genetic interference to demonstrate that frizzled and frizzled 2 act in the wingless pathway," *Cell*, 95:1017-1026, 1998.

Mourrain et al., "*Arabidopsis* SGS2 and SGS3 genes are required for posttranscriptional gene silencing and natural virus resistance," *Cell*, 101:533, 2000.

Peragine et al., "SGS3 and SGS2/SDE1/RDR6 are required for juvenile development and the production of trans-acting siRNAs in *Arabidopsis*," *Genes Dev.*, 18(19):2368-2379, 2004.

Rajagopal et al., "Silencing of midgut aminopeptidase N of *Spodoptera litura* by double-stranded RNA establishes its role as *Bacillus thuringiensis* toxin receptor," *J. Biol. Chem.*, 277:46849-46851, 2002.

Tabara et al., "RNAi in C. elegans: soaking in the genome sequence," *Science*, 282(5388):430-431, 1998.

Tabashnik, "Evaluation of synergism among *Bacillus thuringiensis* toxins," *Appl. Environ. Microbiol.*, 58(10):3343-3346, 1992.

Van Rie et al., "Receptors on the brush border membrane of the insect midgut as determinants of the specificity of *Bacillus thuringiensis* delta-endotoxins," *Appl. Environ. Microbiol.*, 56(5):1378-1385, 1990.

Van Rie et al., "Specificity of *Bacillus thuringiensis* δ-endotoxins," *Eur. J. Biochem.*, 186:239-247, 1989.

Vazquez et al., "Endogenous trans-acting siRNAs regulate the accumulation of *Arabidopsis* mRNAs," *Mol. Cell*, 16(1):69-79, 2004.

Yadav et al., "Host-generated double stranded RNA induces RNAi in plant-parasitic nematodes and protects the host from infection," *Molec. Biochem. Parasitol.*, 148(2):219-222, 2006.

\* cited by examiner

NUCLEIC ACID SEQUENCES FROM
DIABROTICA VIRGIFERA VIRGIFERA
LECONTE AND USES THEREOF

CROSS REFERENCE TO RELATED APPLICATIONS

This application claims benefit under 35 U.S.C. 119(e) of U.S. provisional application Ser. No. 60/307,512, filed Jul. 24, 2001.

FIELD OF THE INVENTION

The present invention is in the field of molecular biology; more particularly, the present invention relates to nucleic acid sequences from the western corn rootworm, *Diabrotica virgifera virgifera* LeConte. The invention encompasses nucleic acid molecules that encode proteins and fragments of proteins. In addition, proteins and fragments of proteins so encoded and antibodies capable of binding the proteins are encompassed by the present invention. The invention also relates to methods of using the disclosed nucleic acid molecules, proteins, fragments of proteins, and antibodies, for example, for gene identification and analysis, and preparation of constructs.

BACKGROUND OF THE INVENTION

The western corn rootworm (WCRW), *Diabrotica virgifera virgifera* LeConte, is a major pest of corn in the United States. The western corn rootworm overwinters in the egg stage in fields where corn was grown the previous season. The eggs hatch from late May through June. Thereafter, the larvae pass through 3 larval stages, or instars, feeding upon the corn root system. Following completion of larval development, the larvae transform into pupae, which are white and immobile. Adults of western corn rootworms begin to emerge in early July and continue to emerge from the pupae stage into August. Adult beetles feed on the corn foliage and silk. Female beetles lay the vast majority of their eggs in the soil of cornfields during August and early September. Western corn rootworm larvae can survive only on corn and a few other species of Poaceae (Branson and Ortman, *J. Econ. Entomol.* 60: 201-203 (1967); Branson and Ortman, *J. Econ. Entomol.* 60: 201-203 (1967)). Larval root feeding decreases plant vigor by reducing the water and nutrients supplied to the developing corn plants. Extensive root damage weakens the root system and makes the plants more susceptible to lodging (plants lean over or elbow), which eventually reduces corn yield and often results in death of the plant. Lodged plants are difficult to harvest resulting in further yield losses. The western corn rootworm adults feed upon corn leaves, which can slow plant growth and, on rare occasions, kill plants of some corn varieties. The western corn rootworm cause economic losses throughout the Midwest and in certain eastern and northeastern states where corn is produced.

Control of corn rootworms has been partially addressed by crop rotation. However, economic demands on the utilization of farmland restrict the use of crop rotation. In addition, the spread of at least one strain of rootworm has been documented in which female oviposition occurs in soybean fields, which further complicates crop rotation strategies. Therefore, chemical insecticides are relied upon most heavily to guarantee the desired level of control. Over $250 million worth of insecticides are applied annually to control corn rootworms alone in the United States. Even with insecticide use, rootworms still can cause over $750 million worth of crop damage each year. The use of chemical insecticides to control corn rootworm has several drawbacks. Continual use of insecticides has allowed resistant insects to evolve. Situations such as extremely high populations of larvae, heavy rains, and improper calibration of insecticide application equipment can result in poor control. Chemical insecticides used for corn rootworm control often raises environmental concerns such as contamination of soil and of both surface and underground water supplies, because many of them are toxic to humans, wildlife and other nontarget species. As a result, much research has been concentrated in the area of biopesticides.

The advantage of using biopesticides is that they are generally less harmful to non-target organisms and the environment as a whole compared to chemical pesticides. The most widely used biopesticide is *Bacillus thuringiensis* (Bt), which is a spore-forming gram-positive bacterium. During sporulation, *B. thuringiensis* produces proteinaceous inclusions which are composed of proteins known as insecticidal crystal proteins (ICPs), Cry proteins, or delta-endotoxins. These proteins are toxic to a variety of insect species including orders Lepidoptera, Coleoptera, Diptera, Hemoptera, Hymenoptera, Orthoptera, and Mallophaga (Beegle and Yamamoto, *Can. Entomol.* 124:587-616; Feitelson, Advanced Engineered Pesticides (L. Kim, ed.), Marcel Dekker, Inc., New York (1993), pp. 63-71; Feitelson, et al., *Bio/Technology* 10:271-275; U.S. Pat. No. 4,948,734 (1990)). Due to their high specificity for particular insect pests and their safety for man and the environment, ICPs have been used as biopesticides for the last three decades.

It has been established that the Bt toxins function in the brush border of the insect midgut epithelial cells as described by Gill et al., *Annu. Rev. Entomol.* 37: 615 (1992). Specific binding of Bt toxins to midgut brush border membrane vesicles has been reported by Hofmann et al., *Proc. Natl. Acad. Sci. USA* 85: 7844 (1988); Van Rie et al., *Eur. J. Biochem.* 186: 239 (1989); and Van Rie, J. et al. *Appl. Environ. Microbiol.* 56: 1378 (1990). It is believed that the specificity of Bt toxins is determined by their specific interaction with receptors in insects' guts. It is advantageous to identify and/or isolate receptors as targets for insecticidal peptides in the guts of western corn rootworms. It is further advantageous to develop target-based screens to produce insecticidal peptides.

A cDNA (or complementary DNA) library, which is constructed from mRNA purified from WCRW intestine, can be one valuable source for isolating receptor protein genes. Construction of cDNA libraries is well-known in the art and a number of cloning strategies exist. Random clones from a cDNA library can be sequenced from both 3' and 5' ends to generate expressed sequence tags (ESTs), which can represent copies of up to the full length transcript (McCombie, et al., *Nature Genetics*, 1: 124-130 (1992); Kurata, et al., *Nature Genetics*, 8: 365-372 (1994); Okubo, et al., *Nature Genetics*, 2: 173-179 (1992)). Typically, only single run sequence data is obtained from the cDNA library (Adams, et al., *Science* 252:1651-1656 (1991)). Automated single run sequencing typically results in an approximately 2-3% error or base ambiguity rate. (Boguski, et al., *Nature Genetics*, 4:332-333 (1993)). Between 150-450 nucleotides of sequence information is usually generated as this is the length of sequence information that is routinely and reliably produced using single run sequence data.

ESTs have been found to be useful for similarity searches and mapping (Adams, et al., *Science* 252:1651-1656 (1991)). Sequence comparisons and similarity analysis would allow the identification of receptors for insecticidal peptides and then full-length cDNA constructs can be obtained using several methods (Land, et al., *Nucleic Acids Res.* 9:2251-2266

(1981); Okayama and Berg, *Mol. Cell Biol.* 2:161-170 (1982); Coleclough, et al., *Gene* 34:305-314 (1985); Krawinkel, et al., *Nucleic Acids Res.* 14:1913 (1986); Han, et al., *Nucleic Acids Res.* 15:6304 (1987)).

SUMMARY OF THE INVENTION

The present invention provides a substantially purified nucleic acid molecule having a nucleotide sequence which is or is complementary to a sequence selected from the group consisting of SEQ ID NO: 1 through SEQ ID NO: 9112.

The present invention also provides a substantially purified nucleic acid molecule, the nucleic acid molecule capable of specifically hybridizing to a second nucleic acid molecule having a nucleotide sequence which is or is complementary to a sequence selected from the group consisting of SEQ ID NO: 1 through SEQ ID NO: 9112.

The present invention further provides a substantially purified protein, peptide, or fragment thereof encoded by a nucleotide sequence which is or is complementary to a sequence selected from the group consisting of SEQ ID NO: 1 through SEQ ID NO:9112.

The present invention also provides a substantially purified nucleic acid molecule encoding a *D. v. virgifera* protein homologue or fragment thereof, wherein the nucleic acid molecules comprises a nucleotide sequence selected from the group consisting of SEQ ID NO: 1 through SEQ ID NO: 9112.

The present invention also provides a substantially purified nucleic acid molecule encoding a protein or fragment thereof, wherein the protein or fragment thereof is selected from the group consisting of *D. v. virgifera* proteins or fragments thereof from Table 1.

The present invention also provides a substantially purified protein or fragment thereof encoded by a nucleotide sequence selected from the group that encodes a *D. v. virgifera* protein or fragment thereof from Table 1.

The present invention also provides a substantially purified nucleic acid molecule encoding a *D. v. virgifera* receptor or fragment thereof for a protein toxic to *D. v. virgifera*, wherein the nucleic acid molecules comprise a nucleotide sequence selected from the group consisting of SEQ ID NO: 1 through SEQ ID NO: 9112.

The present invention also provides a substantially purified nucleic acid molecule encoding a *D. v. virgifera* receptor or fragment thereof for a protein toxic to *D. v. virgifera*, wherein the nucleic acid molecules comprise a nucleotide sequence selected from the group consisting of SEQ ID NO: 1 through SEQ ID NO: 9112 and wherein said protein is isolated from bacteria, fungi, plants and animals or produced by *B. thuringiensis, Photorhabdus,* and *Xenorhabdus*.

The present invention also provides a substantially purified receptor or fragment thereof encoded by a nucleotide sequence selected from the group that encodes a *D. v. virgifera* receptor or fragment thereof from Table 1.

The present invention also provides a substantially purified protein or fragment thereof encoded by a first nucleic acid molecule which specifically hybridizes to a second nucleic acid molecule, the second nucleic acid molecule selected from the group of complements of SEQ ID NO: 1 through SEQ ID NO: 9112.

The present invention also provides a transformed cell having a nucleic acid molecule which comprises: (A) an exogenous promoter region which functions in the cell to cause the production of a mRNA molecule; which is operably linked to (B) a structural nucleic acid molecule, wherein the structural nucleic acid molecule comprises a nucleotide sequence which is or is complementary to a sequence selected from the group consisting of SEQ ID NO:1 through SEQ ID NO:9112; which is operably linked to (C) a 3' non-translated sequence that functions in said cell to cause termination of transcription.

The present invention also provides a transformed cell having a nucleic acid molecule which comprises: (A) an exogenous promoter region which functions in the cell to cause the production of a mRNA molecule; which is operably linked to (B) a structural nucleic acid molecule, wherein the structural nucleic acid molecule encodes a receptor or fragment thereof which binds a protein toxic to *D. v. virgifera* and comprises a nucleotide sequence which is or is complementary to a sequence selected from the group consisting of SEQ ID NO: 1 through SEQ ID NO:9112; which is operably linked to (C) a 3' non-translated sequence that functions in said cell to cause termination of transcription.

The present invention also provides a transformed cell having a nucleic acid molecule which comprises: (A) an exogenous promoter region which functions in the cell to cause the production of a mRNA molecule; which is operably linked to (B) a structural nucleic acid molecule, wherein the structural nucleic acid molecule encode a receptor or fragment thereof which binds a toxin and comprises a nucleotide sequence which is or is complementary to a sequence selected from the group consisting of SEQ ID NO:1 through SEQ ID NO:9112, wherein said receptor or fragment thereof is disposed at the surface of said cell; which is operably linked to (C) a 3' non-translated sequence that functions in said cell to cause termination of transcription.

The present invention also provides a plant cell, a mammalian cell, a bacterial cell, an insect cell, a fungal cell and an algal cell transformed with a nucleic acid molecule of the present invention.

The present invention also provides a method for identifying a candidate protein toxic to *D. v. virgifera* comprising: (a) culturing cells transformed with a nucleic acid molecule of the present invention; (b) recovering said cells having a receptor or fragment thereof disposed at their surface, wherein said receptor or fragment thereof binds a protein toxic to *D. v. virgifera*; (c) contacting said cells with said candidate protein; and (d) determining effects of said candidate protein on metabolism or morphology of said cells, wherein said determination is predictive of cytotoxic property of said candidate protein.

The present invention also provides a computer readable medium having recorded thereon one or more of the nucleotide sequences depicted in SEQ ID NO:1 through SEQ ID NO: 9112 or complements thereof.

DETAILED DESCRIPTION OF THE INVENTION

Agents of the Invention:

(a) Nucleic Acid Molecules

Agents of the present invention include substantially purified (or isolated) nucleic acid molecules and more specifically EST nucleic acid molecules or nucleic acid fragment molecules thereof. EST nucleic acid molecules may encode significant portion(s) of, or indeed most of, the EST nucleic acid molecule. Alternatively, the fragments may comprise smaller oligonucleotides (having from about 15 to about 250 nucleotide residues, and more preferably, about 15 to about 30 nucleotide residues).

A subset of the nucleic acid molecules of the present invention includes nucleic acid molecules that are marker molecules. Another subset of the nucleic acid molecules of the present invention include nucleic acid molecules that encode a protein or fragment thereof. Another subset of the nucleic acid molecules of the present invention are EST molecules.

In a preferred embodiment the nucleic acid molecules of the present invention are derived from leaf beetles belonging to the genus *Diabrotica* (Coleoptera:Chrysomelidae) and in an even more preferred embodiment the nucleic acid molecules of the present invention are derived from species in the *virgifera* group. In a particularly preferred embodiment the nucleic acid molecules of the present invention are derived from *Diabrotica virgifera virgifera* LeConte.

The term "nucleic acid molecule" or "nucleic acid" refers to a single or double-stranded polymer of deoxyribonucleotide or ribonucleotide bases read from the 5' to the 3' end. Nucleic acid molecules may also optionally contain synthetic, non-natural or altered nucleotide bases that permit correct read through by a polymerase and do not alter expression of a polypeptide encoded by that nucleic acid molecule.

As used herein, an agent, be it a naturally occurring molecule or otherwise may be "substantially purified" or "isolated", if desired, referring to a molecule separated from substantially all other molecules normally associated with it in its native state. More preferably a substantially purified molecule is the predominant species present in a preparation. A substantially purified molecule may be greater than 60% free, preferably 75% free, more preferably 90% free, and most preferably 95% free from the other molecules (exclusive of solvent) present in the natural mixture. The term "substantially purified" is not intended to encompass molecules present in their native state.

As used herein "a substantially purified nucleic acid" or "an isolated nucleic acid" refers to a nucleic acid that is no longer accompanied by some of materials with which it is associated in its natural state or to a nucleic acid the structure of which is not identical to that of any of naturally occurring nucleic acid. Examples of a substantially purified nucleic acid include: (1) DNAs which have the sequence of part of a naturally occurring genomic DNA molecules but are not flanked by two coding sequences that flank that part of the molecule in the genome of the organism in which it naturally occurs; (2) a nucleic acid incorporated into a vector or into the genomic DNA of a prokaryote or eukaryote in a manner such that the resulting molecule is not identical to any naturally occurring vector or genomic DNA; (3) a separate molecule such as a cDNA, a genomic fragment, a fragment produced by polymerase chain reaction (PCR), or a restriction fragment; (4) recombinant DNAs; and (5) synthetic DNAs. A substantially purified nucleic acid may also be comprised of one or more segments of cDNA, genomic DNA or synthetic DNA.

It is also contemplated by the inventors that the substantially purified (or isolated) nucleic acids of the present invention also include known types of modifications, for example, labels which are known in the art, methylation, "caps", substitution of one or more of the naturally occurring nucleotides with an analog. Other known modifications include internucleotide modifications, for example, those with uncharged linkages (methyl phosphonates, phosphotriesters, phosphoamidates, carbamates, etc.) and with charged linkages (phosphorothioates, phosphorodithioates, etc.), those containing pendant moieties, such as, proteins (including nucleases, toxins, antibodies, signal peptides, poly-L-lysine, etc.), those with intercalators (acridine, psoralen, etc.), those containing chelators (metals, radioactive metals, boron, oxidative metals, etc.), those containing alkylators, and those with modified linkages.

It is understood that the agents of the present invention may be labeled with reagents that facilitate detection of the agent (e.g. fluorescent labels (Prober, et al., *Science* 238:336-340 (1987), Albarella et al., EP 144914), chemical labels (Sheldon et al., U.S. Pat. No. 4,582,789; Albarella et al., U.S. Pat. No. 4,563,417), modified bases (Miyoshi et al., EP 119448).

The term "nucleotide sequence" or "nucleic acid sequence" refers to both the sense and antisense strands of a nucleic acid as either individual single strands or in the duplex. It includes, but is not limited to, self-replicating plasmids, chromosomal sequences, and infectious polymers of DNA or RNA.

A "coding sequence", "structural nucleotide sequence" or "structural nucleic acid molecule" is a nucleotide sequence which is translated into a polypeptide, usually via mRNA, when placed under the control of appropriate regulatory sequences. The boundaries of the coding sequence are determined by a translation start codon at the 5'-terminus and a translation stop codon at the 3'-terminus. A coding sequence can include, but is not limited to, genomic DNA, cDNA, and recombinant nucleotide sequences.

The term "recombinant DNAs" refers to DNAs that contains a genetically engineered modification through manipulation via mutagenesis, restriction enzymes, and the like.

The term "synthetic DNAs" refers to DNAs assembled from oligonucleotide building blocks that are chemically synthesized using procedures known to those skilled in the art. These building blocks are ligated and annealed to form DNA segments which are then enzymatically assembled to construct the entire DNA. "Chemically synthesized", as related to a sequence of DNA, means that the component nucleotides were assembled in vitro. Manual chemical synthesis of DNA may be accomplished using well established procedures, or automated chemical synthesis can be performed using one of a number of commercially available machines.

The agents of the present invention will preferably be "biologically active" with respect to either a structural attribute, such as the capacity of a nucleic acid to hybridize to another nucleic acid molecule, or the ability of a protein to be bound by antibody (or to compete with another molecule for such binding). Alternatively, such an attribute may be catalytic, and thus involve the capacity of the agent to mediate a chemical reaction or response.

It is further understood, that the present invention provides bacterial, insect, mammalian, viral, microbial, and plant cells comprising the agents of the present invention.

EST nucleic acid molecules or fragment EST nucleic acid molecules or other nucleic acid molecules of the present invention are capable of specifically hybridizing to other nucleic acid molecules under certain circumstances. As used herein, two nucleic acid molecules are said to be capable of specifically hybridizing to one another if the two molecules are capable of forming an anti-parallel, double-stranded nucleic acid structure. A nucleic acid molecule is said to be the "complement" of another nucleic acid molecule if they exhibit complete complementarity. As used herein, molecules are said to exhibit "complete complementarity" when every nucleotide of one of the molecules is complementary to a nucleotide of the other. Two molecules are said to be "minimally complementary" if they can hybridize to one another with sufficient stability to permit them to remain annealed to one another under at least conventional "low-stringency" conditions. Similarly, the molecules are said to be "complementary" if they can hybridize to one another with sufficient stability to permit them to remain annealed to one another under conventional "high-stringency" conditions. Conventional stringency conditions are described by Sambrook, et al., In: *Molecular Cloning, A Laboratory Manual, 2nd Edition, Cold Spring Harbor Press*, Cold Spring Harbor, N.Y.

(1989), and by Haymes, et al. In: *Nucleic Acid Hybridization, A Practical Approach*, IRL Press, Washington, D.C. (1985). Departures from complete complementarity are therefore permissible, as long as such departures do not completely preclude the capacity of the molecules to form a double-stranded structure. Thus, in order for an EST nucleic acid molecule or fragment EST nucleic acid molecule to serve as a primer or probe it need only be sufficiently complementary in sequence to be able to form a stable double-stranded structure under the particular solvent and salt concentrations employed.

Appropriate stringency conditions which promote DNA hybridization are, for example, 6.0× sodium chloride/sodium citrate (SSC) at about 45° C., followed by a wash of 2.0×SSC at 50° C., are known to those skilled in the art or can be found in *Current Protocols in Molecular Biology*, John Wiley & Sons, N.Y. (1989), 6.3.1-6.3.6. For example, the salt concentration in the wash step can be selected from a low stringency of about 2.0×SSC at 50° C. to a high stringency of about 0.2×SSC at 50° C. In addition, the temperature in the wash step can be increased from low stringency conditions at room temperature, about 22° C., to high stringency conditions at about 65° C. Both temperature and salt may be varied, or either the temperature or the salt concentration may be held constant while the other variable is changed.

In a preferred embodiment, a nucleic acid of the present invention will specifically hybridize to one or more of the nucleic acid molecules set forth in SEQ ID NO: 1 through SEQ ID NO: 9112 or complements thereof under moderately stringent conditions, for example at about 2.0×SSC and about 65° C.

In a particularly preferred embodiment, a nucleic acid of the present invention will include those nucleic acid molecules that specifically hybridize to one or more of the nucleic acid molecules set forth in SEQ ID NO:1 through SEQ ID NO: 9112 or complements thereof under high stringency conditions.

In one aspect of the present invention, the nucleic acid molecules of the present invention have one or more of the nucleotide sequences set forth in SEQ ID NO: 1 through to SEQ ID NO:9112 or complements thereof. In another aspect of the present invention, one or more of the nucleic acid molecules of the present invention share between 100% and 90% sequence identity with one or more of the nucleotide sequences set forth in SEQ ID NO: 1 through to SEQ ID NO:9112 or complements thereof. In a further aspect of the present invention, one or more of the nucleic acid molecules of the present invention share between 100% and 95% sequence identity with one or more of the nucleotide sequences set forth in SEQ ID NO: 1 through to SEQ ID NO:9112 or complements thereof. In a more preferred aspect of the present invention, one or more of the nucleic acid molecules of the present invention share between 100% and 98% sequence identity with one or more of the nucleotide sequences set forth in SEQ ID NO: 1 through to SEQ ID NO:9112 or complements thereof. In an even more preferred aspect of the present invention, one or more of the nucleic acid molecules of the present invention share between 100% and 99% sequence identity with one or more of the sequences set forth in SEQ ID NO: 1 through to SEQ ID NO:9112 or complements thereof. In a further, even more preferred aspect of the present invention, one or more of the nucleic acid molecules of the present invention exhibit 100% sequence identity with one or more nucleic acid molecules present within the cDNA libraries designated LIB149, LIB150, LIB3026, and LIB3373 (Monsanto Company, St. Louis, Mo., United States of America).

"Percentage of sequence identity" is determined by comparing two optimally aligned sequences over a comparison window, wherein the portion of the nucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity.

Polypeptides which are "substantially similar" share sequences as noted above except that residue positions which are not identical may differ by conservative amino acid changes. Conservative amino acid substitutions refer to the interchangeability of residues having similar side chains. "Conservative amino acid substitutions" refer to substitutions of one or more amino acids in a native amino acid sequence with another amino acid(s) having similar side chains, resulting in a silent change. Conserved substitutes for an amino acid within a native amino acid sequence can be selected from other members of the group to which the naturally occurring amino acid belongs. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulfur-containing side chains is cysteine and methionine. Preferred conservative amino acids substitution groups are: valine-leucine, valine-isoleucine, phenylalanine-tyrosine, lysine-arginine, alanine-valine, aspartic acid-glutamic acid, and asparagine-glutamine.

Optimal alignment of sequences for comparison can use any means to analyze sequence identity (homology) known in the art, e.g., by the progressive alignment method of termed "PILEUP" (Morrison, Mol. Biol. Evol. 14:428-441 (1997), as an example of the use of PILEUP); by the local homology algorithm of Smith & Waterman (Adv. Appl. Math. 2: 482 (1981)); by the homology alignment algorithm of Needleman & Wunsch (J. Mol. Biol. 48:443 (1970)); by the search for similarity method of Pearson (Proc. Natl. Acad. Sci. USA 85: 2444 (1988)); by computerized implementations of these algorithms (e.g., GAP, BESTFIT, FASTA, and TFASTA in the Wisconsin Genetics Software Package, Genetics Computer Group, 575 Science Dr., Madison, Wis.); ClustalW (CLUSTAL in the PC/Gene program by Intelligenetics, Mountain View, Calif., described by, e.g., Higgins, Gene 73: 237-244 (1988); Corpet, Nucleic Acids Res. 16:10881-10890 (1988); Huang, Computer Applications in the Biosciences 8:155-165 (1992); and Pearson, Methods in Mol. Biol. 24:307-331 (1994); Pfam (Sonnhammer, Nucleic Acids Res. 26:322-325 (1998); TreeAlign (Hein, Methods Mol. Biol. 25:349-364 (1994); MEG-ALIGN, and SAM sequence alignment computer programs; or, by manual visual inspection.

Another example of algorithm that is suitable for determining sequence similarity is the BLAST algorithm, which is described in Altschul et al, J. Mol. Biol. 215: 403-410 (1990). Software for performing BLAST analyses is publicly available through the National Center for Biotechnology Information, http://www.ncbi.nlm.nih.gov/; see also Zhang, Genome Res. 7:649-656 (1997) for the "PowerBLAST" variation.

This algorithm involves first identifying high scoring sequence pairs (HSPs) by identifying short words of length W in the query sequence that either match or satisfy some positive valued threshold score T when aligned with a word of the same length in a database sequence. T is referred to as the neighborhood word score threshold (Altschul et al, J. Mol. Biol. 215: 403-410 (1990)). These initial neighborhood word hits act as seeds for initiating searches to find longer HSPs containing them. The word hits are extended in both directions along each sequence for as far as the cumulative alignment score can be increased. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T and X determine the sensitivity and speed of the alignment. The BLAST program uses as defaults a wordlength (W) of 11, the BLOSUM62 scoring matrix (see Henikoff, Proc. Natl. Acad. Sci. USA 89:10915-10919(1992)) alignments (B) of 50, expectation (E) of 10, M=5, N=−4, and a comparison of both strands. The term BLAST refers to the BLAST algorithm which performs a statistical analysis of the similarity between two sequences; see, e.g., Karlin, Proc. Natl. Acad. Sci. USA 90:5873-5787 (1993). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.1, more preferably less than about 0.01, and most preferably less than about 0.001.

In a preferred embodiment of the present invention, a nucleic acid molecule of the present invention encodes the homologue of a known protein. Table 1 sets forth a list of nucleic acid molecules that encode *D. v. virgifera* proteins or fragments thereof which are homologues of known proteins In a preferred embodiment of the present invention, a *D. v. virgifera* protein or fragment thereof of the present invention is a homologue of another insect protein. In another preferred embodiment of the present invention, a *D. v. virgifera* protein or fragment thereof of the present invention is a homologue of a fungal protein. In another preferred embodiment of the present invention, a *D. v. virgifera* protein or fragment thereof of the present invention is a homologue of a mammalian protein. In another preferred embodiment of the present invention, a *D. v. virgifera* protein or fragment thereof of the present invention is a homologue of a bacterial protein. In another preferred embodiment of the present invention, a *D. v. virgifera* protein or fragment thereof of the present invention is a homologue of an algal protein. In another preferred embodiment of the present invention, a *D. v. virgifera* protein or fragment thereof of the present invention is a homologue of a plant protein.

In a preferred embodiment of the present invention, the nucleic molecule of the present invention encodes a *D. v. virgifera* protein or fragment thereof where a *D. v. virgifera* protein or fragment thereof exhibits a BLAST probability score of greater than 1E-12, preferably a BLAST probability score of between about 1E-30 and about 1E-12, even more preferably a BLAST probability score of greater than 1E-30 with its homologue.

In another preferred embodiment of the present invention, the nucleic acid molecule encoding a *D. v. virgifera* protein or fragment thereof exhibits a percent identity with its homologue of between about 25% and about 40%, more preferably of between about 40% and about 70%, even more preferably of between about 70% and about 90% and even more preferably between about 90% and 99%. In another preferred embodiment, of the present invention, a *D. v. virgifera* protein or fragment thereof exhibits a percent identity with its homologue of 100%.

In a preferred embodiment of the present invention, the nucleic molecule of the present invention encodes a *D. v. virgifera* protein or fragment thereof where the *D. v. virgifera* protein exhibits a BLAST score of greater than 120, preferably a BLAST score of between about 1450 and about 120, even more preferably a BLAST score of greater than 1450 with its homologue.

The degeneracy of the genetic code, which allows different nucleotide sequences to code for the same protein or peptide, is known in the literature. (U.S. Pat. No. 4,757,006).

In an aspect of the present invention, one or more of the nucleic acid molecules of the present invention differ in nucleotide sequence from those encoding a *D. v. virgifera* protein or fragment thereof in SEQ ID NO: 1 through SEQ ID NO: 9112 due to the degeneracy in the genetic code in that they encode the same protein but differ in nucleotide sequence.

In another further aspect of the present invention, one or more of the nucleic acid molecules of the present invention differ in nucleotide sequence from those encoding a *D. v. virgifera* protein or fragment thereof in SEQ ID NO: 1 through SEQ ID NO: 9112 due to fact that the different nucleotide sequence encodes a protein having one or more conservative amino acid changes. It is understood that codons capable of coding for such conservative amino acid substitutions are known in the art.

It is well known in the art that one or more amino acids in a native sequence can be substituted with another amino acid(s), the charge and polarity of which are similar to that of the native amino acid, i.e., a conservative amino acid substitution, resulting in a silent change. Biologically functional equivalents of the proteins or fragments thereof of the present invention can have 10 or fewer conservative amino acid changes, more preferably seven or fewer conservative amino acid changes, and most preferably five or fewer conservative amino acid changes. The encoding nucleotide sequence will thus have corresponding base substitutions, permitting it to encode biologically functional equivalent forms of the proteins or fragments of the present invention.

It is understood that certain amino acids may be substituted for other amino acids in a protein structure without appreciable loss of interactive binding capacity with structures such as, for example, antigen-binding regions of antibodies or binding sites on substrate molecules. Because it is the interactive capacity and nature of a protein that defines that protein's biological functional activity, certain amino acid sequence substitutions can be made in a protein sequence and, of course, its underlying DNA coding sequence and, nevertheless, obtain a protein with like or superior properties. It is thus contemplated by the inventors that various changes may be made in the amino acid sequences of the proteins or fragments of the present invention, or corresponding DNA sequences that encode said polypeptides, without appreciable loss of their biological utility or activity. It is understood that codons capable of coding for such amino acid changes are known in the art.

In making such changes, the hydropathic index of amino acids may be considered. The importance of the hydropathic amino acid index in conferring interactive biological function on a protein is generally understood in the art (Kyte and Doolittle, *J. Mol. Biol.* 157, 105-132 (1982)). It is accepted that the relative hydropathic character of the amino acid contributes to the secondary structure of the resultant protein, which in turn defines the interaction of the protein with other molecules, for example, enzymes, substrates, receptors, DNA, antibodies, antigens, and the like.

Each amino acid has been assigned a hydropathic index on the basis of its hydrophobicity and charge characteristics (Kyte and Doolittle, *J. Mol. Biol.* 157, 105-132 (1982)); these are isoleucine (+4.5), valine (+4.2), leucine (+3.8), phenylalanine (+2.8), cysteine/cystine (+2.5), methionine (+1.9), alanine (+1.8), glycine (−0.4), threonine (−0.7), serine (−0.8), tryptophan (−0.9), tyrosine (−1.3), proline (−1.6), histidine (−3.2), glutamate (−3.5), glutamine (−3.5), aspartate (−3.5), asparagine (−3.5), lysine (−3.9), and arginine (−4.5).

In making such changes, the substitution of amino acids whose hydropathic indices are within ±2 is preferred, those which are within ±1 are particularly preferred, and those within ±0.5 are even more particularly preferred.

It is also understood in the art that the substitution of like amino acids can be made effectively on the basis of hydrophilicity. U.S. Pat. No. 4,554,101, states that the greatest local average hydrophilicity of a protein, as govern by the hydrophilicity of its adjacent amino acids, correlates with a biological property of the protein.

As detailed in U.S. Pat. No. 4,554,101, the following hydrophilicity values have been assigned to amino acid residues: arginine (+3.0), lysine (+3.0), aspartate (+3.0±1), glutamate (+3.0±1), serine (+0.3), asparagine (+0.2), glutamine (+0.2), glycine (0), threonine (−0.4), proline (−0.5±1), alanine (−0.5), histidine (−0.5), cysteine (−1.0), methionine (−1.3), valine (−1.5), leucine (−1.8), isoleucine (−1.8), tyrosine (−2.3), phenylalanine (−2.5), and tryptophan (−3.4).

In making such changes, the substitution of amino acids whose hydrophilicity values are within ±2 is preferred, those which are within ±1 are particularly preferred, and those within ±0.5 are even more particularly preferred.

In a further aspect of the present invention, one or more of the nucleic acid molecules of the present invention differ in nucleotide sequence from those encoding a *D. v. virgifera* protein or fragment thereof set forth in SEQ ID NO: 1 through SEQ ID NO: 9112 or fragment thereof due to the fact that one or more codons encoding an amino acid has been substituted for a codon that encodes a nonessential substitution of the amino acid originally encoded.

Isolation and identification of nucleic acids of the present invention are described in detail in Examples. All or a substantial portion of the nucleic acids of the present invention may be used to isolate cDNAs and nucleic acids encoding *D. v. virgifera* protein homologues or fragments thereof from the same or other species.

A "substantial portion" of a nucleotide sequence comprises enough of the sequence to afford specific identification and/or isolation of a nucleic acid fragment comprising the sequence. In general, gene specific oligonucleotide probes comprising 20-30 contiguous nucleotides may be used in sequence-dependent methods of gene identification (e.g., Southern hybridization) and isolation (e.g., in situ hybridization of bacterial colonies or bacteriophage plaques). In addition, short oligonucleotides of 12-15 bases may be used as amplification primers in PCR in order to obtain a particular nucleic acid fragment comprising the primers. The skilled artisan, having the benefit of the sequences as reported herein, may now use all or a substantial portion of the disclosed sequences for purposes known to those skilled in this art. Accordingly, the instant invention comprises the complete sequences as reported in the accompanying Sequence Listing, as well as substantial portions of those sequences as defined above.

Isolation of nucleic acids encoding protein homologues using sequence-dependent protocols is well known in the art. Examples of sequence-dependent protocols include, but are not limited to, methods of nucleic acid hybridization, and methods of DNA and RNA amplification as exemplified by various uses of nucleic acid amplification technologies (e.g., polymerase chain reaction, ligase chain reaction).

For example, structural nucleic acids encoding a *D. v. virgifera* protein or fragment thereof, either as cDNAs or genomic DNAs, could be isolated directly by using all or a portion of the nucleic acids of the present invention as DNA hybridization probes to screen cDNA or genomic libraries from any desired species employing methodology well known to those skilled in the art. Methods for forming such libraries are well known in the art. Specific oligonucleotide probes based upon the nucleic acids of the present invention can be designed and synthesized by methods known in the art. Moreover, the entire sequences of the nucleic acids can be used directly to synthesize DNA probes by methods known to the skilled artisan such as random primer DNA labeling, nick translation, or end-labeling techniques, or RNA probes using available in vitro transcription systems. In addition, specific primers can be designed and used to amplify a part or all of the sequences. The resulting amplification products can be labeled directly during amplification reactions or labeled after amplification reactions, and used as probes to isolate full length cDNA or genomic DNAs under conditions of appropriate stringency.

Alternatively, the nucleic acids of interest can be amplified from nucleic acid samples using amplification techniques. For instance, the disclosed nucleic acids may be used to define a pair of primers that can be used with the polymerase chain reaction (Mullis, et al., *Cold Spring Harbor Symp. Quant. Biol.* 51:263-273 (1986); Erlich et al., EP 50,424; EP 84,796, EP 258,017, EP 237,362; Mullis, EP 201,184; Mullis et al., U.S. Pat. No. 4,683,202; Erlich, U.S. Pat. No. 4,582,788; and Saiki, R. et al., U.S. Pat. No. 4,683,194) to amplify and obtain any desired nucleic acid or fragment directly from mRNA, from cDNA, from genomic libraries or cDNA libraries. PCR and other in vitro amplification methods may also be useful, for example, to clone nucleic acid sequences that code for proteins to be expressed, to make nucleic acids to use as probes for detecting the presence of the desired mRNA in samples, for nucleic acid sequencing, or for other purposes.

In addition, two short segments of the nucleic acids of the present invention may be used in polymerase chain reaction protocols to amplify longer nucleic acids encoding *D. v. virgifera* protein homologues from DNA or RNA. For example, the skilled artisan can follow the RACE protocol (Frohman et al., *Proc. Natl. Acad. Sci. USA* 85:8998 (1988)) to generate cDNAs by using PCR to amplify copies of the region between a single point in the transcript and the 3' or 5' end. Primers oriented in the 3' and 5' directions can be designed from the nucleic acids of the present invention. Using commercially available 3'RACE or 5'RACE systems (Gibco BRL, Life Technologies, Gaithersburg, Md. U.S.A.), specific 3' or 5' cDNA fragments can be isolated (Ohara et al., *Proc. Natl. Acad. Sci. USA* 86:5673 (1989); Loh et al., *Science* 243:217 (1989)). Products generated by the 3' and 5' RACE procedures can be combined to generate full-length cDNAs (Frohman and Martin, *Techniques* 1: 165 (1989)).

Nucleic acids of interest may also be synthesized, either completely or in part, especially where it is desirable to provide plant-preferred sequences, by well-known techniques as described in the technical literature. See, e.g., Carruthers et al., Cold Spring Harbor Symp. Quant. Biol. 47:411-418 (1982), and Adams et al., J. Am. Chem. Soc. 105:661 (1983). Thus, all or a portion of the nucleic acids of the present invention may be synthesized using codons preferred by a selected host. Species-preferred codons may be determined, for example, from the codons used most frequently in the proteins expressed in a particular host species. Other modifications of the nucleotide sequences may result in mutants having slightly altered activity.

Availability of the nucleotide sequences encoding *D. v. virgifera* proteins or fragments thereof facilitates immunological screening of cDNA expression libraries. Synthetic polypeptides representing portions of the amino acid sequences of *D. v. virgifera* proteins or fragments thereof may be synthesized. These polypeptides can be used to immunize animals to produce polyclonal or monoclonal antibodies with specificity for polypeptides or proteins comprising the amino acid sequences. These antibodies can be then be used to screen cDNA expression libraries to isolate full-length cDNA clones of interest (Lerner, Adv. ImmunoL 36: 1 (1984); Sambrook et al., Molecular Cloning: A Laboratory Manual; Cold Spring Harbor Laboratory Press: Cold Spring Harbor, (1989)). It is understood that people skilled in the art are familiar with the standard resource materials which describe specific conditions and procedures for the construction, manipulation and isolation of antibodies (see, for example, Harlow and Lane, In *Antibodies: A Laboratory Manual*, Cold Spring Harbor Press, Cold Spring Harbor, N.Y. (1988)).

Another aspect of the present invention relates to a method for obtaining a nucleic acid comprising a nucleotide sequence encoding a *D. v. virgifera* protein homologue. In a preferred embodiment, the method of the present invention for obtaining a nucleic acid encoding all or a substantial portion of the amino acid sequence of a *D. v. virgifera* protein comprising: (a) probing a cDNA or genomic library with a hybridization probe comprising all or a portion of a nucleotide sequence selected from the group consisting of SEQ ID NO:1 through SEQ ID NO:9112; (b) identifying a DNA clone that hybridizes with the hybridization probe; (c) isolating the DNA clone identified in step (b); and (d) sequencing the cDNA or genomic fragment that comprises the clone isolated in step (c) wherein the sequenced nucleic acid molecule encodes all or a substantial portion of the amino acid sequence of the *D. v. virgifera* protein homologue.

In another preferred embodiment, the method of the present invention for obtaining a nucleic acid fragment encoding a substantial portion of the amino acid sequence of a *D. v. virgifera* protein homologue comprising: (a) synthesizing a first and a second oligonucleotide primers corresponding to a portion of one of the sequences set forth in SEQ ID NO:1 through SEQ ID NO: 9112; and (b) amplifying a cDNA insert present in a cloning vector using the first and second oligonucleotide primers of step (a) wherein the amplified nucleic acid molecule encodes all or a substantial portion of the amino acid sequence of the *D. v. virgifera* protein homologue.

(b) Protein and Peptide Molecules

A class of agents comprises one or more of the protein or peptide molecules encoded by SEQ ID NO: 1 through SEQ ID NO:9112 or one or more of the protein or fragment thereof or peptide molecules encoded by other nucleic acid agents of the present invention. Protein and peptide molecules can be identified using known protein or peptide molecules as a target sequence or target motif in the BLAST programs of the present invention. In a preferred embodiment the protein or fragment molecules of the present invention are derived from *D. v. virgifera*.

The term "polypeptide", "peptide", or "protein", as used herein, refers to a polymer composed of amino acids connected by peptide bonds. The term applies to any amino acid polymers in which one or more amino acid residue is an artificial chemical analogue of a corresponding naturally occurring amino acid, as well as to any naturally occurring amino acid polymers. The essential nature of such analogues of naturally occurring amino acids is that, when incorporated into a protein, that protein is specifically reactive to antibodies elicited to the same protein but consisting entirely of naturally occurring amino acids. It is well known in the art that proteins or polypeptides may undergo modification, including but not limited to, disulfide bond formation, gamma-carboxylation of glutamic acid residues, glycosylation, lipid attachment, phosphorylation, oligomerization, hydroxylation and ADP-ribosylation. Exemplary modifications are described in most basic texts, such as, for example, *Proteins—Structure and Molecular Properties*, 2nd ed., T. E. Creighton, W. H. Freeman and Company, New York (1993). Many detailed reviews are available on this subject, such as, for example, those provided by Wold, F., Post-translational Protein Modifications. Perspectives and Prospects, pp. 1-12 in *Post-translational Covalent Modification of Proteins*, B. C. Johnson, Ed., Academic Press, New York (1983); Seifter et al., *Meth. Enzymol.* 182:626-M (1990) and Rattan et al., *Protein Synthesis: Post-translational Modifications and Aging*, Ann. N.Y. Acad. Sci. 663:48-62 (1992). Modifications can occur anywhere in a polypeptide, including the peptide backbone, the amino acid side-chains and the amino or carboxyl termini. In fact, blockage of the amino or carboxyl group in a polypeptide, or both, by a covalent modification, is common in naturally occurring and synthetic polypeptides and such modifications may be present in polypeptides of the present invention, as well. For instance, the amino terminal residue of polypeptides made in *E. coli* or other cells, prior to proteolytic processing, almost invariably will be N-formylmethionine. During post-translational modification of the polypeptide, a methionine residue at the $NH_2$ terminus may be deleted. Accordingly, this invention contemplates the use of both the methionine-containing and the methionin-less amino terminal variants of the protein of the invention. Thus, as used herein, the term "protein" or "polypeptide" includes any protein or polypeptide that is modified by any biological or non-biological process. The terms "amino acid" and "amino acids" refer to all naturally occurring amino acids and, unless otherwise limited, known analogs of natural amino acids that can function in a similar manner as naturally occurring amino acids. This definition is meant to include norleucine, ornithine, homocysteine, and homoserine.

One or more of the protein or fragment of peptide molecules may be produced via chemical synthesis, or more preferably, by expressing in a suitable bacterial or eukaryotic host. Suitable methods for expression are described by Sambrook, et al., (In: *Molecular Cloning, A Laboratory Manual, 2nd Edition, Cold Spring Harbor Press*, Cold Spring Harbor, N.Y. (1989)), or similar texts.

A "protein fragment" is a peptide or polypeptide molecule whose amino acid sequence comprises a subset of the amino acid sequence of that protein. A protein or fragment thereof that comprises one or more additional peptide regions not derived from that protein is a "fusion" protein. Such molecules may be derivatized to contain carbohydrate or other moieties (such as keyhole limpet hemocyanin, etc.). Fusion proteins or peptide molecules of the present invention are preferably produced via recombinant means.

Another class of agents comprise protein or peptide molecules encoded by SEQ ID NO: 1 through SEQ ID NO:9112 or, fragments or fusions thereof in which non-essential, or not relevant, amino acid residues have been added, replaced, or deleted. Such a homologue can be obtained by any of a variety of methods. Most preferably, as indicated above, one or more of the disclosed sequences (e.g., SEQ ID NO: 1 through SEQ ID NO:9112 or complements thereof) will be used to define a pair of primers that may be used to isolate the homologue-encoding nucleic acid molecules from any desired species. Such molecules can be expressed to yield homologues by recombinant means.

(c) Antibodies

One aspect of the present invention concerns antibodies, single-chain antigen binding molecules, or other proteins that specifically bind to one or more of the protein or peptide molecules of the present invention and their homologues, fusions or fragments. Such antibodies may be used to quantitatively or qualitatively detect the protein or peptide molecules of the present invention. As used herein, an antibody or peptide is said to "specifically bind" to a protein or peptide molecule of the present invention if such binding is not competitively inhibited by the presence of non-related molecules. In a preferred embodiment the antibodies of the present invention bind to proteins of the present invention. In a more preferred embodiment the antibodies of the present invention bind to proteins derived from *Diabrotica virgifera virgifera*.

Nucleic acid molecules that encode all or part of the protein of the present invention can be expressed, via recombinant means, to yield protein or peptides that can in turn be used to elicit antibodies that are capable of binding the expressed protein or peptide. Such antibodies may be used in immunoassays for that protein. Such protein-encoding molecules, or their fragments may be a "fusion" molecule (i.e., a part of a larger nucleic acid molecule) such that, upon expression, a fusion protein is produced. It is understood that any of the nucleic acid molecules of the present invention may be expressed, via recombinant means, to yield proteins or peptides encoded by these nucleic acid molecules.

The antibodies that specifically bind proteins and protein fragments of the present invention may be polyclonal or monoclonal, and may comprise intact immunoglobulins, or antigen binding portions of immunoglobulins (such as (F(ab'), F(ab')$_2$) fragments, or single-chain immunoglobulins producible, for example, via recombinant means). It is understood that practitioners are familiar with the standard resource materials which describe specific conditions and procedures for the construction, manipulation and isolation of antibodies (see, for example, Harlow and Lane, In *Antibodies: A Laboratory Manual*, Cold Spring Harbor Press, Cold Spring Harbor, N.Y. (1988)).

As discussed below, such antibody molecules or their fragments may be used for diagnostic purposes. Where the antibodies are intended for diagnostic purposes, it may be desirable to derivatize them, for example with a ligand group (such as biotin) or a detectable marker group (such as a fluorescent group, a radioisotope or an enzyme).

The ability to produce antibodies that bind the protein or peptide molecules of the present invention permits the identification of mimetic compounds of those molecules. A "mimetic compound" is a compound that is not that compound, or a fragment of that compound, but which nonetheless exhibits an ability to specifically bind to antibodies directed against that compound.

It is understood that any of the agents of the present invention can be substantially purified and/or be biologically active and/or recombinant.

(d) Insect Constructs and Transformed Insect Cells

The present invention also relates to an insect recombinant expression vectors comprising exogenous genetic material. The present invention also relates to an insect cell comprising an insect recombinant vector. The present invention also relates to methods for obtaining a recombinant insect host cell, comprising introducing into an insect cell exogenous genetic material.

The insect recombinant vector may be any vector which can be conveniently subjected to recombinant DNA procedures and can bring about the expression of the nucleotide sequence. The choice of a vector will typically depend on the compatibility of the vector with the insect host cell into which the vector is to be introduced. The vector may be a linear or a closed circular plasmid. The vector system may be a single vector or plasmid or two or more vectors or plasmids which together contain the total DNA to be introduced into the genome of the insect host. In addition, the insect vector may be an expression vector. Nucleic acid molecules can be suitable inserted into a replication vector for expression in the insect cell under a suitable promoter for insect cells. Many vectors are available for this purpose, and selection of the appropriate vector will depend mainly on the size of the nucleic acid molecule to be inserted into the vector and the particular host cell to be transformed with the vector. Each vector contains various components depending on its function (amplification of DNA or expression of DNA) and the particular host cell with which it is compatible. The vector components for insect cell transformation generally include, but not limited to, one or more of the following: a signal sequence, and origin of replication, one or more marker genes, and an inducible promoter.

The insect vector may be an autonomously replicating vector, i.e., a vector which exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one which, when introduced into the insect cell, is integrated into the genome and replicated together with the chromosome(s) into which it has been integrated. For integration, the vector may rely on the nucleotide sequence of the vector for stable integration of the vector into the genome by homologous or nonhomologous recombination. Alternatively, the vector may contain additional nucleotide sequences for directing integration by homologous recombination into the genome of the insect host. The additional nucleotide sequences enable the vector to be integrated into the host cell genome at a precise location(s) in the chromosome(s). To increase the likelihood of integration at a precise location, there should be preferably two nucleotide sequences which individually contain a sufficient number of nucleic acids, preferably 400 bp to 1500 bp, more preferably 800 bp to 1000 bp, which are highly homologous with the corresponding target sequence to enhance the probability of homologous recombination. These nucleotide sequences may be any sequence that is homologous with a target sequence in the genome of the insect host cell, and, furthermore, may be non-encoding or encoding sequences.

Baculovirus expression vectors (BEVs) have become important tools for the expression of foreign genes, both for basic research and for the production of proteins with direct clinical applications in human and veterinary medicine (Doerfler, *Curr. Top. Microbiol. Immunol.* 131: 51-68 (1968); Luckow and Summers, *Bio/Technology* 6: 47-55 (1988a); Miller, *Annual Review of Microbiol.* 42: 177-199 (1988); Summers, *Curr. Comm. Molecular Biology*, Cold Spring Harbor Press, Cold Spring Harbor, N.Y. (1988); all of which are herein incorporated by reference in their entirety). BEVs are recombinant insect viruses in which the coding sequence for a chosen foreign gene has been inserted behind a baculovirus promoter in place of the viral gene, e.g., polyhedrin (Smith and Summers, U.S. Pat. No. 4,745,051, herein incorporated by reference in its entirety).

The use of baculovirus vectors relies upon the host cells being derived from Lepidopteran insects such as *Spodoptera frugiperda* or *Trichoplusia ni*. The preferred *Spodoptera frugiperda* cell line is the cell line Sf9. The *Spodoptera frugiperda* Sf9 cell line was obtained from American Type Culture Collection (Manassas, Va.) and is assigned accession number ATCC CRL 1711 (Summers and Smith, *A Manual of Methods for Baculovirus Vectors and Insect Cell Culture Procedures*, Texas Ag. Exper. Station Bulletin No. 1555 (1988), herein incorporated by reference in its entirety). Other insect cell systems, such as the silkworm *B. mori* may also be used.

The proteins expressed by the BEVs are, therefore, synthesized, modified and transported in host cells derived from Lepidopteran insects. Most of the genes that have been inserted and produced in the baculovirus expression vector system have been derived from vertebrate species. Other baculovirus genes in addition to the polyhedrin promoter may be employed to advantage in a baculovirus expression system. These include immediate-early (alpha), delayed-early (beta), late (gamma), or very late (delta), according to the phase of the viral infection during which they are expressed. The expression of these genes occurs sequentially, probably as the result of a "cascade" mechanism of transcriptional regulation. (Guarino and Summers, *J. Virol.* 57:563-571 (1986); Guarino and Summers, *J. Virol.* 61:2091-2099 (1987); Guarino and Summers, *Virol.* 162:444-451 (1988); all of which are herein incorporated by reference in their entirety).

Insect recombinant vectors are useful as an intermediates for the infection or transformation of insect cell systems. For example, an insect recombinant vector containing a nucleic acid molecule encoding a baculovirus transcriptional promoter followed downstream by an insect signal DNA sequence is capable of directing the secretion of the desired biologically active protein from the insect cell. The vector may utilize a baculovirus transcriptional promoter region derived from any of the over 500 baculoviruses generally infecting insects, such as for example the Orders *Lepidoptera*, Diptera, Orthoptera, Coleoptera and *Hymenoptera*, including for example but not limited to the viral DNAs of *Autographa californica* MNPV, *Bombyx mori* NPV, *Trichoplusia ni* MNPV, *Rachiplusia ou* MNPV or *Galleria mellonella* MNPV, wherein said baculovirus transcriptional promoter is a baculovirus immediate-early gene IE1 or IEN promoter; an immediate-early gene in combination with a baculovirus delayed-early gene promoter region selected from the group consisting of 39K and a HindIII-k fragment delayed-early gene; or a baculovirus late gene promoter. The immediate-early or delayed-early promoters can be enhanced with transcriptional enhancer elements. The insect signal DNA sequence may code for a signal peptide of a Lepidopteran adipokinetic hormone precursor or a signal peptide of the *Manduca sexta* adipokinetic hormone precursor (Summers, U.S. Pat. No. 5,155,037; herein incorporated by reference in its entirety). Other insect signal DNA sequences include a signal peptide of the Orthoptera *Schistocerca gregaria* locust adipokinetic hormone precurser and the *Drosophila melanogaster* cuticle genes CP1, CP2, CP3 or CP4 or for an insect signal peptide having substantially a similar chemical composition and function (Summers, U.S. Pat. No. 5,155,037).

Insect cells are distinctly different from animal cells. Insects have a unique life cycle and have distinct cellular properties such as the lack of intracellular plasminogen activators in insect cells which are present in vertebrate cells. Another difference is the high expression levels of protein products ranging from 1 to greater than 500 mg/liter and the ease at which cDNA can be cloned into cells (Frasier, *In Vitro Cell. Dev. Biol.* 25:225 (1989); Summers and Smith, In: *A Manual of Methods for Baculovirus Vectors and Insect Cell Culture Procedures*, Texas Ag. Exper. Station Bulletin No. 1555 (1988), both of which are incorporated by reference in their entirety).

Recombinant protein expression in insect cells is achieved by viral infection or stable transformation. For viral infection, the desired gene is cloned into baculovirus at the site of the wild-type polyhedrin gene (Webb and Summers, *Technique* 2:173 (1990); Bishop and Posse, *Adv. Gene Technol.* 1:55 (1990); both of which are incorporated by reference in their entirety). The polyhedrin gene is a component of a protein coat in occlusions which encapsulate virus particles. Deletion or insertion in the polyhedrin gene results the failure to form occlusion bodies. Occlusion negative viruses are morphologically different from occlusion positive viruses and enable one skilled in the art to identify and purify recombinant viruses.

The vectors of present invention preferably contain one or more selectable markers which permit easy selection of transformed cells. A selectable marker is a gene the product of which provides, for example biocide or viral resistance, resistance to heavy metals, prototrophy to auxotrophs, and the like. Selection may be accomplished by co-transformation, e.g., as described in WO 91/17243, a nucleotide sequence of the present invention may be operably linked to a suitable promoter sequence. The promoter sequence is a nucleotide sequence which is recognized by the insect host cell for expression of the nucleotide sequence. The promoter sequence contains transcription and translation control sequences which mediate the expression of the protein or fragment thereof. The promoter may be any nucleotide sequence which shows transcriptional activity in the insect host cell of choice and may be obtained from genes encoding polypeptides either homologous or heterologous to the host cell.

For example, a nuclec acid molecule encoding a *D. v. virgifera* protein homologue or fragment thereof may also be operably linked to a suitable leader sequence. A leader sequence is a nontranslated region of a mRNA which is important for translation by the insect host. The leader sequence is operably linked to the 5' terminus of the nucleotide sequence encoding the protein or fragment thereof. The leader sequence may be native to the nucleotide sequence encoding the protein or fragment thereof or may be obtained from foreign sources. Any leader sequence which is functional in the insect host cell of choice may be used in the present invention.

A polyadenylation sequence may also be operably linked to the 3' terminus of the nucleotide sequence of the present invention. The polyadenylation sequence is a sequence which when transcribed is recognized by the insect host to add polyadenosine residues to transcribed mRNA. The polyadenylation sequence may be native to the nucleotide sequence encoding the protein or fragment thereof or may be obtained from foreign sources. Any polyadenylation sequence which is functional in the fungal host of choice may be used in the present invention.

To avoid the necessity of disrupting the cell to obtain the protein or fragment thereof, and to minimize the amount of possible degradation of the expressed polypeptide within the cell, it is preferred that expression of the polypeptide gene gives rise to a product secreted outside the cell. To this end, the protein or fragment thereof of the present invention may be linked to a signal peptide linked to the amino terminus of the protein or fragment thereof. A signal peptide is an amino acid sequence which permits the secretion of the protein or fragment thereof from the insect host into the culture medium. The signal peptide may be native to the protein or fragment thereof of the invention or may be obtained from foreign sources. The 5' end of the coding sequence of the nucleotide sequence of the present invention may inherently contain a signal peptide coding region naturally linked in translation reading frame with the segment of the coding region which encodes the secreted protein or fragment thereof.

At present, a mode of achieving secretion of a foreign gene product in insect cells is by way of the foreign gene's native signal peptide. Because the foreign genes are usually from non-insect organisms, their signal sequences may be poorly recognized by insect cells, and hence, levels of expression may be suboptimal. However, the efficiency of expression of foreign gene products seems to depend primarily on the characteristics of the foreign protein. On average, nuclear localized or non-structural proteins are most highly expressed, secreted proteins are intermediate, and integral membrane proteins are the least expressed. One factor generally affecting the efficiency of the production of foreign gene products in a heterologous host system is the presence of native signal sequences (also termed presequences, targeting signals, or leader sequences) associated with the foreign gene. The signal sequence is generally coded by a DNA sequence immediately following (5' to 3) the translation start site of the desired foreign gene.

The expression dependence on the type of signal sequence associated with a gene product can be represented by the following example: If a foreign gene is inserted at a site downstream from the translational start site of the baculovirus polyhedrin gene so as to produce a fusion protein (containing the N-terminus of the polyhedrin structural gene), the fused gene is highly expressed. But less expression is achieved when a foreign gene is inserted in a baculovirus expression vector immediately following the transcriptional start site and totally replacing the polyhedrin structural gene.

Insertions into the region −50 to −1 significantly alter (reduce) steady state transcription which, in turn, reduces translation of the foreign gene product. Use of the pVL941 vector optimizes transcription of foreign genes to the level of the polyhedrin gene transcription. Even though the transcription of a foreign gene may be optimal, optimal translation may vary because of several factors involving processing: signal peptide recognition, mRNA and ribosome binding, glycosylation, disulfide bond formation, sugar processing, oligomerization, for example.

The properties of the insect signal peptide are expected to be more optimal for the efficiency of the translation process in insect cells than those from vertebrate proteins. This phenomenon can generally be explained by the fact that proteins secreted from cells are synthesized as precursor molecules containing hydrophobic N-terminal signal peptides. The signal peptides direct transport of the select protein to its target membrane and are then cleaved by a peptidase on the membrane, such as the endoplasmic reticulum, when the protein passes through it.

Another exemplary insect signal sequence is the sequence encoding for *Drosophila* cuticle proteins such as CP1, CP2, CP3 or CP4 (Summers, U.S. Pat. No. 5,278,050; herein incorporated by reference in its entirety). Most of the 9 kb region of the *Drosophila* genome contains genes for the cuticle proteins has been sequenced. Four of the five cuticle genes contain a signal peptide coding sequence interrupted by a short intervening sequence (about 60 base pairs) at a conserved site. Conserved sequences occur in the 5' mRNA untranslated region, in the adjacent 35 base pairs of upstream flanking sequence and at −200 base pairs from the mRNA start position in each of the cuticle genes.

Standard methods of insect cell culture, cotransfection and preparation of plasmids are set forth in Summers and Smith (Summers and Smith, *A Manual of Methods for Baculovirus Vectors and Insect Cell Culture Procedures*, Texas Agricultural Experiment Station Bulletin No. 1555, Texas A&M University (1987)). Procedures for the cultivation of viruses and cells are described in Volkman and Summers, *J. Virol* 19: 820-832 (1975); Volkman et al., *J. Virol* 19: 820-832 (1976); and O'Reilly et al., Eds., Baculovirus Expression Vectors: A laboratory Manual, W.H. Freeman & Co., New York, N.Y. (1994); all of which are herein incorporated by reference in their entirety.

(e) Plant Constructs and Plant Transformants

The present invention also relates to a plant recombinant vector or construct comprising a structural nucleotide sequence encoding a *D. v. virgifera* protein or fragment thereof. The present invention also relates to a transformed plant cell or plant comprising in its genome an exogenous nucleic acid molecule encoding one or more *D. v. virgifera* proteins or fragments thereof. The present invention also relates to methods for creating a transgenic plant in which one or more *D. v. virgifera* proteins or fragments thereof are overexpressed.

By "exogenous" it is meant that a nucleic acid originates from outside the plant. An exogenous nucleic acid molecule can have a naturally occurring or non-naturally occurring nucleotide sequence. One skilled in the art understands that an exogenous nucleic acid molecule can be a heterologous nucleic acid derived from a different plant species than the plant into which the nucleic acid is introduced or can be a nucleic acid derived from the same plant species as the plant into which it is introduced.

The term "overexpression" refers to the expression of a polypeptide or protein encoded by an exogenous nucleic acid introduced into a host cell, wherein said polypeptide or protein is either not normally present in the host cell, or wherein said polypeptide or protein thereof is present in said host cell at a higher level than that normally expressed from the endogenous gene encoding said polypeptide or protein. By "endogenous gene" refers to a native gene in its natural location in the genome of an organism.

The term "genome" as it applies to plant cells encompasses not only chromosomal DNA found within the nucleus, but organelle DNA found within subcellular components of the cell. DNAs of the present invention introduced into plant cells can therefore be either chromosomally integrated or organelle-localized. The term "genome" as it applies to bacteria encompasses both the chromosome and plasmids within a bacterial host cell. Encoding DNAs of the present invention introduced into bacterial host cells can therefore be either chromosomally integrated or plasmid-localized.

Method which are well known to those skilled in the art may be used to construct the plant recombinant construct or vector of the present invention. These method include in vitro recombinant DNA techniques, synthetic techniques, and in vivo genetic recombination. Such techniques are described in Sambrook et al., Molecular Cloning, A Laboratory Manual, Cold Spring Harbor Press, Plainview, N.Y. (1989); and Ausubel et al., Current Protocols in Molecular Biology, John Wiley & Sons, New York, N.Y. (1989).

A plant recombinant construct or vector of the present invention contains a structural nucleotide sequence encoding one or more *D. v. virgifera* proteins or fragments thereof and operably linked regulatory sequences or control elements.

The term "operably linked", as used in reference to a regulatory sequence and a structural nucleotide sequence, means that the regulatory sequence causes regulated expression of the operably linked structural nucleotide sequence. "Expression" refers to the transcription and stable accumulation of sense or antisense RNA derived from the nucleic acid of the present invention. Expression may also refer to translation of mRNA into a polypeptide or protein. "Sense" RNA refers to RNA transcript that includes the mRNA and so can be translated into protein by the cell. "Antisense RNA" refers to a RNA transcript that is complementary to all or part of a target primary transcript or mRNA and that blocks the expression of a target gene (U.S. Pat. No. 5,107,065, incorporated herein by reference). The complementarity of an antisense RNA may be with any part of the specific gene transcript, i.e., at the 5' non-coding sequence, 3' non-translated sequence, introns, or the coding sequence. "RNA transcript" refers to the product resulting from RNA polymerase-catalyzed transcription of a DNA sequence. When the RNA transcript is a perfect complementary copy of the DNA sequence, it is referred to as the primary transcript or it may be a RNA sequence derived from post-transcriptional processing of the primary transcript and is referred to as the mature RNA.

"Regulatory sequences" or "control elements" refer to nucleotide sequences located upstream (5' noncoding sequences), within, or downstream (3' non-translated sequences) of a structural nucleotide sequence, and which influence the transcription, RNA processing or stability, or translation of the associated structural nucleotide sequence. Regulatory sequences may include promoters, translation leader sequences, introns, and polyadenylation recognition sequences.

The promoter sequence may consist of proximal and more distal upstream elements, the latter elements often referred to as enhancers. Accordingly, an "enhancer" is a DNA sequence which can stimulate promoter activity and may be an innate element of the promoter or a heterologous element inserted to enhance the level or tissue-specificity of a promoter. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental conditions.

Promoters which are known or are found to cause transcription of DNA in plant cells can be used in the present invention. Such promoters may be obtained from a variety of sources such as plants and plant viruses. A number of promoters, including constitutive promoters, inducible promoters and tissue-specific promoters, that are active in plant cells have been described in the literature. It is preferred that the particular promoter selected should be capable of causing sufficient expression to result in the production of an effective amount of a protein to cause the desired phenotype. In addition to promoters that are known to cause transcription of DNA in plant cells, other promoters may be identified for use in the current invention by screening a plant cDNA library for genes that are selectively or preferably expressed in the target tissues and then determine the promoter regions.

The term "constitutive promoter" means a regulatory sequence which causes expression of a structural nucleotide sequence in most cells or tissues at most times. Constitutive promoters are active under most environmental conditions and states of development or cell differentiation. A variety of constitutive promoters are well known in the art. Examples of constitutive promoters that are active in plant cells include but are not limited to the nopaline synthase (NOS) promoters; the cauliflower mosaic virus (CaMV) 19S and 35S; the tobacco mosaic virus promoter; the figwort mosaic virus promoters; and actin promoters, such as the *Arabidopsis* actin gene promoter (see, e.g., Huang, Plant Mol. Biol. 33:125-139 (1997)).

The term "inducible promoter" refers to a regulatory sequence which causes conditional expression of a structural nucleotide sequence under the influence of changing environmental conditions or developmental conditions. Examples of inducible promoters include but are not limited to the light-inducible promoter from the small subunit of ribulose-1,5-bis-phosphate carboxylase (ssRUBISCO); the drought-inducible promoter of maize (Busk, Plant J. 11: 1285-1295 (1997)); the cold, drought, and high salt inducible promoter from potato (Kirch, Plant Mol. Biol. 33:897-909 (1997)); a nitrate-inducible promoter derived from the spinach nitrite reductase gene (Back et al., Plant Mol. Biol. 17:9 (1991)); salicylic acid inducible promoter (Uknes et al., Plant Cell 5:159-169 (1993); Bi et al., Plant J. 8:235-245 (1995)); the auxin-response elements E1 promoter fragment (AuxREs) in the soybean (Glycine max L.) (Liu, Plant Physiol. 115:397-407 (1997)); the auxin-responsive *Arabidopsis* GST6 promoter (also responsive to salicylic acid and hydrogen peroxide) (Chen, Plant J. 10: 955-966 (1996)); the auxin-inducible parC promoter from tobacco (Sakai, 37:906-913 (1996)); a plant biotin response element (Streit, Mol. Plant Microbe Interact. 10:933-937 (1997)); the promoter responsive to the stress honnone abscisic acid (Sheen, Science 274:1900-1902 (1996)); the maize In2-2 promoter activated by benzenesulfonamide herbicide safeners (De Veylder, Plant Cell Physiol. 38:568-577 (1997)); a tetracycline-inducible promoter, such as the promoter for the *Avena sativa* L. (oat) arginine decarboxylase gene (Masgrau, Plant J. 11:465-473 (1997)); and a salicylic acid-responsive element (Stange, Plant J. 11:1315-1324 (1997)).

The term "tissue-specific promoter" means a regulatory sequence that causes transcriptions or enhanced transcriptions of DNA in specific cells or tissues at specific times during plant development, such as in vegetative tissues or reproductive tissues. Examples of tissue-specific promoters under developmental control include promoters that initiate transcription only (or primarily only) in certain tissues, such as vegetative tissues, e.g., roots, leaves or stems, or reproductive tissues, such as fruit, ovules, seeds, pollen, pistols, flowers, or any embryonic tissue. Reproductive tissue specific promoters may be, e.g., ovule-specific, embryo-specific, endosperm-specific, integument-specific, seed coat-specific, pollen-specific, petal-specific, sepal-specific, or some combination thereof. One of skill will recognize that a tissue-specific promoter may drive expression of operably linked sequences in tissues other than the target tissue. Thus, as used herein a tissue-specific promoter is one that drives expression preferentially in the target tissue, but may also lead to some expression in other tissues as well.

A variety of promoters specifically active in vegetative tissues, such as leaves, stems, roots and tubers, can also be used to express the nucleic acids of the invention. Examples of tuber-specific promoters include but are not limited to the class I and II patatin promoters (Bevan et al., *EMBO J.* 8: 1899-1906 (1986); Koster-Topfer et al., *Mol Gen Genet.* 219: 390-396 (1989); Mignery et al., *Gene.* 62: 27-44 (1988); Jefferson et al., *Plant Mol. Biol.* 14: 995-1006 (1990)), the promoter for the potato tuber ADPGPP genes, both the large and small subunits; the sucrose synthase promoter (Salanoubat and Belliard, *Gene.* 60: 47-56 (1987), Salanoubat and Belliard, *Gene.* 84: 181-185 (1989)); and the promoter for the major tuber proteins including the 22 kd protein complexes and proteinase inhibitors (Hannapel, *Plant Physiol.* 101: 703-704 (1993)). Examples of leaf-specific promoters include but are not limited to the ribulose biphosphate carboxylase (RBCS or RuBISCO) promoters (see, e.g., Matsuoka, Plant J. 6:311-319 (1994)); the light harvesting chlorophyll a/b binding protein gene promoter (see, e.g., Shiina, Plant Physiol. 115-477-483 (1997); Casal, Plant Physiol. 116:1533-1538 (1998)); and the *Arabidopsis thaliana* myb-related gene promoter (Atmyb5) (Li, FEBS Lett. 379:117-121 (1996)). Examples of root-specific promoter include but are not limited to the promoter for the acid chitinase gene (Samac et al., *Plant Mol. Biol.* 25: 587-596 (1994)); the root specific subdomains of the CaMV35S promoter that have been identified (Lam et al., *Proc. Natl. Acad. Sci.* (U.S.A.) 86:7890-7894 (1989)); the ORF13 promoter from *Agrobacterium rhizogenes* which exhibits high activity in roots (Hansen, Mol. Gen. Genet. 254:337-343 (1997)); the promoter for the tobacco root-specific gene TobRB7 (Yamamoto, Plant Cell 3:371-382 (1991)); and the root cell specific promoters reported by Conkling et al. (Conkling et al., *Plant Physiol.* 93:1203-1211 (1990)).

Another class of useful vegetative tissue-specific promoters are meristermatic (root tip and shoot apex) promoters. For example, the "SHOOTMERISTEMLESS" and "SCARECROW" promoters, which are active in the developing shoot or root apical meristems (Di Laurenzio, Cell 86:423-433 (1996); Long, Nature 379:66-69 (1996)), can be used. Another example of a useful promoter is that which controls the expression of 3-hydroxy-3-methylglutaryl coenzyme A reductase HMG2 gene, whose expression is restricted to meristematic and floral (secretory zone of the stigma, mature pollen grains, gynoecium vascular tissue, and fertilized ovules) tissues (see, e.g., Enjuto, Plant Cell. 7:517-527 (1995)). Also another example of a useful promoter is that which controls the expression of knl-related genes from maize and other species which show meristem-specific expression (see, e.g., Granger, Plant Mol. Biol. 31:373-378 (1996); Kerstetter, Plant Cell 6:1877-1887 (1994); Hake, Philos. Trans. R. Soc. Lond. B. Biol. Sci. 350:45-51 (1995). Another example of a meristematic promoter is the *Arabidopsis thaliana* KNATI promoter. In the shoot apex, KNATI transcript is localized primarily to the shoot apical meristem; the expression of KNATI in the shoot meristem decreases during the floral transition and is restricted to the cortex of the inflorescence stem (see, e.g., Lincoln, Plant Cell 6:1859-1876 (1994)).

Suitable seed-specific promoters can be derived from the following genes: MAC1 from maize (Sheridan, Genetics 142: 1009-1020 (1996); Cat3 from maize (GenBank No. L05934, Abler, Plant Mol. Biol. 22:10131-1038 (1993); vivparous-1 from *Arabidopsis* (Genbank No. U93215); Atimyc1 from *Arabidopsis* (Urao, Plant Mol. Biol. 32:571-57 (1996); Conceicao, Plant 5:493-505 (1994); napA from *Brassica napus* (GenBank No. J02798); the napin gene family from *Brassica napus* (Sjodahl, Planta 197:264-271 (1995)).

The ovule-specific BEL1 gene described in Reiser (1995) Cell 83:735-742, GenBank No. U39944, can also be used. See also Ray (1994) Proc. Natl. Acad. Sci. USA 91:5761-5765. The egg and central cell specific FIEEI promoter is also a useful reproductive tissue-specific promoter.

A maize pollen-specific promoter has been identified in maize (Guerrero (1990) Mol. Gen. Genet. 224:161-168). Other genes specifically expressed in pollen are described, e.g., by Wakeley (1998) Plant Mol. Biol. 37:187-192; Ficker (1998) Mol. Gen. Genet. 257:132-142; Kulikauskas (1997) Plant Mol. Biol. 34:809-814; Treacy (1997) Plant Mol. Biol. 34:603-611.

Promoters derived from genes encoding embryonic storage proteins, which includes the gene encoding the 2S storage protein from *Brassica napus* (Dasgupta, Gene 133:301-302 (1993); the 2s seed storage protein gene family from *Arabidopsis*; the gene encoding oleosin 20 kD from *Brassica napus* (GenBank No. M63985); the genes encoding oleosin A (Genbank No. U09118) and oleosin B (Genbank No. U09119) from soybean; the gene encoding oleosin from *Arabidopsis* (Genbank No. Z17657); the gene encoding oleosin 18 kD from maize (GenBank No. J05212, Lee, Plant Mol. Biol. 26:1981-1987 (1994)); and the gene encoding low molecular weight sulphur rich protein from soybean (Choi, Mol Gen, Genet. 246:266-268 (1995)), can also be used.

Promoters derived from genes encoding for zein genes (including the 15 kD, 16 kD, 19 kD, 22 kD, 27 kD, and gamma genes) (Pedersen et al., Cell 29: 1015-1026 (1982)) can be also used. The zeins are a group of storage proteins found in maize endosperm.

Other promoters known to function, for example, in maize, include the promoters for the following genes: waxy, Brittle, Shrunken 2, Branching enzymes I and II, starch synthases, debranching enzymes, oleosins, glutelins, and sucrose synthases. A particularly preferred promoter for maize endosperm expression is the promoter for the glutelin gene from rice, more particularly the Osgt-1 promoter (Zheng et al., *Mol. Cell Biol.* 13: 5829-5842 (1993), herein incorporated by reference in its entirety). Examples of promoters suitable for expression in wheat include those promoters for the ADP-glucose pyrophosphorylase (ADPGPP) subunits, the granule bound and other starch synthases, the branching and debranching enzymes, the embryogenesis-abundant proteins, the gliadins, and the glutenins. Examples of such promoters in rice include those promoters for the ADPGPP subunits, the granule bound and other starch synthases, the branching enzymes, the debranching enzymes, sucrose synthases, and the glutelins. A particularly preferred promoter is the promoter for rice glutelin, Osgt-1. Examples of such promoters for barley include those for the ADPGPP subunits, the granule bound and other starch synthases, the branching enzymes, the debranching enzymes, sucrose synthases, the hordeins, the embryo globulins, and the aleurone specific proteins.

A tomato promoter active during fruit ripening, senescence and abscission of leaves and, to a lesser extent, of flowers can be used (Blume, Plant J. 12:731-746 (1997)). Other exemplary promoters include the pistol specific promoter in the potato (*Solarium tuberosum* L.) SK2 gene, encoding a pistil-specific basic endochitinase (Ficker, Plant Mol. Biol. 35:425-431 (1997)); the Blec4 gene from pea (*Pisum sativum* cv. Alaska), active in epidermal tissue of vegetative and floral shoot apices of transgenic alfalfa. This makes it a useful tool to target the expression of foreign genes to the epidermal layer of actively growing shoots. The tissue specific E8 promoter from tomato is also useful for directing gene expression in fruits.

It is recognized that additional promoters that may be utilized are described, for example, in U.S. Pat. Nos. 5,378,619, 5,391,725, 5,428,147, 5,447,858, 5,608,144, 5,608,144, 5,614,399, 5,633,441, 5,633,435, and 4,633,436, all of which are herein incorporated in their entirety. In addition, a tissue specific enhancer may be used (Fromm et al., *The Plant Cell* 1:977-984 (1989), herein incorporated by reference in its entirety). It is further recognized that since in most cases the exact boundaries of regulatory sequences have not been completely defined, DNA fragments of different lengths may have identical promoter activity.

The "translation leader sequence" refers to a DNA sequence located between the promoter sequence of a gene and the coding sequence. The translation leader sequence is present in the fully processed mRNA upstream of the translation start sequence. The translation leader sequence may affect processing of the primary transcript to mRNA, mRNA stability or translation efficiency. Examples of translation leader sequences have been described (Turner, R. and Foster, G. D. (1995) Molecular Biotechnology 3:225).

The "3' non-translated sequences" refer to DNA sequences located downstream of a structural nucleotide sequence and include sequences encoding polyadenylation and other regulatory signals capable of affecting mRNA processing or gene expression. The polyadenylation signal functions in plants to cause the addition of polyadenylate nucleotides to the 3' end of the mRNA-precursor. The polyadenylation sequence can be derived from the natural gene, from a variety of plant genes, or from T-DNA. An example of the polyadenylation sequence is the nopaline synthase 3' sequence (NOS 3'; Fraley et al., Proc. Natl. Acad. Sci. USA 80: 4803-4807 (1983)). The use of different 3' non-translated sequences is exemplified by Ingelbrecht et al., Plant Cell 1:671-680 (1989).

Generally, optimal expression in monocotyledonous and some dicotyledonous plants is obtained when an intron sequence is inserted between the promoter sequence and the structural gene sequence or, optionally, may be inserted in the structural coding sequence to provide an interrupted coding sequence. An example of such an intron sequence is the HSP 70 intron described in WO 93/19189.

A recombinant vector or construct of the present invention will typically comprise a selectable marker which confers a selectable phenotype on plant cells. Selectable markers may also be used to select for plants or plant cells that contain the exogenous nucleic acids encoding polypeptides or proteins of the present invention. The marker may encode biocide resistance, antibiotic resistance (e.g., kanamycin, G418 bleomycin, hygromycin, etc.), or herbicide resistance (e.g., glyphosate, etc.). Examples of selectable markers include, but are not limited to, a neo gene (Potrykus et al., *Mol. Gen. Genet.* 199:183-188 (1985)) which codes for kanamycin resistance and can be selected for using kanamycin, G418, etc.; a bar gene which codes for bialaphos resistance; a mutant EPSP synthase gene (Hinchee et al., *Bio/Technology* 6:915-922 (1988)) which encodes glyphosate resistance; a nitrilase gene which confers resistance to bromoxynil (Stalker et al., *J. Biol. Chem.* 263:6310-6314 (1988)); a mutant acetolactate synthase gene (ALS) which confers imidazolinone or sulphonylurea resistance (European Patent Application 154,204 (Sep. 11, 1985)); and a methotrexate resistant DHFR gene (Thillet et al., *J. Biol. Chem.* 263:12500-12508 (1988)).

A recombinant vector or construct of the present invention may also include a screenable marker. Screenable markers may be used to monitor expression. Exemplary screenable markers include a β-glucuronidase or uidA gene (GUS) which encodes an enzyme for which various chromogenic substrates are known (Jefferson, *Plant Mol. Biol, Rep.* 5:387-405 (1987); Jefferson et al., *EMBO J.* 6:3901-3907 (1987)); an R-locus gene, which encodes a product that regulates the production of anthocyanin pigments (red color) in plant tissues (Dellaporta et al., Stadler Symposium 11:263-282 (1988)); a β-lactamase gene (Sutcliffe et al., *Proc. Natl. Acad. Sci.* (U.S.A.) 75:3737-3741 (1978)), a gene which encodes an enzyme for which various chromogenic substrates are known (e.g., PADAC, a chromogenic cephalosporin); a luciferase gene (Ow et al., *Science* 234:856-859 (1986)) a xylE gene (Zukowsky et al., *Proc. Natl. Acad. Sci.* (U.S.A.) 80:1101-1105 (1983)) which encodes a catechol dioxygenase that can convert chromogenic catechols; an α-amylase gene (Ikatu et al., *Bio/Technol.* 8:241-242 (1990)); a tyrosinase gene (Katz et al., *J. Gen. Microbiol.* 129:2703-2714 (1983)) which encodes an enzyme capable of oxidizing tyrosine to DOPA and dopaquinone which in turn condenses to melanin; an α-galactosidase, which will turn a chromogenic α-galactose substrate.

Included within the terms "selectable or screenable marker genes" are also genes which encode a secretable marker whose secretion can be detected as a means of identifying or selecting for transformed cells. Examples include markers which encode a secretable antigen that can be identified by antibody interaction, or even secretable enzymes which can be detected catalytically. Secretable proteins fall into a number of classes, including small, diffusible proteins detectable, e.g., by ELISA, small active enzymes detectable in extracellular solution (e.g., α-amylase, β-lactamase, phosphinothricin transferase), or proteins which are inserted or trapped in the cell wall (such as proteins which include a leader sequence such as that found in the expression unit of extension or tobacco PR-S). Other possible selectable and/or screenable marker genes will be apparent to those of skill in the art.

In addition to a selectable marker, it may be desirous to use a reporter gene. In some instances a reporter gene may be used with or without a selectable marker. Reporter genes are genes which are typically not present in the recipient organism or tissue and typically encode for proteins resulting in some phenotypic change or enzymatic property. Examples of such genes are provided in K. Wising et al. Ann. Rev. Genetics, 22, 421 (1988), which is incorporated herein by reference. Preferred reporter genes include the beta-glucuronidase (GUS) of the uidA locus of *E. coli*, the chloramphenicol acetyl transferase gene from Tn9 of *E. coli*, the green fluorescent protein from the bioluminescent jellyfish *Aequorea victoria*, and the luciferase genes from firefly *Photinus pyralis*. An assay for detecting reporter gene expression may then be performed at a suitable time after said gene has been introduced into recipient cells. A preferred such assay entails the use of the gene encoding beta-glucuronidase (GUS) of the uidA locus of *E. coli* as described by Jefferson et al., (1987 Biochem. Soc. Trans. 15, 17-19) to identify transformed cells.

In preparing the DNA constructs of the present invention, the various components of the construct or fragments thereof will normally be inserted into a convenient cloning vector, e.g., a plasmid that is capable of replication in a bacterial host, e.g., *E. coli*. Numerous vectors exist that have been described in the literature, many of which are commercially available. After each cloning, the cloning vector with the desired insert may be isolated and subjected to further manipulation, such as restriction digestion, insertion of new fragments or nucleotides, ligation, deletion, mutation, resection, etc. so as to tailor the components of the desired sequence. Once the construct has been completed, it may then be transferred to an appropriate vector for further manipulation in accordance with the manner of transformation of the host cell.

A recombinant vector or construct of the present invention may also include a chloroplast transit peptide, in order to target the polypeptide or protein of the present invention to the plastid. The term "plastid" refers to the class of plant cell organelles that includes amyloplasts, chloroplasts, chromoplasts, elaioplasts, eoplasts, etioplasts, leucoplasts, and proplastids. These organelles are self-replicating, and contain what is commonly referred to as the "chloroplast genome," a circular DNA molecule that ranges in size from about 120 to about 217 kb, depending upon the plant species, and which usually contains an inverted repeat region. Many plastid-localized proteins are expressed from nuclear genes as precursors and are targeted to the plastid by a chloroplast transit peptide (CTP), which is removed during the import steps. Examples of such chloroplast proteins include the small subunit of ribulose-1,5-biphosphate carboxylase (ssRUBISCO, SSU), 5-enolpyruvateshikimate-3-phosphate synthase (EPSPS), ferredoxin, ferredoxin oxidoreductase, the light-harvesting-complex protein I and protein II, and thioredoxin F. It has been demonstrated that non-plastid proteins may be targeted to the chloroplast by use of protein fusions with a CTP and that a CTP sequence is sufficient to target a protein to the plastid. Those skilled in the art will also recognize that various other chimeric constructs can be made that utilize the functionality of a particular plastid transit peptide to import the enzyme into the plant cell plastid depending on the promoter tissue specificity.

The present invention also provide a transgenic plant comprising in its genome an isolated nucleic acid which comprises: (A) a 5' non-coding sequence which functions in the cell to cause the production of a mRNA molecule; which is linked to (B) a structural nucleotide sequence, wherein the structural nucleotide sequence encodes a *D. v. virgifera* proteins or fragments thereof; which is linked to (C) a 3' non-translated sequence that functions in said cell to cause termination of transcription.

The term "transgenic plant" refers to a plant that contains an exogenous nucleic acid, which can be derived from the same plant species or from a different plant species. Transgenic plants are also meant to comprise progeny (decendant, offspring, etc.) of any generation of such a transgenic plant. A seed of any generation of all such transgenic plants wherein said seed comprises a DNA sequence encoding the protein or fragment thereof of the present invention is also an important aspect of the invention.

The DNA constructs of the present invention may be introduced into the genome of a desired plant host by a variety of conventional transformation techniques, which are well known to those skilled in the art. Preferred methods of transformation of plant cells or tissues are the *Agrobacterium* mediated transformation method and the biolistics or particle-gun mediated transformation method. Suitable plant transformation vectors for the purpose of *Agrobacterium* mediated transformation include those derived from a Ti plasmid of *Agrobacterium tumefaciens*, as well as those disclosed, e.g., by Herrera-Estrella et al., Nature 303:209 (1983); Bevan, Nucleic Acids Res. 12: 8711-8721 (1984); Klee et al., Bio-Technology 3(7): 637-642 (1985); and EPO publication 120,516. In addition to plant transformation vectors derived from the Ti or root-inducing (R1) plasmids of *Agrobacterium*, alternative methods can be used to insert the DNA constructs of this invention into plant cells. Such methods may involve, but are not limited to, for example, the use of liposomes, electroporation, chemicals that increase free DNA uptake, free DNA delivery via microprojectile bombardment, and transformation using viruses or pollen.

A plasmid expression vector suitable for the introduction of a nucleic acid encoding a polypeptide or protein of the present invention in monocots using electroporation or particle-gun mediated transformation is composed of the following: a promoter that is constitutive or tissue-specific; an intron that provides a splice site to facilitate expression of the gene, such as the Hsp70 intron (PCT Publication WO93/19189); and a 3' polyadenylation sequence such as the nopaline synthase 3' sequence (NOS 3'; Fraley et al., Proc. Natl. Acad. Sci. USA 80: 4803-4807(1983)). This expression cassette may be assembled on high copy replicons suitable for the production of large quantities of DNA.

An example of a useful Ti plasmid cassette vector for plant transformation is pMON17227. This vector is described in PCT Publication WO 92/04449 and contains a gene encoding an enzyme conferring glyphosate resistance (denominated CP4), which is an excellent selection marker gene for many plants. The gene is fused to the *Arabidopsis* EPSPS chloroplast transit peptide (CTP2) and expressed from the FMV promoter as described therein.

When adequate numbers of cells (or protoplasts) containing the exogenous nucleic acid encoding a polypeptide or protein of the present invention are obtained, the cells (or protoplasts) are regenerated into whole plants. Choice of methodology for the regeneration step is not critical, with suitable protocols being available for hosts from Leguminosae (alfalfa, soybean, clover, etc.), Umbelliferae (carrot, celery, parsnip), Cruciferae (cabbage, radish, canola/rapeseed, etc.), Cucurbitaceae (melons and cucumber), Gramineae (wheat, barley, rice, maize, etc.), Solanaceae (potato, tobacco, tomato, peppers), various floral crops, such as sunflower, and nut-bearing trees, such as almonds, cashews, walnuts, and pecans. See, for example, Ammirato et al., Handbook of Plant Cell Culture—Crop Species. Macmillan Publ. Co. (1984); Shimamoto et al., Nature 338:274-276 (1989); Fromm, UCLA Symposium on Molecular Strategies for Crop Improvement, Apr. 16-22, 1990. Keystone, Colo. (1990); Vasil et al., Bio/Technology 8:429-434 (1990); Vasil et al., Bio/Technology 10:667-674 (1992); Hayashimoto, Plant Physiol. 93:857-863 (1990); and Datta et al., Bio-technology 8:736-740 (1990). Regeneration can also be obtained from plant callus, explants, organs, or parts thereof. Such regeneration techniques are described generally in Klee et al., Ann. Rev. Plant Phys. 38:467-486 (1987).

A transgenic plant formed using *Agrobacterium* transformation methods typically contains a single exogenous gene on one chromosome. Such transgenic plants can be referred to as being heterozygous for the added exogenous gene. More preferred is a transgenic plant that is homozygous for the added exogenous gene; i.e., a transgenic plant that contains two added exogenous genes, one gene at the same locus on each chromosome of a chromosome pair. A homozygous transgenic plant can be obtained by sexually mating (selfing) an independent segregant transgenic plant that contains a single exogenous gene, germinating some of the seed produced and analyzing the resulting plants produced for the exogenous gene of interest.

The development or regeneration of transgenic plants containing the exogenous nucleic acid that encodes a polypeptide or protein of interest is well known in the art. Preferably, the regenerated plants are self-pollinated to provide homozygous transgenic plants, as discussed above. Otherwise, pollen obtained from the regenerated plants is crossed to seed-grown plants of agronomically important lines. Conversely, pollen from plants of these important lines is used to pollinate regenerated plants. A transgenic plant of the present invention containing a desired polypeptide or protein of the present invention is cultivated using methods well known to one skilled in the art.

Transgenic plants, that can be generated by practice of the present invention, include but are not limited to *Acacia*, alfalfa, aneth, apple, apricot, artichoke, arugula, asparagus, avocado, banana, barley, beans, beet, blackberry, blueberry, broccoli, brussels sprouts, cabbage, canola, cantaloupe, carrot, cassava, cauliflower, celery, cherry, cilantro, citrus, clementines, coffee, corn, cotton, cucumber, Douglas fir, eggplant, endive, escarole, eucalyptus, fennel, figs, gourd, grape, grapefruit, honey dew, jicama, kiwifruit, lettuce, leeks, lemon, lime, Loblolly pine, mango, melon, mushroom, nut, oat, okra, onion, orange, an ornamental plant, papaya, parsley, pea, peach, peanut, pear, pepper, persimmon, pine, pineapple, plantain, plum, pomegranate, poplar, potato, pumpkin, quince, radiata pine, radicchio, radish, raspberry, rice, rye, sorghum, Southern pine, soybean, spinach, squash, strawberry, sugarbeet, sugarcane, sunflower, sweet potato, sweetgum, tangerine, tea, tobacco, tomato, turf, a vine, watermelon, wheat, yams, and zucchini.

The present invention also provides parts of the transgenic plants of present invention. Plant parts, without limitation, include seed, endosperm, ovule and pollen. In a particularly preferred embodiment of the present invention, the plant part is a seed.

The present invention also further provides method for generating a transgenic plant comprising the steps of: a) introducing into the genome of the plant an exogenous nucleic acid, wherein the exogenous nucleic acid comprises in the 5' to 3' direction i) a promoter that functions in the cells of said plant, said promoter operably linked to; ii) a structural nucleic acid sequence encoding a *D. v. virgifera* protein or fragment thereof, said structural nucleic acid sequence operably linked to; iii) a 3' non-translated nucleic acid sequence that functions in said cells of said plant to cause transcriptional termination; b) obtaining transformed plant cells containing the nucleic acid sequence of step (a); and c) regenerating from said transformed plant cells a transformed plant in which said polypeptide or protein is overexpressed.

Any of the isolated nucleic acid molecules of the present invention may be introduced into a plant cell in a permanent or transient manner in combination with other genetic elements such as vectors, promoters, enhancers etc. Further any of the nucleic acid molecules encoding a *D. v. virgifera* protein or fragment thereof may be introduced into a plant cell in a manner that allows for over expression of the protein or polypeptide encoded by the nucleic acid molecule.

Antibodies have been expressed in plants (Hiatt et al., *Nature* 342:76-78 (1989); Conrad and Fielder, *Plant Mol. Biol.* 26:1023-1030 (1994)). Cytoplasmic expression of a scFv (single-chain Fv antibodies) has been reported to delay infection by artichoke mottled crinkle virus. Transgenic plants that express antibodies directed against endogenous proteins may exhibit a physiological effect (Philips et al., *EMBO J.* 16:4489-4496 (1997); Marion-Poll, *Trends in Plant Science* 2:447-448 (1997)). For example, expressed anti-abscisic antibodies reportedly result in a general perturbation of seed development (Philips et al., *EMBO J.* 16:4489-4496 (1997)).

Antibodies that are catalytic may also be expressed in plants (abzymes). The principle behind abzymes is that since antibodies may be raised against many molecules, this recognition ability can be directed toward generating antibodies that bind transition states to force a chemical reaction forward (Persidas, *Nature Biotechnology* 15:1313-1315 (1997); Baca et al., *Ann. Rev. Biophys. Biomol. Struct.* 26:461-493 (1997)). The catalytic abilities of abzymes may be enhanced by site directed mutagenesis. Examples of abzymes are, for example, set forth in U.S. Pat. No. 5,658,753; U.S. Pat. No. 5,632,990; U.S. Pat. No. 5,631,137; U.S. Pat. No. 5,602,015; U.S. Pat. No. 5,559,538; U.S. Pat. No. 5,576,174; U.S. Pat. No. 5,500,358; U.S. Pat. No. 5,318,897; U.S. Pat. No. 5,298,409; U.S. Pat. No. 5,258,289 and U.S. Pat. No. 5,194,585, all of which are herein incorporated in their entirety.

It is understood that any of the antibodies of the present invention may be expressed in plants and that such expression can result in a physiological effect. It is also understood that any of the expressed antibodies may be catalytic.

(f) Microbial Constructs and Transformed Microbial Cells

The nucleotide sequences of the present invention may be introduced into a wide variety of prokaryotic and eukaryotic microorganism hosts to express the *D. v. virgifera* proteins or fragments thereof of interest. The term "microorganism" includes prokaryotic and eukaryotic microbial species such as bacteria and fungi. Fungi include yeast and filamentous fungi. Illustrative prokaryotes, both Gram-negative and Gram-positive, include Enterobacteriaceae, such as *Escherichia*, *Erwinia*, *Shigella*, *Salmonella*, and *Proteus*; Bacillaceae; Rhizobiceae, such as *Rhizobium*; Spirillaceae, such as photobacterium, *Zymomonas*, *Serratia*, *Aeromonas*, *Vibrio*, *Desulfovibrio*, *Spirillum*; Lactobacillaceae; Pseudomonadaceae, such as *Pseudomonas* and *Acetobacter*; Azotobacteraceae, Actinomycetales, and Nitrobacteraceae. Among eukaryotes are fungi, such as Phycomycetes and Ascomycetes, which includes yeast, such as *Saccharomyces* and *Schizosaccharomyces*; and Basidiomycetes yeast, such as *Rhodotorula*, *Aureobasidium*, *Sporobolomyces*, and the like.

For the purpose of plant protection against insects, a large number of microorganisms known to inhabit the phylloplane (the surface of the plant leaves) and/or the rhizosphere (the soil surrounding plant roots) of a wide variety of important crops may also be desirable host cells for manipulation, propagation, storage, delivery and/or mutagenesis of the disclosed recombinant constructs. These microorganisms include bacteria, algae, and fungi. Of particular interest are microorganisms, such as bacteria, e.g., genera *Bacillus* (including the species and subspecies *B. thuringiensis kurstaki* HD-1, *B. thuringiensis kurstaki* HD-73, *B. thuringiensis sotto*, *B. thuringiensis berliner*, *B. thuringiensis thuringiensis*, *B. thuringiensis tolworthi*, *B. thuringiensis dendrolimus*, *B. thuringiensis alesti*, *B. thuringiensis galleriae*, *B. thuringiensis aizawai*, *B. thuringiensis subtoxicus*, *B. thuringiensis entomocidus*, *B. thuringiensis tenebrionis* and *B. thuringiensis san diego*); *Pseudomonas*, *Erwinia*, *Serratia*, *Klebsiella*, *Zanthomonas*, *Streptomyces*, *Rhizobium*, *Rhodopseudomonas*, *Methylophilius*, *Agrobacterium*, *Acetobacter*, *Lactobacillus*, *Arthrobacter*, *Azotobacter*, *Leuconostoc*, and *Alcaligenes*; fungi, particularly yeast, e.g., genera *Saccharomyces*, *Cryptococcus*, *Kluyveromyces*, *Sporobolomyces*, *Rhodotorula*, and *Aureobasidium*. Of particular interest are such phytosphere bacterial species as *Pseudomonas syringae*, *Pseudomonas fluorescens*, *Serratia marcescens*, *Acetobacter xylinum*, *Agrobacterium tumefaciens*, *Rhodobacter sphaeroides*, *Xanthomonas campestris*, *Rhizobium melioti*, *Alcaligenes eutrophus*, and *Azotobacter vinlandii*; and phytosphere yeast species such as *Rhodotorula rubra*, *R. glutinis*, *R. marina*, *R. aurantiaca*, *Cryptococcus albidus*, *C. diffluens*, *C. laurentii*, *Saccharomyces rosei*, *S. pretoriensis*, *S. cerevisiae*, *Sporobolomyces roseus*, *S. odorus*, *Kluyveromyces veronae*, and *Aureobasidium pollulans*.

It is well known that exogenous nucleic acids encoding polypeptides of interest can be introduced into a microbial host cell, such as a bacterial cell or a fungal cell, using a recombinant construct. The present invention also relates to a fungal or bacterial recombinant construct comprising a structural nucleotide sequence encoding a *D. v. virgifera* protein or fragment thereof. The present invention also relates to a bacterial or fungal cell comprising a bacterial or fungal recombinant vector of the present invention. The present invention also relates to methods for obtaining a recombinant bacterial or fungal host cell, comprising introducing into a bacterial or fungal host cell an exogenous nucleic acid molecule of the present invention.

The bacterial recombinant vector may be a linear or a closed circular plasmid. The vector system may be a single vector or plasmid or two or more vectors or plasmids which together contain the total DNA to be introduced into the genome of the bacterial host. In addition, the bacterial vector may be an expression vector. Nucleic acid molecules encoding *D. v. virgifera* proteins or fragments thereof can, for example, be suitably inserted into a replicable vector for expression in a bacterium under the control of a suitable promoter for that bacterium. Many vectors are available for this purpose, and selection of the appropriate vector will depend mainly on the size of the nucleic acid to be inserted into the vector and the particular host cell to be transformed with the vector. Each vector contains various components depending on its function (amplification of DNA or expression of DNA) and the particular host cell with which it is compatible. The vector components for bacterial transformation generally include, but are not limited to, one or more of the following: a signal sequence, an origin of replication, one or more selectable marker genes, and an inducible promoter allowing the expression of exogenous DNA.

In general, plasmid vectors containing replicon and control sequences that are derived from species compatible with the host cell are used in connection with bacterial hosts. The vector ordinarily carries a replication site, as well as marking sequences that are capable of providing phenotypic selection in transformed cells. For example, *E. coli* is typically transformed using pBR322, a plasmid derived from an *E. coli* species (see, e.g., Bolivar et al., *Gene* 2:95 (1977)). pBR322 contains genes for ampicillin and tetracycline resistance and thus provides easy means for identifying transformed cells. The pBR322 plasmid, or other microbial plasmid or phage, also generally contains, or is modified to contain, promoters that can be used by the microbial organism for expression of the selectable marker genes.

Nucleic acid molecules encoding *D. v. virgifera* proteins or fragments thereof may be expressed not only directly, but also as a fusion with another polypeptide, preferably a signal sequence or other polypeptide having a specific cleavage site at the N-terminus of the mature polypeptide. In general, the signal sequence may be a component of the vector, or it may be a part of the polypeptide encoding DNA that is inserted into the vector. The heterologous signal sequence selected should be one that is recognized and processed (i.e., cleaved by a signal peptidase) by the host cell. For bacterial host cells that do not recognize and process the native polypeptide signal sequence, the signal sequence is substituted by a bacterial signal sequence selected, for example, from the group consisting of the alkaline phosphatase, β-lactamase, or heat-stable enterotoxin II leaders and the like.

Both expression and cloning vectors contain a nucleotide sequence that enables the vector to replicate in one or more selected host cells. Generally, in cloning vectors this sequence is one that enables the vector to replicate independently of the host chromosomal DNA, and includes origins of replication or autonomously replicating sequences. Such sequences are well known for a variety of bacteria.

Expression and cloning vectors also generally contain a selection gene, also termed a selectable marker. This gene encodes a protein necessary for the survival or growth of transformed host cells grown in a selective culture medium. Host cells not transformed with the vector containing the selection gene will not survive in the culture medium. Typical selection genes encode proteins that (a) confer resistance to antibiotics or other toxins, e.g., ampicillin, neomycin, methotrexate, or tetracycline, (b) complement auxotrophic deficiencies, or (c) supply critical nutrients not available from complex media, e.g., the gene encoding D-alanine racemase for Bacilli. One example of a selection scheme utilizes a drug to arrest growth of a host cell. Those cells that are successfully transformed with a heterologous protein or fragment thereof produce a protein conferring drug resistance and thus survive the selection regimen.

The expression vector for producing a polypeptide can also contains an inducible promoter that is recognized by the host bacterial organism and is operably linked to the nucleic acid encoding, for example, the nucleic acid molecule encoding the *D. v. virgifera* protein or fragment thereof of interest. Inducible promoters suitable for use with bacterial hosts include the β-lactamase, *E. coli* λ phage $P_L$ and $P_R$, and *E. coli* galactose, arabinose, alkaline phosphatase, tryptophan (trp), and lactose operon promoter systems and variations thereof (Chang et al., *Nature* 275:615 (1978); Goeddel et al., *Nature* 281:544 (1979); Guzman et al., *J. Bacteriol.* 174:7716-7728 (1992); Goeddel, *Nucleic Acids Res.* 8:4057 (1980); EP 36,776) and hybrid promoters such as the tac promoter (de-Boer et al., *Proc. Natl. Acad. Sci.* (USA) 80:21-25 (1983)). However, other known bacterial inducible promoters are suitable (Siebenlist et al., *Cell* 20:269 (1980)).

Promoters for use in bacterial systems also generally contain a Shine-Dalgarno (S.D.) sequence or a consensus sequence thereof operably linked to the DNA encoding the polypeptide of interest. The promoter can be removed from the bacterial source DNA by restriction enzyme digestion and inserted into the vector containing the desired DNA coding sequence, or vice versa.

Alternatively, the expression constructs can be integrated into the bacterial genome with an integrating vector. Integrating vectors typically contain at least one sequence homologous to the bacterial chromosome that allows the vector to integrate. Integrations appear to result from recombinations between homologous DNA in the vector and the bacterial chromosome. For example, integrating vectors constructed with DNA from various *Bacillus* strains integrate into the *Bacillus* chromosome (E.P.O. Pub. No. 127,328). Integrating vectors may also be comprised of bacteriophage or transposon sequences.

Construction of suitable vectors containing one or more of the above-listed components employs standard recombinant DNA techniques. Isolated plasmids or DNA fragments are cleaved, tailored, and re-ligated in the form desired to generate the plasmids required. Examples of available bacterial expression vectors include, but are not limited to, the multifunctional *E. coli* cloning and expression vectors such as Bluescript™ (Stratagene, La Jolla, Calif.), in which, for example, a *D. v. virgifera* protein or fragment thereof, may be ligated into the vector in frame with sequences for the amino-terminal Met and the subsequent 7 residues of β-galactosidase so that a hybrid protein is produced; pIN vectors (Van Heeke and Schuster *J. Biol. Chem.* 264:5503-5509 (1989)); and the like. pGEX vectors (Promega, Madison Wis.) may also be used to express foreign polypeptides as fusion proteins with glutathione S-transferase (GST). In general, such fusion proteins are soluble and can easily be purified from lysed cells by adsorption to glutathione-agarose beads followed by elution in the presence of free glutathione. Proteins made in such systems are designed to include heparin, thrombin or factor XA protease cleavage sites so that the cloned polypeptide of interest can be released from the GST moiety at will.

It is, of course, necessary to select the appropriate bacteria taking into consideration replicability of the replicon in the cells of a bacterium. For example, *E. coli, Serratia,* or *Salmonella* species can be suitably used as the host when well known plasmids such as pBR322, pBR325, pACYC177, or pKN410 are used to supply the replicon. *E. coli* strain W3110 is a preferred host or parent host because it is a common host strain for recombinant DNA product fermentations. Preferably, the host cell should secrete minimal amounts of proteolytic enzymes.

Host cells are transfected and preferably transformed with the above-described vectors and cultured in conventional nutrient media modified as appropriate for inducing promoters, selecting transformants, or amplifying the genes encoding the desired sequences.

Numerous methods of transfection are known to the ordinarily skilled artisan, for example, calcium phosphate and electroporation. Depending on the host cell used, transformation is done using standard techniques appropriate to such cells. The calcium treatment employing calcium chloride, as described in section 1.82 of Sambrook et al., *Molecular Cloning: A Laboratory Manual*, New York: Cold Spring Harbor Laboratory Press, (1989), is generally used for bacterial cells that contain substantial cell-wall barriers. Another method for transformation employs polyethylene glycol/DMSO, as described in Chung and Miller (Chung and Miller, *Nucleic Acids Res.* 16:3580 (1988)). Yet another method is the use of the technique termed electroporation. In addition, bacterial cells can be readily transformed using various forms of phages (i.e., transducing, temperate, lytic and lysogenic), suicide vectors for inserting DNA directly into the chromosome, and through homologous recombination using either phages, suicide vectors or linear DNA.

Bacterial cells used to produce the polypeptide of interest for purposes of this invention are cultured in suitable media in which the promoters for the nucleic acid encoding the heterologous polypeptide can be artificially induced as described generally, e.g., in Sambrook et al., *Molecular Cloning: A Laboratory Manual*, New York: Cold Spring Harbor Laboratory Press, (1989). Examples of suitable media are given in U.S. Pat. Nos. 5,304,472 and 5,342,763.

A yeast recombinant construct can typically include one or more of the following: a promoter sequence, fusion partner sequence, leader sequence, transcription termination sequence, a selectable marker. These elements can be combined into an expression cassette, which may be maintained in a replicon, such as an extrachromosomal element (e.g., plasmids) capable of stable maintenance in a host, such as yeast or bacteria. The replicon may have two replication systems, thus allowing it to be maintained, for example, in yeast for expression and in a procaryotic host for cloning and amplification. Examples of such yeast-bacteria shuttle vectors include YEp24 (Botstein et al., Gene, 8:17-24 (1979)), pC1/1 (Brake et al., Proc. Natl. Acad. Sci USA, 81:4642-4646 (1984)), and YRp17 (Stinchcomb et al., J. Mol. Biol., 158:157 (1982)). In addition, a replicon may be either a high or low copy number plasmid. A high copy number plasmid will generally have a copy number ranging from about 5 to about 200, and typically about 10 to about 150. A host containing a high copy number plasmid will preferably have at least about 10, and more preferably at least about 20.

Useful yeast promoter sequences can be derived from genes encoding enzymes in the metabolic pathway. Examples of such genes include alcohol dehydrogenase (ADH) (E.P.O. Pub. No. 284044), enolase, glucokinase, glucose-6-phosphate isomerase, glyceraldehyde-3-phosphate-dehydrogenase (GAP or GAPDH), hexokinase, phosphofructokinase, 3-phosphoglycerate mutase, and pyruvate kinase (PyK) (E.P.O. Pub. No. 329203). The yeast PHO5 gene, encoding acid phosphatase, also provides useful promoter sequences (Myanohara et al., Proc. Natl. Acad. Sci. USA, 80:1 (1983)). In addition, synthetic promoters which do not occur in nature also function as yeast promoters. Examples of such hybrid promoters include the ADH regulatory sequence linked to the GAP transcription activation region (U.S. Pat. Nos. 4,876, 197 and 4,880,734). Other examples of hybrid promoters include promoters which consist of the regulatory sequences of either the ADH2, GAL4, GAL10, or PHO5 genes, combined with the transcriptional activation region of a glycolytic enzyme gene such as GAP or PyK (E.P.O. Pub. No. 164556). Furthermore, a yeast promoter can include naturally occurring promoters of non-yeast origin that have the ability to bind yeast RNA polymerase and initiate transcription. Examples of such promoters include, inter alia, (Cohen et al., Proc. Natl. Acad. Sci. USA, 77:1078 (1980); Henikoff et al., Nature 283:835 (1981); Hollenberg et al., Curr. Topics Microbiol. Immunol., 96:119 (1981); Mercerau-Puigalon et al., Gene, 11:163 (1980); and Panthier et al., Curr. Genet., 2:109 (1980)).

Intracellularly expressed fusion proteins provide an alternative to direct expression of the polypeptides of interest. Typically, a DNA sequence encoding the N-terminal portion of a stable protein, a fusion partner, is fused to the 5' end of heterologous structural nucleotide sequence encoding the desired polypeptide. Upon expression, this construct will provide a fusion of the two amino acid sequences. The DNA sequence at the junction of the two amino acid sequences may or may not encode a cleavable site. See, e.g., E.P.O. Pub. No. 196056. Another example is a ubiquitin fusion protein. Such a ubiquitin fusion protein preferably retains a site for a processing enzyme (e.g. ubiquitin-specific processing protease) to cleave the ubiquitin from the polypeptide of the present invention. Through this method, therefore, a mature polypeptide can be isolated [see, P.C.T. WO 88/024066].

Alternatively, polypeptides or proteins can also be secreted from the cell into the growth media by creating chimeric DNA molecules that encode a fusion protein comprised of a leader sequence fragment that provides for secretion in yeast of the polypeptides. Preferably, there are processing sites encoded between the leader fragment and the polypeptide-encoding sequence fragment that can be cleaved either in vivo or in vitro. The leader sequence fragment typically encodes a signal peptide comprised of hydrophobic amino acids which direct the secretion of the protein from the cell.

DNA encoding suitable signal sequences can be derived from genes for secreted yeast proteins, such as the yeast invertase gene (E.P.O. Pub. No. 12873; J.P.O. Pub. No. 62,096,086) and the A-factor gene (U.S. Pat. No. 4,588,684). Alternatively, leaders of non-yeast origin, such as an interferon leader, exist that also provide for secretion in yeast (E.P.O. Pub. No. 60057).

A preferred class of secretion leaders are those that employ a fragment of the yeast alpha-factor gene, which contains both a "pre" signal sequence, and a "pro" region. The types of alpha-factor fragments that can be employed include the full-length pre-pro alpha factor leader (about 83 amino acid residues) as well as truncated alpha-factor leaders (typically about 25 to about 50 amino acid residues) (U.S. Pat. Nos. 4,546,083 and 4,870,008; and E.P.O. Pub. No. 324274). Additional leaders employing an alpha-factor leader fragment that provides for secretion include hybrid alpha-factor leaders made with a pre-sequence of a first yeast, but a pro-region from a second yeast alpha factor. See, e.g., P.C.T. WO 89/02463.

Examples of transcription terminator sequence and other yeast-recognized termination sequences, such as those coding for glycolytic enzymes, are known to those of skill in the art.

Alternatively, the expression constructs can be integrated into the yeast genome with an integrating vector. Integrating vectors typically contain at least one sequence homologous to a yeast chromosome that allows the vector to integrate, and preferably contain two homologous sequences flanking the expression construct. Integrations appear to result from recombinations between homologous DNA in the vector and the yeast chromosome (Orr-Weaver et al., Methods in Enzymol., 101:228-245 (1983)). An integrating vector may be directed to a specific locus in yeast by selecting the appropriate homologous sequence for inclusion in the vector. See Orr-Weaver et al., supra. One or more expression constructs may integrate, possibly affecting levels of recombinant protein produced (Rine et al., Proc. Natl. Acad. Sci. USA, 80:6750 (1983)). The chromosomal sequences included in the vector can occur either as a single segment in the vector, which results in the integration of the entire vector, or as two segments homologous to adjacent segments in the chromosome and flanking the expression construct in the vector, which results in the stable integration of only the expression construct.

Expression and transformation vectors, either extrachromosomal replicons or integrating vectors, have been developed for transformation into many yeasts. For example, expression vectors have been developed for, inter alia, the following yeasts: *Candida albicans* (Kurtz, et al., Mol. Cell. Biol., 6:142 (1986)), *Candida maltosa* (Kunze et al., J. Basic Microbiol., 25:141 (1985)); *Hansenula polymorpha* (Gleeson et al., J. Gen. Microbiol. 132:3459 (1986); Roggenkamp et al., Mol. Gen. Genet. 202:302 (1986)); *Kluyveromyces fragilis* (Das et al., J. Bacteriol. 158:1165 (1984)); *Kluyveromyces lactis* (De Louvencourt et al., J. Bacteriol. 154:737 (1983); Van den Berg et al., Bio/Technology 8:135 (1990)); *Pichia guillerimondii* (Kunze et al., J. Basic Microbiol. 25:141 (1985)); *Pichia pastoris* (Cregg et al., Mol. Cell. Biol. 5:3376 (1985); U.S. Pat. Nos. 4,837,148 and 4,929,555); *Saccharomyces cerevisiae* (Hinnen et al., Proc. Natl. Acad. Sci. USA 75:1929 (1978); Ito et al., J. Bacteriol. 153:163 (1983)); *Schizosaccharomyces pombe* (Beach and Nurse, Nature 300: 706 (1981)); and *Yarrowia lipolytica* (Davidow, et al., Curr. Genet. 10:380471 (1985); and Gaillardin et al., Curr. Genet. 10:49 (1985)).

Methods of introducing exogenous nucleic acids into yeast hosts are well-known in the art, and typically include either the transformation of spheroplasts or of intact yeast cells treated with alkali cations. Transformation procedures usually vary with the yeast species to be transformed. See e.g., Kurtz et al., Mol. Cell. Biol. 6:142 (1986); Kunze et al., J. Basic Microbiol. 25:141 (1985) for *Candida*. See, e.g., Gleeson et al., J. Gen. Microbiol. 132:3459 (1986); Roggenkamp et al., Mol. Gen. Genet. 202:302 (1986) for *Hansenula*. See, e.g., Das et al., J. Bacteriol. 158:1165 (1984); De Louvencourt et al., J. Bacteriol. 154:1165 (1983); Van den Berg et al., Bio/Technology 8:135 (1990) for *Kluyveromyces*. See, e.g., Cregg et al., Mol. Cell. Biol. 5:3376 (1985); Kunze et al., J. Basic Microbiol. 25:141 (1985); U.S. Pat. Nos. 4,837,148 and 4,929,555 for *Pichia*. See, e.g., Hinnen et al., Proc. Natl. Acad. Sci. USA 75:1929 (1978); Ito et al., J. Bacteriol. 153: 163 (1983) for *Saccharomyces*. See, e.g., Beach and Nurse, Nature 300:706 (1981) for *Schizosaccharomyces*. See, e.g., Davidow et al., Curr. Genet. 10:39 (1985); Gaillardin et al., Curr. Genet. 10:49 (1985) for *Yarrowia*.

In order to obtain expression polypeptides or proteins of interest, recombinant microbial host cells derived from the transformants are incubated under conditions which allow expression of the recombinant polypeptide-encoding sequence. These conditions will vary, dependent upon the host cell selected. However, the conditions are readily ascertainable to those of ordinary skill and knowledge in the art.

Detection of polypeptides expressed in the transformed host cell may be performed by several methods. For example, a polypeptide or protein may be detected by its immunological reactivity with antibodies.

Polypeptides or proteins of the present invention may be isolated from the cell by lysis, if formed intracellularly, or isolated from the culture medium, if secreted, by conventional methods.

(g) Mammalian Constructs and Transformed Mammalian Cells

The present invention also relates to a mammalian recombinant expression vector comprising exogenous genetic material. The present invention also relates to a mammalian cell comprising a mammalian recombinant expression vector. The present invention also relates to methods for obtaining a recombinant mammalian host cell, comprising introducing into a mammalian cell exogenous genetic material.

The mammalian recombinant expression vector may be any vector which can be conveniently subjected to recombinant DNA procedures. Many vectors are available for this purpose, and a suitable expression vector is one that is compatible with the desired function (e.g., transient expression, long term expression, integration, replication, amplification) and in which the control elements are compatible with the host cell. The control elements are those non-translated regions of the vector—promoters, enhancers, 5' and 3' untranslated regions—which interact with host celluar proteins to carry out transcription and translation.

Vectors suitable for replication in mammalian cells may include viral replicons, or sequences that ensure integration of the sequence encoding *D. v. virgifera* protein homologues or fragments thereof into the host genome. Suitable vectors may include, for example, those derived from simian virus SV40, retroviruses, bovine papilloma virus, vaccinia virus, and adenovirus. The components of the vectors, e.g. replicons, selection genes, enhancers, promoters, and the like, may be obtained from natural sources or synthesized by known procedures. (See, Kaufman et al, J. Mol. Biol., 159: 511-521 (1982); and Kaufman, Proc. Natl. Acad. Sci., USA, 82:689-693 (1985)).

A suitable vector may be one derived from vaccinia viruses. In this case, a nucleic acid molecule encoding a *D. v. virgifera* protein homologue or fragment thereof is inserted into the vaccinia genome. Techniques for the insertion of foreign DNA into the vaccinia virus genome are known in the art, and utilize, for example, homologous recombination. The insertion of the foreign DNA is generally into a gene which is non-essential in nature, for example, the thymidine kinase gene (tk), which also provides a selectable marker. Plasmid shuttle vectors that greatly facilitate the construction of recombinant viruses have been described (see, for example, Mackett et al, *J Virol.* 49: 857 (1984); Chakrabarti et al., *Mol. Cell. Biol.* 5: 3403 (1985); Moss, In: *Gene Transfer Vectors For Mammalian Cells* (Miller and Calos, eds., Cold Spring Harbor Laboratory, N.Y., p. 10, (1987)). Expression of the *D. v. virgifera* protein homologues or fragments thereof then occurs in cells or animals which are infected with the live recombinant vaccinia virus.

Suitable mammalian expression vectors usually contain one or more eukaryotic control elements that are capable of expression in mammalian cells. The control element is comprised of at least a promoter to mediate transcription of foreign DNA sequences. Suitable promoters for mammalian cells are known in the art and include viral promoters such as that from simian virus 40 (SV40), cytomegalovirus (CMV), Rous sarcoma virus (RSV), adenovirus (ADV), and bovine papilloma virus (BPV).

In addition, the control element may also be comprised of a termination sequence and poly(A) addition sequences which are operably linked to nucleotide sequences encoding *D. v. virgifera* protein homologues or fragments thereof. The control element may also be comprised of an enhancer sequence which increases the expression of *D. v. virgifera* protein homologues or fragments thereof.

Furthermore, the control element may also be comprised of an enhancer, which is any regulatory DNA sequence that can stimulate transcription up to 1000-fold when linked to endogenous or heterologous promoters, with synthesis beginning at the normal mRNA start site. Enhancers are also active when they are placed upstream or downstream from the transcription initiation site, in either normal or flipped orientation, or at a distance of more than 1000 nucleotides from the promoter (Maniatis et al. Science, 236:1237 (1987); Alberts et al., Molecular Biology of the Cell, 2nd ed. (1989)). Enhancers derived from viruses may be particularly useful, because they typically have a broader host range. Examples include the SV40 early gene enhancer (Dijkema et al, EMBO J., 4:761 (1985)) and the enhancer/promoters derived from the long terminal repeat (LTR) of the Rous Sarcoma Virus (Gorman et al., Proc. Natl. Acad. Sci. 79:6777 (1982b)) and from human cytomegalovirus (Boshart et al., Cell, 41:521 (1985)). Additionally, some enhancers are regulatable and become active only in the presence of an inducer, such as a hormone or metal ion (Sassone-Corsi and Borelli, Trends Genet. 2:215 (1986); Maniatis et al. Science, 236:1237 (1987)).

Where selection is intended, sequences which encode selectable markers may also be included in the vector. Selectable markers for mammalian cells are known in the art, and include for example, thymidine kinase, dihydrofolate reductase (together with methotrexate as a DHFR amplifier), aminoglycoside phosphotransferase, hygromycin B phosphotransferase, asparagine synthetase, adenosine deaminase, metallothionien, and antibiotic resistant genes such as neomycin.

For homologous recombination, constructs can be prepared where the amplifiable gene will be flanked, normally on both sides with DNA homologous with the DNA of the target region. Depending upon the nature of the integrating DNA and the purpose of the integration, the homologous DNA will generally be within 100 kb, usually 50 kb, preferably about 25 kb, of the transcribed region of the target gene, more preferably within 2 kb of the target gene. Where modeling of the gene is intended, homology will usually be present proximal to the site of the mutation. By gene is intended the coding region and those sequences required for transcription of a mature mRNA. The homologous DNA may include the 5'-upstream region outside of the transcriptional regulatory region or comprising any enhancer sequences, transcriptional initiation sequences, adjacent sequences, or the like. The homologous region may include a portion of the coding region, where the coding region may be comprised only of an open reading frame or combination of exons and introns. The homologous region may comprise all or a portion of an intron, where all or a portion of one or more exons may also be present. Alternatively, the homologous region may comprise the 3'-region, so as to comprise all or a portion of the transcriptional termination region, or the region 3' of this region. The homologous regions may extend over all or a portion of the target gene or be outside the target gene comprising all or a portion of the transcriptional regulatory regions and/or the structural gene.

The integrating constructs may be prepared in accordance with conventional ways, where sequences may be synthesized, isolated from natural sources, manipulated, cloned, ligated, subjected to in vitro mutagenesis, primer repair, or the like. At various stages, the joined sequences may be cloned, and analyzed by restriction analysis, sequencing, or the like. Usually during the preparation of a construct where various fragments are joined, the fragments, intermediate constructs and constructs will be carried on a cloning vector comprising a replication system functional in a prokaryotic host, e.g., *E. coli*, and a marker for selection, e.g., biocide resistance, complementation to an auxotrophic host, etc. Other functional sequences may also be present, such as polylinkers, for ease of introduction and excision of the construct or portions thereof, or the like. A large number of cloning vectors are available such as pBR322, the pUC series, etc. These constructs may then be used for integration into the primary mammalian host.

The mammalian cell expression vectors described herein may be synthesized by techniques well known to those skilled in this art. Other appropriate expression vectors of which numerous types are known in the art for mammalian expression can also be used for this purpose.

Mammalian cell lines available as hosts for expression are known in the art and include many immortalized cell lines available from the American Type Culture Collection (ATCC). Exemplary mammalian host cells include particularly primate cell lines and rodent cell lines, including transformed cell lines. Suitable cell lines include, but are not limited to, Chinese hamster ovary (CHO) cells, HeLa cells, baby hamster kidney (BHK) cells, monkey kidney cells (COS-1), human hepatocellular carcinoma cells (e.g., Hep G2), human adenovirus transformed 293 cells, mouse L-929 cells, HaK hamster cell lines, murine 3T3 cells derived from Swiss, Balb-c or NIH mice and a number of other cell lines.

The DNA can be introduced into the expression host by a variety of techniques that include calcium phosphate/DNA co-precipitates, microinjection of DNA into the nucleus, electroporation, yeast protoplast fusion with intact cells, transfection, polycations, e.g., polybrene, polyornithine, etc., or the like. The DNA may be single or double stranded DNA, linear or circular. The various techniques for transforming mammalian cells are well known (see Keown et al., *Methods Enzymol*. (1989), Keown et al., *Methods Enzymol.* 185:527-537 (1990); Mansour et al., *Nature* 336:348-352, (1988)).

(h) Computer Media

The nucleotide sequence provided in SEQ ID NO:1, through SEQ ID NO:9112 or fragment thereof, or complement thereof, or a nucleotide sequence at least 90% identical, preferably 95%, identical even more preferably 99% or 100% identical to the sequence provided in SEQ ID NO: 1 through SEQ ID NO:9112 or fragment thereof, or complement thereof, can be "provided" in a variety of mediums to facilitate use. Such a medium can also provide a subset thereof in a form that allows a skilled artisan to examine the sequences.

In one application of this embodiment, a nucleotide sequence of the present invention can be recorded on computer readable media. As used herein, "computer readable media" refers to any medium that can be read and accessed directly by a computer. Such media include, but are not limited to: magnetic storage media, such as floppy discs, hard disc, storage medium, and magnetic tape: optical storage media such as CD-ROM; electrical storage media such as RAM and ROM; and hybrids of these categories such as magnetic/optical storage media. A skilled artisan can readily appreciate how any of the presently known computer readable mediums can be used to create a manufacture comprising computer readable medium having recorded thereon a nucleotide sequence of the present invention.

As used herein, "recorded" refers to a process for storing information on computer readable medium. A skilled artisan can readily adopt any of the presently known methods for recording information on computer readable medium to generate media comprising the nucleotide sequence information of the present invention. A variety of data storage structures are available to a skilled artisan for creating a computer readable medium having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and Microsoft Word, or represented in the form of an ASCII file, stored in a database application, such as DB2, Sybase, Oracle, or the like. A skilled artisan can readily adapt any number of data processor structuring formats (e.g. text file or database) in order to obtain computer readable medium having recorded thereon the nucleotide sequence information of the present invention.

By providing one or more of nucleotide sequences of the present invention, a skilled artisan can routinely access the sequence information for a variety of purposes. Computer software is publicly available which allows a skilled artisan to access sequence information provided in a computer readable medium. The examples which follow demonstrate how software which implements the BLAST (Altschul et al., *J. Mol. Biol.* 215: 403-410 (1990)) and BLAZE (Brutlag, et al., *Comp. Chem.* 17: 203-207 (1993)) search algorithms on a Sybase system can be used to identify open reading frames (ORFs) within the genome that contain homology to ORFs or proteins from other organisms. Such ORFs are protein-encoding fragments within the sequences of the present invention and are useful in producing commercially important proteins such as enzymes used in amino acid biosynthesis, metabolism, transcription, translation, RNA processing, nucleic acid and a protein degradation, protein modification, and DNA replication, restriction, modification, recombination, and repair.

The present invention further provides systems, particularly computer-based systems, which contain the sequence information described herein. Such systems are designed to identify commercially important fragments of the nucleic acid molecule of the present invention. As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A skilled artisan can readily appreciate that any one of the currently available computer-based system are suitable for use in the present invention.

As indicated above, the computer-based systems of the present invention comprise a data storage means having stored therein a nucleotide sequence of the present invention and the necessary hardware means and software means for supporting and implementing a search means. As used herein, "data storage means" refers to memory that can store nucleotide sequence information of the present invention, or a memory access means which can access manufactures having recorded thereon the nucleotide sequence information of the present invention. As used herein, "search means" refers to one or more programs which are implemented on the computer-based system to compare a target sequence or target structural motif with the sequence information stored within the data storage means. Search means are used to identify fragments or regions of the sequence of the present invention that match a particular target sequence or target motif. A variety of known algorithms are disclosed publicly and a variety of commercially available software for conducting search means are available can be used in the computer-based systems of the present invention. Examples of such software include, but are not limited to, MacPattern (EMBL), BLASTIN and BLASTIX (NCBIA). One of the available algorithms or implementing software packages for conducting homology searches can be adapted for use in the present computer-based systems.

The most preferred sequence length of a target sequence is from about 10 to 100 amino acids or from about 30 to 300 nucleotide residues. However, it is well recognized that during searches for commercially important fragments of the nucleic acid molecules of the present invention, such as sequence fragments involved in gene expression and protein processing, may be of shorter length.

As used herein, "a target structural motif," or "target motif," refers to any rationally selected sequence or combination of sequences in which the sequences the sequence(s) are chosen based on a three-dimensional configuration which is formed upon the folding of the target motif. There are a variety of target motifs known in the art. Protein target motifs include, but are not limited to, enzymatic active sites and signal sequences. Nucleic acid target motifs include, but are not limited to, promoter sequences, cis elements, hairpin structures and inducible expression elements (protein binding sequences).

Thus, the present invention further provides an input means for receiving a target sequence, a data storage means for storing the target sequences of the present invention sequence identified using a search means as described above, and an output means for outputting the identified homologous sequences. A variety of structural formats for the input and output means can be used to input and output information in the computer-based systems of the present invention. A preferred format for an output means ranks fragments of the sequence of the present invention by varying degrees of homology to the target sequence or target motif. Such presentation provides a skilled artisan with a ranking of sequences which contain various amounts of the target sequence or target motif and identifies the degree of homology contained in the identified fragment.

A variety of comparing means can be used to compare a target sequence or target motif with the data storage means to identify sequence fragments sequence of the present invention. For example, implementing software which implement the BLAST and BLAZE algorithms (Altschul et al., *J. Mol. Biol.* 215: 403-410 (1990)) can be used to identify open frames within the nucleic acid molecules of the present invention. A skilled artisan can readily recognize that any one of the publicly available homology search programs can be used as the search means for the computer-based systems of the present invention.

Uses of the Agents of the Present Invention

Nucleic acid molecules and fragments thereof of the present invention may be employed to obtain other nucleic acid molecules from other species. Such nucleic acid molecules include the nucleic acid molecules that encode the complete coding sequence of a protein and promoters and flanking sequences of such molecules. In addition, such nucleic acid molecules include nucleic acid molecules that encode for other isozymes or gene family members. Such molecules can be readily obtained by using the above-described nucleic acid molecules or fragments thereof to screen cDNA or genomic libraries obtained from *D. v. virgifera*. Methods for forming such libraries are well known in the art.

Nucleic acid molecules and fragments thereof of the present invention may also be employed to obtain other nucleic acid molecules such as nucleic acid homologues. Such homologues include the nucleic acid molecules that encode, in whole or in part, protein homologues of other species, plants or other organisms. Such molecules can be readily obtained by using the above-described nucleic acid molecules or fragments thereof to screen cDNA or genomic libraries. Methods for forming such libraries are well known in the art. Such homologue molecules may differ in their nucleotide sequences from those found in one or more of SEQ ID NO:1 through SEQ ID NO:9112 or complements thereof because complete complementarity is not needed for stable hybridization. The nucleic acid molecules of the present invention therefore also include molecules that, although capable of specifically hybridizing with the nucleic acid molecules may lack "complete complementarity." In a particular embodiment, methods or 3' or 5' RACE may be used to obtain such sequences (Frohman, M. A. et al., *Proc. Natl. Acad. Sci.* (U.S.A.) 85:8998-9002 (1988); Ohara, O. et al., *Proc. Natl. Acad. Sci.* (U.S.A.) 86:5673-5677 (1989)).

Any of a variety of methods may be used to obtain one or more of the above-described nucleic acid molecules (Zamechik et al., *Proc. Natl. Acad. Sci.* (U.S.A.) 83: 4143-4146 (1986); Goodchild et al., *Proc. Natl. Acad. Sci.* (U.S.A.) 85: 5507-5511 (1988); Wickstrom et al., *Proc. Natl. Acad. Sci.* (U.S.A.) 85: 1028-1032 (1988); Holt et al., *Molec. Cell. Biol.* 8: 963-973 (1988); Gerwirtz et al., *Science* 242: 1303-1306 (1988); Anfossi et al., *Proc. Natl. Acad. Sci.* (U.S.A.) 86: 3379-3383 (1989); Becker et al., *EMBO J.* 8: 3685-3691 (1989)). Automated nucleic acid synthesizers may be employed for this purpose. In lieu of such synthesis, the disclosed nucleic acid molecules may be used to define a pair of primers that can be used with the polymerase chain reaction (Mullis et al., *Cold Spring Harbor Symp. Quant. Biol.* 51: 263-273 (1986); Erlich et al., European Patent 50,424; European Patent 84,796, European Patent 258,017, European Patent 237,362; Mullis, European Patent 201,184; Mullis et al., U.S. Pat. No. 4,683,202; Erlich, U.S. Pat. No. 4,582,788; and Saiki, R. et al., U.S. Pat. No. 4,683,194) to amplify and obtain any desired nucleic acid molecule or fragment.

Nucleic acid molecules and fragments thereof of the present invention may also be employed to create/identify affinity reagents which are capable of a) seeking and binding to expressed proteins and b) verifying that the protein is expressed on insect gut surface as evidenced by binding (for example, by using immunofluorescence). Examples of affinity reagents include but are not limited to RNA aptamers, high-affinity antibodies and peptide aptamers.

RNA aptamers are oligonucleotide ligands, usaually single-stranded RNA, which have high affinity for specific proteins. RNA aptamers can be selected in vitro by the SELEX (Systemic Evolution of Ligands by Exponential Enrichment) methodology. Such methodology comprises: transcribing a DNA library; selecting RNA for binding; and reverse transcribing and amplifying over several rounds the bound RNA to produce a product capable of binding the desired target (Tuerk and Gold, *Science* 249:505-510 (1990); Gold et al., *Annu. Rev. Biochem.* 64, 763-797 (1995)).

Other examples of methods to generate affinity reagents include phage display technology, ribosome display technology and conventional technology for monoclonal antibodies.

Phage display technology refers to a selection process of phage library, which expresses a highly diverse combinatorial immunoglobulin library. The selection process involves the sequential enrichment of specific binding phage from a large excess of nonbinding clones, which is achieved by multiple rounds of phage binding to the target, washing to remove nonspecific binding phage, elution to retrieve specific binding phage and amplification of specific phage after infection of *Escherichia coli*. Any method that separates clones that bind from those that do not can be used as a selection method. Examples of selection methods includes but are not limited to biopanning on immobilized antigen on plastic plates, columns or BIAcore, or selection using biotinylated antigen. The selection and phage-retrieval methods are known to those of skill in the art and are described in the literature (for example, see Winter et al., *Annu. Rev. Immunol.* 12: 433-455 (1994); McCafferty, Hoogenboom, & Chiswell, *Antibody Engineering, a Practical Approach*. IRL Press, Oxford, UK (1996); Hoogenboom, *Trends Biotechnol.* 15: 62-70 (1997); and Griffiths et al, EMBO; 13:3245-3260 (1994)).

Ribosome display technology refers to a methodology of phenotypic selection for ligand binding with a complete, native protein molecule in vitro (Hanes and Pluckthun, *Proc. Natl. Acad. Sci. USA* 94: 4937-4942 (1997)). Such method comprises: (1) first amplifying by PCR a DNA library, whereby introducing a T7 promoter, ribosome-binding site, and stem-loops, and then transcribing DNA to RNA; (2) translating mRNA after purification in vitro in an expression system; (3) after translation affinity-selecting desired ribosome complexes from the translation mixture by binding to the immobilized antigen and removing unspecific ribosome complexes by intensive washing; (4) dissociating the bound ribosome complexes or specifically eluting whole complexes with antigen; (5) isolating RNA from the complexes; (6) reverse transcribing isolated mRNA to cDNA and then PCR amplifying the cDNA; and (7) using the PCR amplified DNA in step 6 for the next cycle of enrichment.

Peptide aptamers are proteins that contain a conformationally constrained peptide region of variable sequence displayed from a scaffold. Peptide aptamers can be generated using phage display technology or ribosome display technology or conventional technology for monoclonal antibodies.

Peptide aptamers from combinatorial libraries can be dominant inhibitors of gene function. For example, peptide aptamers can be used to inhibit the pathway of interest in the cells expressing the peptide aptamers and to identify mutants with phenotypes of interest. C R Geyer, A Colman-Lerner, R Brent; PNAS 96(1999)8567-8572.

A biologically active compound can be conjugated to an affinity reagent to produce a chimeric protein that both binds the target and produces a desirable biological functionality. For example, a binding reagent could be fused to the functional domain of the Bt protein (domain 2) to produce a novel protein capable of binding proteins other than its target protein (e.g., aminopeptidase), producing septicemia similar to that seen with Bt toxicity. In addition, the aptamer itself may have biological activity in addition to the affinity to the expressed cDNA protein.

Promoter sequence(s) and other genetic elements including but not limited to transcriptional regulatory elements associated with one or more of the disclosed nucleotide sequences can also be obtained using the disclosed nucleotide sequences provided herein. In one embodiment, such sequences are obtained by incubating EST nucleic acid molecules or preferably fragments thereof with members of genomic libraries and recovering clones that hybridize to the EST nucleic acid molecule or fragment thereof. In a second embodiment, methods of "chromosome walking," or inverse PCR may be used to obtain such sequences (Frohman, et al., *Proc. Natl. Acad. Sci.* (U.S.A.) 85:8998-9002 (1988); Ohara, et al., *Proc. Natl. Acad. Sci.* (U.S.A.) 86: 5673-5677 (1989); Pang et al., *Biotechniques*, 22(6); 1046-1048 (1977); Huang et al., *Methods Mol. Biol.* 69: 89-96 (1977); Hartl et al., *Methods Mol. Biol.* 58: 293-301 (1996)). In one embodiment, the disclosed ESTs are used to identify cDNAs whose analogous genes contain promoters with desirable expression patterns. Isolation and functional analysis of the 5' flanking promoter sequences of these genes from genomic libraries, for example, using genomic screening methods and PCR techniques would result in the isolation of useful promoters and transcriptional regulatory elements. These methods are known to those of skill in the art and have been described (See for example Birren et al., *Genome Analysis: Analyzing DNA*, 1, (1997), Cold Spring Harbor Laboratory Press, Cold Spring Harbor, N.Y.). Promoters obtained utilizing the ESTs of the present invention could also be modified to affect their control characteristics. Examples of such modifications would include but are not limited to enhancer sequences as reported by Kay et al., *Science* 236:1299 (1987).

In one aspect of the present invention, an evaluation can be conducted to determine whether a particular mRNA molecule is present. One or more of the nucleic acid molecules of the present invention, preferably one or more of the EST nucleic acid molecules of the present invention are utilized to detect the presence or quantity of the mRNA species. Such molecules are then incubated with cell or tissue extracts of a plant under conditions sufficient to permit nucleic acid hybridization. The detection of double-stranded probe-mRNA hybrid molecules is indicative of the presence of the mRNA; the amount of such hybrid formed is proportional to the amount of mRNA. Thus, such probes may be used to ascertain the level and extent of the mRNA production in a plant's cells or tissues. Such nucleic acid hybridization may be conducted under quantitative conditions (thereby providing a numerical value of the amount of the mRNA present). Alternatively, the assay may be conducted as a qualitative assay that indicates either that the mRNA is present, or that its level exceeds a user set, predefined value.

A principle of in situ hybridization is that a labeled, single-stranded nucleic acid probe will hybridize to a complementary strand of cellular DNA or RNA and, under the appropriate conditions, these molecules will form a stable hybrid. When nucleic acid hybridization is combined with histological techniques, specific DNA or RNA sequences can be identified within a single cell. An advantage of in situ hybridization over more conventional techniques for the detection of nucleic acids is that it allows an investigator to determine the precise spatial population (Angerer et al., *Dev. Biol.* 101: 477-484 (1984); Angerer et al., *Dev. Biol.* 112: 157-166 (1985); Dixon et al., *EMBO J.* 10: 1317-1324 (1991)). In situ hybridization may be used to measure the steady-state level of RNA accumulation. It is a sensitive technique and RNA sequences present in as few as 5-10 copies per cell can be detected (Hardin et al., *J. Mol. Biol.* 202: 417-431. (1989)). A number of protocols have been devised for in situ hybridization, each with tissue preparation, hybridization, and washing conditions (Meyerowitz, *Plant Mol. Biol. Rep.* 5: 242-250 (1987); Cox and Goldberg, In: *Plant Molecular Biology: A Practical Approach* (ed. C. H. Shaw), pp. 1-35. IRL Press, Oxford (1988); Raikhel et al., *In situ RNA hybridization in plant tissues*. In *Plant Molecular Biology Manual*, vol. B9: 1-32. Kluwer Academic Publisher, Dordrecht, Belgium (1989)).

In situ hybridization also allows for the localization of proteins within a tissue or cell (Wilkinson, *In Situ Hybridization*, Oxford University Press, Oxford (1992); Langdale, *In Situ Hybridization* 165-179 In: *The Maize Handbook*, eds. Freeling and Walbot, Springer-Verlag, New York (1994)). It is understood that one or more of the molecules of the present invention, preferably one or more of the EST nucleic acid molecules of the present invention or one or more of the antibodies of the present invention may be utilized to detect the expression level or pattern of a protein or mRNA thereof by in situ hybridization.

Fluorescent in situ hybridization also enables the localization of a particular DNA sequence along a chromosome which is useful, among other uses, for gene mapping, following chromosomes in hybrid lines or detecting chromosomes with translocations, transversions or deletions. In situ hybridization has been used to identify chromosomes in several plant species (Griffor et al., *Plant Mol. Biol.* 17: 101-109 (1991); Gustafson et al., *Proc. Nat'l. Acad. Sci.* (U.S.A). 87: 1899-1902 (1990); Mukai and Gill, *Genome* 34: 448-452. (1991); Schwarzacher and Heslop-Harrison, *Genome* 34: 317-323 (1991); Wang et al., *Jpn. J. Genet.* 66: 313-316 (1991); Parra and Windle, *Nature Genetics*, 5: 17-21 (1993)). It is understood that the nucleic acid molecules of the present invention may be used as probes or markers to localize sequences along a chromosome.

It is also understood that one or more of the molecules of the present invention, preferably one or more of the EST nucleic acid molecules of the present invention or one or more of the antibodies of the present invention may be utilized to detect the expression level or pattern of a protein or mRNA thereof by in situ hybridization.

Further, it is also understood that any of the nucleic acid molecules of the present invention may be used as marker nucleic acids and or probes in connection with methods that require probes or marker nucleic acids. As used herein, a probe is an agent that is utilized to determine an attribute or feature (e.g. presence or absence, location, correlation, identity, etc.) or a molecule, cell, tissue or plant. As used herein, a marker nucleic acid is a nucleic acid molecule that is utilized to determine an attribute or feature (e.g., presence or absence, location, correlation, etc.) or a molecule, cell, tissue or plant.

Nucleic acid molecules of the present invention can be used to monitor expression. A microarray-based method for high-throughput monitoring of gene expression may be utilized to measure gene-specific hybridization targets. This 'chip'-based approach involves using microarrays of nucleic acid molecules as gene-specific hybridization targets to quantitatively measure expression of the corresponding genes (Schena et al., *Science* 270: 467-470 (1995); Shalon, Ph.D. Thesis, Stanford University (1996)). Every nucleotide in a large sequence can be queried at the same time. Hybridization can be used to efficiently analyze nucleotide sequences.

Several methods have been described for fabricating microarrays of nucleic acid molecules and using such microarrays in detecting nucleotide sequences. For instance, microarrays can be fabricated by spotting nucleic acid molecules, e.g. genes, oligonucleotides, etc., onto substrates or fabricating oligonucleotide sequences in situ on a substrate. Spotted or fabricated nucleic acid molecules can be applied in a high density matrix pattern of up to about 30 non-identical nucleic acid molecules per square centimeter or higher, e.g. up to about 100 or even 1000 per square centimeter. Useful substrates for arrays include nylon, glass and silicon. See, for instance, U.S. Pat. Nos. 5,202,231; 5,445,934; 5,525,464; 5,700,637; 5,744,305; 5,800,992. Sequences can be efficiently analyzed by hybridization to a large set of oligonucleotides or cDNA molecules representing a large portion of genes of a genome. An array consisting of oligonucleotides or cDNA molecules complementary to subsequences of a target sequence can be used to determine the identity of a target sequence, measure its amount, and detect differences between the target and a reference sequence. Nucleic acid molecule microarrays may also be screened with molecules or fragments thereof to determine nucleic acid molecules that specifically bind molecules or fragments thereof.

A nucleic acid "library" encompassed by the present invention also includes biochemical libraries of the nucleic acids of SEQ ID NOS:1-9112, e.g., collections of nucleic acids representing the provided nucleic acids. The biochemical libraries can take a variety of forms, e.g. a solution of cDNAs, a pattern of probe nucleic acids stably bound to a surface of a solid support (microarray) and the like. By array is meant an article of manufacture that has a solid support or substrate with one or more nucleic acid targets on one of its surfaces, where the number of distinct nucleic acid sequences may be in the tens, or even hundreds, or even thousand, or even tens of thousands. Each nucleic acid will comprise at 18 consecutive covalently linked nucleotides, and often at least 25 consecutive covalently linked nucleotides, and often at least 100 to 1000 consecutive covalently linked nucleotides, and may represent up to a complete coding sequence or cDNA. A variety of different array formats have been developed and are known to those of skill in the art. The arrays of the subject invention find use in a variety of applications, including gene expression analysis, drug screening, mutation analysis and the like, as disclosed in the above-listed exemplary patent documents.

In addition to the above nucleic acid libraries, analogous libraries of polypeptides are also provided, where the where the polypeptides of the library will represent at least a portion of the polypeptides encoded by SEQ ID NOS:1-9112.

The microarray approach may also be used with polypeptide targets (U.S. Pat. No. 5,445,934; U.S. Pat. No. 5,143,854; U.S. Pat. No. 5,079,600; U.S. Pat. No. 4,923,901). Essentially, polypeptides are synthesized on a substrate (microarray) and these polypeptides can be screened with either protein molecules or fragments thereof or nucleic acid molecules in order to screen for either protein molecules or fragments thereof or nucleic acid molecules that specifically bind the target polypeptides (Fodor et al., *Science* 251: 767-773 (1991)).

It is understood that one or more of the molecules of the present invention, preferably one or more of the nucleic acid molecules or protein molecules or fragments thereof of the present invention may be utilized in a microarray based method. In a preferred embodiment of the present invention, one or more of the *D. v. virgifera* nucleic acid molecules or protein molecules or fragments thereof of the present invention may be utilized in a microarray based method. A particular preferred microarray embodiment of the present invention is a microarray comprising nucleic acid molecules encoding genes or fragments thereof that are homologues of known genes or nucleic acid molecules that comprise genes or fragments thereof that elicit only limited or no matches to known genes. A further preferred microarray embodiment of the present invention is a microarray comprising nucleic acid molecules having genes or fragments thereof that are homologues of known genes and nucleic acid molecules that comprise genes or fragment thereof that elicit only limited or no matches to known genes.

In a preferred embodiment, the microarray of the present invention comprises at least 10 nucleic acid molecules that specifically hybridize under high stringency to at least 10 nucleic acid molecules encoding *D. v. virgifera* protein or fragments thereof of the present invention. In a more preferred embodiment, the microarray of the present invention comprises at least 100 nucleic acid molecules that specifically hybridize under high stringency to at least 100 nucleic acid molecules that encode a *D. v. virgifera* protein or fragment thereof of the present invention. In an even more preferred embodiment, the microarray of the present invention comprises at least 1,000 nucleic acid molecules that specifically hybridize under high stringency to at least 1,000 nucleic acid molecules that encode a D. v. virgifera protein or fragment thereof of the present invention. In a further even more preferred embodiment, the microarray of the present invention comprises at least 2,500 nucleic acid molecules that specifically hybridize under high stringency to at least 2,500 nucleic acid molecules that encode a D. v. virgifera protein or fragment thereof of the present invention. In a preferred embodiment, at least 50%, preferably at least 70%, more preferably at least 80%, even more preferably at least 90% of the nucleic acid molecules that comprise the microarray contain one protein or fragment thereof.

Nucleic acid molecules of the present invention may be used in site directed mutagenesis. Site-directed mutagenesis may be utilized to modify nucleotide sequences, particularly as it is a technique that allows one or more of the amino acids encoded by a nucleic acid molecule to be altered (e.g. a threonine to be replaced by a methionine). Three basic methods for site-directed mutagenesis are often employed. These are cassette mutagenesis (Wells et al., *Gene* 34: 315-23 (1985)), primer extension (Gilliam et al., *Gene* 12: 129-137 (1980); Zoller and Smith, *Methods Enzymol.* 100: 468-500 (1983); Dalbadie-McFarland et al., *Proc. Natl. Acad. Sci.* (U.S.A). 79: 6409-6413 (1982)) and methods based upon PCR (Scharf et al., *Science* 233: 1076-1078 (1986); Higuchi et al., *Nucleic Acids Res.* 16: 7351-7367 (1988)). Site-directed mutagenesis approaches are also described in EP 0 385 962, EP 0 359 472, and PCT Patent Application WO 93/07278.

Any of the nucleic acid molecules of the present invention may either be modified by site-directed mutagenesis or used as, for example, nucleic acid molecules that are used to target other nucleic acid molecules for modification. It is understood that mutants with more than one altered nucleotide can be constructed using techniques that practitioners skilled in the art are familiar with such as isolating restriction fragments and ligating such fragments into an expression vector (see, for example, Sambrook et al., *Molecular Cloning: A Laboratory Manual*, Cold Spring Harbor Press (1989)). In a preferred embodiment of the present invention, one or more of the nucleic acid molecules or fragments thereof of the present invention may be modified by site-directed mutagenesis.

Receptors identified from the cDNA libraries of the present invention will find great use in the design of straightforward in vivo screening assays for toxins which will interact successfully with these receptors resulting in measurable effects on the cells in which the receptors reside. Briefly, suitable host cells, which contain expression vectors appropriate to the hosts for the production of the receptors of the invention displayed on the surfaces of the cells. Preferably, the host cells are eucaryotic cells such as mammalian, insect and yeast. Since the receptors are natively membrane proteins, no particular design of the expression system is required in order to effect their disposition at the cell surface. Expression vectors suitable for any desired host are generally known in the art. Procaryotic cells such as *E. coli* also may be adapted for expression of the receptor in the assay, for instance by using a reporter gene under the control of cyclic AMP and operably linked to the receptor via protein G such that toxin binding will interrupt adenyl cyclase activity and thereby produce a detectable change in reporter gene activity.

In the in vivo assays, the modified cells are contacted with the candidate toxin and the effect on metabolism or morphology is noted in the presence and absence of the candidate. The effect may be cytotoxic—i.e., the cells may themselves exhibit one of the indices of cell death, such as reduced thymidine uptake, slower increase in optical density of the culture, reduced exclusion of vital dyes (e.g., trypan blue), increased release of viability markers such as chromium and rubidium, and the like. The differential response between the toxin-treated cells and the cells absent the toxin is then noted. The strength of the toxin can be assessed by noting the strength of the response.

These assays may be conducted directly as described above or competitively with known toxins. For example, one approach might be to measure the diminution in binding of labeled BT cry toxin in the presence and absence of the toxin candidate.

In addition to simply screening candidates, the screen can be used to devise improved forms of toxins which are more specific or less specific to particular classes of insects as desired. The ability to determine binding affinity (K.sub.a and K.sub.d), dissociation and association rates, and cytotoxic effects of a candidate allows quick, accurate and reproducible screening techniques for a large number of toxins and other ligands under identical conditions which was not possible heretofore. Such information will facilitate the selection of the most effective toxins and ligands for any given receptor obtained from any desired host cell.

Competition assays may also employ RNA aptamers, peptide aptamers and antibodies that have high affinity and specificity for the receptor. The information and the structural characteristics of toxins and ligands tested will permit a rational approach to designing more efficient toxins and ligands. Additionally, such assays will lead to a better understanding of the function and the structure/function relationship of both toxin/ligand and toxin receptors on gut surface. In turn, this will allow the development of highly effective toxins/ligands.

In addition to the above discussed procedures, practitioners are familiar with the standard resource materials which describe specific conditions and procedures for the construction, manipulation and isolation of macromolecules (e.g., DNA molecules, plasmids, etc.), generation of recombinant organisms and the screening and isolating of clones, (see for example, Sambrook et al., *Molecular Cloning: A Laboratory Manual*, Cold Spring Harbor Press (1989); Mailga et al., *Methods in Plant Molecular Biology*, Cold Spring Harbor Press (1995); Birren et al., *Genome Analysis: Analyzing DNA,* 1, Cold Spring Harbor, N.Y.).

Having now generally described the invention, the same will be more readily understood through reference to the following examples which are provided by way of illustration, and are not intended to be limiting of the present invention, unless specified.

EXAMPLE 1

Construction of the cDNA Library LIB149

The cDNA library LIB149 was generated from midguts of WCR third instar larvae. Disinfected WCR eggs were suspended in a 0.1% (w/v) agar solution and dispensed into petri dishes containing 2% (w/v) agar and filter paper. The WCR eggs were incubated first at 20° C. and 60% relative humidity for 3 days and then at 25° C. and 60% RH for 10 days. After 13 days of incubation, the eggs were washed from the dishes into sweater boxes containing soil (2 parts Metro-Mix 200:1 part Redi-Earth; steam sterilized) and germinated corn mats, which were prepared by geminating corn seeds of Pioneer varieties 3615, 3732, or CD5 in sweater boxes containing germination paper wet with 1.0% (w/v) $3336^F$ fungicide. Larvae were reared in sweater boxes in a growth chamber (25° C., 70% relative humidity, irrigated for 10 minutes every 2 days, and fertilized every 4 days). Third instar larvae were dissected to separate midguts from other body (cuticle, head, fore- and hindgut, as well as fat body). The harvested midguts were placed in chilled m.c. tube with 25 mM Tris buffer (pH 7.4), thoroughly saturated with the buffer, and then centrifuged for 5 minutes at 14,000 g at 4° C. Supernatant was discarded and midgut pellets were immediately frozen in liquid nitrogen and stored at −80° C. until total RNA preparation. RNA was purified and the cDNA library was constructed as described in Example 2.

Construction of the cDNA Library LIB150

The cDNA library LIB150 was generated from WCR pupae. Disinfected WCR eggs were suspended in a 0.1% (w/v) agar solution and dispensed into petri dishes containing 2% (w/v) agar and filter paper. The WCR eggs were incubated first at 20° C. and 60% relative humidity for 3 days and then at 25° C. and 60% RH for 10 days. After 13 days of incubation, the eggs were washed from the dishes into sweater boxes containing soil (2 parts Metro-Mix 200:1 part Redi-Earth; steam sterilized) and germinated corn mats, which were prepared by geminating corn seeds of Pioneer varieties 3615, 3732, or CD5 in sweater boxes containing germination paper wet with 1.0% (w/v) $3336^F$ fungicide. The sweater boxes containing eggs were placed in a growth chamber (25° C., 70% relative humidity, irrigated for 10 minutes every 2 days, and fertilized every 4 days) for 10 days. 10-day old larval mats were removed from the sweater boxes and transferred into an emergence box containing soil (2 parts Metro-Mix 200:1 part Redi-Earth; steam sterilized) and germinated corn lining the inside of the box. The emergence boxes were placed in a growth chamber (25° C., 70% RH, irrigated for 10 minutes every 2 days, and fertilized every 4 days) for 7 days. WCR pupae were collected, frozen in liquid nitrogen, and stored at −80° C. until total RNA preparation. RNA was purified and the cDNA library was constructed as described in Example 2.

Construction of the cDNA Library LIB3026

The cDNA library LIB3026 was generated from midguts of WCR first instar larvae. Disinfected WCR eggs were suspended in a 0.1% (w/v) agar solution and dispensed into petri dishes containing 2% (w/v) agar and filter paper. The WCR eggs were incubated first at 20° C. and 60% relative humidity for 3 days and then at 25° C. and 60% RH for 10 days. After 13 days of incubation, the eggs were washed from the dishes into sweater boxes containing soil (2 parts Metro-Mix 200:1 part Redi-Earth; steam sterilized) and germinated corn mats, which were prepared by geminating corn seeds of Pioneer varieties 3615, 3732, or CD5 in sweater boxes containing germination paper wet with 1.0% (w/v) 3336$^F$ fungicide. Larvae were reared in sweater boxes in a growth chamber (25° C., 70% relative humidity, irrigated for 10 minutes every 2 days, and fertilized every 4 days). First instar larva were dissected to separate midguts from other body (cuticle, head, fore- and hindgut, as well as fat body). The harvested midguts are placed in chilled m.c. tube with 25 mM Tris buffer (pH 7.4), thoroughly saturated with the buffer, and then centrifuged for 5 minutes at 14,000 g at 4° C. Supernatant was discarded and midgut pellets were immediately frozen in liquid nitrogen and stored at −80° C. until total RNA preparation. RNA was purified and the cDNA library was constructed as described in Example 2.

Construction of the cDNA Library LIB3373

The cDNA library LIB3373 was generated from whole guts of WCR third instar larvae. Western corn rootworm eggs were prepared weekly. Eggs were separated from soil by floating in a separatory funnel containing a 1.25 specific gravity solution of magnesium sulfate. Once separated, the eggs were surface disinfected in 0.25% peroxyacetic acid, rinsed, treated with Nystatin (2 mg/ml), and plated onto sterile filter disks on 2% agar. Egg plates were incubated at 25° C. for two weeks then transferred to corn seedling boxes (described below).

Corn seedlings for rearing the hatching larvae were prepared weekly by treating approximately 1 kg of corn seeds with 25% bleach for five minutes, followed by rinsing. Corn seed was divided into twelve sterile tissue culture boxes, each containing germination paper and 200 ml of 1% Domain fungicide solution. Germination temperature was 29° C. and germinating seedlings were ready for infestation one week after preparation. Following infestation, rearing boxes were incubated at 25° C.

Third instar larvae were harvested from the seedling boxes eight to twelve days following infestation. Insects were harvested by placing infested corn mats onto a screen within a large funnel (60 cm). As insects crawled out of the root mass, they would fall through the funnel into a 50 ml screwcap tube (on ice).

Third instar larva were dissected to separate guts from other body (cuticle, head, and fat body). The harvested guts were placed in chilled m.c. tube with 25 mM Tris buffer (pH 7.4), thoroughly saturated with the buffer, and then centrifuged for 5 minutes at 14,000 g at 4° C. Supernatant was discarded and gut pellets were immediately frozen in liquid nitrogen and stored at −80° C. until total RNA preparation.

Total RNA was isolated using the Pharmacia QuickPrep Total RNA Extraction Kit, following the protocol recommended by the manufacturer. Poly A+ RNA (mRNA) was purified using QuickPrep kit from Amersham Pharmacia Biotech, Inc. (Piscataway, N.J.), essentially as recommended by the manufacturer.

Construction of cDNA libraries is well-known in the art and a number of cloning strategies exist. A number of cDNA library construction kits are commercially available. The Stratagene cDNA Synthesis Kit (Stratagene, La Jolla, Calif.) was used, following the conditions suggested by the manufacturer. The cDNA was ligated into a Lambda Zap vector.

EXAMPLE 2

Total RNA was purified using Trizol reagent from Life Technologies (Gibco BRL, Life Technologies, Gaithersburg, Md. U.S.A.), essentially as recommended by the manufacturer. Poly A+ RNA (mRNA) was purified using magnetic oligo dT beads essentially as recommended by the manufacturer (Dynabeads, Dynal Corporation, Lake Success, N.Y. U.S.A.).

Construction of cDNA libraries is well-known in the art and a number of cloning strategies exist. A number of cDNA library construction kits are commercially available. The Superscript™ Plasmid System for cDNA synthesis and Plasmid Cloning (Gibco BRL, Life Technologies, Gaithersburg, Md. U.S.A.) was used, following the conditions suggested by the manufacturer. The cDNA was ligated into pSPORT cloning vector.

EXAMPLE 3

The cDNA libraries were plated on LB agar containing the appropriate antibiotics for selection and incubated at 37° for a sufficient time to allow the growth of individual colonies. Single colonies were individually transferred to each well of 96-well microtiter plates containing LB liquid including selective antibiotics. The plates were incubated overnight at approximately 37° C. with gentle shaking to promote growth of the cultures. The plasmid DNA was isolated from each clone using Qiaprep plasmid isolation kits, using the conditions recommended by the manufacturer (Qiagen Inc., Santa Clara, Calif. U.S.A.).

The template plasmid DNA clones were used for subsequent sequencing. For sequencing the cDNA libraries LIB149, LIB150, and LIB3026, a commercially available sequencing kit, such as the ABI PRISM dRhodamine Terminator Cycle Sequencing Ready Reaction Kit with AmpliTaq® DNA Polymerase, FS, was used under the conditions recommended by the manufacturer (PE Applied Biosystems, Foster City, Calif.). The ESTs of the present invention were generated by sequencing initiated from the 5' end of each cDNA clone.

A number of sequencing techniques are known in the art, including fluorescence-based sequencing methodologies. These methods have the detection, automation and instrumentation capability necessary for the analysis of large volumes of sequence data. Currently, the 377 DNA Sequencer (Perkin-Elmer Corp., Applied Biosystems Div., Foster City, Calif.) allows the most rapid electrophoresis and data collection. With these types of automated systems, fluorescent dye-labeled sequence reaction products are detected and data entered directly into the computer, producing a chromatogram that is subsequently viewed, stored, and analyzed using the corresponding software programs. These methods are known to those of skill in the art and have been described and reviewed (Birren et al., *Genome Analysis: Analyzing DNA*, 1, Cold Spring Harbor, N.Y., the entirety of which is herein incorporated by reference).

EXAMPLE 4

Sequencing of the cDNA library LIB3373 was carried out using the primary library as the source for sequencing template. Two methods were used to isolate sequencing template: phagemid excision and single phage PCR.

In the phagemid excision method, 400-800 plaques are spread evenly over a bacterial lawn on multiple Petri plates. Blue/white selection was performed to identify putative phage containing gut inserts. White plaques were individually isolated and stored at 4° C. These are stable for several months, and thus can be isolated less frequently in greater numbers (e.g., once a month). Phagemid excision was performed in 96-sample sets from the phage stocks. This step releases the plasmid vector (containing the cDNA insert) from the Uni-Zap phage vector. This protocol was modified from Stratagene's protocol to facilitate phage adhesion and growth in 96-well culture blocks (~1.45 ml volumes). Plaques were allowed to adhere to and multiply in XL1 Blue cells co-infected with Helper phage. Cell lysis releases filamentous phage which is used to infect SOLR cells, where phagemid excision takes place. After excision, cells containing phagemids with insert were identified by a second round of selection (ampicillin resistance, blue/white colonies) immediately before isolation of DNA. Sequence-quality DNA was isolated using the Qiagen TurboPrep protocol (96-well format) and screened (EcoRI×XhoI digest) for the presence and approximate size of insert before setting up template/primer reactions. DNA sequences were then analyzed for ambiguous sequence and vector contamination and trimmed using a commercially available computer software (Sequencher), and submitted as gapped BLAST searches for comparison to public nucleotide and protein databases.

The other method utilized PCR to amplify individual inserts directly from phage; this was performed without isolation of phage DNA. The PCR reaction was carried out in 96-well format using the M13 Reverse and −20 primers. A portion of the PCR product was analyzed on an agarose gel to determine presence and size of insert. The remainder of the PCR product was purified using Qiagen's PCR Purification kit. Sequencing was then conducted using nested primers (T3/T7). This method involves a number of steps that are analogous to the excision screening method (phage isolation, DNA purification, digest/PCR setup, agarose electrophoresis, sequence set-up) and is nearly as labor-intensive. However, this method has the potential to increase the number of clones that can be screened per week because plating is not necessary. All completed sequences were trimmed for vector contamination and ambiguous regions.

EXAMPLE 5

This example illustrates sequence comparison to determine the similarity/identity of the test or query sequence with sequences in publicly available or proprietary databases. A characteristic feature of a protein or DNA sequence is that it can be compared with other known protein or DNA sequences. Sequence comparisons can be undertaken by determining the similarity of the test or query sequence with sequences in publicly available or proprietary databases ("similarity analysis") or by searching for certain motifs ("intrinsic sequence analysis") (e.g. cis elements) (Coulson, *Trends in Biotechnology*, 12: 76-80 (1994); Birren, et al., *Genome Analysis*, 1: 543-559 (1997); both of which are herein incorporated by reference in their entirety).

Similarity analysis includes database search and alignment. Examples of public databases include the DNA Database of Japan (DDBJ); Genebank; and the European Molecular Biology Laboratory Nucleotide sequence Database (EMBL).

A number of different search algorithms have been developed, one example of which are the suite of programs referred to as BLAST programs. There are five implementations of BLAST, three designed for nucleotide sequences queries (BLASTN, BLASTX, and TBLASTX) and two designed for protein sequence queries (BLASTP and TBLASTN) (Coulson, *Trends in Biotechnology*, 12: 76-80 (1994); Birren, et al., *Genome Analysis*, 1: 543-559 (1997)).

BLASTN takes a nucleotide sequence (the query sequence) and its reverse complement and searches them against a nucleotide sequence database. BLASTN was designed for speed, not maximum sensitivity, and may not find distantly related coding sequences. BLASTX takes a nucleotide sequence, translates it in three forward reading frames and three reverse complement reading frames, and then compares the six translations against a protein sequence database. BLASTX is useful for sensitive analysis of preliminary (single-pass) sequence data and is tolerant of sequencing errors (Gish and States, *Nature Genetics*, 3: 266-272 (1993), herein incorporated by reference). BLASTN and BLASTX may be used in concert for analyzing EST data (Coulson, *Trends in Biotechnology*, 12: 76-80 (1994); Birren et al., *Genome Analysis*, 1: 543-559 (1997)).

Given a coding nucleotide sequence and the protein it encodes, it is often preferable to use the protein as the query sequence to search a database because of the greatly increased sensitivity to detect more subtle relationships. This is due to the larger alphabet of proteins (20 amino acids) compared with the alphabet of nucleotide sequences (4 bases), where it is far easier to obtain a match by chance. In addition, with nucleotide alignments, only a match (positive score) or a mismatch (negative score) is obtained, but with proteins, the presence of conservative amino acid substitutions can be taken into account. Here, a mismatch may yield a positive score if the non-identical residue has physical/chemical properties similar to the one it replaced. Various scoring matrices are used to supply the substitution scores of all possible amino acid pairs. A general purpose scoring system is the BLOSUM62 matrix (Henikoff and Henikoff, *Proteins*, 17: 49-61 (1993), herein incorporated by reference in its entirety), which is currently the default choice for BLAST programs. BLOSUM62 is tailored for alignments of moderately diverged sequences and thus may not yield the best results under all conditions. Altschul, *J. Mol. Biol.* 36: 290-300 (1993), herein incorporated by reference in its entirety, uses a combination of three matrices to cover all contingencies. This may improve sensitivity, but at the expense of slower searches. In practice, a single BLOSUM62 matrix is often used but others (PAM40 and PAM250) may be attempted when additional analysis is necessary. Low PAM matrices are directed at detecting very strong but localized sequence similarities, whereas high PAM matrices are directed at detecting long but weak alignments between very distantly related sequences.

Homologues in other organisms are available that can be used for comparative sequence analysis. Multiple alignments are performed to study similarities and differences in a group of related sequences. CLUSTAL W is a multiple sequence alignment package available that performs progressive multiple sequence alignments based on the method of Feng and Doolittle, *J. Mol. Evol.* 25: 351-360 (1987), the entirety of which is herein incorporated by reference. Each pair of sequences is aligned and the distance between each pair is calculated; from this distance matrix, a guide tree is calculated, and all of the sequences are progressively aligned based on this tree. A feature of the program is its sensitivity to the effect of gaps on the alignment; gap penalties are varied to encourage the insertion of gaps in probable loop regions instead of in the middle of structured regions. Users can specify gap penalties, choose between a number of scoring matrices, or supply their own scoring matrix for both the pairwise alignments and the multiple alignments. CLUSTAL W for UNIX and VMS systems is available at: ftp.ebi.ac.uk. Another program is MACAW (Schuler et al., *Proteins, Struct. Func. Genet*, 9:180-190 (1991), the entirety of which is herein incorporated by reference, for which both Macintosh and Microsoft Windows versions are available. MACAW uses a graphical interface, provides a choice of several alignment algorithms, and is available by anonymous ftp at: ncbi.nlm.nih.gov (directory/pub/macaw).

Sequence motifs are derived from multiple alignments and can be used to examine individual sequences or an entire database for subtle patterns. With motifs, it is sometimes possible to detect distant relationships that may not be demonstrable based on comparisons of primary sequences alone. Currently, the largest collection of sequence motifs in the world is PROSITE (Bairoch and Bucher, *Nucleic Acid Research*, 22: 3583-3589 (1994), the entirety of which is herein incorporated by reference.) PROSITE may be accessed via either the ExPASy server on the World Wide Web or anonymous ftp site. Many commercial sequence analysis packages also provide search programs that use PROSITE data.

A resource for searching protein motifs is the BLOCKS E-mail server developed by S. Henikoff, *Trends Biochem Sci.*, 18:267-268 (1993); Henikoff and Henikoff, *Nucleic Acid Research*, 19:6565-6572 (1991); Henikoff and Henikoff, *Proteins*, 17: 49-61 (1993); all of which are herein incorporated by reference in their entirety). BLOCKS searches a protein or nucleotide sequence against a database of protein motifs or "blocks." Blocks are defined as short, ungapped multiple alignments that represent highly conserved protein patterns. The blocks themselves are derived from entries in PROSITE as well as other sources. Either a protein or nucleotide query can be submitted to the BLOCKS server; if a nucleotide sequence is submitted, the sequence is translated in all six reading frames and motifs are sought in these conceptual translations. Once the search is completed, the server will return a ranked list of significant matches, along with an alignment of the query sequence to the matched BLOCKS entries.

Conserved protein domains can be represented by two-dimensional matrices, which measure either the frequency or probability of the occurrences of each amino acid residue and deletions or insertions in each position of the domain. This type of model, when used to search against protein databases, is sensitive and usually yields more accurate results than simple motif searches. Two popular implementations of this approach are profile searches (such as GCG program ProfileSearch) and Hidden Markov Models (HMMs)(Krough et al., *J. Mol. Biol.* 235:1501-1531 (1994); Eddy, *Current Opinion in Structural Biology* 6:361-365 (1996), both of which are herein incorporated by reference in their entirety). In both cases, a large number of common protein domains have been converted into profiles, as present in the PROSITE library, or HHM models, as in the Pfam protein domain library (Sonnhammer et al., *Proteins* 28:405-420 (1997), the entirety of which is herein incorporated by reference). Pfam contains more than 500 HMM models for enzymes, transcription factors, signal transduction molecules, and structural proteins. Protein databases can be queried with these profiles or HMM models, which will identify proteins containing the domain of interest. For example, HMMSW or HMMFS, two programs in a public domain package called HMMER (Sonnhammer et al., *Proteins* 28:405-420 (1997)) can be used.

PROSITE and BLOCKS represent collected families of protein motifs. Thus, searching these databases entails submitting a single sequence to determine whether or not that sequence is similar to the members of an established family. Programs working in the opposite direction compare a collection of sequences with individual entries in the protein databases. An example of such a program is the Motif Search Tool, or MoST (Tatusov et al. *Proc. Natl. Acad. Sci.* 91: 12091-12095 (1994), the entirety of which is herein incorporated by reference.) On the basis of an aligned set of input sequences, a weight matrix is calculated by using one of four methods (selected by the user); a weight matrix is simply a representation, position by position in an alignment, of how likely a particular amino acid will appear. The calculated weight matrix is then used to search the databases. To increase sensitivity, newly found sequences are added to the original data set, the weight matrix is recalculated, and the search is performed again. This procedure continues until no new sequences are found.

Table 1 lists the nucleic acid molecules encoding homologs of known proteins.

Lengthy table referenced here

US07612194-20091103-T00001

Please refer to the end of the specification for access instructions.

LENGTHY TABLES

The patent contains a lengthy table section. A copy of the table is available in electronic form from the USPTO web site (http://seqdata.uspto.gov/?pageRequest=docDetail&DocID=US07612194B2). An electronic copy of the table will also be available from the USPTO upon request and payment of the fee set forth in 37 CFR 1.19(b)(3).

SEQUENCE LISTING (9112 sequences)

SEQ ID NO: 1 - DNA, 585 bp, Diabrotica virgifera
  Clone ID: pGUT3577
ttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagatcaaggacagtgtggatcatgctgggctttcagtaccaccggatccctcgaaggtcaactcgccatccacaaaaatcaacgtgttcctctcagtgaacaagaattggtagactgtgacacatcaagaaatgctggttgtaacggaggtttgatgacagatgcctttaactatgttaaacgccatggtctctcttccgaatctcaatatgcatacaccggcagagatgatcgctgcaagaatggtgagaacaaaccactctcttccattagtggctacgtagaaacttgaacaaactgagatgcact

SEQ ID NO: 2 - DNA, 614 bp, Diabrotica virgifera
  unsure (1)..(614): unsure at all n locations
  Clone ID: pGUT3688
cggcacgaggaanaatcagaatgaagctgttcatccttgccgctgcccttattgtggccacaagtgccaatctaggtgccttcgaaaaatggaccagttttaaggcaacccataacaaatcttacaacgttattgaagacaaacttcgttttgctgttttccaagacaaccttaaaaaaatcgaggaacacaatgctaaatacgaaagtggagaagaaacctactacttggctgtcaacaaattcgccgattggtccagcgctgaattccaagctatgttggcccgtcagatggctaacaagcccaaacaatccttcattgcaaaacacgtagccgatcccaatgtccaagctgtagaagaagttgattggagagaaagtgccgttttggaagtcaaagatcaaggacagtgtggatcatgctgggctttcagtaccaccggatccctcgaaggtcaactcgccatccacaaaaatcaacgtgttcctctcagtgaacaagaaatggtagactgtgacacatcaagaaatgcttgttgtgacggaggtttgatgacagatgcctttaactatgttaaacgtcatggtctctctttcgaatctcaatatgcatac

SEQ ID NO: 3 - DNA, 441 bp, Diabrotica virgifera
  Clone ID: LIB149-014-Q1-E1-A5
cttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagatcaaggacagtgtggatcatgctgggctttcagtaccaccggatccctcgaaggtcaactcgccatccacaaaaatcaacgtgttcctctcagtgaacaagaattggtagactgtgacacatcaagaaatgctggttgtaacggaggtttgatgacagatgcctttaactatgttaaacgccat

SEQ ID NO: 4 - DNA, 456 bp, Diabrotica virgifera
  Clone ID: LIB149-012-Q1-E1-H8
gtccgcaaaagatggaccagttttaaggcaacccataacagatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagatcaaggacagtgtggatcatgctgggctttcagtaccaccggattcctcgaaggtcaactcgccatccacaaaaatcaacgtgttcctctcagtgaacaagaattggtagactgtgacacatcaagaaatgct

SEQ ID NO: 5 - DNA, 421 bp, Diabrotica virgifera
  Clone ID: LIB149-015-Q1-E1-G5
gaacataatgccaaatacgagaacggagaagaaacctactatcttgccgtcaatcaatttgccgattggtccagtgctgaatttaaagctttgttgaattctcaaattatcaacagaccagaactatcctttatcgaaacatacgaagcagatcccaatgttgaacttgcaagttctgttgactggagaaacaaagctgttttgggagtcaaaaatcaaggaagttgtggatcttgctgggctttcagtgccacaggtgctctcgaaggtcaacttgccattcacaaaaatcaaaaggtcccactaagtgaacaagaattggtagactgtgactcatcaaactctggttgcaatggcggtttaatgacaaatgcctttgcatatgttaagagccacggacttgcatcagaaaagcaatatg

SEQ ID NO: 6 - DNA, 433 bp, Diabrotica virgifera
  unsure (1)..(433): unsure at all n locations
  Clone ID: LIB149-026-Q1-E1-A9
attgaggaccaacttcgtttcggagttttccaagagaaccttcgcaaaatcgaagaacataataccaaatatgaaaacggagaagaaacctactatctcgccgttaatcaatttgccgattggtccaacgctgaatttaaagctatgttagactctcaaatggctcagaggccaaaactattggttgctgaaacattcgaagccgattctaatttacaagttccaacagaggttgattggaggaataaaaaggctgatttgggagttaggaaccagggaagctgtggatcctgctgggctttcagtgccgtcggagccatcgaaggtcaacttgctattcacaaaaagcaacacgttcaactaagtgaacaagaattggtagattgtgacacagtaaacgagggatgcaatggaggtttantgacagatgcct

SEQ ID NO: 7 - DNA, 405 bp, Diabrotica virgifera
  Clone ID: LIB149-022-Q1-E1-C12
acttttggattgttcctcagactacggaaatggtgactgtgaagaaggtggtcttatgaccaacgctttcgaatatatccaggacaacggaatagaatctgagtctagctatccgtacacaggcagacaaggaaactgcagacgaagcgctagcaaatctgaactgaagatcaaaggttacaaagaaccagcaaataatgaagaagctttgaggcaagctgttggtactgttggtcccatttctgcagccatttacgccgaaccaatccagttctacaacagtggtatctttaacagcaaacagtgcgtgaacaatgtcaactacttggatcacggaatcctcgtcgtaggttacggtgaagaaaacaacactccctactggattatcaagaactcatggggtgc

SEQ ID NO: 8 - DNA, 461 bp, Diabrotica virgifera
  Clone ID: pGUT3757
caacctcaaaaaatcgaggaacacaatgcttaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagatcaaggacagtgtggatcatgctgggctttcagtaccaccggatccctcgaaggtcaactcgccatccacaaaaatcaacgtgttcctctcagtgaacaagaattggtagactgtgacacatcaagaaatgctggttgtaacggaggtttgatgacagatgcctttaactatgttaaacgccatggtctctctttcgaatctcaatatgcatacacccgcagagatga

SEQ ID NO: 9 - DNA, 453 bp, Diabrotica virgifera
  Clone ID: LIB3026-011-Q1-E1-G5
cccacgcgtccgcttcgaaaaatggactagttttaaggccacccataacaaatcttacaacgttattgaagacaaacttcgtttcgctgttttccaagagaacctcaaaaaaatcgaggaacacaatgctaaatacgaaagtggagaagaaacctactatttggctgttaacaaattcgccgattggtccagcgctgaattccaagctatgttggcccgtcaaatggctaacaagccaaaacaaaccttcattggaaaacacgtagaagatcccaatgtccaagctgcagatgaagttgattggagatcaagcgctgacttgggagtcaaggatcaaggaaactgtggatcatgctgggctttcagtaccaccggattcctcgaaggtcaactcgccatccacaaaaatcaacgtgttcctctcagtgaacaagaattgggagactgtgacac

SEQ ID NO: 10 - DNA, 453 bp, Diabrotica virgifera
  unsure (1)..(453): unsure at all n locations
  Clone ID: LIB149-044-Q1-E1-F7
tcgcgggtcgacacacgcatctacccacgcgtctgaaattcgtttcggagttttccaagagaaccttcgcaaaatcgaagaacataataccaaatatgaaaacggagaagaaacctactatctcgccgttaagcaatttgccgattggtccaacgctgaatttaaagctatgttagactctcaaatggctcagaggccaaaactattggttgctgaaacattcgaagccgattctaatttacaagttccaacagaggttgattggagaaataaaaaggctgatttgggagttaggaaccagggaagctgtggatcctgctgggctttcagtgccgtcggagccatcgaaggtcaacttgctattcacaaaaagcaacacgttcaactaagtgaacaagaattggtagattgtgacacagtanacgagggatgcaatggaggttaatgacagat

SEQ ID NO: 11 - DNA, 414 bp, Diabrotica virgifera
  Clone ID: LIB149-042-Q1-E1-C10
agttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagatcaaggacagtgtggatcatgctgggctttcagtaccaccggatccctcgaaggtcaactcgccatccacaaaaatcaacgtgttcctctcagtgaacaagaattggtagactgtgacacatcaagaaatgctggttgtaacggaggtttgatgacagatgcctttaa

SEQ ID NO: 12 - DNA, 458 bp, Diabrotica virgifera
  Clone ID: pGUT3148
ctgaagctagctatccgtacgaagctatccaaggagattgcagaacaaccaatgacaaagcagtacttcatattcaaggttacaatgaagtatatccaagtgaagaagctttgagacaagctgtcggtactgttggtcccatttctgcagctatttgggctgaaccaatccagttctactcaagcggtatatatgacgacccaaattgcttgaactatgtcgaatacttggatcacggaattctcgtcgtaggttacggtgaagagaatggcacaccctactggattgtcaagaactcatggggagcaacttggggtgaagaaggttacttcaggttgaagagaaatattgcattatgtggtttggctcagatggccagttatccagttttgtaaaggtgcaatataagtaaataaaataaggtaaaatgaaaaaaaaaaaaaaaaaactcggggggg

SEQ ID NO: 13 - DNA, 393 bp, Diabrotica virgifera
  Clone ID: LIB3026-014-Q1-E1-G2
actagctatccttacgaagctgaacaaagagaatgcagacgcagttctggcaaagctgcagttaacattcaaggttacaaagaagtaacagccaatgaagaatctttaagacaagcagttggtactgttggtccaatttctgcagcaattaacgctaatcccctccaattctactcaagtggtgtttttgacggccagtgcgcaaatagcaggaatgacttggatcacggcatcctggtcgtaggttatggtgaagaaaacaacaagccttattggattatcaagaactcatggggtgcagattggggtgagcaaggttacttcagactggagagaaatgttaatatgtgcggattggatttagtgacaagttacccagttctggtaacatat

SEQ ID NO: 14 - DNA, 441 bp, Diabrotica virgifera
  Clone ID: LIB149-026-Q1-E1-C5
acccacgcgtccggaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagatcaaggacagtgtggatcatgctgggctttcagtaccaccggatccctcgaaggtcaactcgccatccacaaaaatcaacgtgttcctctcagtgaacaagaattggtagactgtgacacatcaagaaatgctggttgtaacggaagtttgatgacagatgcccttaactatgttaaaacgcatggtctctcttccgaatctcaatatgcatacaccggcagagatgatcgctgcaagaatgt

SEQ ID NO: 15 - DNA, 460 bp, Diabrotica virgifera
  Clone ID: LIB3026-012-Q1-E1-G12
atccgagaaaaaatcagaatgaagctgttcatccttgctgccctcattgtggccacaagtgccaacctaggcgcctttgaaaaatggaccagttttaaggcaacacataacaaatcctactcccttgttgaagacaaacttcgtttcgcagttttccaagaaaacttgaagaaaatcgaagaacataatgccaaatacgagaacggagaagaaacctactatcttgccgtcaatcaatttgccgattggtccagtgctgaatttaaagctttgttgaattctcaaattatcaacagaccagaactatcctttatcgaaacatacgaagcagatcccaatgttgaacttgcaagttctgttgactggagaaacaaagctgttttgggagtcaaaaatcaaggaagttgtggatcttgctgggctttcagtgccacaggtgctctcgaacgtcaacttgcca

SEQ ID NO: 16 - DNA, 422 bp, Diabrotica virgifera
  Clone ID: LIB149-045-Q1-E1-A7
acgaaaaaaaatcgaggaacacaatgctaaatacgaaagtggagaagaaacctactacttggctgttaacaaattcgccgattggtccagcgctgaattccaagctatgtgggcccgtcagatggctaacaagcccaaacaatcctttattgcaaaacacgtagccgatcccaatgtccaagctgtagaagaagttgattggagagatagtgccgttttgggagtcaaagatcaaggacagtgtggatcatgctgggctttcagtaccaccggatccctcgaaggtcaactcgccatccacaaaaatcaacgtgttcctctcagtgaacaagaattggtagactgtgacacatcaagaaatgctggttgtaaccgaggtttgatgacagatgcctttaactatgttaaacgccatgggcctc

SEQ ID NO: 17 - DNA, 408 bp, Diabrotica virgifera
  Clone ID: LIB149-041-Q1-E1-H9
gcgggtcgatacaagcctctaaagttattcagtgataacttgaagaaaatcgaagaacataatgccaaatacgagaacggagaagaaacctactatcttgccgtcaatcaatttgccgattggtccagtgctgaatttaaagctttgttgaattctcaaattatcaacagaccagaactatcctttatcgaaacatacgaagcagatcccaatgttgaacttgcaagttctgttgactggagaaacaaagctgttttgggagtcaaaaatcaaggaagttgtggatcttgctgggctttcagtgccacaggtgctctcgaaggtcaacttgccattcacaaaaatcaaaaggtcccactaagtgaacaagaattggtagactgtgactcatcaaactctggttgcaat

SEQ ID NO: 18 - DNA, 401 bp, Diabrotica virgifera
  Clone ID: LIB3026-028-Q1-E1-F9
aggaaaaatggaccagttttaaggcaacacataacaaatcctactcccttgttgaagacaaacttcgtttcgcagttttccaagaaaacttgaagaaaatcgaagaacataatgccaaatacgagaacggagaagaaacctactatcttgccgtcaatcaatttgccgattggtccagtgctgaatttaaagctttgttgaattctcaaattatcaacagaccagaactatcctttatcgaaacatacgaagcagatcccaatgttgaacttgcaagttctgttgactggagaaacaaagctgttttgggagtcaaaaatcaaggaagttgtggatcttgctgggctttcagtgccacaggtgctctcgaaggtcaacttgccattcacaaaaatcaaaag

SEQ ID NO: 19 - DNA, 414 bp, Diabrotica virgifera
  Clone ID: LIB149-010-Q1-E1-G6
caaacttcgttttgctgttttccaagagaatctccgcaaaatcgacgcacacaatgctaaatacgaaaagggagaagaaacctactacatggctgttaacaaattcgccgattggtccagcgcagaattccaagccatgttggaccgtcagatggctaacaagccaaaacaatccttcattgcaaaacacgtagtcgatcccaatgtccaagctgtagaagaagttgattggagagaaagtgctgttttgggagtcaaagatcaaggacagtgtggatcatgctgggctttcagtaccaccggatccctcgaaggtcaactcgccatccacaaaaatcaacgtgttcctctcagtgaacaagaattggtagactgtgataaggtaaacgatggttgtgacggaggtttgatgac

SEQ ID NO: 20 - DNA, 398 bp, Diabrotica virgifera
  unsure (1)..(398): unsure at all n locations
  Clone ID: LIB149-039-Q1-E1-D1
ttgaagatcatcgaagaacataatgccaaatacgagaacggagaagaaacctactatcttgccgtcaatcaatttgccgattggtccagtgctgaatttaaagctttgttgaattctcaaattatcaacagaccagaactatcctttatcgaaacatacgaagcagatcccaatgttgaacttgcaagttctgttgactggagaaacaaagctgttttgggagtcaaaaatcaaggaagttgtggatcttgctgggctttcagtgccacaggtgctctcgaaggtcaacttgccattcacaaaaatcaaaaggtcncactaagtgaacaagaattggtagactgtgactcatcaaactctggttgcaatggcggtttaatgacaaatgcctttgcata

SEQ ID NO: 21 - DNA, 456 bp, Diabrotica virgifera
  Clone ID: pGUT2484
caaccaatgacaaagcagtacttcatattcaaggttacaatgaagtatatccaagtgaagaagctttgagacaagctgtcggtactgttggtcccatttctgcagctatttgggctgaaccaatccagttctactcaagcggtatatatgacgacccaaattgcttgaactatgtcgaatacttggatcacggaattctcgtcgtaggttacggtgaagagaatggcacaccctactggattgtcaagaactcatggggagcaacttggggtgaagaaggttacttcaggttgaagagaaatattgcattatgtggtttggctcagatggccagttatccagttttgtaaaggtgcaatataagtaaataaaataaggtaaaatggaaaaaaaaatataaaaaaaaaaaatctgggggggggccccggtcccaatttccccttatggggggccgtt

SEQ ID NO: 22 - DNA, 461 bp, Diabrotica virgifera
  Clone ID: LIB149-016-Q1-E1-G12
tagaaaaaatctactaattggctgttaacaaattcgccgattggtccagcgctgaattccaagctatgttggcccgtcaaatggctaacaagccaaaacaaaccttcattggaaaacacgtagaagatcccaatgtccaagctgcagatgaagttgattggagatcaagcgctgacttgggagtcaaggatcaaggaaactgtggatcatgctgggctttcagtaccaccggatccctcgaaggtcaactcgccatccacaaaaatcaacgtgttcctctcagtgaacaagaattggtagactgtgacacagtaaatgctggttgtgacggaggtttgatgacagatgcctttaactatgttaaaggccatggtctctcttccgaatctcaatatgcatacaccggcagagatggtcgctgcaagaatgttcagaacaaacaagtcccttccatcagtggc

SEQ ID NO: 23 - DNA, 444 bp, Diabrotica virgifera
  Clone ID: LIB149-016-Q1-E1-D12
tacattcagtcgaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagatcaaggacagtgtggatcatgctgggctttcagtaccaccgg

SEQ ID NO: 24 - DNA, 436 bp, Diabrotica virgifera
  Clone ID: LIB3026-017-Q1-E1-G2
attcagaagaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagatcaaggacagtgtggatcatgctgggctttcagtacc

SEQ ID NO: 25 - DNA, 441 bp, Diabrotica virgifera
  Clone ID: LIB149-016-Q1-E1-F10
cccaagcgtccggaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagatcaaggacagtgtggatcatgctgggctttcagtacca

SEQ ID NO: 26 - DNA, 442 bp, Diabrotica virgifera
  Clone ID: LIB149-009-Q1-E1-C3
cattcagaagaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagatcaaggacagtgtggatcatgctgggctttcagtaccaccgg

SEQ ID NO: 27 - DNA, 408 bp, Diabrotica virgifera
  Clone ID: LIB149-031-Q1-E1-H11
agaacaattatgatcactgggtctccttcaaggctaaacattcaaaacaatacaaactactagaagataaactaagattccaaattttccaagaaaaccttcgcgaaatcgaagagcacaacgcaagatacgccaaaggagaggtgggttggttcaagggggtcactaaattcgccgattggaccaaagaagaattcgaggctctattaaaacgccagtctgcttcaaaacccaaacttgacaagagtttgggagtgtatactgccgatccaaacgttaaggtgccttcgtctgttgattggaggaccgagaatgcagtactgcctgtaagggaccaaggatcctgtgggtcgtgttgggcattcagtagcgttggagctctagagggacaactagcaatcaactaca

SEQ ID NO: 28 - DNA, 415 bp, Diabrotica virgifera
  Clone ID: LIB149-003-Q1-E1-H4
gcgtccagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagatcaaggacagtgtggatcatgctgggctttcagtaccaccggatccctcgaaggtcaactcgccatccacaaaaatcaacgtgttcctctcagtgaacaagaattggtagactgtgacacatcaagaaatgctggttgtaacggaagtttgatgacagatgcctttaactatgttaaacgccatggtctctcttccgaatctcaatatgcatacaccggc

SEQ ID NO: 29 - DNA, 437 bp, Diabrotica virgifera
  Clone ID: LIB149-044-Q1-E1-G9
ggtcgatacaagcctctacaataaatcgtctaattttaagaccacccataacaaatcttacaacgttattgaagacaaacttcgtttcgctgttttccaagagaacctaaaaaaaatcgaggaacagaatgctaaatacgaaaatggagaagaaacctactatttggctgttaacaaattcgccgattggtccagcgctgaattccaagctatgttggcccgtcaaatggctaacaagccaaaacaaaccttcattggaaaacacgtagaagatcccaatgtccaagctgcagatgaagttgattggagatcaagcgctgacttgggagtcaaggatcaaggaaactgtggatcatgctgggctttcagtaccaccggatccctcgaaggtcaactcgccatccacaaaaatcaacgtgttcctctcagtgaacaag

SEQ ID NO: 30 - DNA, 419 bp, Diabrotica virgifera
  Clone ID: LIB3026-009-Q1-E1-G12
attcctttgagtcctcaatatcttgtcgactgttctgaggaaaacgatggatgtggtggtggagaccaaaggttagctttcagatttcttaaacataaccgtatgccctccgaagaggattatccatatactatgaaagatgatgtttgccgagaagatgtcaaaatgtcgctcggtcccatctcgggatacacacatctgaatgcaacggaagaatctttaatttcagctctcgctaccgttggcccaatcgctgtttccgctgatgcaactaaatggtcattatatggaggaggagtttttgatgacgaagaatgtggaaaaaatataaaccatgccatacttgctacaggttacactgatgagtacattgttatcaaaaattcatggggagcagattggggtgaagatggatacat

SEQ ID NO: 31 - DNA, 418 bp, Diabrotica virgifera
  Clone ID: LIB149-030-Q1-E1-A6
cgggccgacccaagcgtcagcccacgcgtccggaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagatcaaggacagtgtggatcatgctgggctttcagtaccaccggatccctcgaaggtcaactcgccatcca

SEQ ID NO: 32 - DNA, 395 bp, Diabrotica virgifera
  Clone ID: LIB149-022-Q1-E1-B1
aaaatcgaggaacacaatgctaaatacgaaagtggagaagaaacctactatttggctgttaacaaattcgccgattggtctagcgctgaattccaagctatgttggcccgtcaaatggctaacaagccaacacaaaccttcattggaaaacacgtagaggatcccaatgtccaagctgcagatgaagttgattggagatcaagcgctgacttgggagtaaaggatcaaggaagctgtggatcatgctgggctttcagtaccaccggatccctcgaaggtcaactcgccatccacaaaaatcaacgtgttcctctcagtgaacaagaattggtagactgtgacacagtaaatgctggttgtgacggaggtttgatgacagatgcctttaactatgt

SEQ ID NO: 33 - DNA, 396 bp, Diabrotica virgifera
  Clone ID: LIB149-023-Q1-E1-H8
acgcaaatgccaaactatctgcattcgaacactggagcagttttaaggcaacacataataaatcttacaacgttattgaggaacaacttcgtttcggagttttccaagagaaccttcgcaaaatcgaagaacataataccaaatatgaaaacggagaagaaacctactatctcgccgttaatcaatttgccgattggtccaacgctgaatttaaagctatgttagactctcaaatggctcagaggccaaaactattggttgctgaaacattcgaagccgattctaatttacaagttccaacagaggttgattggaggaataaaaaggctgatttgggagttaggaaccagggaagctgtggatcctgctgggctttcagtgccgtcggagccatcg

SEQ ID NO: 34 - DNA, 420 bp, Diabrotica virgifera
  Clone ID: LIB149-042-Q1-E1-C12
agaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagatcaaggacagtgtggatcatgctgggct

SEQ ID NO: 35 - DNA, 425 bp, Diabrotica virgifera
  unsure (1)..(425): unsure at all n locations
  Clone ID: LIB149-049-Q1-E1-B2
agaaaaatcagaatgaagctgttcatccttgccgctgcccttattgtggccacaagtgccaatctaagtgccttcganaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgattccaatgtccaagctgtagaagaagttgattggagagatagtgccgttttgggagtcaaagatcaaggacagtgtggatcatgctgggctttcag

SEQ ID NO: 36 - DNA, 439 bp, Diabrotica virgifera
  unsure (1)..(439): unsure at all n locations
  Clone ID: LIB149-049-Q1-E1-G7
agttctttcagaagaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatngtcaagctgtagaagaagttgattggagagatagtgccgttttgggagtcaaagatcaaggacagtgtggatcatgctgggctttcagta

SEQ ID NO: 37 - DNA, 409 bp, Diabrotica virgifera
  Clone ID: LIB149-036-Q1-E1-E10
tgagtcgtattaattttccaagaaaacttgaagaaattcgaagaacataatgacaaatacgagaacggagatgaaacctactatcttgccgtcaatcaatttgccgattggtccagtgctgaatttaaagctttgttgaattcacaaattatcaacagaccagaactatcctttatcgaaacatacgaagcatatcccaatgttgaacttgcagattctgttgactggagaaacatagctgttttgggagtcaaaagtcaaggaagttgtggatattgctgggctttcagtgccataggtgcactcgaaggtcaacttgccattcacaagaatcaaaaggtcccactaagtgaacaagagttggtagactgtgactcatcaaactctggttgcaatggcggtttaaaga

SEQ ID NO: 38 - DNA, 406 bp, Diabrotica virgifera
  Clone ID: LIB3026-027-Q1-E1-H9
agattgaggaacagcttcgtttcggagttttccaagagaaccttcgcaaaatcgaagaacataataccaaatatgaaaacggagaagaaacctactatctcgccgttaatcaatttgccgattggtccaacgctgaatttaaagctatgttagactctcaaatggctcagaggccaaaactattggttgctgaaacattcgaagccgattctaatttacaagttccaaacagaggttgattggaggaataaaaaggctgatttgggagttaggaaccagggaagctgtggatcctgctgggctttcagtgccgtcggagccatcgaaggtcaacttgctattcacaaaaagcaacacgttcaactaagtgaacaagaattggtagattgtgacacagtaaacgagg

SEQ ID NO: 39 - DNA, 419 bp, Diabrotica virgifera
  Clone ID: LIB149-042-Q1-E1-D9
agaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagatcaaggacagtgtggatcatgctgggc

SEQ ID NO: 40 - DNA, 426 bp, Diabrotica virgifera
  Clone ID: LIB149-011-Q1-E1-E5
aaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagatcaacgacagtgtggatcatgctgggctttcagta

SEQ ID NO: 41 - DNA, 438 bp, Diabrotica virgifera
  Clone ID: LIB149-009-Q1-E1-F3
cagacgcgtgagcggacgcgtgggttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagatcaaggacagtgtggatcatgctgggctttcagtaccaccgga

SEQ ID NO: 42 - DNA, 402 bp, Diabrotica virgifera
  Clone ID: LIB149-029-Q1-E1-A10
agcccacgcgtccgaacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagatcaaggacagtgtggatcatgctgggctttcagtaccaccggattcctcgaaggtcaactcgccatccacaaaaatcaacgtgttcctctcagtgaacaag

SEQ ID NO: 43 - DNA, 457 bp, Diabrotica virgifera
  Clone ID: LIB149-016-Q1-E1-C12
cccacgcgtccggttctttcagaagaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagatcaaggacagtgttgatcatgctgggctttcagttacaccgg

SEQ ID NO: 44 - DNA, 430 bp, Diabrotica virgifera
  Clone ID: LIB149-009-Q1-E1-E7
tatcagaagaaaaatcagaatgaagctgttcatccttgctgctgccctcattgtagccacaagtgccaatctaggtgccttcgaaaaatggactagttttaaggccacccataacaaatcttacaacgttattgaagacaaacttcgtttcgctgttttccaagagaacctcaaaaaaatcgaggaacacaatgctaaatacgaaagtggagaagaaacctactatttggctgttaacaaattcgccgattggtccagcgctgaattccaagctatgttggcccgtcaaatggctaacaagccaaaacaaaccttcattggaaaacacgtagaagatcccaatgtccaagctgcagatgaagttgattggagatcaagcgctgacttgggagtcaaggatcaaggaaactgtggatcatgctgggctttc

SEQ ID NO: 45 - DNA, 436 bp, Diabrotica virgifera
  Clone ID: LIB149-008-Q1-E1-H6
cccacgcgtccgaagaaaaatcagaatgaagctgttcatccttgctgctgccctcattgtggccacaagtgccaatctaggtgccttcgaaaaatggaccagttttaaggcaacccataacaaatcttacaacgttattgaagacaaacttcgtttcgctgttttccaagagaacctcaaaaaaatcgaggaacacaatgctaaatacgaaagtggagaagaaacctactatttggctgttaacaaattcgccgattggtctagcgctgaattccaagctatgttggcccgtcaaatggctaacaagccaacacaaaccttcattggaaaacacgtagaggatcccaatgtccaagctgcagatgaagttgattggagatcaagcgctgacttgggagtaaaggatcaaggaagctgtggatcatgctgggctttc

SEQ ID NO: 46 - DNA, 436 bp, Diabrotica virgifera
  Clone ID: LIB149-014-Q1-E1-C5
cccacgcgtccggaaaaatcagaatgaagctgttcatccttgctgctgccctcattgtagccacaagtgccaatctaggtgccttcgaaaaatggactagttttaaggccacccataacaaatcttacaacgttattgaagacaaacttcgtttcgctgttttccaagagaacctcaaaaaaatcgaggaacacaatgctaaatacgaaagtggagaagaaacctactatttggctgttaacaaattcgccgattggtccagcgctgaattccaagctatgttggcccgtcaaatggctaacaagccaaaacaaaccttcattggaaaacacgtagaagatcccaatgtccaagctgcagatgaagttgattggagatcaagcgctgacttgggagtcaaggatcaaggaaactgtggatcatgctgggctttcag

SEQ ID NO: 47 - DNA, 429 bp, Diabrotica virgifera
  Clone ID: LIB149-008-Q1-E1-D3
ctttcagaagaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgattccaatgtccaagctgtagaagaagttgattggagagatagtgccgtcttgggagtcaaagatcaaagacagtgtggatcatgctgggctt

SEQ ID NO: 48 - DNA, 442 bp, Diabrotica virgifera
  Clone ID: LIB149-029-Q1-E1-D7
aacccacgcgtccgcccacgcgtccggaatgaagctgttgatcattgctgctgccctcattgtggccgcaaatgccaaactatctgcattcgaacactggagcagttttaaggcaacacataataaatcttacaacgttattgaggaacagcttcgtttcggagttttccaagagaaccttcgcaaaatcgaagaacataataccaaatatgaaaacggagaagaaacctactatctcgccgttaatcaatttgccgattggtccaacgctgaatttaaagctatgttagactctcaaatggctcagaggccaaaactattggttgctgaaacattcgaagccgattctaatttacaagttccaacagaggttgattggaggaataaaaaggctgatttgggagttaggaaccagggaagctgtggatcctgctgggctttc

SEQ ID NO: 49 - DNA, 425 bp, Diabrotica virgifera
  unsure (1)..(425): unsure at all n locations
  Clone ID: LIB149-036-Q1-E1-E8
ctcgcggctcgacacaagcgtcaacagtcttccttacgcagttttccaagaaaacttgaagaaaatcgaagaacataatgccaaatacgagaacggagatgaaacctactatcttgccgtcaatcaatttgccgattggtccagtgctgaatttaaagctttgttgaattctcaaattatcaacagaccagaactatcctttatcgaaacatacgaagcagatcccaatgttgaacttgcaagttctgttgactggagaaacagagctgttttgggagtcaaaaatcaacgaagttgtggatcntgctgggctttcagtgccacaggtgctctcgaaggtcaacttgccattcacaagattcaaaaggtcccactaagtgaacaagaattggtagactgtgactcatcaaactctggtttgcaat

SEQ ID NO: 50 - DNA, 414 bp, Diabrotica virgifera
  Clone ID: LIB149-005-Q1-E1-H7
agccttgctgctgccctcattgtagccacaagtgccaatctaggtgccttcgaaaaatggactagttttaaggccacccataacaaatcttacaacgttattgaagacaaacttcgtttcgctgttttccaagagaacctcaaaaaaatcgaggaacacaatgctaaatacgaaagtggagaagaaacctactatttggctgttaacaaattcgccgattggtccagcgctgaattccaagctatgttggcccgtcaaatggctaacaagccaaaacaaaccttcattggaaaacacgtagaagatcccaatgtccaagctgcagatgaagttgattggagatcaagcgctgacttgggagtcaaggatcaaggaaactgtggatcatgctgggctttcagtacaacgggttcc

SEQ ID NO: 51 - DNA, 432 bp, Diabrotica virgifera
  Clone ID: LIB149-044-Q1-E1-E9
ctctaaagtaagtcgtattaagctgttcatccttgctgccctcattgtggccacaagtgccaacctaggcgcctttgaaaaatggaccagttttaaggcaacacataacaaatgcgacgcccttgttgaagacaaacttcgtttcgcagttttccaagaaaacttgaagaaaatcgaagaacataatgccaaatacgagaacggagaagaaacctactatcttgccgtcaatcaatttgccgattggtccagtgctgaatttaaagctttgttgaattctcaaattatcaacagaccagaactatcctttatcgaaacatacgaagcagatcccaatgttgaacttgcaagttctgttgactggagaaacaaagctgttttgggagtcaaaaatcaaggaagttgtggatcttgctgggctttcagtgccac

SEQ ID NO: 52 - DNA, 443 bp, Diabrotica virgifera
  unsure (1)..(443): unsure at all n locations
  Clone ID: LIB149-029-Q1-E1-G3
agaaaaatcagaatgaagctgttgatcattgctgctgccctcattgtggccgcaaatgccaaactatctgcattcgaacactggagcagttttaaggcaacacataataaatcttacaacgttattgaggaacaacttcgtttcggagttttccaagagaaccttcgcaaaatcgaagaacataataccaaatatgaaaacggagaagaaacctactatctcgccgttaatcaatttgccgattggtccaacgctgaatttaaagctatgttagactctcaaatggctcagangccaaaactattggttgctgaaacattcgaagccgattctaatttacaagttccaacagangttgattggaggaataaaaaggctgatttgggagttangaaccagggaagctgtggatcctgctgggctttcagtgccgtcggagccat

SEQ ID NO: 53 - DNA, 457 bp, Diabrotica virgifera
  Clone ID: LIB149-010-Q1-E1-F12
agctcaaaatgaagctgttaattctagccgccaccctcattgtggccataaatgccaatttatctgcctttgagcaatggaccagttttaaggcaacacacaacaaattttacaacgttattgaggacaaacttcgttttgctgttttccaagagaatctccgcaaaatcgacgcacacaatgctaaatacgaaaagggagaagaaacctactacatggctgttaacaaattcgccgattggtccagcgcagaattccaagccatgttggaccgtcagatggctaacaagccaaaacaatccttcattgcaaaacacgtagtcgatcccaatgtccaagctgtagaagaagttgattggagagaaagtgctgttttgggagtcaaagatcaaggacagtgtggatcatgctgggctttcagtaccaccggatccctcgaaggtcaactcgccatcca

SEQ ID NO: 54 - DNA, 412 bp, Diabrotica virgifera
  Clone ID: LIB149-004-Q1-E1-H4
cgacgcacgcgtcagcacacgcgtccgcaaacttcgtttcgctgttttcaaggacacctccaaaaaatccaaggaacacaatgctaaatacgaaagtggagaagaaccctactacttggctgtaaacaaattcgccgattggtccagcgctgaattccaagctatgttggcccgtcagatggctaacaagcccaaacaatcctttattgcaaaacacgtacccgatcccaatgtccaagctgtagaagaagttgattggagagatagtgccgttttgggagtcaaagatcaaggacagtgtggatcatgctgggctttcagtaccaccggatccctcgaaggtcaactcgccatccacaaaaatcaacgtgttcctcccagtgaacaagaattgggacactgtgacacatca

SEQ ID NO: 55 - DNA, 419 bp, Diabrotica virgifera
  Clone ID: LIB149-036-Q1-E1-A12
cgcgggtcgatacaagactctacagggagtcgtagaaaaagaagaatgggtgcaatttaaggttaaaaataacaaaagttacagaagctatgttgaagaacaaacacgattcagaatttttcaagaaaatctgagaaaaatcgaaaatcacaatgaaaaatataacaatggagagtctacttttaagtttggtgttaccaaatttgcagacctaactgaaaaagaatttctggacctgttggtgctatctaaaaatgcaaggcctaatagaactcatgctacacatttgctagccccactaagagatctaccatcagcattagattggagagacaagggagctgtaactgaggtaaaagatcaaggaatgtgtggctcttgttggacctttagtacaactgggtcagtagaaagagctc

SEQ ID NO: 56 - DNA, 424 bp, Diabrotica virgifera
  Clone ID: LIB149-033-Q1-E1-G1
tactttcagtcgaaatatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagatcaaggacagtgtggatcatgc

SEQ ID NO: 57 - DNA, 360 bp, Diabrotica virgifera
  Clone ID: LIB149-034-Q1-E1-A1
acgaaaaatggaccaattttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagatcaaggacagtgtggatcatgctggggcttcagtaccaccg

SEQ ID NO: 58 - DNA, 422 bp, Diabrotica virgifera
  Clone ID: LIB149-013-Q1-E1-C9
agaaaatcagaatgaagctgttcatccttgctgctgccctcattgtagccacaagtgccaatctaggtgccttcgaaaaatggactagttttaaggccacccataacaaatcttacaacgttattgaagacaaacttcgtttcgctgttttccaagagaacctcaaaaaaatcgaggaacacaatgctaaatacgaaagtggagaagaaacctactatttggctgttaacaaattcgccgattggtccagcgctgaattccaagctatgttggcccgtcaaatggctaacaagccaaaacaaaccttcattggaaaacacgtagaagatcccaatgtccaagctgcagatgaagttgattggagatcaaacgctgacttgggagtcaaggattaaggaaactgtggatcatgctgggctttc

SEQ ID NO: 59 - DNA, 398 bp, Diabrotica virgifera
  Clone ID: LIB149-024-Q1-E1-B9
aagtccacttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagatcaaggacagtgtggatcatgctggg

SEQ ID NO: 60 - DNA, 401 bp, Diabrotica virgifera
  Clone ID: LIB3026-019-Q1-E1-H1
aagttcaaccttgccgctgcccttattgtggccacaagtgccaatctaggtgccttcgaaaaatggaccagttttaaggcaacccatatcaaatcttacaacgttattgaagacaaacttcgattcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatactgccgttttgggagtcaaagatcaaggacagtgtggatcatgctgggc

SEQ ID NO: 61 - DNA, 402 bp, Diabrotica virgifera
  Clone ID: LIB149-023-Q1-E1-H5
agtcaactcgccatccacaaaaatcaacgtgttcctctcagtgaacaagaattggtagactgtgacacatcaagaaatgctggttgtaacggaggtttgatgacagatgcctttaactatgttaaacgccatggtctctcttccgaatctcaatatgcatacaccggcagagatgatcgctgcaagaatgttgagaacaaaccactctcttccattagtggctacgtagaacttgaaacaactgaagatgcactcgcgtccgctgttgctagcgtaggtccagtttccatcgctgttgatgctgatacatggcaattatacggaggtggacttttcaacaacaaaaactgtagaaccaacctcaatcacggtgttcttgctgttggatacactaaagatgca

SEQ ID NO: 62 - DNA, 446 bp, Diabrotica virgifera
  Clone ID: LIB3026-012-Q1-E1-E2
ctccggaaaaatcagaatgaagctgttgatcattgctgctgccctcattgtggccgcaaatgccaaactatctgcattcgaacactggagcagttttaaggcaacacataataaatcttacaacgttattgaggaacagcttcgtttcggagttttccaagagaaccttcgcaaaatcgaagaacataataccaaatatgaaaacggagaagaaacctactatctcgccgttaatcaatttgccgattggtccaacgctgaatttaaagctatgttagactctcaaatggctcagaggccaaaactattggttgctgaaacattcgaagccgattctaatttacaagttccaacagaggttgattggaggaataaaaaggctgatttgggagttatagaacaaggaagctgtggattctgctgggctttcagtgccgtcggagcca

SEQ ID NO: 63 - DNA, 426 bp, Diabrotica virgifera
  Clone ID: LIB149-031-Q1-E1-B8
aattctttcagaagaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggcgaataaacctactacttggctgttaacaaattcgccgattggtccagcgctgaattccaagctatgttggcccgtcagatggctaacaagcccaaacaatcctttattgcaaaacacgtatccgatcccaatgtccaagctgtagaagaagttgattggagagatagtgccgttttgggagtcaaagatcaaggacagtgtggatcatgc

SEQ ID NO: 64 - DNA, 413 bp, Diabrotica virgifera
  Clone ID: LIB149-022-Q1-E1-A7
agaattttgtgatcaagagtaaggcgaaacattcgaaacaatacagaatcacagaagataaactgagattccaaatcttccaaaaaaaccttcgagaaatcgaagagcacaacgcaagatacgccaaaggagaggtgggatggttcaagggtgtcactccatttgccgattggaccaaagaagagttcaaggctctactaacacgccaggctacttcaaagcccaagcttacttatcgccaatcgtgtatcgccgattccaatgttactttaccattatttgttgattggaggtttaaagacgcagtactacctgtaagagaccagggtcaatgtggatcgtgctgggcctttagtgtcgtcggagccctggagggacaggtagcaattcaccaaaaccaaagagttcctctg

SEQ ID NO: 65 - DNA, 447 bp, Diabrotica virgifera
  Clone ID: LIB149-009-Q1-E1-F2
cgagtccacacacgcctccgcacacacgtctgcccacgcgtccggttcatccttgctgctgccctcattgtagccacaagtgccaatctaggtgccttcgaaaaatggactagttttaaggccacccataacaaatcttacaacgttattgaagacaaacttcgtttcgctgttttccaagagaacctcaaaaaaatcgaggaacacaatgctaaatacgaaagtggagaagaaacctactatttggctgttaacaaattcgccgattggtccagcgctgaattccaagctatgttggcccgtcaaatggctaacaagccataacaaaccttcattggaaaacacgtagaagatcccaatgtccaagctgcagatgaagttgattggagatcaagcgctgacttgggagtcaacgatcaaggaaactgtggatcatgctgggctttc

SEQ ID NO: 66 - DNA, 424 bp, Diabrotica virgifera
  Clone ID: LIB149-012-Q1-E1-B2
aggaaaattcagattgaaccggtcaacccttgcggcggcccttatggtggcaacaattgcaaaccaaggtgccttcgaaaaatggacaatttttaaggcaacccataacaaatcttacaacgttattgaagacaaacttcgtttcgctgttttccaagacaacctcataaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagatcaaggacagtgtggatcatgctgggctttc

SEQ ID NO: 67 - DNA, 416 bp, Diabrotica virgifera
  Clone ID: LIB149-004-Q1-E1-D8
atcaggaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagatcaaggacagtgtggatcat

SEQ ID NO: 68 - DNA, 420 bp, Diabrotica virgifera
  unsure (1)..(420): unsure at all n locations
  Clone ID: LIB149-043-Q1-E1-D10
gaaaaatcagaatgaagctgttcatccttgctgctgccctcattgtagccacaagtgccaatctaggtgccttcgaaaaatggactagttttaaggccacccataacaaatcttacaacgttattgaagacaaacttcgtttcgctgttttccaagagaacctcaaaaaaatcgaggaacacaatgctaaatacgaaagtggagaagaaacctactatttggctgttaacaaattcgccgattggtccagcgctgaattccaagctatgttgggccgtcaaatggctaacaggcaaaacaanaccttcattggaaaacacgtaaaagatcccaatgtccaagctgcaaatgaatttgattggagataaaccgctgacttgggattcaaggatcaaggaaactgtggatcatgctgggctt

SEQ ID NO: 69 - DNA, 425 bp, Diabrotica virgifera
  Clone ID: LIB149-031-Q1-E1-A5
ccgggccgacccacgagtcaagaaaaatcagaatgaagctgttcatccttgctgccctcattgtggccacaagtgccaacctaggcgcctttgaaaaatggaccagttttaaggcaacacataacaaatcctactcccttgttgaagacaaacttcgtttcgcagttttccaagaaaacttgaagaaaatcgaagaacataatgccaaatacgagaacggagaagaaacctactatcttgccgtcaatcaatttgccgattggtccagtgctgaatttaaagctttgttgaattctcaaattatcaacagaccagaactatcctttatcgaaacatacgaagcagatcccaatgttgaacttgcaagttctgttgactggagaaacaaagctgttttgggagtcaaaaatcaaggaagttgtgga

SEQ ID NO: 70 - DNA, 421 bp, Diabrotica virgifera
  Clone ID: LIB149-031-Q1-E1-C8
agtcactttcagaagaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgattccaatgtccaagctgtagaaaaagttgattggagagatagtgccgttttgggagtcaaagatcaaggacagtgtgga

SEQ ID NO: 71 - DNA, 402 bp, Diabrotica virgifera
  Clone ID: LIB149-046-Q1-E1-F3
acgacttgcggccgccctcattgtgaccacaagtgccaatctaggtgccttcgaaaaatggaccagttttaaggcaacccataacaaatcttacaacgttattgaagacaaacgtcgtttcgctgttttccaagagaacctcaaaaaaatcgaggaacacaatgctaaatacgaaagtggagaagaaacctactatttggctgttaacaaattcgccgattggtctagcgctgaattccaagctatgttggcccgtcaaatggctaacaagccaacacaaaccttcattggaaaacacgtagaggatcccaatgtccaagctgcagatgaagttgattggagatcaagcgctgacttgggagtaaaggatcaaggaagctgtggatcatgctgggctttcag

SEQ ID NO: 72 - DNA, 395 bp, Diabrotica virgifera
  unsure (1)..(395): unsure at all n locations
  Clone ID: LIB3026-003-Q1-E1-C2
atcgaagaccacggaatcgaatctgaatctagctatccttacgaagctgaacaaagagaatgcagacgcagttctggcaaagctgcagttaacattcaaggttacaaagaagtagcagccaatgaagaatctttaagacaagcagttggtactgttggtccaatttctgcagcaattaacgctaacgcgatccagttctactcaagtggcgtgtttgacggcgagtgcgcaaataccgggagtgacgtggatcacggcatcctggtcgtaggttatggtggaagaaacaacagccttattggatcatcangaactcatggggtgcagattggggtgagcaaggttacttcagactggagagaaatgttaatatgtgcggattggatttagtgaca

SEQ ID NO: 73 - DNA, 422 bp, Diabrotica virgifera
  Clone ID: LIB149-007-Q1-E1-G11
gaaaaatcagaatgaagctgttcatccttgctgctgccctcaatgtggccaaaagttccaatccaagtgccttccaaaaatgggccaattttaaaggaacccataacaaatcctacaacgttaatgaagacaaacttcgtttcgctgttttccaagagaacctcaaaaaaatcgaggaacacaatgctaaatacgaaagtggagaagaaacctactatttggctgttaacaaattctccgattggtctaacgctgaattccaagctatgttgggccgtcaaatggctaacaagccaacacaaaccttcattggaaaacacgtagaagatcccaatgtccaagctgcagatgaagttgattggagatcaaacgctgacttgggagtaaaggatcaaggaagctgtggattatgccgggctttc

SEQ ID NO: 74 - DNA, 398 bp, Diabrotica virgifera
  Clone ID: LIB149-037-Q1-E1-A1
tgagtcgtattaaactactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagatcaaggacagtgtggatcatgctgggctttcagtaccaccggattcctcgaaggtcaactcgccatccacaaaaatcaacgtgttcctctcagtgaacaagaattggtagactgtgacacatcaagaaatgctggttgtaacggaggtttgatgacagatgcctttaactaggttaaacgccatgggctcgcctccgaatctca

SEQ ID NO: 75 - DNA, 406 bp, Diabrotica virgifera
  Clone ID: LIB149-004-Q1-E1-G9
aagaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgattccaatgtccaagctgtagaagaagttgattggagagatagtgccgttttggaagtcaaagatcaaggacagtgt

SEQ ID NO: 76 - DNA, 411 bp, Diabrotica virgifera
  Clone ID: LIB3026-008-Q1-E1-G4
ttcagaagaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgattccaatgtccaagctgtagaagaagttgattggagagatagtgccgttttgggagtcaaagatcaaggacagtgt

SEQ ID NO: 77 - DNA, 416 bp, Diabrotica virgifera
  Clone ID: LIB149-028-Q1-E1-D10
gttctttcagaagaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagatcaaggacagtgt

SEQ ID NO: 78 - DNA, 450 bp, Diabrotica virgifera
  Clone ID: LIB149-016-Q1-E1-B9
cccacgcgtccgcccacgcgtccgcccacgcgtccgctttcagaagaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagatcaaggacagtgtg

SEQ ID NO: 79 - DNA, 409 bp, Diabrotica virgifera
  Clone ID: LIB149-020-Q1-E1-B12
aggaaaaatcagaatgaagctgttcatccttgctgctgccctcattgtggccacaagtgccaatctaggtgccttcgaaaaatggaccagttttaaggcaacccataacaaatcttacaacgttattgaagacaaacttcgtttcgctgttttccaagagaacctcaaaaaaatcgaggaacacaatgctaaatacgaaagtggagaagaaacctactatttggctgttaacaaattcgccgattggtctagcgctgaattccaagctatgttggcccgtcaaatggctaacaagccaacacaaaccttcattggaaaacacgtagaggatcccaatgtccaagctgcagatgaagttgattggagatcaagcgctgacttgggagtaaaggatcaaggaagctgtgga

SEQ ID NO: 80 - DNA, 456 bp, Diabrotica virgifera
  Clone ID: LIB149-036-Q1-E1-F12
ctcgcgggtcgacacaagactctacattcagtcgtaatatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagattcaagacagtgttgatcatgcggggctttca

SEQ ID NO: 81 - DNA, 417 bp, Diabrotica virgifera
  Clone ID: LIB3026-026-Q1-E1-E7
acccacgcgtccgcggacgcgtgggtgggcattcagtagcgttggagctctagagggacaactagcaatcaactacaaccaaagagttcctttgagtcctcaatatcttgtcgactgttctgaggaaaacaatggatgtggtggtggagaccaaaggttagctttcaggtttcttaaacataaccgtatgccctccgaagaggattatccatatactatgaaagatgatgtttgccgagaagatgtcaaaatgtctctcggtcccatctcgggatacacacatctgaatgcaacggaagaatctttaatttcagctctcgctaccgttggcccaatcgctgtttccgctgatgcaactaaatggtcattatatggaggaggagtttttgatgacgaagaatgtggaaaaaatataaa

SEQ ID NO: 82 - DNA, 448 bp, Diabrotica virgifera
  Clone ID: LIB149-014-Q1-E1-E9
cccacgcgtccgcggacgcgtggggaaaactcaaaatgaagctgttaattctagccgccaccctcattgtggccataaatgccaatttatctgcctttgagcaatggaccagttttaaggcaacacacaacaaattttacaacgttattgaggacaaacttcgttttgctgttttccaagagaatctccgcaaaatcgacgcacacaatgctaaatacgaaaagggagaagaaacctactacatggctgttaacaaattcgccgattggtccagcgcagaattccaagccatgttggaccgtcagatggctaacaagccaaaacaatccttcattgcaaaacacgtagtcgattccaatgtccaagctgtagaagaagttgattggagagaaagtgctgttttgggagtcaaagatcaaggacagtgtggatcatgctgggctttcag

SEQ ID NO: 83 - DNA, 415 bp, Diabrotica virgifera
  Clone ID: LIB149-025-Q1-E1-B2
ctcaaaatgaagctgttaattctagccgccaccctcattgtggccataaatgccaatttatctgcctttgagcaatggaccagttttaaggcaacacacaacaaattttacaacgttattgaggacaaacttcgttttgctgttttccaagagaatctccgcaaaatcgacgcacacaatgctaaatacgaaaagggagaagaaacctactacatggctgttaacaaattcgccgattggtccagcgcagaattccaagccatgttggaccgtcagatggctaacaagccaaaacaatccttcattgcaaaacacgtagtcgatcccaatgtccaagctgtagaagaagttgattggagagaaagtgctgttttgggagtcaaagatcaaggacagtgtggatcatgctgggctt

SEQ ID NO: 84 - DNA, 364 bp, Diabrotica virgifera
  Clone ID: LIB3026-011-Q1-E1-F4
caatttatctgcctttgagcaatggaccagttttaaggcaacacacaacaaattttacaacgttattgaggacaaacttcgttttgctgttttccaagagaatctccgcaaaatcgacgcacacaatgctaaatacgaaaagggagaagaaacctactacatggctgttaacaaattcgccgattggtccagcgcagaattccaagccatgttggaccgtcagatggctaacaagccaaaacaatccttcattgcaaaacacgtagtcgatcccaatgtccaagctgtagaagaagttgattggagagaaagtgctgttttgggagtcaaagatcaaggacagtgtggatcatgctgggctttc

SEQ ID NO: 85 - DNA, 421 bp, Diabrotica virgifera
  Clone ID: LIB149-012-Q1-E1-H11
aaaaaactcaaaatgaagctgttaattctagccgccaccctcattgtggccataaatgccaatttatctgcctttgagcaatggaccagttttaaggcaacacacaacaaattttacaacgttattgaggacaaacttcgttttgctgttttccaagagaatctccgcaaaatcgacgcacacaatgctaaatacgaaaagggagaagaaacctactacatggctgttaacaaattcgccgattggtccagcgcagaattccaagccatgttggaccgtcagatggctaacaagccaaaacaatccttcattgcaaaacacgtagtcgatcccaatgtccaagctgtagaagaagttgattggagagaaagtgctgttttgggagtcaaagatcaaggacagtgtggatcatgctgggctt

SEQ ID NO: 86 - DNA, 410 bp, Diabrotica virgifera
  Clone ID: LIB149-021-Q1-E1-F10
ctttcagaagaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagatcaaggacag

SEQ ID NO: 87 - DNA, 434 bp, Diabrotica virgifera
  Clone ID: LIB149-048-Q1-E1-H12
ccgggccgacacaagactcaagatcgagtcgtataaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagatcaaggacag

SEQ ID NO: 88 - DNA, 386 bp, Diabrotica virgifera
  Clone ID: LIB149-048-Q1-E1-C4
cccacgcgtccgtgttgttattgcttgtcttattgtgacaatcgctgccgaattgaacggttatgaccactgggtttctttcaaggctaaacattcaaagcaatataaaataacagaagataaactaagattccaaattttccaagacaaccttcgcgaaatagaagaacacaacgcaagatatgccaaaggagaagtaggatggtacaaaggtgtcactccattcgctgattggaccaaagaagaattcaaggctctgttgacacgtcaagctgcttccaggcctaaacttaacgagagtttgggggttcatgtcgccgatccaaatgttaagttggcatcctctgttgattggaggagcaaaggagcagtattgcctgtaagag

SEQ ID NO: 89 - DNA, 397 bp, Diabrotica virgifera
  Clone ID: LIB149-045-Q1-E1-E8
aaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagatcaaggac

SEQ ID NO: 90 - DNA, 372 bp, Diabrotica virgifera
  Clone ID: LIB149-041-Q1-E1-C1
cccacgcgatccgcccacgcgtcagcgaaaaatggaccagttttaaggcaacccataacagatcttacaaagttattgaagacaaacttcgtatcgctggattccaagacaacctcaaaaaaatcgaggaacacaatgctaaatactatagtggggaagaaacctactacttggctgttaacaaattcgccgattggtccagcgctgaattccaagctatgttagggcgtcagatggctaacaagcccaaacaatcctttattgcgaaacacgtagccgatcccaatgtccaagctgtagaagaagttgattggagagatagtgccgttttgggagtcaaagatcaatgacagtgtggatcatgctgggctt

SEQ ID NO: 91 - DNA, 416 bp, Diabrotica virgifera
  Clone ID: LIB149-031-Q1-E1-G10
acccacgcgtccgcccacgcgtccggaagctgttcatccttgctgctgccctcattgtagccacaagtgccaatctaggtgccttcgaaaaatggactagttttaaggccacccataacaaatcttacaacgttattgaagacaaacttcgtttcgctgttttccaagagaacctcaaaaaaatcgaggaacacaatgctaaatacgaaagtggagaagaaacctactatttggctgttaacaaattcgccgattggtccagcgctgaattccaagctatgttggcccgtcaaatggctaacaagccaaaacaaaccttcattggaaaacacgtagaagatcccaatgtccaagctgcagatgaagttgattggagatcaagcgctgacttgggagtcaaggatcaaggaaactgt

SEQ ID NO: 92 - DNA, 404 bp, Diabrotica virgifera
  Clone ID: LIB149-005-Q1-E1-G9
acaatatcatgtcgactgttctgaggaaaacgatggatgtggtggtggagaccaaaggttagctttcaggtttcttaaacataaccgtatgccctccgaagaggattatccatatactatgaaagatgatgtttgccgagaagatgtcaaaatgtcgctcggtcacatctcgggatacacacatctgaatgcaacggaagaagctttaatttcagctctcgctaccgttggcccaatcgctgtttccgctgatgcaactaaatggtcattatatggaggacgagtttttgatgacgaagaatgtggaaacaatataaaccatgccatacttgctacacgttacactgatgagtacattgttatcacaaattcatggggagcagattggggtgaagatggataca

SEQ ID NO: 93 - DNA, 410 bp, Diabrotica virgifera
  Clone ID: LIB149-039-Q1-E1-D11
acaagcctctagaatgagtcgtatgaagctgttcatccttgctgccctcattgtggccacaagtgccaacctaggcgcctttgaaaaatggaccagttttaaggcaacacataacaaatcctactcccttgttgaagacaaacttcgtttcgcagttttccaagaaaacttgaagaaaatcgaagaacataatgccaaatacgagaacggagaagaaacctactatcttgccgtcaatcaatttgccgattggtccagtgctgaatttaaagctttgttgaattctcaaattatcaacagaccagaactatcctttatcgaaacatacgaagcagatcccaatgttgaacttgcaagttctgttgactggagaaacaaagctgttttgggagtcaaaaatcaatgaagtt

SEQ ID NO: 94 - DNA, 401 bp, Diabrotica virgifera
  Clone ID: LIB149-045-Q1-E1-H2
cacgcgaccgaaaaaatcagaatgaagctgttcatccttgccgctgcccttattgtggccacaagtgccaatctaggtgccttcgaaaaatggaccagttttaaggcaacccataagagatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaaga

SEQ ID NO: 95 - DNA, 425 bp, Diabrotica virgifera
  Clone ID: LIB149-049-Q1-E1-C9
acggacgagtgggtttcagaagaaaaatcagaatgaagctgttcatccttgctgctgccctcattgtagccacaagtgccaatctaggtgccttcgaaaaatggactagttttaaggccacccataacaaatcttacaacgttattgaagacaaacttcgtttcgctgttttccaagagaacctcaaaaaaatcgaggaacacaatgctaaatacgaaagtggagaagaaacctactatttggctgttaacaaattcgccgattggtccagcgctgaattccaagctatgttggcccgtcaaatggctaacaagccaaaacaaaccttcattggaaaacacgtagaagatcccaatgtccaagctgcagatgaagttgattggagatcaagcgctgacttgggagtcaaagatcaaagaaactgt

SEQ ID NO: 96 - DNA, 416 bp, Diabrotica virgifera
  Clone ID: LIB149-021-Q1-E1-A11
agttctttcagaagaaaaatcagaatgaagctgttcatccttgctgctgccctcattgtagccacaagtgccaatctaggtgccttcgaaaaatggactagttttaaggccacccataacaaatcttacaacgttattgaagacaaacttcgtttcgctgttttccaagagaacctcaaaaaaatcgaggaacacaatgctaaatacgaaagtggagaagaaacctactatttggctgttaacaaattcgccgattggtccagcgctgaattccaagctatgttggcccgtcaaatggctaacaagccaaaacaaaccttcattggaaaacacgtagaagatcccaatgtccaagctgcagatgaagttgattggagatcaagcgctgacttgggagtcaaggatcaaggaaactg

SEQ ID NO: 97 - DNA, 396 bp, Diabrotica virgifera
  Clone ID: LIB149-032-Q1-E1-B7
aagttctttcagaagaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagaaataatgccgttttggg

SEQ ID NO: 98 - DNA, 393 bp, Diabrotica virgifera
  Clone ID: LIB149-005-Q1-E1-B7
atcagaaaaatcagaatgaagctgttcatccttgctgccctcattgtggccacaagtgccaacctaggcgcctttgaaaaatggaccagttttaaggcaacacataacaaatcctactcccttgttgaagacaaacttcgtttcgcagttttccaagaaaacttgaagaaaatcgaagaacataatgccaaatacgagaacggagaagaaacctactatcttgccgtcaatcaatttgccgattggtccagtgctgaatttaaagctttgttgaattctcaaattatcaacagaccagaactatcctttatcgaaacatacgaagcagatcccaatgttgaacttgcaagttctgttgactggagaaacaaagctgttttgggagtcaaaaat

SEQ ID NO: 99 - DNA, 386 bp, Diabrotica virgifera
  Clone ID: LIB149-045-Q1-E1-C5
atcagaatgaagctgttcatccttgctgccctcattgtggccacaagtgccaacctaggcgcctttgaaaaatggaccagttttaaggcaacacataacaaatcctactcccttgttgaagacaaacttcgtttcgcagttttccaagaaaacttgaagaaaatcgaagaacataatgccaaatacgagaacggagaagaaacctactatcttgccgtcaatcaatttgccgattggtccagtgctgaatttaaagctttgttgaattctcaaattatcaacagaccagaactatcctttatcgaaacatacgaagcagatcccaatgttgaacttgcaagttctgttgactggagaaacaaagctgttttgggagtcaaaaatca

SEQ ID NO: 100 - DNA, 397 bp, Diabrotica virgifera
  Clone ID: LIB149-019-Q1-E1-A11
agttctatcagaagaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggag

SEQ ID NO: 101 - DNA, 422 bp, Diabrotica virgifera
  Clone ID: LIB149-003-Q1-E1-F12
gggccgacccaaacgtcaattcttagtcaaagaaaaatcagaatgaagctgttcatccttgctgccctcattgtggccacaagtgccaacctaggcgcctttgaaaaatggaccagttttaaggcaacacataacaaatcctactcccttgttgaagacaaacttcgtttcgcagttttccaagaaaacttgaagaaaatcgaagaacataatgccaaatacgagaacggagaagaaacctactatcttgccgtcaatcaatttgccgattggtccagtgctgaatttaaagctttgttgaattctcaaattatcaacagaccagaactatcctttatcgaaacatacgaagcagatcccaatgttgaacttgcaagttctgttgactggagaaacaaagctgttttgggagtcaaaaatca

SEQ ID NO: 102 - DNA, 406 bp, Diabrotica virgifera
  Clone ID: LIB149-023-Q1-E1-F8
gttgttctttcagaagaaaaatcagaatgaagctgttcatccttgctgctgccctcattgtagccacaagtgccaatctaggtgccttcgaaaaatggactagttttaaggccacccatagcaaatcttacaacgttattgaagacaaacttcgtttcgctgttttccaagagaacctcaaaaaaatcgaggaacacaatgctaaatacgaaagtggagaagaaacctactatttggctgttaacaaattcgccgattggtccagcgctgaattccaagctatgttggcccgtcaaatggctaacaagccaaaacaaaccttcattggaaaacacgtagaagatcccaatgtccaagctgcagatgaagttgattggcgatcaagcgctgacttgggagtcaagga

SEQ ID NO: 103 - DNA, 406 bp, Diabrotica virgifera
  Clone ID: LIB149-011-Q1-E1-C1
cacccaggcgtccgtatcagaaaaaaaatcagaatgaagctgttcatccttgccgctgcccttattgtggccacaagtgccaatctaggtgccttcgaaaaatggaccagttttaaggcaacccataacaaatcgtacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggag

SEQ ID NO: 104 - DNA, 403 bp, Diabrotica virgifera
  Clone ID: LIB149-016-Q1-E1-B3
gttctttcagaagaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaaga

SEQ ID NO: 105 - DNA, 393 bp, Diabrotica virgifera
  Clone ID: LIB149-045-Q1-E1-D2
acgattcagaagaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttggg

SEQ ID NO: 106 - DNA, 441 bp, Diabrotica virgifera
  Clone ID: LIB149-009-Q1-E1-B1
cacacgcgtccgcccacgcgtccgcccacgcgtccggttgttctttcagaagaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaag

SEQ ID NO: 107 - DNA, 392 bp, Diabrotica virgifera
  Clone ID: LIB149-021-Q1-E1-D8
aatttcagaagaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttggg

SEQ ID NO: 108 - DNA, 403 bp, Diabrotica virgifera; identical to SEQ ID NO: 104
  Clone ID: LIB149-048-Q1-E1-B2

SEQ ID NO: 109 - DNA, 428 bp, Diabrotica virgifera
  Clone ID: LIB149-044-Q1-E1-D11
caccctaaagtgagtcgtattatatatttatcctgctttgtgcttgccttttggttgcctcagcacaactttcggctaacaaacaatgggttacgttcaagaaatctttccaaaggagtgagaaattacgagaagaaaaacttcgtttccaagtatttcaaaaaaatcttcgcaaaattaatgaacacaattcaaaatacgagaagggagaaacgagttactttcttaaaataaccaaattcgctgactggaccgatgaagaattgaacgctatgttaaacccaaaaatagtagctaaatcacaccataaaaataccaaaacgctcgtacgtgatccaaacttttctcgtccagcaagcatcgactggagagatacagctgttttggctgtcaaagatcaggcagcctgtggttcttgttgggcattt

SEQ ID NO: 110 - DNA, 403 bp, Diabrotica virgifera
  Clone ID: LIB149-010-Q1-E1-F4
acggacgcgtgggcggacgcgtggggaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttt

SEQ ID NO: 111 - DNA, 418 bp, Diabrotica virgifera
  Clone ID: LIB149-008-Q1-E1-G3
cccacgcgtccgcggacgcgtgggtttcagaagaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatactgccgttttgggagtc

SEQ ID NO: 112 - DNA, 407 bp, Diabrotica virgifera
  Clone ID: LIB149-006-Q1-E1-E4
agttgatctttcagaagaaaaatcagaatgaagctgttcatccttgccgctgcccttattgtggccacaagtgccaatctaggtgccttcgaaaaatggatcagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaaga

SEQ ID NO: 113 - DNA, 415 bp, Diabrotica virgifera
  Clone ID: LIB3026-009-Q1-E1-D11
atcacgcatccgttcgtttcggagttttctaagagaaccttcgcaaaatcgaagaacataataccagatatgattacggagaataaacctactatctcgccgtcaatcaatttgccgattggtccaacgctgaatttaaagcgatgttagactctcaaatggctcagaggccgaaactattggttgctgaaacattcgaagccgattctaagttacaatttccaacataggttgattggaggaatataaaggctgatttgggagttaggaaccatggaagctgttgatcctgctgggctttcagtgccgtcggagccatcgaaggtcaatttgcaattcacaaaaagcattacgttcatctaagtgaacttgaattggtagattgtgacacagtaaaccagggattcactggagg

SEQ ID NO: 114 - DNA, 412 bp, Diabrotica virgifera
  Clone ID: LIB3026-020-Q1-E1-E1
accatgaagctgatgatcaatgctgctgccctcattgtggccgcaaatgccaaactatctgcattcgaacactggagcagttttaaggcaacacataataaatcttacaacgttattgaggaacaacttcgtttcggagttttccaagagaaccttcgcaaaatcgaagaacataataccaaatatgaaaacggagaagaaacctactatctcgccgttaatcaatttgccgattggtccaacgctgaatttaaagctatgttagactctcaaatggctcagaggccaaaactattggttgctgaaacattcgaagccgattctaatttacaagttcaacagaggttgattggaggaataaaaacgctgatttgggagttaggaaccaccgaagctgtggatcctgctgggc

SEQ ID NO: 115 - DNA, 404 bp, Diabrotica virgifera
  Clone ID: LIB149-035-Q1-E1-H11
tgaacacacagtccggttctttcagaagaaaaatcagaatgaagctgttcatccttgctgctgccctcattgtagccacaagtgccaatctaggtgccttcgaaaaatggactagttttaaggccacccataacaaatcttacaacgttattgaagacaaacttcgtttcgctgttttccaagagaacctcaaaaaaatcgaggaacacaatgctaaatacgaaagtggagaagaaacctactatttggctgttaacaaattcgccgattggtccagcgctgaattccaagctatgttggcccgtcaaatggctaacaagccaaaacaaaccttcattggaaaacacgtagaagattccaatgtccaagctgcagatgaagttgattggagatcaagcgctgac

SEQ ID NO: 116 - DNA, 365 bp, Diabrotica virgifera
  Clone ID: LIB149-024-Q1-E1-D6
atgaagctgttcatccttgctgctgccctcattgtagccacaagtgccaatctaggtgccttcgaaaaatggactagttttaaggccacccataacaaatcttacaacgttattgaagacaaacttcgtttcgctgttttccaagagaacctcaaaaaaatcgaggaacacaatgctaaatacgaaagtggagaagaaacctactatttggctgttaacaaattcgccgattggtccagcgctgaattccaagctatgttggcccgtcaaatggctaacaagccaagacaaaccttcattggaaaacacgtagaagatcccaatgtccaagctgcagatgaagttgactggagatcaagcgctga

SEQ ID NO: 117 - DNA, 404 bp, Diabrotica virgifera
  unsure (1)..(404): unsure at all n locations
  Clone ID: LIB149-047-Q1-E1-H5
agaaaaatcagaatgaagctgttcatccttgctgctgccctcattgtagccacaagtgccaatctaggtgccttcgaaaaatggactagttttaaggccacccataacaaatcttacaacgttattgaagacaaacttcgtttcgctgttttccaagagaacctcaaaaaaatcgaggaacacaatgctaaatacgaaagtggagaagaaacctactatttggctgttaacaaattcgccgattggtccagcgctgaattccaagctatgttggcccgtcaaatggctaacaagccaaaacaaaccttcattggaaaacacgtagaagatcccaatgtccaagctgcagatgaagttgattggagatcaagcgctgacttgggagtcaaggatcaangaaactg

SEQ ID NO: 118 - DNA, 402 bp, Diabrotica virgifera
  Clone ID: LIB149-026-Q1-E1-A7
attcgggggccgacccacgcgtacagaaaaatcagaatgaagctgttcatccttgctgctgccctcattgtagccacaagtgccaatctaggtgccttcgaaaaatggactagttttaaggccacccataacaaatcttacaacgttattgaagacaaacttcgtttcgctgttttccaagagaacctcaaaaaaatcgaggaacacaatgctaaatacgaaagtggagaagaaacctactatttggctgttaacaaattcgccgattggtccagcgctgaattccaagctatgttggcccgtcaaatggctaacaagccaaaacaaaccttcattggaaaacacgtagaagatcccaatgtccaagctgcagatgaagttgattggagatcaagcgctgac

SEQ ID NO: 119 - DNA, 391 bp, Diabrotica virgifera
  Clone ID: LIB149-029-Q1-E1-E12
aagttcattcagaagaaaaatcagaatgaagctgttcatccttgctgctgccctcattgtagccacaagtgccaatctaggtgccttcgaaaaatggactagttttaaggccacccataacaaatcttacaacgttattgaagacaaacttcgtttcgctgttttccaagagaacctcaaaaaaatcgaggaacacaatgctaaatacgaaagtggagaagaaacctactatttggctgttaacaaattcgccgattggtccagcgctgaattccaagctatgttggcccgtcaaatggctaacaagccaaaacaaaccttcattggaaaacacgtagaagatcccaatgtccaagctgcagatgaagttgattggagatcaagcgctgac

SEQ ID NO: 120 - DNA, 403 bp, Diabrotica virgifera
  Clone ID: LIB150-002-Q1-E1-D11
gttctttcagaagaaaaatcagaatgaagctgttcatccttgctgctgccctcattgtagccacaagtgccaatctaggtgccttcgaaaaatggactagttttaaggccacccataacaaatcttacaacgttattgaagacaaacttcgtttcgctgttttccaagagaacctcaaaaaaatcgaggaacacaatgctaaatacgaaagtggagaagaaacctactatttggctgttaacaaattcgccgattggtccagcgctgaattccaagctatgttggcccgtcaaatggctaacaagccaaaacaaaccttcattggaaaacacgtagaagatcccaatgtccaagctgcagatgaagttgattggagatcaagcgctgacttgggagtcaagga

SEQ ID NO: 121 - DNA, 410 bp, Diabrotica virgifera
  Clone ID: LIB149-014-Q1-E1-D4
cccacgcgaccggttctttcagaagaaaaatcagaatgaagctgttcatccttgctgctgccctcattgtagccacaagtgccaatctaggtgccttcgaaaaatggactagttttaaggccacccataacaaatcttacaacgttattgaagacaaacttcgtttcgctgttttccaagagaacctcaaaaaaatcgaggaacacaatgctaaatacgaaagtggagaagaaacctactatttggctgttaacaaattcgccgattggtccagcgctgaattccaagctatgttggcccgtcaaatggctaacaagccaaaacaaaccttcattggaaaacacgtagaagatcccaatgtccaagctgcagatgaagttgattggagatcaagcgctgacttgggagtc

SEQ ID NO: 122 - DNA, 390 bp, Diabrotica virgifera
  Clone ID: LIB149-049-Q1-E1-H9
agttcttacagaagaaatatcagaatgaagctgttcatccttgctgctgccctcattgtagccacaagtgccaatctaggtgccttcgaaaaatggactagttttaaggccacccataacaaatcttacaacgttattgaagagaaacttcgattcgctgttttccaagagaacctcagaaaaatcgaagaacacaatgctaaatacgaaagtggagaacaaacctactatttggctgttaacaaattcgccgattggtccaacgctgaattccaagcgatgttggcccgtcaaatggctaacaagccagtacaaaccttcattgggaaacacgtagaatatcccaatgtccaagctgcagatgaagttgattggagatcaagcgctgac

SEQ ID NO: 123 - DNA, 400 bp, Diabrotica virgifera
  Clone ID: LIB149-040-Q1-E1-C8
cccacgcgtccgcccacgcgtccggaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagataatgccgt

SEQ ID NO: 124 - DNA, 389 bp, Diabrotica virgifera
  Clone ID: LIB149-031-Q1-E1-A11
aaaatcagaaagaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaagaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgtattgggagtcaaaga

SEQ ID NO: 125 - DNA, 383 bp, Diabrotica virgifera
  Clone ID: LIB149-027-Q1-E1-D3
ccccgagaaaatcaaaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtaaaagaagttgattggagagatagtgcccttt

SEQ ID NO: 126 - DNA, 405 bp, Diabrotica virgifera
  Clone ID: LIB149-045-Q1-E1-B6
atgatctttcagaagaaaaatcagaatgaagctgttcatccttgccgctgcccttattgtggccacaagtgccaatctaggtgccttcgaaaaatggaccagttttaagggcaaccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgattccaatgtccaagctgtagaagaagttgattggagagatagtgccgttttgggagtcaaaga

SEQ ID NO: 127 - DNA, 402 bp, Diabrotica virgifera
  Clone ID: LIB149-004-Q1-E1-B9
acccacgcgtccgttcagaagaaaaatcagaatgaagctgttcatccttgctgctgccctcattgtagccacaagtgccaatctaggtgccttcgaaaaatggactagttttaaggccacccataacaaatcttacaacgttattgaagacaaacttcgtttcgctgttttccaagagaacctcaaaaaaatcgaggaacacaatgctaaatacgaaagtggagaagaaacctactacttggctgttaacaaattcgccgattggtccagcgctgaattccaagctatgttggcccgtcaaatggctaacaagccaaaacaaaccttcattggaaaacacgtagaagatcccaatgtccaagctgcagatgaagttgattggagattaagcgctgacttggg

SEQ ID NO: 128 - DNA, 351 bp, Diabrotica virgifera
  Clone ID: LIB149-024-Q1-E1-D7
atgaagctgttcatccttgctgctgccctcattgtagccacaagtgccaatctaggtgccttcgaaaaatggactagttttaaggccacccataacaaatcttacaacgttattgaagacaaacttcgtttcgctgttttccaagagaacctcaaaaaaatcgaggaacacaatgctaaatacgaaagtggagaagaaacctactatttggctgttaacaaattcgccgattggtccagcgctgaattccaagctatgttggcccgtcaaatggctaataggccaagacagaccttcattggaaaacacgtacaagatcccaatgtccaagctgcagatgaaattgattgg

SEQ ID NO: 129 - DNA, 427 bp, Diabrotica virgifera
  Clone ID: LIB149-049-Q1-E1-G9
acttttagtgagagaaaactcaaaatgaagctgttaattctagccgccaccctcattgtggccataaatgccaatttatctgccttcgagcaatggaccagttttaaggcaacacacaacaaatcttacaacgttattgaggacaaacttcgttttgctgttttccaagagaatctccgcaaaatcgacgcacacaatgctaaatacgaaaagggagaagaaacctactacatggctgttaacaaattcgccgattggtccagcgcagaattccaagccatgttggaccgccagatggctaacaagccaaaacaatccttcattgcaaaacacgtagtcgatcccaatgtccaagctgtagaagaagttgattggagagaaactgctgttttgggagtcaaagatcaaagacagtgtggatcatgct

SEQ ID NO: 130 - DNA, 377 bp, Diabrotica virgifera
  Clone ID: LIB149-037-Q1-E1-H4
agatgttgctgttcatccttgatgctgccctcattgtagccacaagtgccaatctaggtgccttcgaaaaatggactagttttaaggccacccataacaaatcttacaacgttattgaagacaaacttcgtttcgctgttttccaagagaacctcaaaaaaatcgaggaacacaatgctaaatacgaaagtggagaagaaacctactatttggctgttaacaaattcgccgattggtccagcgctgaattccaagctatgttggcccgtcaaatggctaacaagccaaaacaaaccttcattggaaaacacgtagaagatcccaatgtccaagctgcagatgaagttgattggagatcaagcgctgacttgggagtc

SEQ ID NO: 131 - DNA, 366 bp, Diabrotica virgifera
  Clone ID: LIB149-039-Q1-E1-A5
aattcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggag

SEQ ID NO: 132 - DNA, 377 bp, Diabrotica virgifera
  Clone ID: LIB149-035-Q1-E1-F9
aacacacgtccgcccacgcgtccggttcatccttgccgctgcccttattgtggccacaagtgccaatctaagtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtg

SEQ ID NO: 133 - DNA, 393 bp, Diabrotica virgifera
  Clone ID: LIB149-040-Q1-E1-H10
agttctttcagaagaaaaatcagaatgaaactgttcatccttgccgctgcccttattgtggccacaagtgccaatctatgtgccttcgaaaaatggaccagttttaaggcaacccataacaaatcttacaacgttattgaagacaaacttcgtttcgctgttttccaagacaacctcatataaatcgaggaacacaatgctaaatacgaatgtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttg

SEQ ID NO: 134 - DNA, 406 bp, Diabrotica virgifera
  Clone ID: LIB149-025-Q1-E1-C9
actacattaagataaaatcatagtttaaaaacttatatttcgtttgaacagaaaataagactcagaatgaaaattttattgaccctcattgggaccatcgtggtagtcaatgctttgtcaactaaacaacaatgggaaaactttaagcgtaaccataataaatcatatgcacatgttctagaagaaaactatcgcttgtctgtttttcgtttaaatctaaagaaaattgaagaacataatgccagataccagaaaggcgaagtttcttattatatgggtgtaaccaaatttgcagatttaacagctgttgaatttatgtctatgcttaataaacaaataagtacaaagccaaatattcaaggtatacttgcacaattgtccgaagattcaatacctgattcctttg

SEQ ID NO: 135 - DNA, 410 bp, Diabrotica virgifera
  Clone ID: LIB149-029-Q1-E1-D11
tgcccaaacgtctgccaacgcgtccgcggacgcgtgggtttcagaagaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttctccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggag

SEQ ID NO: 136 - DNA, 367 bp, Diabrotica virgifera
  Clone ID: LIB149-022-Q1-E1-C6
agttctttcagaagaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaag

SEQ ID NO: 137 - DNA, 352 bp, Diabrotica virgifera
  Clone ID: LIB149-019-Q1-E1-D6
atcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagtta

SEQ ID NO: 138 - DNA, 394 bp, Diabrotica virgifera
  Clone ID: LIB149-032-Q1-E1-A8
acccacgcgtccgcccacgcgtccggttctttcagaagaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttg

SEQ ID NO: 139 - DNA, 367 bp, Diabrotica virgifera
  Clone ID: LIB149-039-Q1-E1-A7
aatttcagaagaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttg

SEQ ID NO: 140 - DNA, 411 bp, Diabrotica virgifera
  unsure (1)..(411): unsure at all n locations
  Clone ID: LIB149-033-Q1-E1-H2
agaataataaacattgaaagtgattgttgttattgcttgtcttattgtggcaattacggccaaattgaacaattatgataactgggtctccttcaaggctaaacattcaaaacaatacaaactactagaagataaactaagattccaaattttccaagaaaaccttcgcgaaatcgaagagcacaatgcaagatacgccaaaggagatgtgggttggttcaagggggtcactaaattcgccgattggaccaaagaagaattcgaggctctattaaaacgccaatctgcttcaaaacccaaacttgacaagagtttgggagtgtatactgccgatccaaacgttaaggtgccttcgtctgttgattggaggaccganaatgcagtactgcctgtaagggaccaaagatcctg

SEQ ID NO: 141 - DNA, 359 bp, Diabrotica virgifera
  Clone ID: LIB149-046-Q1-E1-C1
tcagacgaaaaatcagaataaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgattccaatgtccaagctgtagaagaa

SEQ ID NO: 142 - DNA, 431 bp, Diabrotica virgifera
  Clone ID: LIB149-048-Q1-E1-D11
ctcgcgggtcgacacaagcctctataatgagtcataataaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttggggagtcaaagatcaaggacagtgtg

SEQ ID NO: 143 - DNA, 432 bp, Diabrotica virgifera
  Clone ID: LIB149-045-Q1-E1-C6
cgggtccgaccacgcgtccgaccaagcgtccgcccacgcgtccgcccacgcgtccgcccacgcgtccgcggacgcgtgggttcagaagaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgattccaatgtcaaagctg

SEQ ID NO: 144 - DNA, 363 bp, Diabrotica virgifera
  Clone ID: LIB149-020-Q1-E1-G1
actgtagttctttcagaagaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctg

SEQ ID NO: 145 - DNA, 388 bp, Diabrotica virgifera
  Clone ID: LIB149-032-Q1-E1-F7
acccacgcgtccgcccacgcgtccggttctttcagaagaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaag

SEQ ID NO: 146 - DNA, 359 bp, Diabrotica virgifera
  Clone ID: LIB149-046-Q1-E1-B8
agttctttcagaagaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgt

SEQ ID NO: 147 - DNA, 358 bp, Diabrotica virgifera
  Clone ID: LIB149-041-Q1-E1-G3
agttctttcagaagaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctg

SEQ ID NO: 148 - DNA, 401 bp, Diabrotica virgifera
  Clone ID: LIB149-004-Q1-E1-E8
aagttttagtaaaagaaaaatcagaatgaagctgttgatcattgctgctgccctcattgtggccgcaaatgccaaactatctgcattcgaacactggagcagttttaaggcaacacataataaatcttacaacgttattgaggaacaacttcgtttcggagttttccaagagaaccttcgcaaaatcgaagaacataataccaaatatgaaaacggagaagaaacctactatctcgccgttaatcaatttgccgattggtccaacgctgaatttaaagctatgttagactctcaaatggctcagaggccaaaactattggttgctgaaacattcgaagccgattctaatttacaagttccaacagaggttgattggaggaataaaaaggctgatttgggag

SEQ ID NO: 149 - DNA, 398 bp, Diabrotica virgifera
  Clone ID: LIB3026-007-Q1-E1-B3
gttttagtaaaagaaaaatcagaatgaagctgttgatcattgctgctgccctcattgtggccgcaaatgccaaactatctgcattcgaacactggagcagttttaaggcaacacataataaatcttacaacgttattgaggaacagcttcgtttcggagttttccaagagaaccttcgcaaaatcgaagaacataataccaaatatgaaaacggagaagaaacctactatctcgccgttaatcaatttgccgattggtccaacgctgaatttaaagctatgttagactctcaaatggctcagaggccaaaactattggttgctgaaacattcgaagccgattctaatttacaggttccaacagaggttgattggaggaataaaaaggctgatttggga

SEQ ID NO: 150 - DNA, 384 bp, Diabrotica virgifera
  Clone ID: LIB149-010-Q1-E1-E2
gttttagtaaaagaaaaatcagaatgaagctgttgatcattgctgctgccctcattgtggccgcaaatgccaaactatctgcattcgaacactggagcagttttaaggcaacacataataaatcttacaacgttattgaggaacagcttcgtttcggagttttccaagagaaccttcgcaaaatcgaagaacataataccaaatatgaaaacggagaagaaacctactatctcgccgttaatcaatttgccgattggtccaacgctgaatttaaagctatgttagactctcaaatggctcagaggccaaaactattggttgctgaaacattcgaagccgattctaatttacaagttccaacagaggttgattggaggaataaaa

SEQ ID NO: 151 - DNA, 376 bp, Diabrotica virgifera
  Clone ID: LIB149-027-Q1-E1-C2
aggacgcgtgagcggacgcgtgggtttcagaagaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttaatgcaaaacacgttaccgattccaatgtccaaact

SEQ ID NO: 152 - DNA, 344 bp, Diabrotica virgifera
  Clone ID: LIB149-042-Q1-E1-G5
cccacgcgtccgcccacgcgtccggttgttctttcagaagaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcc

SEQ ID NO: 153 - DNA, 385 bp, Diabrotica virgifera
  Clone ID: LIB149-016-Q1-E1-B8
acccacgcgtccgcggacgcgtgggtttcagaagaaaaatcagaatgaagctgttcatccttgctgctgccctcattgtagccacaagtgccaatctaggtgccttcgaaaaatggactagttttaaggccacccataacaaatcttacaacgttattgaagacaaacttcgtttcgctgttttccaagagaacctcaaaaaaatcgaggaacacaatgctaaatacgaaagtggagaagaaacctactatttggctgttaacaaattcgccgattggtccagcgctgaattccaagctatgttggcccgtcaaatggctaacaagccaaaacaaaccttcattggaaaacacgtagaagatcccaatgtccaagctgcagatga

SEQ ID NO: 154 - DNA, 365 bp, Diabrotica virgifera
  Clone ID: LIB149-034-Q1-E1-G4
agttcattcagaagaaaaatcagaatgaagctgttcatccttgctgctgccctcattgtggccacaagtgccaatctaggtgccttcgaaaaatggaccagttttaaggcaacccataacaaatcttacaacgttattgaagacaaacttcgtttcgctgttttccaagagaacctcaaaaaaatcgaggaacacaatgctaaatacgaaagtggagaagaaacctactatttggctgttaacaaattcgccgattggtctagcgctgaattccaagctatgttggcccgtcaaatggctaacaagccaacacaaaccttcattggaaaacacgtagaggatcccaatgtccaagctgcagatga

SEQ ID NO: 155 - DNA, 360 bp, Diabrotica virgifera
  Clone ID: LIB149-035-Q1-E1-G8
agctttcagaagaaaaatcagaatgaagctgttcatccttgctgctgccctcattgtagccacaagtgccaatctaggtgccttcgaaaaatggactagttttaaggccacccataacaaatcttacaacgttattgaagacaaacttcgtttcgctgttttccaagagaacctcaaaaaaatcgaggaacacaatgctaaatacgaaagtggagaagaaacctactatttggctgttaacaaattcgccgattggtccagcgctgaattccaagctatgttggcccgtcaaatggctaacaagccaaaacaaaccttcattggaaaacacgtagaagatcccaatgtccaagctgcaga

SEQ ID NO: 156 - DNA, 333 bp, Diabrotica virgifera
  Clone ID: LIB149-024-Q1-E1-B8
aaaataatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacatcctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatccc

SEQ ID NO: 157 - DNA, 416 bp, Diabrotica virgifera
  Clone ID: LIB149-009-Q1-E1-G1
ccaacgcgtccgtgttctttcagaagaaaaatcagaatgaagctgttcatccttgccgctgcccttaatgtggccacaagtgccaatctaagtgccttcgaaaaatggaccagttttaaggcaacccatagcaaatcttacaacgttagtgaagacaatcttcgtttcgctgttttccaagacaacctcaaaaaaatcgaggaacacaatgctaaatacgaaagtggagaagaaacctactacttggctgttaacaaagtcgcccattggtccagcgctgaattccaagctatgttggcccgtcagatggctaacacgcccaaacaatcctttattgcataacacgtagccgatcccaatgtccaagctgtataagaagttgattggagagatagtgccgttttgggagtcaatga

SEQ ID NO: 158 - DNA, 376 bp, Diabrotica virgifera
  Clone ID: LIB149-027-Q1-E1-F7
atcacgttgaaactgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgttgccggatcccaatgtcaaagctgtagaagaagttgattggagagatagtgccgttttg

SEQ ID NO: 159 - DNA, 357 bp, Diabrotica virgifera
  Clone ID: LIB149-024-Q1-E1-G6
atttcagaagaaaaatcagaatgaagctgttcatccttgccgctgcccttgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaacacgtagccgatcccaatgtccaagctgtagaaga

SEQ ID NO: 160 - DNA, 355 bp, Diabrotica virgifera
  Clone ID: LIB149-042-Q1-E1-E5
aatacagaataataatcagaatgaagctgttcatccttgctgctgccctcattgtggccacaagtgccaatctaggtgccttcgaaaaatggaccagttttaaggcaacccataacaaatcttacaacgttattgaagacaaacttcgtttcgctgttttccaagagaacctcaaaaaaatcgaggaacacaatgctaaatacgaaagtggagaagaaacctactatttggctgttaacaaattcgccgattggtctagcgctgaattccaagctatgttggcccgtcaaatggctaacaagccaacacaaaccttcattggaaaacacgtaaaggattccaatgtccaagctgc

SEQ ID NO: 161 - DNA, 335 bp, Diabrotica virgifera
  Clone ID: LIB149-019-Q1-E1-H3
agttcttagtcaaagaaaaatcagaatgaagctgttcatccttgctgccctcattgtggccacaagtgccaacctaggcgcctttgaaaaatggaccagttttaaggcaacacataacaaatcctactcccttgttgaagacaaacttcgtttcgcagttttccaagaaaacttgaagaaaatcgaagaacataatgccaaatacgagaacggagaagaaacctactatcttgccgtcaatcaatttgccgattggtccagtgctgaatttaaagctttgttgaattctcaaattatcaacagaccagaactatcctttatcgaaacatacgaag

SEQ ID NO: 162 - DNA, 412 bp, Diabrotica virgifera
  Clone ID: LIB149-019-Q1-E1-H11
agaaaaatcagaatgaagctgttcatccttgctgctgccctcattgtagccacaagtgccaatctaggtgccttcgaaaaatggactagttttaaggccacccataacaaatcttacaacgttattgaagacaaacttcgtttcgctgttttccaagagaacctcaaaaaaatcgaggaacacaatgctaaatacgaaagtggagaagaaacctactatttggctgttaacaaattcgccgattggtccagcgctgaattccaagctatgttggcccgtcaaatggctaacaagccaaaacaaaccttcattggaaaacacgtagaagatccaatgtccaagctgcagatgaagttgattggagatcaagcgctgacttgggagtcaaggatcaaggaaactgtggatcatg

SEQ ID NO: 163 - DNA, 385 bp, Diabrotica virgifera
  unsure (1)..(385): unsure at all n locations
  Clone ID: LIB149-036-Q1-E1-D6
aacccacgcgtccgcccacgcgtccgcccacgcgtccggaaaaatcagaatgaagctgttcatccttgctgctgccctcattgtagccacaagtgccaatctaggtgccttcgaaaaatggactagttttaaggccacccataacaaatcttacaacgttattgaagacaaacttcgtttcgctgttttccaagagaacctcaaaaaaatcgaggaacacaatgctaaatacgaaagtggagaagaaacctactatttggctgttaacaaattcgccgattggtccagcgctgaattccaagctatgttggcccgtcaaatggctaacaagccaaaacaaaccttcattggaaaacacgtagaagatcccaatgntcaagctgca

SEQ ID NO: 164 - DNA, 400 bp, Diabrotica virgifera
  Clone ID: pGUT2113
caccgggggcggcgtctaaacagtggatcccggctgaggaattcgcacgaaggtgaagaaaactcaaatggaactggtaattctagccgccaccctcattgtggccataaatgccaatttatctgccttcgagcaatggaccagttttaaggcaacacacaacaaatcttacaacgttattgaggacaaacttcgttttgctgttttccaagagaatctccgcaaaatcgacgcacacaatgctaaatacgaaaagggagaagaaacctactacatggctgttaacaaattcgccgattggtccagcgcagaattccaagccatgttggaccgccagatggctaacaagccaaaacaatccttcattgcaaaacacgtagtcgatcccaatgtccaagct

SEQ ID NO: 165 - DNA, 373 bp, Diabrotica virgifera
  Clone ID: LIB149-024-Q1-E1-D8
acaagactctatagtgagtcgtatcattgctgctgccctcattgaagccacaagtgccaatctatgtgccttcgaaaaatggactatttttaaggccacccataacaaatcttacaacgttattgaagacaaacttcgtttcgctgttttccaagagaacctcaaaaaaatcgaggaacacaatgctaaatacgaaagtggagaacaaacctactatttggctgttaacaaattcgccgattggtccagcgctgaattccaagctatgttggcccgtcaaatggctaacaagccaaaacaaaccttcattggaaaacacgtagaagatcccaatgtccaagctgcagatgaacttgattggagatcaaacgct

SEQ ID NO: 166 - DNA, 357 bp, Diabrotica virgifera
  Clone ID: LIB149-019-Q1-E1-B4
gatgatgttctttcagaagaaaaatcagaatgaacctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtatccgatcccaatgtcc

SEQ ID NO: 167 - DNA, 376 bp, Diabrotica virgifera
  Clone ID: LIB149-046-Q1-E1-A1
agatttattcttattattcttgctattgctgcagttcaagcattaagtgataatgaagaatgggtacagtttaaggtaaaacaaggcaaaagctacaggaattacgtcgaagaacaaaagaggttcacaatttttcaagaaaatttaagaaaaatcgaaaatcacaatgaaaaatattaccatggactatccacttttaaattgggagtaactaaattttcagatttgactgaaaaagaatttgccgatatgttaggactttctaaaactgacaaacccactaaaccccgtatgacacattcactcactccagtaaaagatcttccatccatgtttgattggagagagaaaggagcagtcaccgaggtcaagaatc

SEQ ID NO: 168 - DNA, 344 bp, Diabrotica virgifera
  Clone ID: LIB149-041-Q1-E1-A5
attcagaagaagaatcagaatgaagctgttcatccttgctgctgccctcattgtagccacaagtgccaatctaggtgccttcgaaaaatggactagttttaaggccacccataacaaatcttacaacgttattgaagacaaacttcgtttcgctgttttccaagagaacctcaaaaaaatcgaggaacacaatgctaaatacgaaagtggagaagaaacctactatttggctgttaacaaattcgccgattggtccagcgctgaattccaagctatgttggcccgtcaaatggctaacatgccataacaaaccttcattggaaaacacgtaaaagatcccaatg

SEQ ID NO: 169 - DNA, 395 bp, Diabrotica virgifera
  Clone ID: LIB149-025-Q1-E1-G2
aaaaaaatcaagattgaaccggttaacccttgcggctgcccttattgtggcaacaattgcaaatctaggtgccttcgaaaaatggaccagttttaaggcaaccaataacaaatcttacaacgttattgaagacaaacttcgtttcgctgttttcaaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgattccaatgtccaagctgtagaagaagttgattggagagatagtgccgttttgggagtcaaagata

SEQ ID NO: 170 - DNA, 356 bp, Diabrotica virgifera
  Clone ID: LIB149-020-Q1-E1-F3
acattaagataaaatcatagtttaaaaacttatatttcgtttgaacagaaaataagactcagaatgaaaattttattgaccctcattgggaccatcgtggtagtcaatgctttgtcaacgaaacaacaatgggaaagctttaagcgtaaccataataaatcatatgcacatgttctagaagaaaactatcgcttgtctgtttttcgtttaaatctaaagaaaattgaagaacataatgccagataccagaaaggcgaagtttcttattatatgggtgtaaccaaatttgcagatttaacagctgttgaatttatgtctatgcttaataaacaaataagtacaaagccaaatattca

SEQ ID NO: 171 - DNA, 430 bp, Diabrotica virgifera
  Clone ID: LIB149-025-Q1-E1-C4
gggccgacacacgcgtccacatttagtcagagaaaactcataatgaagctgttaattctagccgccaccctcattgtggccataaatgccaatttatctgcctttgagcaatggaccagttttaaggcaacacacaacaaattttacaacgttattgaggacaaacttcgttttgctgttttccaagagaatctccgcaaaatcgacgcacacaatgccaaatacgaaaagggagaagaaacctactacatggctgttaacaaattcgctgattggtccagcgcagaattccaagccatgttggaccgtcagatggctaacaagccaaaacaatccttcattgcaaaacacgtagtcgatcccaatgtccaagctgtagaagaagttgattggagagaaagtgctgttttgggagtcaaagatcaaggac

SEQ ID NO: 172 - DNA, 416 bp, Diabrotica virgifera
  Clone ID: LIB149-031-Q1-E1-C11
aacatcattcagagagagaaaactcaaaatgaagctgttaattctagccgccaccctcattgtggccataaatgccaatttatctgcctttgagcaatggaccagttttaaggcaacacacaacaaattttacaacgttattgaggacaaacttcgttttgctgttttccaagagaatctccgcaaaatcgacgcacacaatgctaaatacgaaaagggagaagaaacctactacatggctgttaacaaattcgccgattggtccagcgcagaattccaagccatgttggaccgtcagatggctaacaagccaaaacaatccttcattgcaaaacacgtagtcgatcccaatgtccaagctgtagaagaagttgattggagagaaagtgctgttttgggagtcaaagatcaaggac

SEQ ID NO: 173 - DNA, 403 bp, Diabrotica virgifera
  Clone ID: LIB149-030-Q1-E1-C10
agagaaaactcaaaatgaagctgttaattctagccgccaccctcattgtggccataaatgccaatttatctgcctttgagcaatggaccagttttaaggcaacacacaacaaattttacaacgttattgaggacaaacttcgttttgctgttttccaagagaatctccgcaaaatcgacgcacacaatgctaaatacgaaaagggagaagaaacctactacatggctgttaacaaattcgccgattggtccagcgcagaattccaagccatgttggaccgtcagatggctaacaagccaaaacaatccttcattgcaaaacacgtagtcgatcccaatgtccaagctgtagaagaagttgattggagagaaagtgctgttttgggagtcaaagatcaaggaca

SEQ ID NO: 174 - DNA, 350 bp, Diabrotica virgifera
  Clone ID: LIB149-042-Q1-E1-D10
cctatagtgagtcgtattaaactgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacatattcgccgattggtccagcgctgaattccaagctatgttggcccgtcagatggctaacaagcccaaacaatcctttattgcaaaacacgtagccgatcccaatgtccaagctgt

SEQ ID NO: 175 - DNA, 275 bp, Diabrotica virgifera
  Clone ID: pGUT2529
gaaaaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcc

SEQ ID NO: 176 - DNA, 440 bp, Diabrotica virgifera
  Clone ID: LIB149-024-Q1-E1-G8
cccaaacgtccatttcagaataacaatcataatgaacctgttcatccttgccgctgcccttgtggccacaagtgccagtctatgtgccttcgaaaaatggaccagttttaaggcaacccataacagatcttacagcgttagtgaagacaaacttcgtttcgctgttttccaagacaacctcaacaaaatcgaggaacacaatgctaaatacgacagtggagaagaaacctactacttggctgttaacaaattcgccgattggtccagcgctgaattccaatctatgttggtccgtcagatggctaacaagcccaagcaatcctttattgcaaacacgtagccgatcccaatgtccaagctgtagaaaaagttgattggagagatactggccgttttggaaatccaaagttaacggccagtgttggttaaggccggggctt

SEQ ID NO: 177 - DNA, 370 bp, Diabrotica virgifera
  Clone ID: LIB149-044-Q1-E1-H10
gaagctgttaattctagccgccaccctcattgtggccataaatgccaatttatctgcctttgagcaatggaccagttttaaggcaacacacaacaggttttacaacgttattgaggacaaacttcgttttgctgttttccaagagaatctccgcaaaatcgacgcacacaatgctaaatacgaaaagggagaagaaacctactacatggctgttaacaaattcgccgattggtccagcgcagaattccaagccatgttggaccgtcagatggctaacaagccaaaacaatccttcattgcaaaacacgtagtcgatcccaatgtccaagctgtagaagaagttgattggagagaaagtgctgttttggga

SEQ ID NO: 178 - DNA, 381 bp, Diabrotica virgifera
  Clone ID: LIB149-038-Q1-E1-A9
cctatagtgagtcgtattaaactgttcatccttgctgccctcattgtggccacaagtgccaacctaggcgcctttgaaaaatggaccagttttaaggcaacacataacaaatcctactcccttgttgaagacaaacttcggttcgcagttttccaacaaaacttgaagagaatcgaagaacataatgccacatacgagaacggagaagaaacctactatcttgccgtcaatcaatttgccgattggtccactgctgaatttaaagctttgttgaattctcaaattatcaccagaccagaactatcctttatcgacacatacgaagcagatcccaatgttgaacttgcaagttccgttgaccggacaaacaaacctgttttg

SEQ ID NO: 179 - DNA, 404 bp, Diabrotica virgifera
  Clone ID: LIB149-035-Q1-E1-H12
taaacagacatcctggaaaactcaaaatgaagctgttaattctagccgccaccctcattgtggccataaatgccaatttatctgccttcgagcaatggaccagttttaaggcaacacacaacaaatcttacaacgttattgaggacaaacttcgttttgctgttttccaagagaatctccgcaaaatcgacgcacacaatgctaaatacgaaaagggagaagaaacctactacatggctgttaacaaattcgccgattggtccagcgcagaattccaagccatgttggaccgccagatggctaacaagccaaaacaatccttcattgcaaaacacgtagtcgatcccaatgtccaagctgtagaagaagttgattggagagaaactgctgttttgggagtcaaa

SEQ ID NO: 180 - DNA, 357 bp, Diabrotica virgifera
  Clone ID: LIB3026-032-Q1-E1-A8
ccgggtgcccccacgcgtccgtaatgttttagtaaaagaaaaatcagaatgaagctgttgatcattgctgctgccctcattgtggccgcaaatgccaaactatctgcattcgaacactggagcagttttaaggcaacacataataaatcttacaacgttattgaggaacaacttcgtttcggagttttccaagagaaccttcgcaaaatcgaagaacataataccaaatatgaaaacggagaagaaacctactatctcgccgttaatcaatttgccgattggtccaacgctgaatttaaagctatgttagactctcaaatggctcagaggccaaaactattggttgctgaaacattc

SEQ ID NO: 181 - DNA, 405 bp, Diabrotica virgifera
  Clone ID: LIB149-044-Q1-E1-H6
ccgggccgacccacacgtccacccacgcgtccgcggacgcgtgggttttagtaaaagaaaaatcagaatgaagctgttgatcattgctgctgccctcattgtggccgcaaatgccaaactatctgcattcgaacactggagcagttttaaggcaacacataataaatcttacaacgttattgaggaacaacttcgtttcggagttttccaagagaaccttcgcaaaatcgaagaacataataccaaatatgaaaacggagaagaaacctactatctcgccgttaatcaatttgccgattggtccaacgctgaatttaaagctatgttagactctcaaatggctcagaggccaaaactattggttgctgaaacattcgaagccgattctaatttacaagttccaac

SEQ ID NO: 182 - DNA, 409 bp, Diabrotica virgifera
  unsure (1)..(409): unsure at all n locations
  Clone ID: LIB150-039-Q1-E1-B2
gaagttgctacttgctattgcgtgtcttgttgcgggaatcaccgcagattttgacgattatgaccaatacgttcattttaaggggaaaacattcgagaacatacaaaatcacagaagataaacttagattccaaatcttccaaaacaaccttcaagaaatcgaagaacacaacgcaagatacgccaaagggagaagtgggatgggtccagggtgtcactccatttgccgattggaccanagaagagttcaaggctctactaacacgccaggctgcttcaaagcccaagcttacttatcgccaatcgtgtattgccgattccaatgttactttaacattatctgttgattggaggttaaaagacgtagtactacctgtaagagaccagggtaaatgtggatcgtgctggg

SEQ ID NO: 183 - DNA, 370 bp, Diabrotica virgifera
  Clone ID: LIB149-005-Q1-E1-G5
agttcagaagaaaaatcagaatgaagctgttcatccttgccgctgcccttattgtggccacagttgcaaaccaaggtgccttcgaaaaatggccaagttttaaggcaacccataacaaatcttacaacgttattgaagacaaacttcgtttcgctgttttccaagacaacctcaaaaaaatcgaggaacacaatgctaaatacgaaagtggagaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtagaagaagttgattg

SEQ ID NO: 184 - DNA, 407 bp, Diabrotica virgifera
  Clone ID: LIB150-043-Q1-E1-G8
acatcttttagtgagagaaaactcaaaatgaagctgttaattctagccgccaccctcattgtggccataaatgccaatttatctgcctttgagcaatggaccagttttaaggcaacacacaacaaattttacaacgttattgaggacaaacttcgttttgctgttttccaagagaatctccgcaaaatcgacgcacacaatgctaaatacgaaaagggagaagaaacctactacatggctgttaacaaattcgccgattggtccagcgcagaattccaagccatgttggaccgtcagatggctaacaagccaaaacaatccttcattgcaaaacacgtagtcgatcccaatgtccaagctgtagaagaagttgattggagagaaagtgctgttttgggagtcaaaga

SEQ ID NO: 185 - DNA, 382 bp, Diabrotica virgifera
  Clone ID: LIB149-003-Q1-E1-A12
aagaaaactcaaaatgaagctgttaattctagccgccaccctcattgtggccataaatgccaatttatctgcctttgagcaatggaccagttttaaggcaacacacaacaaattttacaacgttattgaggacaaacttcgttttgctgttttccaagagaatctccgcaaaatcgacgcacacaatgctaaatacgaaaagggagaagaaacctactacatggctgttaacaaattcgccgattggtccagcgcagaattccaagccatgttggaccgtcagatggctaacaagccaaaacaatccttcattgcaaaacacgtagtcgatcccaatgtccaagctgtagaagaagttgattggagagaaaatgctgttttg

SEQ ID NO: 186 - DNA, 405 bp, Diabrotica virgifera
  Clone ID: LIB149-016-Q1-E1-G4
tcaagacactcgtggaaaactcaaaatgaagctgttaattctagccgccaccctcattgtggccataaatgccaatttatctgcctttgagcaatggaccagttttaaggcaacacacaacaaattttacaacgttattgaggacaaacttcgttttgctgttttccaagagaatctccgcaaaatcgacgcacacaatgctaaatacgaaaagggagaagaaacctactacatggctgttaacaaattcgccgattggtccagcgcagaattccaagccatgttggaccgtcagatggctaacaagccaaaacaatccttcattgcaaaacacgtagtcgatcccaatgtccaagctgtagaagaagttgattggagagaaagtgctgttttgggagtcaaaga

SEQ ID NO: 187 - DNA, 392 bp, Diabrotica virgifera
  Clone ID: LIB149-028-Q1-E1-H7
agaaaactcaaaatgaagctgttaattctagccgccaccctcattgtggccataaatgccaatttatctgcctttgagcaatggaccagttttaaggcaacacacaacaaattttacaacgttattgaggacaaacttcgttttgctgttttccaagagaatctccgcaaaatcgacgcacacaatgctaaatacgaaaagggagaagaaacctactacatggctgttaacaaattcgccgattggtccagcgcagaattccaagccatgttggaccgtcagatggctaacaagccaaaacaatccttcattgcaaaacacgtagtcgatcccaatgtccaagctgtagaagaagttgattggagagaaagtgctgttttgggagtcaaaga

SEQ ID NO: 188 - DNA, 412 bp, Diabrotica virgifera
  Clone ID: LIB149-004-Q1-E1-C1
agcacacgcgtccgcttttagtgagagaaaactcaaaatgaagctgttaattctagccgccaccctcattgtggccataaatgccaatttatctgcctttgagcaatggaccagttttaaggcaacacacaacaaattttacaacgttattgaggacaaacttcgttttgctgttttccaagagaatctccgcaaaatcgacgcacacaatgctaaatacgaaaagggagaagaaacctactacatggctgttaacaaattcgccgattggtccagcgcagaattccaagccatgttggaccgtcagatggctaacaagccaaaacaatccttcattgcaaaacacgtagtcgatcccaatgtccaagctgtagaagaagttgattggagagaaagtgctgttttgggagtc

SEQ ID NO: 189 - DNA, 398 bp, Diabrotica virgifera
  Clone ID: LIB149-044-Q1-E1-C10
acatcatttagtgagagaaaactcaaaatgaagctgttaattctagccgccaccctcattgtggccataaatgccaatttatctgcctttgagcaatggaccagttttaaggcaacacacaacaaattttacaacgttattgaggacaaacttcgttttgctgttttccaagagaatctccgcaaaatcgacgcacacaatgctaaatacgaaaagggagaagaaacctactacatggctgttaacaaattcgccgattggtccagcgcagaattccaagccatgttggaccgtcagatggctaacaagccaaaacaatccttcattgcaaaacacgtagtcgatcccaatgtccaagctgtaaaagaagttgattggagagaaagtgctgttttggg

SEQ ID NO: 190 - DNA, 369 bp, Diabrotica virgifera
  Clone ID: LIB149-044-Q1-E1-G7
acggacacttgggcggacgcgtggggttgttctttaagaaaaatcaaaatgaaactatttgtcgccttcgcagccatcattttgagcgtcagtgctttgtcactcaacgaccattgggaaaactttaaggtcaaacatggcaaagcttacaaaaacccaatcgaggaaagagtccgcttttcagttttccaatccaatctgaaactcatcaacgaacacaatgccaaatacgagcaaggtcttgtaggttacacaatggcagtcaaccagttcggtgacatgacccaagaagagttcaaagccaagctcggtatgcaagcaaagaatatccctaacatcaagaacaactcgtcatgttcaagatgtaaa

SEQ ID NO: 191 - DNA, 277 bp, Diabrotica virgifera
  Clone ID: pGUT4278
ttcagaagaaaaatcagaatgaagctgttcatccttgctgctgccctcattgtagccacaagtgccaatctaggtgccttcgaaaaatggactagttttaaggccacccataacaaatcttacaacgttattgaagacaaacttcgtttcgctgttttccaagagaacctcaaaaaaatcgaggaacacaatgctaaatacgaaagtggagaagaaacctactatttggctgttaacaaattcgccgattggtccagcgctgaattccaagctatgt

SEQ ID NO: 192 - DNA, 294 bp, Diabrotica virgifera
  Clone ID: pGUT1925
gttaattctagccgccaccctcattgtggccataaatgccaatttgtctgccttcgagcaatggaccagttttaaggcaacacacaacaaatcttacaacgttattgaggaaaaacttcgttttgctgttttccaagagaatctgcgcaaaatcgacgcacacaatgctaaatacgaaaagggagaagatacctactacatggctgttaacaaattcgccgattggtccagcgcaaattttcaagccatgttggaacgccagaatggctacaagccaaaacaatccttcattgc

SEQ ID NO: 193 - DNA, 308 bp, Diabrotica virgifera
  Clone ID: LIB3026-033-Q1-E1-A6
aggaaattaggtgtgaaaggtgtttaaaaatgaggttccttattctacttgccgtattggctgtagctgtgaatgctacatcaatccaccaacaatgggctacatttaaggtaaaccattccaagaagtacggacatcttaaagaagagcaagttcgcttccaagttttctctcaaaatctccgcaaaattgaggaacacaatgcaagataccagaatggtgaagtatccttctacttgggggttaatcaattcgcagatatgactccagaggaattcaaggctatgcttgactcccaactcattcac

SEQ ID NO: 194 - DNA, 451 bp, Diabrotica virgifera
  Clone ID: LIB150-029-Q1-E1-C1
ttttcaaataaaacatattcataatcttaaaaaagtgtacagtcaagcaataattgtttaaattagaaccgtataaatattgaaattattttcaagatgaagggttttatttttatttttcttgctattgctgcagttcaagcattaagtgataatgaagaatgggtacagtttaaggtaaaacaaggcaaaagctacaggaattacgtcgaagaacaaaagaggttcacaatttttcaagaaaatttaagaaaaatcgaaaatcacaatgaaaaatattaccatggactatccacttttaaattgggagtaactaaattttcagatttgactgaaaaagaatttgccgatatgttaggactttctaaaactgacaaacccactaaaccccgtatgacacattcactcactccagtaaaagatcttccatccatgtttgattggagagaga

SEQ ID NO: 195 - DNA, 387 bp, Diabrotica virgifera
  Clone ID: LIB149-047-Q1-E1-C2
atttaaatgcgagaaaactcaaaatgaagctgttaattctagccgccaccctcattgtggccataaatgccaatttatctgcctttgagcaatggaccagttttaaggcaacacacaacaaattttacaacgttattgaggacaaacttcgttttgctgttttccaagagaatctccgcaaaatcgacgcacacaatgctaaatacgaaaagggagaagaaacctactacatggctgttaacaaattcgccgattggtccagcgcagaattccaagccatgttggaccgtcagatggctaacaagccaaaacaatccttcattgcaaaacacgtagtcgatcccaatgtccaagctgtagaagaagttgattggagagaaagtgctg

SEQ ID NO: 196 - DNA, 458 bp, Diabrotica virgifera
  Clone ID: LIB149-012-Q1-E1-D8
ccaagcgtccgcaaacgcgtgggtttcagaaagaaaaatcaaaatgaagctgttcatccttgctgctgccctcattgatagccacaagtgccaatctaagtgccttcgaaaaatggactagttttaaggccacccataacagggcttacaacgttattgatgacaaacttcgtttcgctgttttccaagagaacctcattaaaatcgaggaacacaatgcataaatacgagcagtggattaagaaacctactatttggctgttaccagattctccgattggtccagcgctgaattccaagctatgttggcccgtcaaatggctaacaagccaaggcaaaccttcattggcaaacacgtaaaagatcccaatgtccaagctgcagatgaacttgattggagatcaagcgctgacttgggagtcaaggatcaacgaaactgtggatcatgctgggctttc

SEQ ID NO: 197 - DNA, 405 bp, Diabrotica virgifera
  Clone ID: LIB3026-028-Q1-E1-F1
agaattttgtgatcaagagtaagaatagatcatgaagttgctacttgttattgcgtgtctcattgcgggaatcaccgcagatttgaacgattatgaccaatacgtcctttttaaggcgaaacattcgaaacaatacagaatcacagaagataaactgagattccaaatcttccaaaacaaccttcgagaaatcgaagagcacaacgcaagatacgccaaaggagaggtgggatggttcaagggtgtcactccatttgccgattggaccaaagaagagttcaaggctctactaacacgccaggctgcttcaaagcccaagcttaccgacaacttgggatcgtgtatcgccaattccaatgttactttaccattatttgttgattggaggtttaaagacgcagtact

SEQ ID NO: 198 - DNA, 383 bp, Diabrotica virgifera
  unsure (1)..(383): unsure at all n locations
  Clone ID: LIB149-044-Q1-E1-B6
agagaaaactcaaaatgaagctgttaattctagccgccaccctcattgtggccataaatgccaatttatctgcctttgagcaatggaccagttttaaggcaacacacaagaaattttacaacgttattgaggacaaacttcgttttgctgttttccaagagaatctccgcaaaatcgacgcacacaatgctaaatacgaaaagggagaagaaacctactacatggctgttaacaaattcgccgattggtccagcgcagaattccaagccatgttggaccgtcagatggctaacaagccaaaacaatccttcattgcaaaacacgtagtcgatcccaatgtcnaagctgtaaaaaagtttgattggaaagaaattgctgttttg

SEQ ID NO: 199 - DNA, 369 bp, Diabrotica virgifera
  Clone ID: LIB149-006-Q1-E1-E2
agaaaaatcacaatgaagctgttcatccttgcgctgccctaattttggcaaaaagtgcaaatccaagtgccttcgaaaaatggaccaagttttaatgcaacccataacaaatcttacaacgttattgaagacatacttcgtttcgctgttttccaagacaacctcaaaaaaatcgaggaacacaatgctaaatacgaaagtggcgaagaaacctactacttggctgttaacaaattcgccgattggtccagcgctgaattccaagctatgttggcccgtcagatggctaacaagcccaaacaatcctttattgcaaaacacgtagccgatcccaatgtccaagctgtaaaagaagttgattggagagat

SEQ ID NO: 200 - DNA, 392 bp, Diabrotica virgifera
  Clone ID: LIB149-006-Q1-E1-A8
agaggaatcagaatgaatctgttcagccatgctgccctcattgtgggcacaagtgtcaacctaagcgcctttgagaaatggaccagttttatggcaacacataacaaatcctactcccttgttgaagacaaacttcgtttcgcagttttccaagaaaacttgaggaagatcgacgaacagattgccacatacgagaacggagaagaaacctactatcttgccgtcaatcaatttgccgattggtccagtgctgaacttaaagctttgttgaattcgcaaattatcagcagaccagaactatcctttatcgacacatacgaagcatatcccaatgttgaacttgcaagttctgttgactggagatacaaagctgttttgggagtcaaaaatca

SEQ ID NO: 201 - DNA, 372 bp, Diabrotica virgifera
  Clone ID: LIB149-042-Q1-E1-H4
cggcccacgcgtcagcccacgcgtccggaaaaatcagcatgaagctgttcacccttgctgcggcccttattgtggccacaggtgccaaccaaggtggctccaaaaaatgggcaatttttaaggcaacccataacatttcttacaacgtgattcaagacaaacttcgtttcgcggttttcaaaaacaacctcaaaaaaatcgaggaatacaatgctaaatacgaaactggagaataaacctactacatggctgttaacaaattcaccgattggtccaacgctgaattcgaagctatgttggcccgtcagatggctaacacgcccaatgaatcctttattgcaaatcacgtagccgatcccaatgtcaaagctg

SEQ ID NO: 202 - DNA, 436 bp, Diabrotica virgifera
  Clone ID: LIB150-001-Q1-E1-C3
gttttcaaataaaacatattcataatcttaaaaaagtgtacagtcaagcaataattgtttaaattagaaccgtataaatattgaaattattttcaagatgaagggttttatttttatttttcttgctattgctgcagttcaagcattaagtgataatgaagaatgggtacagtttaaggtaaaacaaggcaaaagctacaggaattacgtcgaagaacaaaagaggttcacaatttttcaagaaaatttaagaaaaatcgaaaatcacaatgaaaaatattaccatggactatccacttttaaattgggagtaactaaattttcagatttgactgaaaaagaatttgccgatatgttaggactttctaaaactgacaaacccactaaaccccgtatgacacattcactcactccagtaaaagatcttccatccatg

SEQ ID NO: 203 - DNA, 372 bp, Diabrotica virgifera
  Clone ID: LIB149-027-Q1-E1-E8
gtcgaaacacgcgtccaaaatgactcataatgaaagctgttaattctagccgccaccctcattgtggccataaatgccaatttatctgcctttgagcaatggaccagttttaaggcaacacacaacaaattttacaacgttattgaggacaaacttcgttttgctgttttccaagagaatctccgcaaaatcgacgcacacaatgctaaatacgaaaagggagaagaaacctactacatggctgttaacaaattcgccgattggtccagcgcagaattccaagccatgttggaccgtcagatggctaacaagccaaaacaatccttcattgcaaaacacgtagtcgatcccaatgtccaagctgtagaagaa

SEQ ID NO: 204 - DNA, 357 bp, Diabrotica virgifera
  Clone ID: LIB3026-017-Q1-E1-B4
cccacgcgtccggaaaactcaaaatgaagctgttaattctagccgccaccctcattgtggccataaatgccaatttatctgcctttgagcaatggaccagttttaaggcaacacacaacaaattttacaacgttattgaggacaaacttcgttttgctgttttccaagagaatctccgcaaaatcgacgcacacaatgctaaatacgaaaagggagaagaaacctactacatggctgttaacaaattcgccgattggtccagcgcagaattccaagccatgttggaccgtcagatggctaacaagccaaaacaatccttcattgcaaaacacgtagtcgatcccaatgtccaagctg

SEQ ID NO: 205 - DNA, 347 bp, Diabrotica virgifera
  Clone ID: LIB3026-007-Q1-E1-D3
gagaaaactcaaaatgaatctgttaattctagccgccaccctcattgtggccataaatgccaatttatctgcctttgagcaatggaccagttttaaggcaacacacaacaaattttacaacgttattgaggacaaacttcgttttgctgttttccaagagaatctccgcaaaatcgacgcacacaatgctaaatacgaaaagggagaagaaacctactacatggctgttaacaaattcgccgattggtccagcgcagaattccaagccatgttggaccgtcagatggctaacaagccaaaacaatccttcattgcaaaacacgtactcgatcccaatgtccaagctg

SEQ ID NO: 206 - DNA, 348 bp, Diabrotica virgifera
  Clone ID: LIB149-034-Q1-E1-G9
aggaaaactcaaaatgaagctgttaattctagccgccaccctcattgtggccataaatgccaatttatctgcctttgagcaatggaccagttttaaggcaacacacaacaaattttacaacgttattgaggacaaacttcgttttgctgttttccaagagaatctccgcaaaatcgacgcacacaatgctaaatacgaaaagggagaagaaacctactacatggctgttaacaaattcgccgattggtccagcgcagaattccaagccatgttggaccgtcagatggctaacaagccaaaacaatccttcattgcaaaacacgtagtcgattccaatgtccaagctgt

SEQ ID NO: 207 - DNA, 366 bp, Diabrotica virgifera
  Clone ID: LIB149-042-Q1-E1-E3
gggccgaccacgcgtctagagaaaatccaaaatagaagctgttaattctagccgccaccctcattgtggccataaatgccaatttatctgcctttgagcaatggaccagttttaaggcaacacacaacaaattttacaacgttattgaggacaaacttcgttttgctgttttccaagagaatctccgcaaaatcgacgcacacaatgctaaatacgaaaagggagaagaaacctactacatggctgttaacaaattcgccgattggtccagcgcagaattccaagccatgttggaccgtcagatggctaacaagccaaaacaatccttcattgcaaaacacgtagtcgatcccaatgtccaagctg

SEQ ID NO: 208 - DNA, 377 bp, Diabrotica virgifera
  Clone ID: LIB149-010-Q1-E1-C1
acggacgcgtgggcttttagtgagagaaaactcaaaatgaagctgttaattctagccgccaccctcattgtggccataaatgccaatttatctgcctttgagcaatggaccagttttaaggcaacacacaacaaattttacaacgttattgaggacaaacttcgttttgctgttttccaagagaatctccgcaaaatcgacgcacacaatgctaaatacgaaaagggagaagaaacctactacatggctgttaacaaattcgccgattggtccagcgcagaattccaagccatgttggaccgtcagatggctaacaagccaaaacaatccttcattgcaaaacacgtagtcgatcccaatgtccaagctgtagaaga

SEQ ID NO: 209 - DNA, 309 bp, Diabrotica virgifera
  Clone ID: pGUT4311
agtgagagaaaactcaaaatgaagctgttaattctagccgccaccctcattgtggccataaatgccaatttatctgcctttgagcaatggaccagttttaaggcaacacacaacaaattttacaacgttattgaggacaaacttcgttttgctgttttccaagagaatctccgcaaaatcgacgcacacaatgctaaatacgaaaagggagaagaaacctactacatggctgttaacaaattcgccgattggtccagcgcagaattccaagccatgttggaccgtcagatggcttacaagccaaaacaa

SEQ ID NO: 210 - DNA, 346 bp, Diabrotica virgifera
  Clone ID: LIB149-024-Q1-E1-F5
actctagaatgtgtcagcataatattagaagtgttacacttaaacaattttttcatcaaaactttgtaaatatactttttttttcgacatgaaggtttttgttttaatttttttggttactgctgcagttcacgcattaacagacaaagaagaatgggtgaagtttaaggttagacataacaaacgttatagaaattacattgaataacaaaagcgatttacaatttttcaagataatctaaggaaaatcgcaaatcacaatgaccaatttgataagggactgtctacttttaagttgggtgtaaacaaatttgcagatttgactgaacaagaatttttcgatatg

SEQ ID NO: 211 - DNA, 361 bp, Diabrotica virgifera
  Clone ID: LIB149-034-Q1-E1-E11
aaagataatacacaatgaaagtgattgttgttattgcttgtcttattgtggcaattactgcccaattgaacaattatgatcactgggtctctttcaaggctaaacattcaaaacaatacaaactactagaagataaactaagattccaaattttccaagacaaccttcgcgaaatcgaagagcacaacgcaagatacgccaaaggagaggtgggatggttcaagggggtcactaaattcgccgattggaccaaagaagaattcgaggctctattaaaacgccaatctgcttcaaaacccaaacttgacaagagtttgggagtgtatactgccgatccaaacgttaaggtgccttcgtctgt

SEQ ID NO: 212 - DNA, 333 bp, Diabrotica virgifera
  Clone ID: LIB149-024-Q1-E1-D3
tgaagcggttcacccttgccgctgcccttattgtggccacaaatgccaatctacgtgccttcaaaaaatggacaacttttaacgcaacccatttcatatcctacaacgttattgacgacaaacttcgtttcgctgttttccaagacaacctcaaaaaaatcgaggaacacaatgctaaatacgacagtggagaagaaacctactaattggctgttaacaaattcgccgattggtccagcgctgaattccaagctatgttggcccgtcagatggctaacaagcccaaacaatcctttattgcaaaacacgtaaccgattccaatgtccaagctg

SEQ ID NO: 213 - DNA, 290 bp, Diabrotica virgifera
  Clone ID: pGUT4312
agtgagagaaaactcaaaatgaagctgttaattctagccgccaccctcattgtggccataaatgccaatttatctgcctttgagcaatggaccagttttaaggcaacacacaacaaattttacaacgttattgaggacaaacttcgttttgctgttttccaagagaatctccgcaaaatcgacgcacacaatgctaaatacgaaaagggagaagaaacctactacatggctgttaacaaattcgccgattggtccagcgcagaattccaagccatgttggaccgtcagat

SEQ ID NO: 214 - DNA, 366 bp, Diabrotica virgifera
  unsure (1)..(366): unsure at all n locations
  Clone ID: LIB149-006-Q1-E1-B3
cgcgtccaataaaaacattgaaagtgattgttgtaattgcttgtcttattgtggcaattactgccaaattgaacaattatgatcactgggtctccttcaaggctaaacattcanaacaatacaaactactagaagataaactaagattccaaattttccaagaaaaccttcgcgaaatcgaagagcacaacgcaagatacgccaaaggagaggtgggttggttcaagggggtcactaaattcgccgattggaccaaagaagaattcgaggctctattaaaacgccagtctgcttcaaaacccaaacttgacaagagtttgggagtgtatactgccgatccaaacgttaaggtgccttcgtctgttg

SEQ ID NO: 215 - DNA, 403 bp, Diabrotica virgifera
  Clone ID: LIB3026-024-Q1-E1-H9
cagttgttctttcataagaaaaatcagaatgaagctgttcatccttgacgctgcccttgttgtggccacaagtaccaatctaggtgccttcgaaaagtcgaccagttttaaggcaacccatagaacatcttacaacgttattgaagacacacttcgttgcgctgtgttcgaagacaacctcaaaatgttcgaggaacacaatgcggaatacgaaagtggagaagaaacctactagttggctgttaataaattcgccgattggtccagcgctgaattccacgctatgttagctcgtcagattgctaatactgccaaacagtccttaagtgcactacacgtaaccgatgccaatgtcaacgctgtagaaaaactgtattggagagatagtgcctttttgggattc

SEQ ID NO: 216 - DNA, 376 bp, Diabrotica virgifera
  Clone ID: LIB150-015-Q1-E1-C10
gaagtaaatacttccgtccaaaatgtgtaaaggtataaaaatgaaatattttgtgataattttaattgcaatttttgttacgattgaagctttaacagataaagaacaatggatgcaatataagaaaaagtacaacacaaactacaaatttagatcggtagacaacgaaagatttataatatttcaacaaaacttacgccaaatagaagaacacaatgccagagcagaaagtggtctctccacatttgaaatgggcattactaagtttgccgacatgacagcagaggaattttctcgatgggttagtcgctcccaaagcgaccacaacagaattttttcaaaaggtcaacagtcgctacatacggatctaagcatc

SEQ ID NO: 217 - DNA, 359 bp, Diabrotica virgifera
  unsure (1)..(359): unsure at all n locations
  Clone ID: LIB149-028-Q1-E1-E4
aattgtcttattgaggcaattactgccaaattgaacaattatgatcactgggtctccttcaangctaaacattcanaacaatacanactactaaaaagataaactaagattccaaattttcaaaganaaccttcgcgaaatccaagagcacaatgcaagatacgccaaangagaggtgggttggttcaaggnggtcactaaattcgccgattggaccaaagaagaattcgaggctctattaaaacgccaatctgcttcaaaacccaaacttgacaagagtttgggagtgtatactgccgatccaaacgttaaggtgccttcgtctgttgattggaggaccgagaatgcagtactgcctg

SEQ ID NO: 218 - DNA, 379 bp, Diabrotica virgifera
  unsure (1)..(379): unsure at all n locations
  Clone ID: LIB149-012-Q1-E1-F1
ccacgcgtcccgcaagaataagaaaatacacattgaaattgattgtggtaattgcttgcctaattgtggcaattacggccaaattgaccaattagaataacggggtccccttcaaggctaaacattcaaaacaatacaaactactagaagatanactaagattccaaattttccaagacaaccttcgcgaaatcgaagagcacaacgcaagatacgccaaaggagaggtgggatggttcaagggggtcactaaattcgccgattggaccaaagaagaattcgaggctctattaaaacgccaatctgcttcaaaacccaaacttgacaagagtttgggagtgtatactgccgattcaaacgttaaagtgccttcgtctgt

SEQ ID NO: 219 - DNA, 204 bp, Diabrotica virgifera
  Clone ID: pGUT813
cacaaatgccaatttatctgccttcgagcaatggaccagttttaaggcaacacacaacaaatcttacaacgttattgaggacaaacttcgttttgctgttttccaagagaatctccgcaaaatcgacgcacacaatgctaaatacgaaaagggagaagatacctactacatggctgttaacaaattcgccgattggtccagcgc

SEQ ID NO: 220 - DNA, 431 bp, Diabrotica virgifera
  unsure (1)..(431): unsure at all n locations
  Clone ID: LIB149-046-Q1-E1-E5
agttgaacacatcgcaatctaatctgataggctcttaaaaaattaaaataacacttaattataatgaagtatataacagttgcacgaaatttataaaaatattctagacgatagaattttgtgaccaagagtaagaatagatcatgaagttgctacttgttattgcgtgtctcattgcgggaatcaccgcagatttgaacgattatgaccaatacgtcctttttaaggcgaatcattcgaaacaatacagaatcacagaagataaactgagattccaaatcttccaaaaaaaccttcgagaaatcgaagagcacaacgcaagatacgccaaaggagaagtgggatggttcaagggtgtcactccatttgccgnattggacaaagaagagttcaaagctctaataacacgccaggctacttcaaagccaagc

SEQ ID NO: 221 - DNA, 239 bp, Diabrotica virgifera
  Clone ID: LIB3026-008-Q1-E1-H2
gttttccaagagaaccttcgcaaaatcgaagaacatagtaccaaatatgaaaacggagaagaaacctactatctcgccgttaatcaatttgccgattggtccaacgctgaatttaaagctatgttagactcccaaatgggtcaaaggccaaaactattggttgctgaaacattcgaagccgaattcaatttacaagttccaacagaagttgattggaggaataaaaaaggtgatttggg

SEQ ID NO: 222 - DNA, 385 bp, Diabrotica virgifera
  Clone ID: LIB149-038-Q1-E1-C7
gtgagtcgtattacatgcaatagattgttcaaaatgaagctgttcatccctgctgctgccctcattgtagccagtagtgctaatctaggtgccttctaaaaatggactagttttaaggccacccatagtatatcttacaacgttattgtagacatccttcgtttcgctgtcttccatgagaacctcaaatgtatcgaggaatacaatgctaaatactatagtggagaaggtacctactatttggctgttatcatattcgccgattggacaagcgctgaattcgaagctatgttggaccgtcaactggctaacaagcttgtaaaaaccttcattggtaaacacgtatgagatctcaatgtccacgctgcacatgattatgattggc

SEQ ID NO: 223 - DNA, 383 bp, Diabrotica virgifera
  Clone ID: LIB149-014-Q1-E1-H5
ctgacgcgtgggcggacgcgtgcgccgacgcctgcgctttcataagattggtcacaatgaatctgttcatccttgacgctgcccttagtggggccacaagtgccaatctaagtgccttcgacaaatggaccaattttaaggcaaccgataacacatcttgcaacgttattgacgacacacttcgtttcgctgttttccaacacaacctcaaagtgctcgatgaacacaatgctatatacaatagtggcgaacaaacatactacttggctgttaacaaattcgccgattggtctagcgctgaattccaagctatgttggcccgtcatatggctaacaagcccaatcactcctttattgcaatacacctagccgatcgcaatgtc

SEQ ID NO: 224 - DNA, 393 bp, Diabrotica virgifera
  Clone ID: LIB149-047-Q1-E1-D8
tacaagccactacagtgaggcgtattatcaagtctcttccctcagtggattcgtaaatcttgctataactgaagctgcactagataatgctcttgctaatgtccgtccaatatccagagctgttgatgcagatacatggcaacattatggaggtggagttttcagtaacatttactgtggaaccgcccgcaatcacggtattcttgccgtaagacacactatagatgactttatcgttgacaacacatggagaacaacttggggtgagaattggtacatcaaagtcatcagcggtaacaacttgtgtggtattaagcacatgaactcttatcccaaattgtaaatgataatgtatatataaaatatgtgtaatactaattaatatataaatat

SEQ ID NO: 225 - DNA, 228 bp, Diabrotica virgifera
  unsure (1)..(228): unsure at all n locations
  Clone ID: LIB3026-003-Q1-E1-F8
cggacgcgtggggggacaggtagcaattcaccaaaaccaaagagttcctctgagtcctcaatatcttgtcgactgcagtaggacaaattatggttgtagtggtggtattcaagaggatgctttcgaagaaattcgaaatataggtatatgtgccgacgcagattatccatacgaaggcgaaaatgagcgttgtcgtaaagccggcggagggggggnttanttctatct

SEQ ID NO: 226 - DNA, 412 bp, Diabrotica virgifera
  Clone ID: LIB149-033-Q1-E1-H6
aggtaaatacttccgtccaaaatgtgtaaagatataaaaatgaaatattttgtgataattttaattgcaatttttgttacgattgaagctttaacagataaagaacaatggatgcaatataagaaaaagtacaacaaaaactacaaatttagatcggtagacaacgaaagatttataatatttcaacaaaacttacgccaaatagaagaacacaatgccagagcagaaagtggtctctccacatttgaaatgggcattactaagtttgccgacatgacagcagaggaattttctcgatgggttagtcgctcccaaagcgaccacaacagatttttttcaaaaggtcaacagtcgctacatacggatctaagcatcaaagcaaatccaccttctgaagtggattggagaaaag

SEQ ID NO: 227 - DNA, 332 bp, Diabrotica virgifera
  Clone ID: LIB149-006-Q1-E1-D6
gcacgactcaagagtgagtcgaattagcagttaacagattcgccgattggtccagcgctgaattccatgctatgttggaccgtcagatggctaacacacttagacaatccgttattgcaaatcacgttgccgatcgcaatgtcgacgctgtagatgaagttgattggtgagatagtgccgttttgggagtcatacatcattgacactgtggatcatgctgggctttcagtagcaccggatctctcgagggtcagatcgcgatccacaagactcatcgtgttcctctcagtgagcaagcactggtaaactgtgatacatcaggaaatgcttgg

SEQ ID NO: 228 - DNA, 245 bp, Diabrotica virgifera
  Clone ID: LIB149-021-Q1-E1-B7
accacgcgtccggaaaaatcagaatgaagctgttcatccttgctgctgccctcattgtagccacaagtgccaatctaggtgccttcgaaaaatggactagttttaaggccacccataacaaatcttacaacgttaatgaagacaaacttcgtttccctgttttccaagagaaactcaaaaaaatccaagaacacaatgctaaatacgaaagttgagaagaaacctaataattggctgttaacaaa

SEQ ID NO: 229 - DNA, 388 bp, Diabrotica virgifera
  Clone ID: LIB149-046-Q1-E1-H3
acgaaaatggtcaacgcaattgcttaaaatgatcaagaacagtttgctgagtttaaacaaaagttccagaaagcttacgaatcttcagacgaggaaaacaataggtttaagatattccaagacaatttgcgagaaatagaagagcacaataaaaaatatgaaaagggtgaaactacatataccatgggtgtaaatcaattttctgatttgtctcctgaagaatgggctaatagaaaccatggatataggccaagaccaaatcatcaataatacaaaatgttattaaaaatgaaaaaaaattctcttatttgaaattaaatcttctgttcctactttaaaccaaaaaccaattttattaatgatgtactccaaatacttttaataaaat

SEQ ID NO: 230 - DNA, 329 bp, Diabrotica virgifera
  Clone ID: LIB150-015-Q1-E1-C11
ttccgtccacaatgtgtaaaggtacaaacatgaaatactttgtgataaatttaagtgcaatttttgttacgattgaagctttaacagataaagaacactggatgcaacatcagaaaaagtacaacacacactacatctttagatcggtagacaacgaaagatttatcatatttcaacaaaacttacgccaaatagaagagcacaatgccagagcacaaagtggtctctccacatttgaaatgggcattaccacgtttgccgacatgacagcagaggaattttccccgatgggttagtccctcccaagggcgaccacaacagaatttttt

SEQ ID NO: 231 - DNA, 406 bp, Diabrotica virgifera
  Clone ID: LIB149-023-Q1-E1-C6
agctgatcaatgctgatgcccacattgtggccgcaaatgccaatctatctgcatgctaacactggatccattttcaatgcaccacagcatgactcgtaccacgtgattgatgaacaacttcgtttcggagttttccaggagaagcttcgcaaaatcaagtaccatctgaccatatatgaactctgtgaatagacctactatctctccgtgaatcaagttgccgattggtccaccactcacttgatagctatgttagactctcaaatggctcagaggctaactctattggttgctgacacattcgatgccgatctctatattcaaggtccaacagaggttgattggatgagatggaaagctgatttggcagttaggattcatggaatctgtggatcctgctgggctt

SEQ ID NO: 232 - DNA, 437 bp, Diabrotica virgifera
  Clone ID: LIB149-008-Q1-E1-D8
cacacgcgtccgcggaaaaacaaaccagtttttagtaaactagggaagtaaatacttccgtccaaaatgtgtaaaggtataaaaatgaaatattttgtgataattttaattgcaatttttgttacgattgaagctttaacagataaagaacaatggatgcaatataagaaaaagtacaacaaaaactacaaatttagatcggtagacaacgaaagatttataatatttcaacaaaacttacgccaaatagaagaacacaatgccagagcagaaagtggtctctccacatttgaaatgggcattactaagtttgccgacatgacagcagaggaattttctcgatgggttagtcgctcccaaagcgaccacaacagatttttttcaaaaggtcaacagtcgctacatacggatctaagcatcaaagcaaatccaccttc

SEQ ID NO: 233 - DNA, 627 bp, Diabrotica virgifera
  Clone ID: pGUT3409
gattcctctacctatacttttagtgttagctgtcgcaacatccatcaaggctgaagtctctccggatattatagcagttcccaatggtttaagtggaaagggaattaccactagatactgggattgctgcaaaccatcatgtgcttgggcagacaatgtcaacacgcctgataaacaacctcttaagtcgtgcagagttgatggagaagctgtagccccacctaatgatccgtctggatgtgatataaatggttcttcgtttgtatgtaacaacaaccaaccgtatgtggttaactccactttatcctatggttttgcttctgcttccttttccggtggtattgatactagcatgtgttgttcctgcatgttactaaattttgagggtcagctgaaaggaaagcaattcttggttcaactcactaactctggtgaagagtatcagaccaaccaatttgatctcggtatccctggaggtggagtaggtttattccccaaagggtgtactgctcagtggaacgctcccagtactggttggggtgacttatacggaggagtccatactgaagaagagtgtaacgagctttctgaagttttacaaccaggatgcaaatggagggttacatt

SEQ ID NO: 234 - DNA, 449 bp, Diabrotica virgifera
  Clone ID: LIB3026-032-Q1-E1-B11
ccacgcgtccggaaaaaggcattagtggagagggaacaactacccgttattgggattgttgcaaaccttcctgctcatggaggggaaacgtccatacacctagcggagtaccagttgcctcatgcgatagatctggagtgaacagggttgatgctaatgcaaaatcaggttgtgagggtggcggcagtgcttacatgtgcaacagtcaacaaccatgggcagtaaatagcactttggcatatggttttggtgccgcgtctttcagtaacggaattgatgtatccttatgttgcgcttgtttcttacttagcttcaaagattaaatttcaaacaagaaaaatgattgtacaagttacaaatactggttctgatttgagtcataatcattttgacattgctcttcccggaggtggtgttggaattttcactcaaggttgtcatgaccaatg

SEQ ID NO: 235 - DNA, 453 bp, Diabrotica virgifera
  unsure (1)..(453): unsure at all n locations
  Clone ID: LIB3026-012-Q1-E1-D10
acaacatgaagatcgctatccttgtttcagcccttgtggctcttgcagtagctacccctttagaacaaagtccagaaattaaattcattgagaaaggcattagtggagagggaacaactacccgttattgggattgttgcaaaccttcctgctcatggaggggaaacgtccatacacctagcggagtaccagttgcctcatgcgatagatctggagtgaacagggttgatgctaatgcaaaatcaggttgtgagggtggcggcagtgcttacatgtgcaacagtcaacaaccatgggcagtaaatagcactttggcatatggttttggtgccgcgtctttcagtaacggaattgatgtatccttatgttgcgcttgtttcttacttagcttcaaagatcaaatttcanacaagaaaatgattgtacaggttacaaatactggttctgatttga

SEQ ID NO: 236 - DNA, 448 bp, Diabrotica virgifera
  Clone ID: LIB3026-004-Q1-E1-H5
caacatgaagatcgctatccttgtttcagcccttgtggctcttgcagtagctacccctttagaacaaagtccagaaattaaattcattgagaaaggcattagtggagagggaacaactacccgttattgggattgttgcaaaccttcctgctcatggaggggaaacgtccatacacctagcggagtaccagttgcctcatgcgatagatctggagtgaacagggttgatgctaatgcaaaatcaggttgtgagggtggcggcagtgcttacatgtgcaacagtcaacaaccatgggcagtaaatagcactttggcatatggttttggtgccgcgtctttcagtaacggagttgatgtatccttatgttgcgcttgtttcttacttagcttcaaagatcaaatttcaaacaagaaaatgattgtacaagttacaaatactggttctgat

SEQ ID NO: 237 - DNA, 405 bp, Diabrotica virgifera
  Clone ID: LIB3026-004-Q1-E1-A5
gttagctgtcgcaacatccatcaaggctgaagtctctccggatattatagcagttcccaatggtttaagtggaaagggaattaccactagatactgggattgctgcaaaccatcatgtgcttgggcagacaatgtcaacacgcctgataaacaacctcttaagtcgtgcagagttgatggagaagctgtagccccacctaatgatccgtctggatgtgatataaatggttcttcgtttgtatgtaacaacaaccaaccgtatgtggttaactccactttatcctatggttttgcttctgcttccttttccggtggtattgatactagcatgtgttgttcctgcatgttactaaattttgagggtcagctgaaaggaaagcaattcttggttcaactcactaactc

SEQ ID NO: 238 - DNA, 441 bp, Diabrotica virgifera
  unsure (1)..(441): unsure at all n locations
  Clone ID: LIB3026-005-Q1-E1-C8
gaagatcgctatccttgtttcagcccttgtggctcttgcagtagctacccctttagaacaaagtccagaaattaaattcattgagaaaggcattagtggagagggaacaactacccgttattgggattgttgcaaaccttcctgctcatggaggggaaacgtccatacacctagcggagtaccagttgcctcatgcgatagatctggagtgaacagggttgatgctaatgcaaaatcaggttgtgagggtggcggcagtgcttacatgtgcaacagtcaacaacaatgggcagtaaatagcactttggcataaggttttggtgccgcgtctttcagtaacggagttgatgtatccttatgttgcgcttgtttcttacttagcttcaaagatcaaatttcanacaagaaaatgattgtacaagttacaaatactggttctga

SEQ ID NO: 239 - DNA, 441 bp, Diabrotica virgifera
  unsure (1)..(441): unsure at all n locations
  Clone ID: LIB3026-022-Q1-E1-A12
gaagggggtctaagtggtaatggttccacaagccggtattgggactgttgtaagccagcatgtgcttggccctcaaatgttccgcatagtccaaggccagttactagttgtaaagctgacggaataacaccaataaatccagacgctatgtcaggttgtgaaaatggtactgcatatacgtgcacaaatcaacaaccatttattgttaatcaaacgtatggatatggatttgcagctgcttatttaattggtggaccgagcacaaacaacttttgctgtgcttgtttcttgcttaactttacagatcaaataaaatataaacacatggttgtacaggtaacaaacagtggtaccaactttgataaaaacgagttcgtcattgctctacctggaagcggtgtcngggatcacccagaaggttgccacgatcagtggaacgct

SEQ ID NO: 240 - DNA, 420 bp, Diabrotica virgifera
  unsure (1)..(420): unsure at all n locations
  Clone ID: LIB149-015-Q1-E1-G9
catgtttcagcccttgtggctcttgcagtagctacccctttagaacaaagtccagaaattaaattcattgagaaaggcattantggagaaggaacaactacccgttattgggattgttgcaaaccttcctgctcatggangggaaacgtccatacacctagcggagtaccagttgcctcatgcgatagatctggagtgaacagggttgatgctaatgcaaaatcaggttgtgagggtggcggcagtgcttacatgtgcaacagtcaacaaccatgggcagtaaatagcactttggcatatggttttggtgccgcgtctttcagtaacggagttgatgtatccttatgttgcgcttgtttcttacttagcttcaaagatcaaatttcanacaagaaaatgattgtacaagttacaaatact

SEQ ID NO: 241 - DNA, 423 bp, Diabrotica virgifera
  Clone ID: LIB3026-024-Q1-E1-B9
ggggtcacccacacgtccgcaaacgcgtccgggttttggtgctgcatctttcagtaacggaattgatgtatccttatgttgcgcttgtttcttacttagcttcaaagatcaaatttcaaacaagaagatgatcgtacaagttacaaatactggttctgatttaagtcataatcatttcgacatcgctcttcccggaggtggtgttggaattttcacacaaggttgtcatgaccaatggaatgccccatggaacggttggggtgaccaatatggtggagttcataacagaggggaatgtgctactcttcctcaagccttacagtctggatgctacttcagatttgatttctaccagaatgctaccaatccacgaatgcatttcgacgaagtctaaggccctgctgaaatcgttgccaggatctg

SEQ ID NO: 242 - DNA, 436 bp, Diabrotica virgifera
  Clone ID: LIB3026-005-Q1-E1-E11
caacatgaagatcgctatccttgtttcagcccttgtggctcttgcagtagctacccctttagaacaaagtccagaaattaaattcattgagaaaggcattagtggagagggaacaactacccgttattgggattgttgcaaaccttcctgctcatggaggggaaacgtccatacacctagcggagtaccagttgcctcatgcgatagatctggagtgaacagggttgatgctaatgcaaaatcaggttgtgagggtggcggcagtgcttacatgtgcaacagtcaacaaccatgggcagtaaatagcactttggcatatggttttggtgccgcgtctttcagtaacggaattgatgtatccttatgttgcgcttgtttcttacttagcttcaaagatcaaatttcaaacacgaaaatgattgtacaagttacaaat

SEQ ID NO: 243 - DNA, 447 bp, Diabrotica virgifera
  Clone ID: LIB3026-012-Q1-E1-A3
ggggcctccgcaacatgaaaatcgctatccttgtttcagcccttgtggctcttgcagtagctacccctttagaacaaagtccagaaattaaattcattgagaaaggcattagtggagagggaacaactacccgttattgggattgttgcaaaccttcctgctcatggaggggaaacgtccatacacctagcggagtaccagttgcctcatgcgatagatctggagtgaacagggttgatgctaatgcaaaatcaggttgtgagggtggcggcagtgcttacatgtgcaacagtcaacaaccatgggcagtaaatagcactttggcatatggttttggtgccgcgtctttcagtaacggaattgatgtatccttatgttgcgcttgtttcttacttagcttcaaagattaaatttcaaacaagaaaatgattgtacaagttacaaata

SEQ ID NO: 244 - DNA, 428 bp, Diabrotica virgifera
  Clone ID: LIB3026-001-Q1-E1-F4
accaagcgtccgcccacgcgtccgtgttgcgcttgtttcttacttagcttcaaagatcaaatttcaaacaagaaaatgattgtacaagttacaaatactggttctgatttgagtcataatcattttgacattgctcttcccggaggtggtgttggaattttcacacaaggttgtcatgaccaatggaatgccccatggaacggttggggtgaccaatatggtggagttcataacagaggcgaatgtgctactcttcctcaagcgttacagtctggatgttactttagatttgatttctaccagaatgctaacaatccaagaatgcatttcgaccaagtccaatgccctgctgaaatcgttgccagatctggttgcagtctttaaataataatataatataattatttgttttaaaacaattaagtttt

SEQ ID NO: 245 - DNA, 425 bp, Diabrotica virgifera
  Clone ID: LIB3026-007-Q1-E1-G5
cgctatcattgtttcagcccttgtggctcttgcagtagctacccctttagaacaaagcccagaaattaaattcattgagaaaggcattagtggagagggaacaactactcgttattgggattgttgcaaaccttcctgctcatggagaggaaatgtccatacacctagtggagtaccagttgcctcgtgcgatagatctggagtaaacagggttgatgctaatgcaaaatcaggttgtgagggtggcggcagtgcttatatgtgcaacagtcaacaaccatgggcagtaaatagcactttggcatatggttttggtgccgcgtctttcagtaacggggttgatgtaaccttaggttgcgcttgtttcctacttagcttcaaagatcaaatttcagacaagaaaatgattgtacaagttacaaata

SEQ ID NO: 246 - DNA, 419 bp, Diabrotica virgifera
  Clone ID: LIB3026-006-Q1-E1-G5
gaagatcgctatccttgtttcagcccttgtggctcttgcagtagctacccctttagaacaaagtccagaaattaaattcattgagaaaggcattagtggagagggaacaactacccgttattgggattgttgcaaaccttcctgctcatggaggggaaacgtccatacacctagcggagtaccagttgcctcatgcgatagatctggagtgaacagggttgatgctaatgcaaaatcaggttgtgagggtggcggcagtgcttacatgtgcaacagtcaacaaccatgggcagtaaatagcactttggcatatggttttggtgccgcgtctttcagtaacggaattgatgtatccttatgttgcgcttgtttcttacttagcttcaaagatcaaatttcaaacaagaaaatgattgtac

SEQ ID NO: 247 - DNA, 446 bp, Diabrotica virgifera
  unsure (1)..(446): unsure at all n locations
  Clone ID: LIB149-039-Q1-E1-F8
ctcgcgggtcgacacacgcctccagaatatctctatccatgtttcagcccttgtggctcttgcagtagctacccctttagaacaaagtccagaaattaaattcattgagaaaggcattagtggagagggaacaactacccgttattgggattgttgcaaaccttcctgctcatggaggggaaacgtccatacacctagcggagtaccagttgcctcatgcgatagatctggagtgaacagggttgatgctaatgcaaaatcaggttgtgagggtggcggcagtgcttacatgtgcaacagtcaacaaccatgggcagtaaatagcactttggcatatggttttggtgccgcgtctttcagtaacggagttgatgtatccttatgttgcgcttgtttcttacttagcttcaaagatcanatttcanacaagaaaatgattgtacaag

SEQ ID NO: 248 - DNA, 421 bp, Diabrotica virgifera
  Clone ID: LIB3026-035-Q1-E1-C11
aacatgaagatcgctatccttgtttcagcccttgtggctcttgcagtagctacccctttagaacaaagtccagaaattaaattcattgagaaaggcattagtggagagggaacaactacccgttattgggattgttgcaaaccttcctgctcatggaggggaaacgtccatacacctagcggagtaccagttgcctcatgcgatagatctggagtgaacagggttgatgctaatgcaaaatcaggttgtgagggtggcggcagtgcttacatgtgcaacagtcaacaaccatgggcagtaaatagcactttggcatatggttttggtgccgcgtctttcagtaacggagttgatgtatccttatgttgcgcttgtttcttacttagcttcaaagatcaaatttcaaacaagaaaatgattg

SEQ ID NO: 249 - DNA, 440 bp, Diabrotica virgifera
  Clone ID: LIB149-026-Q1-E1-H12
acaatcctctagagtgactcgtattatgtttcagcccttgtggctcttgcagtagctacccctttagaacaaagtccagaaattaaattcattgagaaaggcattagtggagagggaacaactacccgttattgggattgttgcaaaccttcctgctcatggaggggaaacgtccatacacctagcggagtaccagttgcctcatgcgatagatctggagtgaacagggttgatgctaatgcaaaatcacgttgtgagggtggcggcagtgcttacatgtgcaacagtcaacaaccatgggcagtaaatagcactttggcatatggttttggtgccgcgtctttcagtaacggagttgatgtatccttatgttgcgcttgtttcttacttagcttcagagatcaaatttcaaactagaagatgattgtacaagttacaaa

SEQ ID NO: 250 - DNA, 418 bp, Diabrotica virgifera
  Clone ID: LIB3026-035-Q1-E1-F12
aacatgaagatcgctatccttgtttcagcccttgtggctcttgcagtagctacccctttagaacaaagtccagaaattaaattcattgagaaaggcattagtggagagggaacaactacccgttattgggattgttgcaaaccttcctgctcatggaggggaaacgtccatacacctagcggagtaccagttgcctcatgcgatagatctggagtgaacagggttgatgctaatgcaaaatcaggttgtgagggtggcggcagtgcttacatgtgcaacagtcaacaaccatgggcagtaaatagcactttggcatatggttttggtgccgcgtctttcagtaacggagttgatgtatccttatgttgcgcttgtttcttacttagcttcaaagatcaaatttcaaacaagaaaatga

SEQ ID NO: 251 - DNA, 423 bp, Diabrotica virgifera
  Clone ID: LIB149-031-Q1-E1-B2
agtaacacaacatgaagatcgctatccttgtttcagcccttgtggctcttgcagtagctacccctttagaacaaagtccagaaattaaattcattgagaaaggcattagtggagagggaacaactacccgttattgggattgttgcaaaccttcctgctcatggaggggaaacgtccatacacctagcggagtaccagttgcctcatgcgatagatctggagtgaacagggttgatgctaatgcaaaatcaggttgtgagggtggcggcagtgcttacatgtgcaacagtcaacaaccatgggcagtaaatagcactttggcatatggttttggtgccgcgtctttcagtaacggagttgatgtatccttatgttgcgcttgtttcctacttagcttcaaagatcaaatttcaaacaagaaaa

SEQ ID NO: 252 - DNA, 428 bp, Diabrotica virgifera
  Clone ID: LIB3026-001-Q1-E1-C11
ggggcaagacaacatgaagatcgcaatccttgtttcagcccttgtggctcttgcagtagctacccctttagaacaaagtccagaaattaaattcattgaaaaaggcattagtggagagggaacaactacccgttattgggattgttgcaaaccttcctgctcatggaggggaaacgtccatacacctagcggagtaccagttgcctcatgcgatagatctggagtgaacagggttgatgctaatgcaaaatcaggttgtgagggtggcggcagtgcttacatgtgcaacagtcaacaaccatgggcagtaaatagcactttggcatatggttttggtgccgcgtctttcagtaacggagttgatgtatccttatgttgcgcttgtttcttacttagcttcaaagatcaaatttcaaacaagaaaatga

SEQ ID NO: 253 - DNA, 450 bp, Diabrotica virgifera
  Clone ID: LIB3026-032-Q1-E1-G2
cggcaaaacatgaagatcgctatcattgttcagccctggggctcctgcaataactaaccctttaaaacaaagcccaaaaattaaattcaatgagaaagggaataatggaaaaggaacaactactcgttaatgggattgttgcaaaccttcctgctcatggagaagaaatgtccatacacctagtggagtaacagttgcctcgtgcgatagatctggagtaaacagggttgatgctaatgcaaaatcaggttgtgagggtggcggcagtgcttatatgtgcaacagtcaacaaccatgggcagtaaatagcactttggcatatggttttggtgccgcgtctttcagtaacggggttgatgtatccttatgttgcgcttgtttcttacttagcttcaaagatcaaatttcaaacaagaaaatgattgtacaagttacaaatactggttctga

SEQ ID NO: 254 - DNA, 408 bp, Diabrotica virgifera
  Clone ID: LIB3026-002-Q1-E1-E8
agatcgctatccttgtttcagcccttgtggctcttgcagtagctacccctttagaacaaagtccagaaattaaattcattgagaaaggcattagtggagagggaacaactacccgttattgggattgttgcaaaccttcctgctcatggaggggaaacgtccatacacctagcggagtaccagttgcctcatgcgatagatctggagtgaacagggttgatgctaatgcaaaatcaggttgtgagggtggcggcagtgcttacatgtgcaacagtcaacaaccatgggcagtaaatagcactttggcatatggttttggtgccgcgtctttcagtaacggaattgatgtatccttatgttgcgcttgtttcttacttagcttcaaagatcaaatttcaaacaagaaaa

SEQ ID NO: 255 - DNA, 390 bp, Diabrotica virgifera
  Clone ID: LIB3026-028-Q1-E1-B9
cgcgtcagcccacgcgtccgaaatcaggttgtgagggtggcggcagtgcttacatgtgcaacagtcaacaaccatgggcagtaaatagcactttggcatatggttttggtgccgcgtctttcagtaacggaattgatgtatccttatgttgcgcttgtttcttacttagcttcaaagatcaaatttcaaacaagaaaatgattgtacaggttacaaatactggttctgatttgagtcataatcattttgacattgctcttcccggaggtggtgttggaattttcactcaaggttgtcatgatcactggaatgccccatggaacggttggggtgaccaatatggtggagttcatcacagatgcgattgtgctaatcttcctcaagctttac

SEQ ID NO: 256 - DNA, 416 bp, Diabrotica virgifera
  Clone ID: LIB3026-011-Q1-E1-H7
tgagcttgtttcttacttagcttcaaagatcaaatttcaaacaagaaaatgattgtacaagttacaaatactggttctgatttgagtcataatcattttgacattgctcttcccggaggtggtgttggaattttcacacaaggttgtcatgaccaatggaatgccccatggaacggttggggtgaccaatatggtggagttcataacagaggcgaatgtgctactcttcctcaagctttacagtctggatgttactttagatttgatttctaccagaatgctaacaatccaagaatgcatttcgaccaagtccaatgccctgctgaaatcgttgccagatctggttgcagtctttaaataataatataatataattatttgttttaaaacaattatgttttacttaagtatatact

SEQ ID NO: 257 - DNA, 423 bp, Diabrotica virgifera
  Clone ID: LIB149-011-Q1-E1-G11
aacacatcatgaagatcgctatccatgtttcagcccttgtggctcttgcagtagcgacccctttagaacaacgtccagaaattaaattcattgagaaaggcattagtggagagggaacaactacccgttattgggattgttgcaaaccttcctgctcatggaggggaaacgtccatacacctagcggagtaccagttgcctcatgcgatagatctggagtgaacagggttgatgctaatgcaaaatcaggttgtgagggtggcggcagtgcttacatgtgcaacagtcaacaaccatgggcagtaaatagcactttggcatatggttttggtgccgcgtctttcagtaacggagttgatgtatccttatgttgcgcttgtttcttacttagcttcaaagatcaaatttcaaacaagaaaatga

SEQ ID NO: 258 - DNA, 450 bp, Diabrotica virgifera
  unsure (1)..(450): unsure at all n locations
  Clone ID: LIB3026-030-Q1-E1-G11
gcgtccgtaaagatgctatcgttgtttcggcccttgtggcacttgcagtaactaaccctttagaacaaaacccacaaatttaatttatttagaaaagcattaatggagaaggaaaaactactcgttattgggattgttgcaaaccttcctgctcatggaggggaaacgtccatacacctagcggagtaccggttgcgtcatgcgatagatctggagtaaacagggttgatgataatgcaaaatcaggatgtgaaggtggcggcagtgcttacatgtgcaatagtcaacaaccctgggcagtaaatagcactttggcatatggttttggtgctgcatctttcagtaacggaattgatgtatccttatgttgcgcttgtttcctacttagcttcanagattaaatttcaaacaagaaaatgatcgtacaagttacaaatactggttctgatt

SEQ ID NO: 259 - DNA, 423 bp, Diabrotica virgifera
  Clone ID: LIB3026-009-Q1-E1-E11
aagcaaaagtggtgatggtgtaactacaagatactgggactgctgcgctccatcatgcgcttggtacccaagaatccacacgcaaaacggtgttcccatccaaacgtgtaaagccgatggtgttactccaagtgataaagacttaaacgcacaatctggttgcgaggttggtggagtagcatacacctgcactaaccaatcgcccaagatcattaacgagactttggcttacactttcgtagcagcctcattcgctggtggtcttgactacgccgactgctgcatatgtctggtcatggacttcaaaggtaagctcgccggaaaacgtttgttggctcaggttaccaatacaggtgaagctcttggccaaaaccatttcgatatccaaatgcccggaggtggagtacgcatctacaatctggg

SEQ ID NO: 260 - DNA, 404 bp, Diabrotica virgifera
  Clone ID: LIB3026-026-Q1-E1-B4
cattgtttcagcccttgtggctcttgcagtagctacccctttagaacaaagcccataaattaaattcattgagaaaggcattagtggagagggaacaactactcgttattgggattgttgcaaaccttcctgctcatggagaggaaatgtccatacacctagtggagtaccagttgcctcgtgcgatagatctggagtaaacagggttgatgctaatgcaaaatcaggttgtgagggtggcggcagtgcttatatgtgcaacagtcaacaaccatgggcagtaaatagcactttggcatatggttttggtgccgcgtctttcagtaacggggttgatgtaaccttatgttgcgcttgtttcttacttagcttcaaagatcaaatttcaaacaagaaaatgattg

SEQ ID NO: 261 - DNA, 368 bp, Diabrotica virgifera
  Clone ID: LIB149-039-Q1-E1-B5
atggaggggaaacgtccatacacctagcggagtaccagttgcctcatgcgatagatctggagtgaacagggttgatgctaatgcaaaatcaggttgtgagggtggcggcagtgcttacatgtgcaacagtcaacaaccatgggcagtaaatagcactttggcatatggttttggtgccgcgtctttcagtaacggagttgatgtatccttatgttgcgcttgtttcttacttagcttcaaagatcaaatttcaaacaagaaaatgattgtacaagttacaaatactggttctgatttgagtcataatcattttgacattgctcttcccggaggtggtgttggaattttcactcaaggttgtcatgacc

SEQ ID NO: 262 - DNA, 413 bp, Diabrotica virgifera
  Clone ID: LIB3026-001-Q1-E1-F10
aaaagatcgctatccttgtttcagcccttgtggctcttgcagtagctacccctttagaacaaagtccagaaattaaattcattgagaaaggcattagtggagagggaacaactacccgttattgggattgttgcaaaccttcctgctcatggaggggaaacgtccatacacctagcggagtaccagttgcctcatgcgatagatctggagtgaacagggttgatgctaatgcaaaatcaggttgtgagggtggcggcagtgcttacatgtgcaacagtcaacaaccatgggcagtaaatagcactttggcatatggttttggtgccgcgtctttcagtaacggagttgatgtatccttatgttgcgcttgtttcttacttagcttcaaagattaaattttaaacaagaaaatg

SEQ ID NO: 263 - DNA, 399 bp, Diabrotica virgifera
  unsure (1)..(399): unsure at all n locations
  Clone ID: LIB149-028-Q1-E1-B4
acacaacatgaagatcgctatccttgtttcagcccttgtggctcttgcagtagctacncctttagaacanagtccagaaattaaattcattgagaaaggcattagtggagaaggaacaactacccgttattgggattgttgcaaaccttcctgctcatggaggggaaacgtccatacacctagcggagtaccagttgcctcatgcgatagatctggagtgaacagggttgatgctaatgcaaaatcaggttgtgagggtggcggcagtgcttacatgtgcaacagtcaacaaccatgggcagtaaatagcactttggcatatggttttggtgccgcgtctttcagtaacggagttgatgtatccttatgttgcgcttgtttcttacttagcttcaaaga

SEQ ID NO: 264 - DNA, 392 bp, Diabrotica virgifera
  Clone ID: LIB149-022-Q1-E1-D9
accacgcgtccgcttttagtgttagctgtcgcaacatccatcaaggctgaagtctctccggatattatagcagttcccaatggtttaagtggaaagggaattaccactagatactgggattgctgcaaaccatcatgtgcttgggcagacaatgtcaacacgcctgataaacaacctcttaagtcgtgcagagttgatggagaagctgtagccccacctaatgatccgtctggatgtgatataaatggttcttcgtttgtatgtaacaacaaccaaccgtatgtggttaactccactttatcctatggttttgcttctgcttccttttccggtggtattgatactagcatgtgttgttcctgcatgttactaaattttgagggtcagctgaa

SEQ ID NO: 265 - DNA, 424 bp, Diabrotica virgifera
  Clone ID: LIB3026-034-Q1-E1-B10
cccacgcgtccgcacaacatgaagatcgctatccttgtttcagcccttgtggctcttgcagtagcttcccctttagaacaaagtccagaaattaaattcattgagaaaggcattagtggagagggaacaactacccgttattgggattgttgcaaaccttcctgctcatggaggggaaacgtccatacacctagcggagtaccagttgcctcatgcgatagatctggagtgaacagggttgatgataatgcaaaatcaggttgtgagggtggcggcagtgcttacatgtgcaacagtcaacaaccatgggcagtaaacagcactttggcatatggttttggtgccgcgtctttcagtaacggaattgatgtatccttatgttgcgcttgtttcttacttagcttcaaagatcaaatttcaaaca

SEQ ID NO: 266 - DNA, 406 bp, Diabrotica virgifera
  Clone ID: LIB3026-002-Q1-E1-A6
acccacgcgtccgcacaacatgaagatcgctatccttgtttcagcccttgtggctcttgcagtagctacccctttagaacaaagtccagaaattaaattcattgagaaaggcattagtggagagggaacaactacccgttattgggattgttgcaaaccttcctgctcatggaggggaaacgtccatacacctagcggagtaccagttgcctcatgcgatagatctggagtgaacagggttgatgctaatgcaaaatcaggttgtgagggtggcggcagtgcttacatgtgcaacagtcaacaaccatgggcagtaaatagcactttggcatatggttttggtgccgcgtctttcagtaacggagttgatgtatccttatgttgcgcttgtttcttacttagcttc

SEQ ID NO: 267 - DNA, 414 bp, Diabrotica virgifera
  Clone ID: LIB3026-019-Q1-E1-C6
cggacgcgtgggtttaagtaacacaacatgaagatcgctatcattgtttcagcccttgtggctcttgcagtagctacccctttagaacaaagcccagaaattaaattcattgagaaaggcattagtggagagggaacaactactcgttattgggattgttgcaaaccttcctgctcatggagaggaaatgtccatacacctagtggagtaccagttgcctcgtgcgatagatctggagtaaacagggttgatgctaatgcaaaatcaggttgtgagggtggcggcagtgcttatatgtgcaacagtcaacaaccatgggcagtaaatagcactttggcatatggttttggtgccgcgtctttcagtaacggggttgatgtatccttatgttgcgcttgtttcttacttagcttc

SEQ ID NO: 268 - DNA, 361 bp, Diabrotica virgifera
  unsure (1)..(361): unsure at all n locations
  Clone ID: pGUT969
aactacccgttattgggattgttgcaaaccttcctgctcatggaggggaaacgtccatacacctagcggagtaccagttgcctcatgcgatagatctggagtgaacagggttgatgctnnatgcaaatcaggtggtgatggtggcngcagtgcttacatgtgcaacagtcaacaaccatgggcagtaaatagcactttggcatatggttttggtgccgcgtctttcagtaacggagttgatgtatccttatgttgcgcttgtttcttacttagcttcaaagatcaaatttcaaacaagagnatgattgtacaagttacaaatactggttctgatttgagtcataatcattttgacattgct

SEQ ID NO: 269 - DNA, 412 bp, Diabrotica virgifera
  Clone ID: LIB3026-029-Q1-E1-B9
aggaagatcgctatccttgtttcagcccttgtggctcttgcagtagctacccctttagaacaaagtccagaaattaaattcattgagaaaggcattagtggagagggaacaactacccgttattgggattgttgcaaaccttcctgctcatggaggggaaacgtccatacacctagcggagtaccagttgcctcatgcgatagatctggagtgaacagggttgatgctaatgcaaaatcaggttgtgagggtggcggcagtgcttacatgtgcaacagtcaacaaccatgggcagtaaatagcactttggcatatggttttggtgccgcgtctttcagtaacggaattgatgtacccttatgttgcgcttgtttcttacttagcttcatagattaaatttcaaacaagaaaa

SEQ ID NO: 270 - DNA, 434 bp, Diabrotica virgifera
  Clone ID: LIB3026-020-Q1-E1-H9
gcgtccaaccacacgtccgcccacgcgtccggtaacacaacatgaagatcgctatcgttgtttcggcccttgtggcacttgcagtagctacccctttagaacaaagcccagaaattaaatttattgagaaaggcattagtggagagggaacaactactcgttattgggattgttgcaaaccttcctgctcatggaggggaaacgtccatacacctagcggagtaccggttgcgtcatgcgatagatctggagtaaacagggttgatgataatgcaaaatcaggatgtgaaggtggcggcagtgcttacatgtgcaatagtcaacaaccctgggcagtaaatagcactttggcatatggttttggtgctgcatctttcagtaacggaattgatgtatccttatgttgcgcttgtttcttacttagcttcaaagat

SEQ ID NO: 271 - DNA, 446 bp, Diabrotica virgifera
  Clone ID: LIB3026-032-Q1-E1-B8
agttattattcaagcgatgatttttattatattctttttgctagcctttgttggcctagctccttctatagatgctttagaactaactccagttgaagggggtctaagtggtaatggttccacaagccggtattgggactgttgtaagccagcatgtgcttggccctcaaatgttccgcatagtccaaggccagttactagttgtaaagctgacggaataacaccaataaatccagacgctatgtcaggttgtgaaaatggtactgcatatacgtgcacaaatcaacaaccatttattgttaatcaaacgtatggatatggatttgcagctgcttatttaattggtggaccgagcacaaacaacttttgctgtgcttgtttcttgcttaactttacagattaaataaaatataaacacatggttgtacaggtaacaaacagtggta

SEQ ID NO: 272 - DNA, 367 bp, Diabrotica virgifera
  Clone ID: LIB149-049-Q1-E1-F12
atgttagatgtcgcaacatccatcaaggctgaagtctctccggatattatagcagttcccaatggtttaagtggaaagggaattaccactagatactgggattgctgcaaaccatcatgtgcttgggcagacaatgtcaacacgcctgataaacaacctcttaagtcgtgcagagttgatggagaagctgtagccccacctaatgatccgtctggatgtgatataaatggttcttcgtttgtatgtaacaacaaccaaccgtatgtggttaactccactttatcctatggttttgcttctgcttccttttccggtggtattgatactagcatgtgttgttcctgcatgttactaaattttgagggtc

SEQ ID NO: 273 - DNA, 389 bp, Diabrotica virgifera
  Clone ID: LIB149-048-Q1-E1-E12
ctctacaatatgtcgatcgatatccttgtttcagcccttgtggctcttgcagtagctacccctttagaacaaagtccagaaattaaattcattgagaaaggcattagtggagagggaacaactacccgttattgggattgttgcaaaccttcctgctcatggaggggaaacgtccatacacctagcggagtaccagttgcctcatgcgatagatctggagtgaacagggttgatgctaatgcaaaatcaggttgtgagggtggcggcagtgcttacatgtgcaacagtcaacaaccatgggcagtaaatagcactttggcatatggttttggtgccgcgtctttcagtaacggagttgatgtatccttatgttgcgcttgtttcctact

SEQ ID NO: 274 - DNA, 443 bp, Diabrotica virgifera
  Clone ID: LIB149-029-Q1-E1-A8
acacaacatgaagatcgctatccttgtttcagcccttgtggctcttgcagtagctacccctttagaacaaagtccagaaattaaattcattgagaaaggcattagtggagagggaacaactacccgttattgggattgttgcaaaccttcctgctcatggaggggaaacgtccatacacctagcggagtaccagttgcctcatgcgatagatctggagtgaacagggttgatgctaatgcaaaatcaggttgtgagggtggcggcagtgcttacatgtgcaacagtcaacaaccatgggcaagtaatagcactttggcatatgggtttgggtgccgcgtccttcagttacggagttgatgtatccttaggttgcgcttgtttcctacttagcttcaaagatcaaatttcaaacaagaaaatgattgtacaagttacaaatact

SEQ ID NO: 275 - DNA, 402 bp, Diabrotica virgifera
  Clone ID: LIB3026-014-Q1-E1-A5
ggccgaccaacgcgtccacaaaagtggtgatggtgtaactacaagatactgggactgctgcgctccatcatgcgcttggtacccaagaatccacacgcaaaacggtgttcccatccaaacgtgtaaagccgatggtgttactccaagtgataaagacttaaacgcacaatctggttgcgaggttggtggagtagcatacacctgcactaaccaatcgcccaagatcattaacgagactttggcttacactttcgtagcagcctcgttcgctggtggtcttgactacgccgactgctgcatatgtccggtcatggacttcaaaggtaagctcgccggaaaacgtttgttggctcaggttaccaatacaggtgaaactcttggccaaaaccatttcgatatcca

SEQ ID NO: 276 - DNA, 415 bp, Diabrotica virgifera
  Clone ID: LIB3026-034-Q1-E1-E12
gggaaacgtccatacacctatcggagtaccatttgcctcatgcgatagatctggagtaaacagggttgatgatcaggcaaaatcacgttgtgagggtggcggcagtgcctacatgtgcaccagtcattatccatgggcagtaaataccacattggcatatgggtttggagccgcgtctttcagtaacgggattgatgtatccttatgttgcgcatgtttcttacgtaacttcaaagatcaaatttcatacaagaaaatgattgtacaagttacaaatactggttctgatttgagtcataatcattttgacattgctcttcccagaggtggtgttggaattttcacacaaggttgtcatgaccaatggaatgccccatggaacggttggggtgaccaaaatggtggagttcataac

SEQ ID NO: 277 - DNA, 413 bp, Diabrotica virgifera
  Clone ID: LIB3026-022-Q1-E1-F1
ccgccaacgcgtacgcacaacatgaagatcgctatcctagtttcagcccttgtggctcttgcagtagctacccctttagaacaaagtccagaaattaaattcattgagaaaggcattagtggagagggaacaactacccgttattgggattgttgcaaaccttcctgctcatggaggggaaacgtccatacacctagcggagtaccagttgcctcatgcgatagatctggagtaaacagggttgatgataatgcaaaatcaggttgtgagggtggccgcagtgcttacatgtgcaacagtcaacaaccatgggcagtaaatagcactttggcatatggttttggtgccgcgtctttcagtaacgggattgatgtaaccttaggttgcgcctgtttcttacttagcttcacaga

SEQ ID NO: 278 - DNA, 417 bp, Diabrotica virgifera
  Clone ID: LIB3026-035-Q1-E1-G10
cccacgcgtccgaaacaagaaaatgattgtacaagttacaaatactggttctgatttgagtcataatcattttgacattgctcttcccggaggtggtgttggaattttcactcaaggttgtcatgaccaatggaatgccccatggaacggttggggtgaccaatatggtggagttcataacagaggcgaatgtgctacccttcctcaagctttacagtctggatgttactttagatttgatttctaccagaatgctaacaatccaagaatgcacttcgaccaagtccaatgtcctgctgaaatcgttgccagatctggttgcagtctttaaataataatataatataattattggttttaaaacaattatgttttacttaagtatatactcaatttaaaaaaaaatagagccaaaaa

SEQ ID NO: 279 - DNA, 417 bp, Diabrotica virgifera
  Clone ID: LIB149-003-Q1-E1-A8
acccacgcgtccggcctgataaacaacctcttaagtcgtgcagagttgatggagaagctgtagccccacctaatgatccgtctggatgtgatataaatggttcttcgtttgtatgtaacaacaaccaaccgtatgtggttaactccactttatcctatggttttgcttctgcttccttttccggtggtattgatactagcatgtgttgttcctgcatgttactaaattttgagggtcagctgaaaggaaagcaattcttggttcaactcactaactctggtgaagagtatcagaccaaccaatttgatctcggtatccctggaggtggagtaggtttattccccaaagggtgtactgctcagtggaacgctcccagtactggttggggtgacttatacggaggagtccatactgaag

SEQ ID NO: 280 - DNA, 419 bp, Diabrotica virgifera
  Clone ID: LIB3026-004-Q1-E1-G7
agttaacacgaatatgttgtctttgaaaatagcagttgctattttgtcacttgcgggcgttactatcgcacaggatttaactcctatacctggtggcaaaagtggtgatggtgtaactacaagatactgggactgctgcgctccatcatgcgcttggtacccaagaatccacacgcaaaacggtgttcccatccaaacgtgtaaagccgatggtgttactccaagtgataaagacttaaacgcacaatctggttgcgaggttggtggagtagcatacacctgcactaaccaatcgcccaagatcattaacgagactttggcttacactttcgtagcagcctcgttcgctggtggtcttgactacgccgactgctgcatatgtctggtcatggacttcaaaggtaagctcgccggaaaac

SEQ ID NO: 281 - DNA, 415 bp, Diabrotica virgifera
  Clone ID: LIB3026-017-Q1-E1-A8
aacacgaatatgttgtctttgaaaatagcagttgctattttgtcacttgcgggcgttactatcgcacaggatttaactcctatacctggtggcaaaagtggtgatggtgtaactacaagatactgggactgctgcgctccatcatgcgcttggtacccaagaatccacacgcaaaacggtgttcccatccaaacgtgtaaagccgatggtgttactccaagtgataaagacttaaacgcacaatctggttgcgaggttggtggagtagcatacacctgcactaaccaatcgcccaagatcattaacgagactttggcttacactttcgtagcagcctcgttcgctggtggtcttgactacgccgactgctgcatatgtctggtcatggacttcaaaggtaagctcgccggaaaac

SEQ ID NO: 282 - DNA, 433 bp, Diabrotica virgifera
  Clone ID: LIB149-009-Q1-E1-A2
gaatatcgctatccatgtttcagcccttgtggctcttgcagtagctacccctttagaacaaagtccagaaattaaattcattgagaaaggcattagtggagagggaacaactacccgttattgggattgttgcaaaccttcctgctcatggaggggaaacgtacatacacctagcggagtaccagttgcctcatgcgatagatctggagtgaacagggttgatgataatgcaaaatcaggttgtgagggtggcggcagtgcttacatgtgcaacagtcaacaaccatgggcagtaaatagcactttggcatatggttttggtgccgcgtctttcagtaacggaattgatgtatccttatgttgtgagggtggcggcagtgcttacatgtgcaacagtcaacaaccatgggcagtaaatagcactttggcatat

SEQ ID NO: 283 - DNA, 373 bp, Diabrotica virgifera
  Clone ID: LIB149-010-Q1-E1-F7
acacaacatgaagatcgctatccttgtttcagcccttgtggctcttgcagtagctacccctttagaacaaagtccagaaattaaattcattgagaaaggcattagtggagagggaacaactacccgttattgggattgttgcaaaccttcctgctcatggaggggaaacgtacatacacctagcggagtaccagttgcctcatgcgatagatctggagtgaacagggttgatgataatgcaaaatcaggttgtgagggtggcggcagtgcttacatgtgcaacagtcaacaaccatgggcagtaaatagcactttggcatatggttttggtgccgcgtctttcagtaacggaattgatgtaaccttatgttgc

SEQ ID NO: 284 - DNA, 429 bp, Diabrotica virgifera
  unsure (1)..(429): unsure at all n locations
  Clone ID: LIB149-039-Q1-E1-G8
acccacgcgtccgcccacgcgtccgatgatttttattatattctctttgctagcctttgttggcctagctccttctatagatgctttagaactaactccagttgaagggggtctaagtggtaatggttccacaagccggtattgggactgttgtaagccagcatgtgcttggccctcaaatgttccgcatagtccaaggccagttactagttgtaaagctgacggaataacaccaataaatccagacgctatgtcaggttgtgaaaatggtactgcatatacgtgcacaaatcaacaaccatttattgttaatcaaacgtatggatatggatttgcagctgcttatttaattggtggaccgagcacaaacaacttttgctgtgcttgtttcttgcttaactttacagatcanataaaatataaacacat

SEQ ID NO: 285 - DNA, 376 bp, Diabrotica virgifera
  Clone ID: LIB3026-029-Q1-E1-G4
gacgacgcgtccacgctatcattgtttcagcccttgtggctcttgcagtagctacccctttagaacaaagtccagaaattaaattcattgagaaaggcattagtggagagggaacaactacccgttattgggattgttgcaaaccttcctgctcatggaggggaaacgtacatacacctagcggagtaccagttgcctcatgcgatagatctggagtgaacagggttgatgataatgcaaaatcaggttgtgagggtggcggcagtgcttacatgtgcaacagtcaacaatcatgggcagtaaatagcactttggcatatcgttttggtgccccgtctttcactaacggaattgacgtatccttatgttgcgcttg

SEQ ID NO: 286 - DNA, 405 bp, Diabrotica virgifera
  Clone ID: LIB3026-031-Q1-E1-F8
agatcacaccttcctgctcatggaggtgaaacctacatacacctagcggactaccacttgcctcatgcaatatatctggagtgaacagggttgatgacaacgcataatcaggttgtgagggtgacggcactgcttacatgtgcaacagtcaccatccatgggcactacctatcactttggcatatggttttggtgccgcgtctttcaataacggaattgatgtatccctaagttgcacttgttacttacataccttcagtgatcacatttcaaacacgacaattattgtacaaattaccaatactggttctgatttgactcataatcaatttgacattcctcttcccggatgtggtgttggcattttcacacaaggttgtcatgaccactggcatgccccatgga

SEQ ID NO: 287 - DNA, 397 bp, Diabrotica virgifera
  Clone ID: LIB3026-028-Q1-E1-C10
cggacgcgtgggcaacacgcctgataaacaacctcttaagtcgtgcagagttgatggagaagctgtagccccacctaatgatccgtctggatgtgatataaatggttcttcgtttgtatgtaacaacaaccaaccgtatgtggttaactccactttatcctatggttttgcttctgcttccttttccggtggtattgatactagcatgtgttgttcctgcatgttactaaattttgagggtcagctgaaaggaaagcaattcttggttcaactcactaactctggtgaagagtatcagaccaaccaatttgatctcggtatccctggaggtggagtaggtttattccccaaagggtgtactgctcagtggaaagctcccagtactggttggggtgac

SEQ ID NO: 288 - DNA, 361 bp, Diabrotica virgifera
  Clone ID: LIB3026-009-Q1-E1-D2
aacacaacatgaagatcgctatcctagtttcagcccttgtggctcttgcagtagctacccctttagaacaaagtccagaaattaaattcattgagaaaggcattagtggagagggaacaactacccgttattgggattgttgcaaaccttcctgctcatggaggggaaacgtccatacacctagcggagtaccagttgcctcatgcgatagatctggagtaaacagggttgatgctaatgcaaaatcaggttgtgagggtggcggcagtgcttacatgtgcaacagtcaacaaccatgggcagtaaatagcactttggcatatggttttggtgccgcgtctttcagtaacgggattgatgt

SEQ ID NO: 289 - DNA, 422 bp, Diabrotica virgifera
  Clone ID: LIB149-010-Q1-E1-F10
cataaatatcgctatccatgtttcaacgcttgtggctcttgcagtagctacccctttagaacaaagtctagatattaatttcattgataaaggcattagtggacagggaacagctaaccgttattgggattgttgcataccttcctgctcatggcagggaaacttctataaacctaacggtgtaccagttgcctcatgcgagatatctggagtgttcagggttgatgctaatgcatgatcaggttgtgagggtagtggcagtgcttacatgtgcatcagtcaacaagcataggcactagataacactttggcatatggttttggtgccgcgtcattcagtaacggcattgatgtatccttatgttgctcatgtgtcttacatagcttcacggatcaagtttcaaacaattaaatgattgttc

SEQ ID NO: 290 - DNA, 350 bp, Diabrotica virgifera
  Clone ID: LIB3026-010-Q1-E1-F3
taaagatcgctatccttgtttcagcccttgtggctcttgcagtagctacccctttagagcaaagtccagaaattaaattcattgagaaaggcattagtggagagggaacaactacccgttattgggattgttgcaaaccttcctgctcatggaggggaaacgtccatagacctagcggagtaccagttgcctcatgcgatagatctggagtgaacagggttcatgctaatgcaaaatcaggttgtgagggtggcggcagtgcttacatgtgcaacagtcaacagccatgggcagtaaatagcactttgggatatggttttggtgccgcgtctttcagtaacggagttgat

SEQ ID NO: 291 - DNA, 317 bp, Diabrotica virgifera
  unsure (1)..(317): unsure at all n locations
  Clone ID: pGUT1021
taaattttgagggtcagctgaaaggaaagcaattcttggttcaactcactaactctggtgaagagtatcagaccaaccaatttgatctcggtatccctggaggtggagtatgtttattccccaaagggtgtactgctcagtggaacgctcccagtactggttggggtgacttatacggaagagtccatactgaaaaaaagtgtaacgagcttcctgaagttttacaaccaggatgcanatggatgtttacatttatggaaggcgtttctaaccccgaagtgacattttatcaagtacaatgtccaagggatcttgtt

SEQ ID NO: 292 - DNA, 325 bp, Diabrotica virgifera
  Clone ID: LIB3026-020-Q1-E1-H4
tatccatgtttcagaccttgtggctcttgcagtagctacccctttagaacaaagtccagaaattaaattcattgagaaaggcattagtggagagggaacaactacccgttattgggattgttgcaaaccttcctgctcatggaggggaaacgtccatacacctagcggagtaccagttgcctcatgcgatagatctggagtgaacagggttgatgctaatgcaaaatcaggttgtgagggtggcggcagtgcttacatgtgcaacagtcaacaaccatgggcagtaaatagcactttggcatatggttttggtgccgcgtctttc

SEQ ID NO: 293 - DNA, 347 bp, Diabrotica virgifera
  Clone ID: LIB3026-018-Q1-E1-F1
acgctctacctatacttttagtgttagctgtcgcaacatccatcaaggctgaagtctctccggatattatagcagttcccaatggtttaagtggaaagggaattaccactagatactgggattgctgcaaaccatcatgtgcttgggcagacaatgtcaacacgcctgataaacaacctcttaagtcgtgcagagttgatggagaagctgtagccccacctaatgatccgtctggatgtgatataaatggttcttcgtttgtatgtaacaacaaccaaccgtatgtggttaactccactttatcctatggttttgcttctgcttccttttccggtggtattgatact

SEQ ID NO: 294 - DNA, 298 bp, Diabrotica virgifera
  Clone ID: LIB3026-026-Q1-E1-A11
attttgacattgctcttcccggaggtggtgttggaattttcacacaaggttgtcatgaccaatggaatgccccatggaacggttggggtgaccaatatggtggagttcataacagaggcgaatgtgctactcttcctcaagctttacagtctggatgttactttagatttgatttctaccagaatgccaacaatccaagaatgcatttcgaccaagtccaatgccctgctgaaatcgttgccagatctggttgcagtctttaaataataatataatataattatttgttttaaaacaa

SEQ ID NO: 295 - DNA, 353 bp, Diabrotica virgifera
  Clone ID: LIB3026-007-Q1-E1-B6
cccacgcgtccggaagatcgctatccttgtttcagcccttgtggctcttgcagtagctacccctttagaacaaagtccagaaattaaattcattgagaaaggcattagtggagagggaacaactacccgttattgggattgttgcaaaccttcctgctcatggaggggaaacgtacatacacctagcggagtaccagttgcctcatgcgatagatctggagtgaacagggttgatgataatgcaaaatcaggttgtgagggtgccggcagtgcttacatgtgcaacagtcaacaaccatgggcagtaaatagcactttggcatatggttttggtgccgcgtctttcagtaacg

SEQ ID NO: 296 - DNA, 355 bp, Diabrotica virgifera
  Clone ID: LIB3026-025-Q1-E1-B3
gtccgaataaagacgctatcgttgtttcggcccttgtggcacttgcagtagctacccctttagaacaaagcccagaaattaaatttattgagaaaggcattagtggagagggaacaactactcgttattgggattgttgcaaaccttcctgctcatggaggggaaacgtccatacacctagcggagtaccggttgcgtcatgcgatagatctggagtaaacagggttgatgataatgcaaaatcaggatctgaaggtggccgcagtgcttacatgtgcaatagtcaacaaccctgggcagtaaatagcactttggcatatggttttggtgctgcatctttcagtaacggaattga

SEQ ID NO: 297 - DNA, 308 bp, Diabrotica virgifera
  unsure (1)..(308): unsure at all n locations
  Clone ID: pGUT3873
gaacaactactcgttattgggattgttgcanaccttgctgctcatggaggggaaatgtccatacacctagcggagtaccggttgcgtcatgcgatagatctggagtaaacagggttgatgataatgcaaaatcaggatgtgaaggtggcggcagtgcttacatgtgcaatagtcaacaacccttggcagtaaatagcactttggcatatggttttggtgctgcatctttcagtaacggaattgatgtatccttatgttgcgcttgtttttacttagcttcaaagatcaaatttcaaacaagaaaatga

SEQ ID NO: 298 - DNA, 327 bp, Diabrotica virgifera
  Clone ID: LIB149-038-Q1-E1-H4
aaccctggttccaaccctgggggtccttgaattagctacccctttagaacaaagtcaagaaattaatttcattgaaaaaggcattagtggagagggaacagctacccgttattgggattgttgcaaaccttcctgctcatggaggggaaacgtccatacacctagcggagtaccagttgcctcatgcgatagatctggagtgaacagggttgatgctaatgcaaaatcaggttgtgatggtggcggcagtgcttacatgtgcaacagtcaacaggcatgggcagtagatagcaatttggcatatggttttggtgccgcgtctttcag

SEQ ID NO: 299 - DNA, 362 bp, Diabrotica virgifera
  Clone ID: LIB3026-008-Q1-E1-B10
aacacaacatgaagattcgcaacattgtttcagcccttgtggctcttgcagtagccacccctttagaacaaagcccagaaattaaattcattgagaaaggcattagtggaaaaggaacaactactcgttattgggattgttgcaaaccttcctgcctcatgaaaggaaatgtccatacacctagtggagtaccagttgcctcgtgcgcatagatctggagtaacacaggttgatgctaatgcaaaatcaggttgtgacggtggccgcagtgcttatatgtgcaacagtcaacaaccatgggcagtaaatagcactttggcatatggttttggtgccgcgtctttcagtaacggggttgatgt

SEQ ID NO: 300 - DNA, 364 bp, Diabrotica virgifera
  Clone ID: LIB3026-004-Q1-E1-F8
cccacgcgtccgcccacgcgtccggtaacacaacatgaagatcgctatccttgtttcagcccttgtggctcttgcagtagctacccctttagaacaaagtccagaaattaaattcattgagaaaggcattagtggagagggaacaactacccgttattgggattgttgcaaaccttcctgctcatggaggggaaacgtccatacacctagcggagtaccaattgcctcatgcgatagatctggagtgaacagggttgatgctaatgcaaaatcaggttgtgaaggtggcggcaatgcttacatgtgcaacagtcaacaaacaagggcagttaaaaacactttggcatatggttttggtgccccg

SEQ ID NO: 301 - DNA, 314 bp, Diabrotica virgifera
  Clone ID: pGUT4253
gcagtgcttacatgtgcaacagtcaacaaccatgggcgagtaaatagcactttggcatatggttttggtgccgcgtctttcagtaacggagttgatgtatccttatgttgcgcttgtttcttacttagcttcaaagatcaaatttcaaacaagaaaatgattgtacaagttacaaatactggttctgatttgagtcataatcattttgacattgctcttcccggaggtggtgttggaattttcactcaaggttgtcatgaccaatggaatgccccatggaacggtggggtgaccaatatggtggagttcataac

SEQ ID NO: 302 - DNA, 387 bp, Diabrotica virgifera
  Clone ID: LIB3026-008-Q1-E1-D5
aagatcgctatccttgtttcagcccttgtggctcttgcagtagctacccctttagaacaaagtccagaaattaaattcattgagacaggcattagtggagagggaacaactacccgttattgggattgttgcaaaccttcctgctcatggaggggaaacgtccatacacctagcggagtaccagttgcctcatgcgatagatctggagtgaacacggttgatgctactgcagaatcacgttgtgagggtggccgcaatgcttacatgttcaacagtcaacacccatgggcagtaaatagcactttggcatacggttttggtgccgcgtccttcactaaccgactttatgtacccttatgttgcgcttgtttcttacttagcttcaaa

SEQ ID NO: 303 - DNA, 300 bp, Diabrotica virgifera
  unsure (1)..(300): unsure at all n locations
  Clone ID: pGUT746
cttgtttcagcccttgtggctcttgcagtagctacccctttagaacaaagtccagaaattaaattcattgagaaaggcattagtggagagggaacaactacccgttattgggattgttgcaaaccttcctgctcatggaggggaaacgtccatacacctagcggagtaccagttgcctcatgcgataaatctggagtgaacagggttgatgctaatgcaaaatcaggttgtgatggtggcggcagtgcttacatgtgcaacagtcaacaaccatggggcagtaatancactttggcatat

SEQ ID NO: 304 - DNA, 344 bp, Diabrotica virgifera
  unsure (1)..(344): unsure at all n locations
  Clone ID: LIB149-022-Q1-E1-G7
aggaaatgtggaatacaaaaagccagtaaaagcgtgccaggctgacggagaaaacgccaatgatccagaaaatgagtctggatgtattggtggtcaatcttatatatgtacaaagcaatctggtttcgcaattaactcaactttagcctatgggtatgttgctgctcgtttccatggaacaactagaaacatgtgttgttcgtgcgttctcttcagtttccaacctcaagagttggctaataagaaaatgttggtacaagtaaccaacactggaaatgcacctgaaacaaacactaacttatttgatatcgccatgcctggaagtggagttggntattacacac

SEQ ID NO: 305 - DNA, 265 bp, Diabrotica virgifera
  unsure (1)..(265): unsure at all n locations
  Clone ID: pGUT4258
gtgcaatagtcaacaaccctgggcagtaaatagcacgttggcatatgggtttggtgcgtgcatctttcantaacggaattgatgtatccttatgttgcgcttgtttcttacttagcttcaaagatcaaatttcaaacaagaaaatgatcgtacaagttacaaatactggttctgatttaagtcataatcatttcgacatcgctcttcccggaggtggtgttggaattttcacacaaggttgtcatgaccaatggaatgccccatg

SEQ ID NO: 306 - DNA, 302 bp, Diabrotica virgifera
  Clone ID: LIB3026-022-Q1-E1-C5
cacgagtccgcacacgcgtccgattttcactcaaggttgtcatgaccaatggaatgccccatggaacggttggggtgaccaatatggtggagttcataacagaggcgaatgtgctacccttcctcaagctttacagtctggatgttactttacatgtgatttctaccagactgctaacaatccaagactgcacttctaccacgtccaatgtcctgctgaaatcgttgccagatctggttgcagtctttaaataataataccatatagttattcgttttaacacactcacgttttactcaact

SEQ ID NO: 307 - DNA, 375 bp, Diabrotica virgifera
  Clone ID: LIB3026-002-Q1-E1-C9
atgacgcatagcaagccttgttacatcccttgtggctcttgcagtagctagccctttacaacaaaggccagaaattatattgattgggaaaggcattagtggagagggaataactagccgttagtgggattgttgcaaaccttcctgctcagggaggggaaacgtccatacacctaacggagtaccagttgtctcatgcgatagatctggattgaacacggttgatgctaatgcaaaatcaggttgtaagggtggctgcaatgcttacatgtacaacagtcaagactcatgggcagtacataccactttggtatatagttttaggtccgagtctttcagtaactgagttgatgtagccgtatggttcacttgttt

SEQ ID NO: 308 - DNA, 240 bp, Diabrotica virgifera
  Clone ID: LIB3026-032-Q1-E1-C9
cagacgcgtggggctcagtggaacgctcccagtactggttggggtgacttatacggaggagtccatactgaagaagagtgtaacgagcttcctgaagttttacaaccaggatgcaaatggaggtttacatttatggaaggcgtttctaaccccgaagtgacattttatcaagtacaatgtccaagggaacttgttgaaagaagtggttgtgtattgtaaatagaatgagatagatacaat

SEQ ID NO: 309 - DNA, 275 bp, Diabrotica virgifera
  Clone ID: LIB3026-035-Q1-E1-D3
aagatcgctatccttgtttcagcccttgtggctcttgcagtagctacccctttagaacaaagtccagaaattaaattcattgagaaaggcattagtggagagggaacaactacccgttattgggattgttgcaaaccttcctgctcatggaggggaaacgtccatacacctagcggagtaccagttgcctcatgcgatagatctggagtgaacagggttgatgctaatgcaaaatcaggttgtgagggtggcggcagtgcttacatgtgcaacag

SEQ ID NO: 310 - DNA, 215 bp, Diabrotica virgifera
  Clone ID: pGUT3497
attcggcacgaggttggggtgacttatacggaggagtccatactgaagaagagtgtaacgagcttcctgaagttttacaaccaggatgcaaatggaggtttacatttatggaaggcgtttctaaccccgaagtgacattttatcaagtacaatgtccaagggaacttgttgaaagaagtggttgtgtattgtaaatagaatgagatagatacaat

SEQ ID NO: 311 - DNA, 273 bp, Diabrotica virgifera
  Clone ID: LIB3026-002-Q1-E1-A8
agaccaatggaatgccccatggaacggttggggtgaccaatatggtggagttcataacagaggcgaatgtgctactcttcctcaagctttacagtctggatgttactttagatttgatttctaccagaatgctaacaatccaagaatgcacttcgaccaagtccaatgtcctgctgaaatcgttgccagatctggttgcagtctttaaataataatataatataattatttgttttaaaacaattatgttttactaaagtatatactcaattt

SEQ ID NO: 312 - DNA, 244 bp, Diabrotica virgifera
  Clone ID: LIB3026-020-Q1-E1-G12
gtccgagccgcaactttcagtaacggagttgatgtatccttatgttgcgcttgtttcttacttagcttcaaagatgaaatttcaggcaagaaaatgattgtacaagttacaaatactggttctgatttgagtcataatcattttgacattgctcttcccggaggtggagttggaattttcactcacggttgtcatgaccaagggaatgccccatgcaaacggttggggtgaccaatatggtgga

SEQ ID NO: 313 - DNA, 285 bp, Diabrotica virgifera
  Clone ID: LIB3026-002-Q1-E1-E5
acaatggaatgccccatggaacggttggggtgaccaatatggtggggttcataacataggctaatgtgctactcttcctcaagctttacagtctggatgttactttagatttgatttctaccacaatgctaacaatccaagaatgcatttcgagcaagtccaatgccctgctgaaatcgttgccagatctggttgcagtctttacataataatataatataattatttgttttaaaacaattatgttttacttaagtatatactcaatcttaaaatatagaataa

SEQ ID NO: 314 - DNA, 262 bp, Diabrotica virgifera
  Clone ID: LIB3026-019-Q1-E1-F7
aggccccatggaacggttggggtgaccaatatggtggagttcataacagaggcgaatgtgctactcttcctcaagctttacagtctggatgttactttagatttgatttctaccagaatgctaacaatccaagaatgcacttcgaccaagtccaatgtcctgctgaaatcgttgccagatctggttgcagtctttaaataataatataatataattatttgttttaaaacaattatgttttactaaagtatatactcaattt

SEQ ID NO: 315 - DNA, 246 bp, Diabrotica virgifera
  Clone ID: pGUT1587
ttggggtgaccaatatggtggagttcataacagaggcgaatgtgctacccttcctcaagctttacagtctggatgttactttagatttgatttctaccagaatgctaacaatccaagaatgcacttcgaccaagtccaatgtcctgctgaaatcgttgccagatctggttgcagtctttaaataataatataatataattattggttttaaaacaattatgttttacttaagtatatactcaattt

SEQ ID NO: 316 - DNA, 245 bp, Diabrotica virgifera
  Clone ID: pGUT1435
ggggaccaatatggggggggttcattaccagaggcgaaaggggctacccttcctcaggctttacagtctggatgttactttagatttgatttctaccagaatgctaacaatccaagaatgcacttcgaccaagtccaatgtcctgctgaaatcgttgccagatctggttgcagtctttaaataataatataatataattattggttttaaaacaattatgttttacttaagtatatactcaattt

SEQ ID NO: 317 - DNA, 384 bp, Diabrotica virgifera
  Clone ID: LIB149-044-Q1-E1-D12
gggtcgagacacgcgtccaaccaaacgtccgaataaatgttggtttgtgcatgtaaaagtgttataaatataatttaaataataatgtataccggtatagtgaatatttttttggtttccatagccatagtcacagcatcttccaaagaatcatcaccagacatcgtggcaatacctggaggtcttagaggcgatgccataactaccagatactgggattgttgtgttgtatcttgcagttgggatgctaacgttcataccaaaaatcgtcaaccagtgaaatcttgccaaaagaatggagcaacctatagtacaagggagaataatggaaattcggtctgttatcctgaccatcccggaaatgcatatgtttgtaacaataat

SEQ ID NO: 318 - DNA, 178 bp, Diabrotica virgifera
  Clone ID: LIB3026-035-Q1-E1-G12
gaagatcgctatccttgtttcagcccttgtggctcttgcagtagctacccctttagaacaaagtccagaaattaaattcattgagaaaggcattagtggagagggaacaactacccgttattgggattgttgcaaaccttcctgctcatggaggggaaacgtccatacacctagcgga

SEQ ID NO: 319 - DNA, 192 bp, Diabrotica virgifera
  unsure (1)..(192): unsure at all n locations
  Clone ID: pGUT1057
taaattttgagggtcagctgaaaggaaagcaattcttggttcaactcactaactctggtgaagagtatcagaccaaccaatttgatctcggtatccctggaggtggagtaagtntattcnccaaatggtgtactgctcantggaacgctcccagtactggttggggtgacttatacngaggagtccatactg

SEQ ID NO: 320 - DNA, 453 bp, Diabrotica virgifera
  Clone ID: LIB149-010-Q1-E1-C9
agaaactatttgtcgcattcgcagccatcattttgagcgtcagtgctttgtcactcaacgaccattgggaaaactttaaggtcaaacatggcaaagcttacaaaaacccaatcgaggaaagagtccgcttttcagttttccaatccaatctgaaactcatcaacgaacacaatgccaaatacgagcaaggtcttgtaggttacacaatggcagtcaaccagttcggtgacatgacccaagaagagttcaaagccaagctcggtatgcaagcaaagaatatccctaacatcaagacaactcgtcatgttcaagatgtaaatgctgaggttccagactccattgactggagacaaaaaggtgccgttttaggtgttaaagatcaaggacagtgtggatcttgctgggctttcagtgctactggttccctggaaggacaaaattacatcatcaatg

SEQ ID NO: 321 - DNA, 438 bp, Diabrotica virgifera
  Clone ID: LIB3026-016-Q1-E1-G6
gatggccccattgggcatataactacattaaagatcacggcctctgtctagagtctgattacaagtatcaaggattagacggtgactgcaaacagtgtaatccggttctcaaaaccatcaatggctacgcatctgtagatcaaaccgaagaagcacttaaggaggctgtaggtactgttggcccaatatcagtatgtgtgaacgctaattgggactggcaactgtacagcggaggtatccttgatagccaaagttgtccaggcggcattttaaaccatgcagttttagctgttggatatggttcagaaaatggtaaagacttttggcttatcaagaattcatgggacacttattggggagaagcaggttatttgagattggtacgtggtacaaaccagtgcggtatcaatgaagttgccgattatcctctcctataat

SEQ ID NO: 322 - DNA, 404 bp, Diabrotica virgifera
  Clone ID: LIB149-005-Q1-E1-A10
aaccacgcatccggttttccaatccaatctgaaactcatcaacgaacacaatgccaaatacgagcaaggtcttgtaggttacacaatggcagtcaaccagttcgctgacatgacccaagaagagttcaaagccaagctcggtatgcaagcaaagaatatccctaacatcaagacaactcgtcatgttcaagatgtaaatgctgaggttccagactccattgactggagacaaaaaggtgccgttttaggtgttaaagatcaaggacagtgtggatcttgctgggctttcagtgctactggttccctggaaggacaaaattacatcatcaatggccaatcagtaggcctcagcgagcaagaacttttggattgttcctcagactacggaaatggcgactgcgact

SEQ ID NO: 323 - DNA, 432 bp, Diabrotica virgifera
  Clone ID: LIB149-016-Q1-E1-C4
atcgcgggtcaacacacgcgtctaaaactatttgtcgcattcgcagccatcattttgagcgtcagtgctttgtcactcaacgaccattgggaaaactttaaggtcaaacatggcaaagcttacaaaaacccaatcgaggaaagagtccgcttttcagttttccaatccaatctgaaactcatcaacgaacacaatgccaaatacgatcaaggtcttgtaggttacacaatggcagtcaaccagttcgctgacatgacccaagaagagttcaaagccaagctcggtatgcaagcaaagaatatccctaacatcaagacaactcgtcatgttcaagatgtaaatgttgaggttccagactccattgactggagacaaaaaggtgccgttttaggtgttaaagatcaaggacagtgtggatcttgctgggctttc

SEQ ID NO: 324 - DNA, 556 bp, Diabrotica virgifera
  Clone ID: pGUT3345
caaagatcctgtgggtcgtgttgggcattcagtagcgttggagctctagagggacaactagcaatcaactacaaccaaagagttcctttgagtcctcaatatcttgtcgactgttctgaggaaaacgatggatgtggtggtggagaccaaaggttagctttcaggtttcttaaacataaccgtatgccctccgaagaggattatccatatactatgaaagatgatgtttgccgagaaaatatcaaaatgtgtctcggtcccatctcgggatacacacatctgaatgcgacggaagaagacttataatatcatctctctctaccgtgggccaaatcgctgttcccgctgatgcaactaagtggtcattatatggaggaggagtttttgacgacgaataatgtggaaaaaatatacaccatgccatacttgctacaggttacactgatgagtacattgttatcaaatattcatggcgagcagattggggtgaagatggatacatgaagctagcaagaggacaaaatacgtgccaaattaacgtagataattcatatcc

SEQ ID NO: 325 - DNA, 412 bp, Diabrotica virgifera
  unsure (1)..(412): unsure at all n locations
  Clone ID: LIB3026-014-Q1-E1-D10
gactgtgacacatcaagaaatgctggttgtaacggaggtttgatgacagatgcctttaactatgttaaacgccatggtctctcttccgaatctcaatatgcatacaccggcagagatgatcgctgcaagaatgttgagaacaaaccactctcttccattagtggctacgtagaacttgaaacaactgaagatgcactcgcgtccgctgttgctagcgtaggtccagtttccatcgctgttgatgctgatacatggcaattatacggaggtggacttttcaacaacaaaaactgtagaaccaacctcaatcacggtgttcttgctgttggatacactaaagatgcattcattgtcaagaactcatggggaactagctggggtgaacaaggttacatcanagttgcccgtggtg

SEQ ID NO: 326 - DNA, 520 bp, Diabrotica virgifera
  unsure (1)..(520): unsure at all n locations
  Clone ID: pGUT3555
tcgcccgaggtttgatgacagatgcctttaactatgttaaaggccatggtctctcttccgaatctcaatatgcatacaccggcagagatggtcgctgcaagaatgttcagaacaaacaagtctcttccatcagtggctacgtagaacttgcaacaactgaaaatgcactcgtttccgctcttgctagcgtaggtccagtttccatcgctgttgatgctgatacatggcaattttatggaggtggagttttcaacaacagaaactgtggaaccgccctcaatcacggtattcttgctgttggatacactaaagatgtattcattgtcaagaactcatggggaactagctggggtgaaaaaggttacatcagagtagcccgtggtcacaacttgtgtggtattaacctcatgaactcttaccctaaattgtaaatgatttaatgtaaatgaaacaccaaatagaattcanaattaaagataaataaacaactaaaaaaaaaaaaaaaaaaactcgggggggg

SEQ ID NO: 327 - DNA, 363 bp, Diabrotica virgifera
  Clone ID: LIB149-014-Q1-E1-F4
atccaatctaaaactcatcaacgaacacaatgcaaaatacgagcgaggacttgttggttacacaatggcaattaatcagttcgctgatataactccagaagagttcaaagccaagctaggtatgcaagcaaagaacatccctaacatcaagaaaactcctcatgttcaagatgtaaatgctgaggttccagactccatcgattggagacaaaaaggtgccgtattgggagttaaagaccaaggagactgcggatcctgctgggcattcagtactactggttcccttgaaggacaaaactacatcatcaatggcaaatcagtaggcctcagcgagcaagaacttttggattgttcctcagacta

SEQ ID NO: 328 - DNA, 427 bp, Diabrotica virgifera
  Clone ID: LIB149-048-Q1-E1-F5
gatgtggtggtggagaccaaaggttagctttcaggtttcttaaacataaccgtatgccctccgaagaggattatccatatactatgaaagatgatgtttgccgagaagatgtcaaaatgtcgctcggtcccatctcgagatacacacatctgaatgcaacggaagaagctttaatttcagctctcgctaccgttggcccaatcgctgtttccgctgatgcaactaaatggtcattatatggaggaggagtttttgatgacgaagaatgtggaaaaaatataaaccatgccatacttgctacaggttacactgatgagtacattgttatcaaaaattcatggggagcagattggggtgaagatggatacatgaagctagcaagaggacaaaatacgtgccaaattaacgtagataattcatatcccac

SEQ ID NO: 329 - DNA, 366 bp, Diabrotica virgifera
  Clone ID: LIB149-031-Q1-E1-C2
agctaacaaaaacccaatcgaggaaagagtccgcttttcagttttccaatccaatctgaaactcatcaacgaacacaatgccaaatacgagcaaggtcttgtaggttacacaatggcagtcaaccagttcggtgacatgacccaagaagagttcaaagccaagctcggtatgcaagcaaagaatatccctaacatcaagacaactcgtcatgttcaagatgtaaatgctgaggttccagactccattgactggagacaaaaaggtgccgttttaggtgttaaagatcaaggacagtgtggatcttgctgggctttcagtgctactggttccctggaaggacaaaattacatcatcaatggcaaatc

SEQ ID NO: 330 - DNA, 413 bp, Diabrotica virgifera
  Clone ID: LIB149-003-Q1-E1-B9
aaatgaaactattcatcgcctttgcagctgttattctaagcgccggtgctctgtcactcaatcagcattgggaaagctttaaagtccaacatggcaaagtttacaaaaacccaatcgaggaaagagtccgcttctctgttttccaagcaaatttgaaaaccataaacgaacacaacgctaaatacgaacaaggacttgttggttacacaatggcagtcaaccagtttgctgacatgaccccagaagaattcaaagccaagcttggtatgcaagctaagaacatgcgcaagatcaagaaatcccgtcatgttcaaaatgtaaatgctgaggttccggactccattgattggagacaaaaaggtgccgttttaggtgttaaagatcaacgacagtgtggatcctgctgggctttc

SEQ ID NO: 331 - DNA, 436 bp, Diabrotica virgifera
  Clone ID: LIB149-013-Q1-E1-H1
aggcctccggaataatcgatgcacacaatgctaaatacgaaaagggagaagaaacctactacatggctgttaacaaattcgccgattggtccagcgcagaattccaagccatgttggaccgtcagatggctaacaagccaaaacaatccttcattgcaaaacacgtagtcgatcccaatgtccaagctgtagaagaagttgattggagagaaagtgctgttttgggagtcaaagatcaaggacagtgtggatcatgctgggctttcagtaccaccggatccctcgaaggtcaactcgccatccacaaaaatcaacgtgttcctctcagtgaacaagaattggtagactgtgataaggtaaacgatggttgtgacggaggtttgatgacagatgccttcttttatattgaacatcatggtccttcatcagaagaaca

SEQ ID NO: 332 - DNA, 434 bp, Diabrotica virgifera
  Clone ID: LIB149-016-Q1-E1-A4
gccgttaacagcttcgacgattggtccagcgctgaattccaagctatgttggcccgtcaaatggctaacaagccaaaacaaaccttcattggaaaacacgtagaagatcccaatgtccaagctgcagatgaagttgattggagatcaagcgctgacttgggagtcaaggatcaaggaaactgtggatcatgctgggctttcagtaccaccggatccctcgaaggtcaactcgccatccacaaaaatcaacgtgttcctctcagtgaacaagaattggtagactgtgacacagtaaatgctggttgtgacggaggtttgatgacagatgcctttaactatgttaaaggccatggtctctcttccgaatctcaatatgcatacaccggcagagatggtcgctgcaagaatgttcagaacaaacaagtcccctccaa

SEQ ID NO: 333 - DNA, 411 bp, Diabrotica virgifera
  Clone ID: LIB149-029-Q1-E1-B5
aaacagtgtaatccggttctcaaaaccatcaatggctatgcatctgtagatcaaaccgaagaagcacttaaggaggctgtaggtactgttggcccaatatcagtatgtgtcaacgctaattgggactggcaactgtacagcgggggtatccttgatagccaaagttgtccaggcggcattttaaaccatgcagttttagctgttggatatggttcagaaaatggtaaagacttttggcttatcaagaattcatgggacacttattggggagaagcaggttatttgagattggtacgtggtacaaaccagtgcggtatcaatgaagttgccgattatcctctcctataattttaaagattgtcatgccttacagtttatataatgaaacatgaataaaaatattatatcttt

SEQ ID NO: 334 - DNA, 416 bp, Diabrotica virgifera
  unsure (1)..(416): unsure at all n locations
  Clone ID: LIB149-027-Q1-E1-F10
cacgcctctaaaatcgttcgacctcagaagaggattatccatatactatgaaagatgatgtttgccgagaagatgtcaaaatgtctctcggtcccatctcgggatacacacatctgaatgcaacggaagaatctttaatttcagctctcgctaccgttggcccaatcgctgtttccgctgatgcaactaaatggtcattatatggaggaggagtttttgatgacgaagaatgtggaaaaaatataaaccatgccatacttgctacaggttacactgatgagtacattgttatcaaaaattcatggggagcagattggggtgaagatggatacatgaagctagcaagaggacaaaatacgtgccaaattaacgtagataattcatatcccactttataaattttanacacaaacttg

SEQ ID NO: 335 - DNA, 414 bp, Diabrotica virgifera
  Clone ID: LIB149-020-Q1-E1-B10
aggaaaaatcaagatgaaactattcatcgcctttgcagctgttattctaagcgccggtgctctgtcactcaatcagcattgggaaagctttaaagtccaacatggcaaagtttacaaaaacccaatcgaggaaagagtccgcttctctgttttccaagcaaatttgaaaaccataaacgaacacaacgctaaatacgaacaaggacttgttggttacacaatggcagtcaaccagtttgctgacatgaccccagaagaattcaaagccaagcttggtatgcaagctaagaacatgcccaagatcaagaaatcccgtcatgttcaaaatgtaaatgctgaggttccggactccattgattggagacaaaaaggtgccgttttaggtgttaaagatcaaggacagtgtggatcctg

SEQ ID NO: 336 - DNA, 446 bp, Diabrotica virgifera
  Clone ID: LIB3026-024-Q1-E1-A9
ggggtcacccacacgtccggatactactgcaaagagtgtattccggctatcaaaaaaatcaatggctattcatctataaataaaactgaagaagcacttaaggaggctgtaggtacggctggcccaattgcagtatgtgtcaacgctaatgacgactggcaactgtacagcgggggtatccttgagagccaaagttgcccaggcggcgaaagtataaaccatgcagttttagctgttggatatggttcagaaaatggtaaagacttttggcttatcaagaattcgtggaacacttattggggagaagaaggttatttgagaatagtacgtggtaaaaaccagtgtggtatcaatgaagtggccgattatcccctcctataattttaaaaattgtcatgccttgcaatataatgaaacatagataaaaatataactttacgtgttaa

SEQ ID NO: 337 - DNA, 419 bp, Diabrotica virgifera
  Clone ID: LIB3026-006-Q1-E1-D2
aaaatcaaaatgaaactattcatcccctttgcagctgttattcaagcgccggtgctctgtcactcaatcagcattgggaaagctttaaagtccaacatggcaaagtttacaaaaacccaatcgaggaaagagtccgcttctctgttttccaagcaaatttgaaaaccataaacgaacacaacgctaaatacgaacaaggacttgttggttacacaatggcagtcaaccagtttgctgacatgaccccagaagaattcaaagccaagcttggtatgcaagctaagaacatgcccaagatcaagaaatcccgtcatgttcaaaatgtaaatgctgaggttccggactccattgattggagacaaaaaggtgccgttttaggtgttaaagatcaaagacagtgtggatcctgccgggctttc

SEQ ID NO: 338 - DNA, 343 bp, Diabrotica virgifera
  Clone ID: pGUT3750
catgtttctttatataaactgtagggcacgacaatttttaaaattataggagaggataatcggcaacttcattgataccgcactggtttgtaccacgtaccaatctcaaataacctgcttctccccaataagtgtcccatgaattcttgataagccaaaagtctttaccattttctgaaccatatccaacagctaaaactgcatggtttaaaatgccgcctggacaactttggctatcaaggatacccccgctatacagttgccagtcccaattagcgttgacacatactgatattgggccaacagtacctacagcctccttaagtgcttcttcggttcggca

SEQ ID NO: 339 - DNA, 420 bp, Diabrotica virgifera
  Clone ID: LIB149-003-Q1-E1-H12
ctaaaatgagtcgtactactatacaggcgtagatggtcattgcaatcatgtaaaagacaaacaagtctcttcgatcagtggttacgtcgaacttgatgaaactgaaagtgctctagctgatgctctcgctaatgttggtccagtgtcaatagctgtcgaagctgatacatggcaattctattcaggtggagttttcaacaataaaaattgtggagacgctcttaaccacggtgttcttgctgtgggatacactaaagatgtcttcatcgttaaaaactcatggggaacaggctggggtgaacaaggttacatcagagttgcccgtggtagcaacttatgtggtattaacctcatgaactcttaccccaagttgtagataacagttaatgaaaagtgatatatttataataataaatgata

SEQ ID NO: 340 - DNA, 391 bp, Diabrotica virgifera
  Clone ID: LIB149-013-Q1-E1-A12
aaaaaatcaaaatgaaactatttgtcgccttcgcagccatcattttgagcgtcagtgctttgtcactcaacgaccattgggaaaactttaaggtcaaacatggcaaagcttacaaaaacccaatcgaggaaagagtccgcttttcagttttccaatccaatctgaaactcatcaacgaacacaatgccaaatacgatcaaggtcttgtaggttacacaatggcagtcaaccagttcgctgacatgacccaagaagagttcaaagccaagctcggtatgcaagcaaagaatatccctaacatcaagacaactcgtcatgttcaagatgtaaatgttgaggttccagactccattgactggagacaaaaaggtgccgttttaggtgttaaaga

SEQ ID NO: 341 - DNA, 377 bp, Diabrotica virgifera
  Clone ID: LIB149-037-Q1-E1-B6
tgagtcgtagtaatcatcttgagcgccagtgctttgtcactcaacgaccattgggaaaactttaaggttaaacatggcaaagcttacaaaaacccaatcgaggaaagagtccgcttctcagttttccaatccaatctaaaactcatcaatgaacacaatgcaaaatacgagcaaggagttgttggttacacaatggcaataaatcagttcgctgacataactccagaagagttcaaagccaagctaggtatgcaagcaaagaacatccctaacatcaagaaaactcctcatgttcaagatgtaaatgctgaggttccagactccatcgattggagacaaaaaggtgccgtattgggagttaaagaccaaggagactg

SEQ ID NO: 342 - DNA, 422 bp, Diabrotica virgifera
  Clone ID: LIB149-025-Q1-E1-E10
aaaagacacagaataatgggtgaagtttaagattagacataacaaaagttatagaaattacattgaagaacataagcgatttacaaattttcaagataatctaaggaaaatcgcatatcacaatgaccaatttgataagggactgtctacttttaagttgggtgtaaccaaatttgcagatttgactgaaaaagaatttttcgatatgttaggactttccaaaagtaacatatccactagaactcgtgttactcactcacttgctccagtaaaagatcttccatccaagtttgattggagagaacaatgagcagtaactgaggtcaatgatcaaggatcatgtggctcctgttggaggttttagtacgactggtacagtagaaggagcttattttcttaaaacaggaaaactggtctcttta

SEQ ID NO: 343 - DNA, 393 bp, Diabrotica virgifera
  Clone ID: LIB149-028-Q1-E1-H5
aaatacccctatacaggcgtagatggtcattgcaatcatgtaaaagacaaacaagtctcttcgatcagtggttacgtcgaacttgatgaaactgaaagtgctctagctgatgctctcgctaatgttggtccagtgtcaatagctgtcgaagctgatacatggcaattctattcaggtggagttttcaacaataaaaattgtggagacgctcttaaccacggtgttcttgctgtgggatacactaaagatgtcttcatcgttaaaaactcatggggaacaggctggggtgaacaaggttacatcagagttgcccgtggtagcaacttatgtggtattaacctcatgaactcttaccccaagttgtagataacagtttatggaaagtgataaaat

SEQ ID NO: 344 - DNA, 396 bp, Diabrotica virgifera
  Clone ID: LIB149-009-Q1-E1-C6
cccacgcgtccgcccacgcgtccgcggacgcgtgggcggacgcgtgggaagaagtagcagccaatgaggaatctttaagacaagcagttggtactgttggtccaatttctgcagcaattaacgctaatcccctccaattctactcaagtggtgtttttgacggccagtgcgcaaatagcaggaatgacttggatcacggcatcctggtcgtaggttatggtgaagaaaacaacaagccttattggatcatcaagaactcatggggtgcagattggggtgagcaaggttacttcagactggagagaaatgttaatatgtgcggattggatttagtgacaagttacccagttctgtaaacatattctcagtcttcataattgaataaaatgtttttat

SEQ ID NO: 345 - DNA, 392 bp, Diabrotica virgifera
  Clone ID: LIB149-006-Q1-E1-B1
agaaaaatcaaaatgaaactatttgtcgccttcgcagccatcattttgagcgtcagtgctttgtcactcaacgaccattgggaaaactttaaggtcaaacatggcaaagcttacaaaaacccaatcgaggaaagagtccgcttttcagttttccaatccaatctgaaactcatcaacgaacacaatgccaaatacgagcaaggtcttgtaggttacacaatggcagtcaaccagttcggtgacatgacccaagaagagttcaaagccaagctcggtatgcaagcaaagaatatccctaacatcaagacaactcgtcatgttcaagatgtaaatgctgaggttccagactccattgactggagacaaaaaggtgccgttttaagtgttaaaga

SEQ ID NO: 346 - DNA, 414 bp, Diabrotica virgifera
  Clone ID: LIB3026-019-Q1-E1-A11
agtgcatacaccggcagagatgatcgctgcaagaatgttgagaacaaaccactctcttccattagtggctacgtagaacttgaaacaactgaagatgcactcgcgtccgctgttgctagcgtaggtccagtttccatcgctgttgatgctgatacatggcaattatacggaggtggacttttcaacaacaaaaactgtagaaccaacctcaatcacggtgttcttgctgttggatacactaaagatgcattcattgtcaagaactcatggggaactagctggggtgaacaaggttacatcagagttgcccgtggtgaaaacttgtgtggtattaacctcatgaactcttaccctaaattgtaaatgatttaatgcaaatgaaacaccaattggaattcagaaataaggataatt

SEQ ID NO: 347 - DNA, 424 bp, Diabrotica virgifera
  Clone ID: LIB3026-034-Q1-E1-H12
cccacgcgaccggttctttaagaaaagtcaaaatgaaactattcatcgcctttgcagctgttattctaagcgccagtgctttgtcactcaatcagcattgggaaagctttaaagtccaacatggcaaagtttacaaaaacccaatcgaggaaagagtccgcttctctgttttccaagcaaatttgaaaaccataaacgaacacaacgctaaatacgaacaaggacttgttggttacacaatggcagtcaaccagttcgctgacatgaccccagaagaattcaaagccaagcttggtatgcaagctaagaacatgcccaagatcaagaaatcccgtcatgttcaaaatgtaaatgctgaggttccggactccattgattggagacaaaaaggtgccgtattgggagtcaaagatcaaggacagtg

SEQ ID NO: 348 - DNA, 400 bp, Diabrotica virgifera
  Clone ID: LIB3026-006-Q1-E1-E5
aaagatgttaaaaaagcgattagttctatttctggatataagaaatgtaatccaaccgaagaagatttgatttctgctgttgctactgtgggacccatatcttctactgtcgatgcatccacatggtcattgtatgcaggaggtatcctggatgacacgaattgtggagattggctcaatcatgctgtgcttgctgtaggttataccgatgactacatcctgatcaaaaattcttggggtgaagactggggtgaagaaggatacataaagctagctcgagggcataacatatgcgcaattaacgaagataattcctatcccgttttgttaattttaaatttaaatttggaccaacaacaatgaaaaatgtgatataaatgtataataaactaataatagt

SEQ ID NO: 349 - DNA, 400 bp, Diabrotica virgifera
  Clone ID: LIB149-039-Q1-E1-H5
ctcgcgggtcgatacacgcgtctaaacacacgtctgggacgctgcaagaatgttcagaacaaacaagtctcttccatcagtggctacgtagaacttggaacaactgaaaatgcactcgtttccgctcttgctagcgtaggtccagtttccatcgctgttgatgctgatacatggcaattctatggaggtggagttttcaacaacagaaactgtggaaccgccctcaatcacggtattcttgctgttggatacacgaaagatgtattcattgtcaagaactcatggggaactagctggggtgaaaaaggttacatcagagtagcccgtggtcacaacttgtgtggtattaacctcatgaactcttaccctaaattgtaaatgatttaatgtaaatgaaaca

SEQ ID NO: 350 - DNA, 415 bp, Diabrotica virgifera
  Clone ID: LIB149-043-Q1-E1-G1
gggtcccagcacgcgtccgcacacacgtccggaaaaatcaaaatgaaactatttgtcgccttcgccgtcatcatcttgagcgccagtgctttgtcactcaacgaccattgggaaaactttaaggttaaacatggcaaagcttacaaaaacccaatcgaggaaagagtccgcttctcagttttccaatccaatctaaaactcatcaatgaacacaatgcacaatacgagcaaggagttgttggttacacaatggcaataaatcagttcgctgacataactccagaagagttcaaagccaagctaggtatgcaagcaaagaacatccctaacatcaagaaaactcctcatgttcaagatgtaaatgctgaggttccagactccatcgattggagacaaaaaggtgccgtattgggag

SEQ ID NO: 351 - DNA, 331 bp, Diabrotica virgifera
  Clone ID: LIB149-007-Q1-E1-D5
gtggattcgtaaatcttgctagaactgaaactgcactagttaatgctcttgctaatgtcggtccaatatctatagctgttgatgcagatacatggcagcattatggaggtggagttttcaataacaaaaattgtggaaccgccctcaatcacggtattcttgccgtaggatacactaaagatgcctttatcgttaagaactcatggggaacaagttggggtgagaatggttacatcagagtcatccgcggtaagaacttgtgcggtattaaccaaatgaactcttatcccaaattgtaaatgataataaatagataaaatatgtataatat

SEQ ID NO: 352 - DNA, 403 bp, Diabrotica virgifera
  unsure (1)..(403): unsure at all n locations
  Clone ID: LIB3026-027-Q1-E1-A9
agcaaccatgtaaaaaacaaacaagtctcttcgatcaatggttacgtcgaacttgatgaaactgaaagtgctctagctgatgctctcgctactgttggtccagtgtcaatagctgtcgacgctgatacatggcaattctattcaggtggagttttcaacaataaaaattgtggaaacgctcttaaccatggtgttcttgctgtgggatacactaaagatgccttcgtcgttaaaaactcatggggaacaagctggggtgaacaaggttacatcagagttgcccgtggtagcaacctatgtggtattaacctcatgaactcttaacccaangttgtaaataacagttaataaaaaatatatataatactaaatgatataattttaacaaaaataaaaaaataaa

SEQ ID NO: 353 - DNA, 396 bp, Diabrotica virgifera
  Clone ID: pGUT2360
cttccctcagtggattcgtaaatcttgctagaactgaaactgcactagttaatgctcttgctaatgtcggtccaatatctatagctgttgatgcagatacatggcagcattatggaggtggagttttcaataacaaaaattgtggaaccgccctcaatcacggtattcttgccgtaggatacactaaagatgcctttatcgttaagaactcatggggaacaagttggggtgagaatggttacatcagagtcatccgcggtaagaacttgtgcggtattaaccaaatgaactcttatcccaaattgtaaatgataataaatagataaaatatgtataatataaataaatatataaatatgaaaaaaaatgtataatataaataaaaaaataactgtg

SEQ ID NO: 354 - DNA, 300 bp, Diabrotica virgifera
  Clone ID: LIB149-040-Q1-E1-C12
actcgcgtccgctgttgctagcgtaggtccagtttccatcgctgttgatgctgatacatggcaattatacggaggtggacttttcaacaacaaaaactgtagaaccaacctcaatcacggtgttcttgctgttggatacactaaagatgcattcattgtcaagaactcatggggaactagctggggtgaacaaggttacatcagagttgcccgtggtgaaaacttgtgtggtattaacctcatgaactcttaccctaaattgtaaatgatttaatgcaaatgaaacaccaaatagaattc

SEQ ID NO: 355 - DNA, 279 bp, Diabrotica virgifera
  Clone ID: LIB3026-026-Q1-E1-H4
gatagccaaagttgtccaggcggcattttaaaccatgcagttttagctgttggatatggttcagaaaatggtaaagacttttggcttatcaagaattcatgggacacttattggggagaagcaggttatttgagattggtacgtggtacaaaccagtgcggtatcaatgaagttgccgaatatcctctcctaaaattttaaaaattgtcataccttacagtttatataatgaaacatgaataacaatattataactttaaaaaaaacctccacccaaaa

SEQ ID NO: 356 - DNA, 409 bp, Diabrotica virgifera
  Clone ID: LIB149-032-Q1-E1-H5
acccacgcgtccgtgttgttcttcgagaaaaatcaaaatgaaactatttgtcgccttcgcagccatcattttgggcgccagtgctttgtcactcaacgaccattgggaaaactttaaggtcaaacatggcaaagcttacaaaaacccaatcgaggaaagagtccgcttctcagttttccaatccaatctaaaactcatcaacgaacacaatgcaaaatacgagcaaggacttgttggttacacaatggctattaatcagttcgctgacataactccagaagagttcaaagccaagctaggtgtgcaagcaaagaacatccctaacatcaagaaaactcctcatgttcaagatgtaaatgctgaggttccagactccatcgattggagacaaaaaagtgctgtagttggg

SEQ ID NO: 357 - DNA, 254 bp, Diabrotica virgifera
  unsure (1)..(254): unsure at all n locations
  Clone ID: LIB3026-002-Q1-E1-A2
acccacgcgtccgtataaaccatgcagttttagctgttggatatggttcagaaaatggtaaagacttttggcttatcaagaattcgtggaacacttattggggagaagaaggttatttgagaatagtacgtggtaaaaaccagtgtggtatcaatgaagtggccgattatcccctcctataattttaaaaattgtcatgccttacaatataatgaaacatataacaaatattataatcanaaacaaatgaaaga

SEQ ID NO: 358 - DNA, 448 bp, Diabrotica virgifera
  Clone ID: LIB149-026-Q1-E1-D4
acgcgtccgaatgttccttcaaaagaaaaatccaaattgaaccggtcaacccttgcggcggccctaattgtggcaacaattgccaatcaaggtgccttcgaaaaatggacaagttttaaggcaacccataacaaatcttacaacgttattgaagacaaacttcgtttcgctgttttccaagacaacctcaaaaaaatcgaggaacacaattgctaaatacgaaagtggagaagaaacctactacttggctgttaacaaattcgccgattggtccagcgctgaattccaagctatgttggcccgtcagatggctaacaagcccatacaatcctttattgcaaaacacgtagccgatcccaatgtccaagctgtacaagaagttgattggagagatagtgccgttttgggagtcaaagatcaaggacagtgtggatcatgctgggctttc

SEQ ID NO: 359 - DNA, 208 bp, Diabrotica virgifera
  Clone ID: LIB3026-017-Q1-E1-F3
aggatatggttcagaaaatggtaaagacttttggcttatcaagaattcatggaacacttattggggagaagcaggttatttgagactagtacgtggtaaaaaccattgcggtatcagtgaagtggccgattatcctctcctataatttaaaaaattgtcatgtctgacagtttatataatgaaacataaataaaaatattataacttt

SEQ ID NO: 360 - DNA, 336 bp, Diabrotica virgifera
  unsure (1)..(336): unsure at all n locations
  Clone ID: LIB149-024-Q1-E1-H2
agaaaaatcanaataaaacaatttgccccctcccaaccaaccattttaaccttcattcctttgccactcaacaacaattggaaaaacttaaaggtcaaacatggcaaagcttacaaaaacccaatcgaggaaagagtccgcttttcagttttccaatccaatctgaaactcatcaacgaacacaatgccaaatacgagcaaggtcttgtangttacacaatggcagtcaaccagttcggtgacatgacccaagaagagttcaaagccaagctcggtatgcaagcaaagaatatccctaacatcaagacaactcgtcatgttcaagatgtaaatgct

SEQ ID NO: 361 - DNA, 300 bp, Diabrotica virgifera
  Clone ID: LIB149-049-Q1-E1-G11
attatggaggtggagttttcaataacaaaaattgtggaaccgccctcaatcacggtattcttgccgtatgatacactaaagatgcctttatcgttaagaactcatggggaacaagttggggtgagaatggttacatcagagtcatccgcggtaagaacttgtgcggtattaaccaaatgaactcttatcccaaattgtaaatgataataaatagataaaatatgtataatataaataaatatataaatatgaaaaaaaaaaaaataaaagaaaacaaaacaaacaaaataaaatcaaaag

SEQ ID NO: 362 - DNA, 306 bp, Diabrotica virgifera
  Clone ID: LIB149-044-Q1-E1-E11
acaagcctctagcataaatcctgatatggacttttcaacaacaaaaactgtagaaccaacctcaatcacggtgttcttgctgttggatacactaaagatgcattcattgtcaagaactcatggggaactagctggggtgaacaaggttacatcagagttgcccgtggtgaaaacttgtgtggtattaacctcatgaactcttaccctaaattgtaaatgatttaatgcaaatgaaacaccaaatagaattcaaaaataaagataaataaaaaactaaaaaaaaaaaaaaagggggccctcacaatc

SEQ ID NO: 363 - DNA, 320 bp, Diabrotica virgifera
  Clone ID: pGUT2704
gaaaatggtaaagacttttggcttatcaagaattcgtggaacgcttattggggagaagaaggttatttgagaatagtacgtggtaaaaaccagtgtggtatcaatgaagtggccgattatcccctcctataattttaaaaattgtcatgccttacaatataatgaaacataaaaaaaatattataacaaaaaaaaaaaaaaaaaaaaaaaaaaaaaaaaaaaaaaaaaaaaaaaaaaaaaaaaaaaaaaaacgggggggggggcccccccccaccacctctttggggggggttttaaaaaaaaccggggcgggtttttta

SEQ ID NO: 364 - DNA, 406 bp, Diabrotica virgifera
  Clone ID: LIB149-020-Q1-E1-C10
acccacgcgtccgcccacgcgtccgcccacgcgtccgcgaattttatttttattaactattctataaaactacaacaaaaaattttcgtgttaaaaatatgtaaaatattacaaaactaaaataataaaaacagattttaaaaattcaacaaaattcaatgtatcagttgtcaatggttcccactgcaagttattagataaataaatatcattttacaatgacgacacagtcttggcaataaaaaaaggtatagatgtaaaagaagaagaagaaatgtagaaaatattttacctctatttagatatttatacccttttatacaaataccaacttcgcaagtgcttgggcacgctcgtgtcgagtcgagcgcgtatattaaggggttaataatttttaaacgtgtca

SEQ ID NO: 365 - DNA, 264 bp, Diabrotica virgifera
  Clone ID: LIB149-022-Q1-E1-D8
cccacgcgtccgcccacgcgtccgccgacgcgtccgcgaacccatctgcagactcgtggggatggcgagcttcagcctggtatccatgggtggtatagtcgcaccagcgagaagtgatccatcagtcctagaatggactgacacttagcccgtagaaggaactatccagctgccctatgcataggtagtagaacctttccatgcttggtacgatggatactctaatgggacgcgcattgattactaccatgggacgagctggac

SEQ ID NO: 366 - DNA, 347 bp, Diabrotica virgifera
  unsure (1)..(347): unsure at all n locations
  Clone ID: LIB149-019-Q1-E1-G3
acccacgcgtccgcccacgcgtccgcccacgcgtccgcgataatattctcagacaaatgaatacaatacaatggggataaaggaaaaaattaattacgcttacttagttgcattttgtggaaaccttctggctctaactggcgatacaactttaacatggtcttcaccaattttaacgaaactggattcaaacgatacagatataaatccattgggaaggaagataacattagatgaaatatcatggatcggatctttgcagtatataggcgcaatggtangaattctgcccttcgccgttttagctgatgtaataggaagaaaacctgtactgctcctattggccg

SEQ ID NO: 367 - DNA, 58 bp, Diabrotica virgifera
  Clone ID: LIB3026-002-Q1-E1-H10
cccacgcgtccgcccacgcgtccgcccacgcgtccgcccacgcgtccgcggacgcgtg

SEQ ID NO: 368 - DNA, 240 bp, Diabrotica virgifera
  Clone ID: LIB150-021-Q1-E1-C12
cggacgcgtaggcggacgcgtgggcggacgcgtgggcggacgcgtgggtaattcgtttggtttataaaatgagtttaaaagatggaccaccaagaaaattaagaaaactggaagatataaaacccaatgtccaacaacctataacacagagtactatagcagttccttctggttcttctacaagactttgtccttatttggatacgattaacaggcaataattaaattttgaattccaaa

SEQ ID NO: 369 - DNA, 389 bp, Diabrotica virgifera
  Clone ID: LIB3026-028-Q1-E1-H5
ccacgcgtcgaccacgcgtccgcggacgcgtgggcggacgcgtgggcggacgcgtgggattgtacaagaaatgaaatcaattttcattattacattcttcgcttgtattggtcttgcagtagcagttgcaattccaatgaacataaagggtccagctccagatttagatgatccaaactgtgtagtctgcttttccgctggaaattttattcaaggatttaagaactcaggtgattccaaggaagaagcaaaacaacaaaggaattttatctgtaacctgtttaacactgacgagctaatgcaaatctgtatgagcacttatgaagatgacgtctaatatatttatggagtaactgacctcagaacagttactgaaatgtgcatacaca

SEQ ID NO: 370 - DNA, 378 bp, Diabrotica virgifera
  Clone ID: LIB150-039-Q1-E1-D12
accacgcgtccgcccacgcgtccgcccacgcgtccgcgacgagccggtcagtattgcgtcaagcttggatcgttacaagtggaatcgatcccaatcaaaatataaacaaaatgagttccaaagacaatagcgatgttgcagtcgacaaattagacaagaaaaaaagtacagatggcaaagcagagataaaaggaacgaagcgagcggcagaggacaaaacagaagaccccaaaaaagcgaaaaaagaagaaaatggtgcaaattcagacggtgaggatttagatgaggaagaagaagaggccattgaagaagaggaagacacgggcgaagaagacgtagttgaaggggatgatgaagaaatagaggctgaagatgaag

SEQ ID NO: 371 - DNA, 352 bp, Diabrotica virgifera
  Clone ID: LIB150-003-Q1-E1-F10
aaccacgcgtccgcccacgcgtccgcccacgcgtccgcccacgcgtccgcggacgcgtggctgtgtgacataagctattggaacagcacagtctcttaaacgaacagatgaaagtgaagttctgtcaatatctttttctaaaaagtgttttgaacatactcctctattaacaaatctgatctatacttcatgtcttcttcgcaggatcttctggaaagctaaaaatacaaaatatatgcattactaagcattattaacaaattttagttttaaataaaaaatatgattaatggactcacaaaatattataaaacagcttagaaattgtttattagtatagtcggttccccag

SEQ ID NO: 372 - DNA, 393 bp, Diabrotica virgifera
  Clone ID: LIB150-020-Q1-E1-F10
acccacgcgtccgcccacgcgtccgcccacgcgtccgcaagcgttgagcttttgccagtgttgttagtgagctccaatgacttttataaaaaatacaagttaaaatgaatcataataataatatgttacaattgtgtagactgtgtttagttaaggacgaagttaatataccaatttttgaggaacaaggtgatattaggcaaatattcctgaaaattagttcgtgtctaccggtgaaggtttcccgagatgaccaactgcctaaaaaatatgtgatggatgttcctataagttagatatgttgtatgaattttggaatactagtgcgaatgcagagaaacaattgttaacatggttgggagaggcgggcatgacatctcagatgacagatgg

SEQ ID NO: 373 - DNA, 427 bp, Diabrotica virgifera
  unsure (1)..(427): unsure at all n locations
  Clone ID: LIB150-003-Q1-E2-F10
gggccgacccacgcgtcaacccaagcgtccgcccacgcgtccgcccacgcgtccgcccacgcgtccgcggacgcgtggctgtgtgacataagctattggaacagcacagtctcttaaacgaacagatgaaagtgaagttctgtcaatatctttttctaaaaagtgttttgaacatactcctctattaacaaatctgatctatacttcatgtcttcttcgcaggatcttctggaaagctaaaaatacaaaatatatgcattactaagcattattaacaaattttagttttaaataaaaaatatgattaatggactcacaaaatattataaaacagcttagaaattgtttattagtatagtcggttccccagttgtgtctgagactcagtagtacctactgagactgagtttagcanatcaactataat

SEQ ID NO: 374 - DNA, 426 bp, Diabrotica virgifera
  Clone ID: LIB149-031-Q1-E1-E1
acggacgcgtgggcggacgcgtgggcggacgcgtgggtcaaaattcagagttggcgcaatgatatgaattcattgtaatttctagacgaatctattcatctaggttttattggcatttcggtgatattatattttccatgggatgtgtgcggtgtcctttcttaaatttgtttaaaataaaccattattttagctgttaaacgaaacaataaacatattcctcacttacactccgcttgtttattttcgttaattctattagtcagcgcagtttatgtaaaatcaaagtgttaccttttgtgatctcaccaaatttggcgaagaaaatattttgaaatattttaaaaaaaaattcatttcaaaattacattctgtccatattgtgagtttttttaaggtaaggattaaatctcgataaaagataaa

SEQ ID NO: 375 - DNA, 467 bp, Diabrotica virgifera
  unsure (1)..(467): unsure at all n locations
  Clone ID: LIB150-019-Q1-E1-C9
gtggaccgacgcgtccgcccacgcgaccgcccacgcgtccgcccacgcgtccgcccacgcgtccgcggacgcgtggctgtgtgacataagctattggaacagcacagtctcttaaacgaacagatgaaagtgaagttctgtcaatatctttttctaaaaagtgttttgaacatactcctctattaacaaatctgatctatacttcatgtcttcttcgcaggatcttctggaaagctaaaaatacaaaatatatgcattactaagcattattaacaaattttagttttaaataaaaaatatgattaatggactcacaaaatattataaaacagcttagaaattgtttattagtatagtcggttccccagttgtgtctgagactcagtagtacctactgagactgagtttagcanatcaactataatattctgtgtattcattagttggtactgcatattatagtgtgt

SEQ ID NO: 376 - DNA, 412 bp, Diabrotica virgifera
  unsure (1)..(412): unsure at all n locations
  Clone ID: LIB150-005-Q1-E2-B7
cccacgcgtccgcccacgcgtccgcccacgcgtccgctttcacttcatctttgtaaataaatcaataaatttcatagtacaaaacaaaatattttttaaaggtacattaaacaatgtctgaaaataatcatgatgatatgttatttgaaatgctcaaagactgcataactctgccgaaattcctatatgacatatttggctttttggcaataaggaccgacttttataatgtgtccatgatgaatcccggtttgggtttgccaaaaggtctttctgaaaagttagtcagacatacatttttgacatggaaagctgtcncacgagatgtcatatacacccctaatgaaatacctgtatctacagaagaactagtcgtgtcttgtactgaagaatcagaccagcacgtgtcctc

SEQ ID NO: 377 - DNA, 386 bp, Diabrotica virgifera
  Clone ID: LIB150-027-Q1-E1-G10
cccacgcgtccgcccacgcgtccgcccacgcgtccgctcaacggttgattttcctggtgcagagtccaaataatgtttatacgctgtgagctcgtaggtagaggggataattaaaaattcgcgagcgccagtagtaacaagtttgtaaacctttactgggaaatttgctttttgacgttctgcattaagcgttgcatattacagcttttaaatgtctcacgaaagttgttgtcttaaagagtgtcgaaatactggttataatagtaactgtgtattctacaactttcctgtcgctaagcataaggtgattcaacgacaaaaatggattgatgcaattagaaaaaagtaagtaaacacaattttaattttaaaacggtagaaaaatt

SEQ ID NO: 378 - DNA, 419 bp, Diabrotica virgifera
  Clone ID: LIB150-033-Q1-E1-A11
accacgcgtccgcccacgcgtccgcccacgcgtccgcgcaatactcagcctccttcagcgtcttagacttacgatacgacttactcgaatttatcgactgcctttcactctcaatcgaatttaacttgcaatggcagagaccgaaccgtcaattgaaataactaaagatgacaatactttacagaaacttgaagagaaagcccaaaaagcccaagaagccttcgagcgtgaagaaaaagccaaaaaggaattagaagctctctatgccaagctcttagctgagaagaccgagttgttatctaacttggaaggagaaaagggatccctttccgaaactcaagaaagggccaacaaactccaagcccaaaagaacgacctcgagtctcaacttttctgaaaccaagatcgtttgagccaag

SEQ ID NO: 379 - DNA, 453 bp, Diabrotica virgifera
  unsure (1)..(453): unsure at all n locations
  Clone ID: LIB150-029-Q1-E1-G9
cccacgcgtccgcccacgcgtccgcccacgcgtccgcccacgcgtccgtttattttaaaataataaaatattttttagtaaaagtaaagaaaaattttatttaatgatagttaattagtaatgtgagagaatattttatttttaaaaaagaaaaatttaatttttggaccttgggtaacaaggaataataattaataattaaaaaattaatattttcgaatttaaaagagcctaaaaaattaaaatttttattgtaaaatanatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaaataaaat

SEQ ID NO: 380 - DNA, 427 bp, Diabrotica virgifera
  Clone ID: LIB150-018-Q1-E1-B1
gtccgcccacgcaaccgcccacgcgtccgcccacgcgtccgcccacgcgtccgcacgatcatcatgaaggccttgattgtccttagcgtttgcttttgcttaactctagctgccgaatccgagaaaaaggaagtaacgcaggagagtaaaaaacaagagaaacgcggtctttacggccttggtgatcatggtggaggattcggcctaggcggccacgattttggaggcggccatgattttggaggcggtgattacggaggtcatcaagaacaccacgaacacgtaaaaacggtcgtagttgaaaagaaaattccaactccttacgaagtagtcaagcatgtgccttacaccgtcgaaaagaaagtaccctacgaggtcaaagtaccagtaccacaaccttacgaggtgtacaaaaaagtaccatatc

SEQ ID NO: 381 - DNA, 409 bp, Diabrotica virgifera
  Clone ID: LIB150-040-Q1-E1-A3
cgtccgcggacgagtgggcggacgcgtgggcggacgcgtgggcggacgcgtgggggccggagagattgctgtacgagacgactcttctattctagagagctggaagctattgcagggaaactgctttttgtcccttgattagtcgagtattagttttatcttgttgtacattgtttgttgtggtgcttatcgcgtgtgttgttgagtgtttatattacttgaaatagaactagcgatggcaactgaggtcgaaaataacgcacccgaaacaaaggaaattaaggaggagataccgtccggcgacaacaaagccgatgaggccggtaaacaagaaaatgccggcgacgcgcctgcctcggcaaaagaaaaagaaccgactcctccaaaagtattggtacacaaaccaaat

SEQ ID NO: 382 - DNA, 364 bp, Diabrotica virgifera
  unsure (1)..(364): unsure at all n locations
  Clone ID: LIB149-010-Q1-E1-B3
acccacgcgtccgcccacgcgtccgcccacgcgtccgtaaaatattgtacaaaaaatgaaatcaattttcattattacattctttgcttgcattggtcttgcagtaacagttgcaattccaatgaacataaaaggtccagctccagatttagatgatccaaactgtgtagtctgcttttccgctggaaattttattcaaggatttaagaactcaggtgattccaaggaagaagcanaacaacaaagaaattttatctgtaacctgtttaacactgacgagctaatgcaaatctgtatgagcacttatgaagaggacgtcgaatatatttatggagtaactgacctcagaacagtaactgaaatg

SEQ ID NO: 383 - DNA, 424 bp, Diabrotica virgifera
  Clone ID: LIB149-012-Q1-E1-D9
aggaagcgtgggcggacgcgtgggcggacgcgtgggcggacgcgtgggcaatctggcctcgaaatctattagtgtttccttgaaaaaaacattaattttatacaatctgcttagggatacattttgtttcttaaacttaacggtccttgttagcatatggtttgtatattaaatgtgaattttaaatgactaatgttatttcgttttgagaaaagttattgaaaatttagcaaaaatagtaattaaagcgtatcgctatattatatgcatttaacaattcaagaaagaactgtgagttgcctacatttggccccactgaactgaataacctaaaaaatttattttaaaagctcttaaatacaatttttttaattgaatataaatacttaactgacaaatttcatataaacagttgctttgtttc

SEQ ID NO: 384 - DNA, 361 bp, Diabrotica virgifera
  Clone ID: LIB3026-028-Q1-E1-H6
cggacgcgtgggcggacgcgtgggcggacgcgtgggcggacgcgtgggcagattgcaggtgcaggtcacttttatcttttcttttcctagaacatcagtgatataattgcaacatgcgcaacaaggccggaaaagtgaaagaaacctccaaagagaagaaacagaggaaaaaggattttcaagaaacccaaaaacaagtaaaaaccattgtattaccaggactgatagttattgctatattcattatcatttatgtttatatgaaaacaagaccaaaaaatggttacattgattgatacagaaaatcaataaaacatgtaaatattacgttaatttttaaatatattaaagtttataacat

SEQ ID NO: 385 - DNA, 354 bp, Diabrotica virgifera
  Clone ID: LIB149-024-Q1-E1-D1
accacgcgtccgcccacgcgtccgcccacgcgtccgcccacgcgtccgcaaggattattaattaataattatatatttattattttcgaatttaaaagagctaaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaagattaaaaattttcatattttaaaatatg

SEQ ID NO: 386 - DNA, 432 bp, Diabrotica virgifera
  Clone ID: LIB149-026-Q1-E1-E12
acccacgcgtccgcccacgcgtccgcccacgcgtccgtaaattctgtgggattcccagaatacactttcaaggttggaatgaaattttatgtatttcatggttatgtactgtcactgatttcgggaaaccatgttgccatgtgaatgacaaaagataatttcacatgaaaacatcgatttttgtccatttaagcgtaccattgatttggaatatttatgcaaacctctaaatttggcacctgtttttgaaaaattggtagatgcatgcattgacgcattttttaaacagtttactgttagtttttagtttgttaggtcggttgtttgtgctgcgccctggatttgggcgttgtctgttgcatcatatacaaatttgtgaaagtgaagttagtttatcgggtgggttgtattgcgctcagcggtcaaatacct

SEQ ID NO: 387 - DNA, 404 bp, Diabrotica virgifera
  Clone ID: LIB150-002-Q1-E1-H5
cccacgcgtccgcccacgcgtccgcccacgcgtccgctttttacaaacttaatgatcattctatggaatttatggaagattttttagcggaatggaagcatgggcatggatttttatggtataatttcttaacatttagaaatagatccaatttaattggtatggatatgaaaatatcgagtactgcatcttttgctgatgaaaataatcatttggacgatttgaaggatacccattcggatgcatcgttgaaagttacttcagctctgctaaaagttatcacggaaatggttaatataactccagtaatgttgtatgatactggttccaataaatgcagaggaatgattgacgatttggaaaatggacgagctgagctaccaggtaactctctttttatctcg

SEQ ID NO: 388 - DNA, 472 bp, Diabrotica virgifera
  Clone ID: LIB150-029-Q1-E1-A9
cccacgcgtccgcccacgcgtccgcccacgcgtccgctgtgatgtatcggaaaatattttctctatggacttaaaaatttaagtaagtcataggtatcgttaatcattataaatatactgcaatatgaacagattttaataaacttgctatataatatatttaaaaaataaatagaggagttaatttccgtccttttgggaaataaccacatttcaatgggagaacaattgacgtttgacagtataacgtcaagctttgacatttgaaaagttgtaacgtccaaactttgacattgatatatttctcaaggctcactctgtatcacattatgtatattaacaatatgaaatatatattaagatatcaataatttcggtatataatacactactaaatttccctattcataaaggttacattattttttttgtgaaatttgtatttttcttattgtaacgtaaacaatattta

SEQ ID NO: 389 - DNA, 211 bp, Diabrotica virgifera
  Clone ID: LIB149-040-Q1-E1-A1
acggacgcgtgggcggacgcgtgggcggacgcgtgggctgcagagagaaagatgtttctttttattaagatcatgtaatgaaaagttctttacatgatcttaataaaaagaacttttcattacactaccagatttttttatatcgaaaatttttgtttattagccctaatttcatctgtcatgggtattgttgtatttttaattaatccat

SEQ ID NO: 390 - DNA, 309 bp, Diabrotica virgifera
  unsure (1)..(309): unsure at all n locations
  Clone ID: LIB150-028-Q1-E1-D3
acggacgcgtgggcggacgcgtgggcggacgcgtgggctaggagacagaaacaattttagctttaatatgacgttttatatatttacagcttaactgtgtgaattgacaggtcagtgtangatatgataaggcccgatatatggataatgtattatgtttagtattttttgtataagatcaagtgtattcgatcattgtacataaaagtttatatatatatttattttgccatatttatatcagtagtttataggagatgaagtatattttttatattaaatacattgaaataaaagtatttgcaatgg

SEQ ID NO: 391 - DNA, 353 bp, Diabrotica virgifera
  Clone ID: LIB3026-006-Q1-E1-F4
cccacgcgtccgcccacgcgtccgcccacgcgtccggttcaattatatttatattattaaatcaccctttaacttgtggtttaataatattaatacaaacaattttcacatcagttattacaggattaataaattataattactgattttcttatattttatttttaattatagtaggaggaatattaattctttttatttatataaccagaattgcttcaaatgaaaaatttaaatttaattttaatataactttaataataattagaatttttactattatttctatattaagatttattttagattaattttaatttaattcctttataaaaattatagaaatgaataac

SEQ ID NO: 392 - DNA, 370 bp, Diabrotica virgifera
  Clone ID: LIB3026-034-Q1-E1-H3
cccacgcgtccgcccacgcgtccgcccacgcgtccgagctgcagcaggaaagcagaataaacagcaaaagggtaaagttcagaaagtagtgaaaaaagaaccagaaccagaagaagatgatagtgacgatgaagaggaaactgtagtaagtaaagctaaaatccagaaagtagtgacgaaacaagaagctgatagtgatgatgacgatggtagtgaagaggaaagtggtgaagaagaaggaagcggcgatgaagaagaaagtggtgatgaagaggataatgatgatgatgaatcagaggaggagtctgattaaaaattacatataagatgtatatgttatacatcatgttttgtataaaagtaattttgt

SEQ ID NO: 393 - DNA, 429 bp, Diabrotica virgifera
  Clone ID: LIB150-011-Q1-E1-C9
cccacgcgtccgcccacgcgtccgcccacgcgtccgtattcataaaaactattcaagttatcctgtttctaagacacgtttcctgtcactgtcctgtcacatttgttaagaaggcaaacttaatttcattgtcatttagcagagactgaatgaattattttttcgtctatgtaaatcgcttcgtgaaagaaatcatgggacaacgaatccctataactaataccaatttaaatgtaatctcgctcacaattaactaaaacatgacatgaaccttcggtacaatccgtcaacaaaaggttaaaaatgttttggtcaacagttatttatgcaatttgtgtagtaaaagacttcttgattttgtttggtgtattcagttaacttccttttaaaggcaaattctaaacaatgtctgtgatagtagaataacga

SEQ ID NO: 394 - DNA, 411 bp, Diabrotica virgifera
  unsure (1)..(411): unsure at all n locations
  Clone ID: LIB149-025-Q1-E1-D8
cccacgcgtccgcccacgcgtccgcccacgcgtccggtttactgttgttgcccttttattgtgtgttgctttaaatgaagtacatagcggagttatactcggcaaaggattaggtagaagttttacagcatgtcctgatccccttaacccaggaatattggtatccgacaacgacatttcaggaggtctcttcgaatctatcaacttaagagttccagaaataggattgttagaaacgcctatttcatgcatattgatcgttgataaaaagaagagttcaactgacccaattaatggtgcaagaagtgtaagttctccatatgttgaaataagtatcaaaccaggattcttcgaatctcttcattatacgattgaagtgtacaggaaagcacctgnatacacgcctgcctc

SEQ ID NO: 395 - DNA, 399 bp, Diabrotica virgifera
  Clone ID: LIB150-002-Q1-E1-E12
cccacgcgtccgcccacgcgtccgcccacgcgtccgacgatattatcagagactgggatcttaaacaccgtgtacaaggaattagtgacattgtccccacccaaggagtaagtactcttcgtcaatacgctggacaagttggagatgttatgccccttggtgaaaatgtacaatctgtaatctacagaaactggaacctcgaccaagacttgctccaaaactattctccactcaggcatttccaaactcttcttggacaaatccaacagcaacgtgaacttcaacaaggtttattgagccaacagcaatatttacctcaacaatatttatctggagaatatcttcttgaagatcagatgaacactaatcaaatcttgaaacagatctacagacagcaac

SEQ ID NO: 396 - DNA, 454 bp, Diabrotica virgifera
  Clone ID: LIB150-001-Q1-E1-D4
cccacgcgtccgcccacgcgtccgcccacgcgtccgacgatattatcagagactgggatcttaaacaccgtgtacaaggaattagtgacattgtccccacccaaggagtaagtactcttcgtcaatacgctggacaagttggagatgttatgccccttggtgaaaatgtacaatctgtaatctacagaaactggaacctcgaccaagacttgctccaaaactattctccactcaggcatttccaaactcttcttggacaaatccaacagcaacgtgaacttcaacaaggtttattgagccaacagcaatatttacctcaacaatatttatctggagaatatcttcttgaagatcaaatgaacactaatcaaatcttgaaccaaatctacagacagcaacttggacaatctccattgaaccgttatttggtaaacatgagacttgtaaacggaca

SEQ ID NO: 397 - DNA, 423 bp, Diabrotica virgifera
  unsure (1)..(423): unsure at all n locations
  Clone ID: LIB150-020-Q1-E1-G5
acggacgcgtgggcggacgcgtgggcggacgcgtgggcaatgatgagcctccaatactgtggattggtccttttggcaggtcttttgttggtttccgcccaccctggaaccgactctaaggctgaagccaaggtatcttcagtagccgagaagaaacaggaaaaacgtggtcttcttgatctaggctacggtgggggacacgactttggaggaggacttgaacttggagggcatggtttggatttgggtggacatggtggtttcgacggaggatatggtggagggttaggtggagggtatggtggattagacgaaggtcatgttaagcacattaccatcaccaaagaagttaaagtacctgttcctgcaccatatcncgtacacatcgaaaagaaaataccagttccagtgccagtcaaagta

SEQ ID NO: 398 - DNA, 368 bp, Diabrotica virgifera
  Clone ID: LIB150-008-Q1-E1-B7
aacacgcgtccgcccacgcgtccgcccacgcgtccgctttcacttcatctttgtaaataaatcaataaatttcatagtacaaaacaaaatattttttaaaggtacattaaacaatgtctgaaaataatcatgatgatatgttatttgaaatgctcaaagactgcagaactctgccgaaattcctagatgacatatttggctttttggcaagaacgaccgacttttataatgtgtccatgatgaatcccggtttgggtttgccaaaacgtctttctgaaaagttagtcagacatacatttttgaaatggaaagctgtcccacgagatgtcatatacacccctaatgaaatacctgtatctacagaagaa

SEQ ID NO: 399 - DNA, 425 bp, Diabrotica virgifera
  unsure (1)..(425): unsure at all n locations
  Clone ID: LIB149-012-Q1-E1-A10
accacgcgtccgcccacgcgtccgcccacgcgtccgggcgtcaataagttatatttcatgaatgaaataccatgacgtcatttttacttttcctccctagggaggaaaaatattttcctccctaaggaggaaaagtacaactttgctccctacaatcaggtccggaaaagtatactttcggtagaggtangtggaaaaaaccctttcctgctctttgtataacctcaaacgtaactaccaacaaaacgtgtgctactatgtcgtaagattaacgacgttgccactcacatgtgtagctctttcgtttaatacttgcggctaaatttgaaatccgttccatactgaacttcacgttacaagaagttttatttagttganacccaccttaccctaatcattagatacgtagtcataagaaccaaaca

SEQ ID NO: 400 - DNA, 395 bp, Diabrotica virgifera
  Clone ID: LIB3026-001-Q1-E1-B12
aggacgcgtgggcggacgcgtgggcggacgcgtggggaaacctatcaaatttttaaaatgtacactaagtttactgttgttgcccttttattgtgtgttgctttaaatgaagtacatagcggagttatactcggcaaaggattaggtagaagttttacagcatgtcctgatccccttaacccaggaatattggtatccgacaacgacatttcaggaggtctcttcgaatctatcaacttaagagttccagaaataggattgttagaaacgcctatttcatgcatattgatcgttgataaaaagaagagttcaactgacccaattattggtgcaggaggtgtaggttctccatatgttgaaataagtatcaaaccaggattcttcgaatctcttca

SEQ ID NO: 401 - DNA, 85 bp, Diabrotica virgifera
  Clone ID: LIB150-036-Q1-E1-C2
agcgtccgcccacgcgtccgcccacgcgtccgcgggcgcgtgggtttttagggcttttttattgaaatagcaatttaaagtagtt

SEQ ID NO: 402 - DNA, 374 bp, Diabrotica virgifera
  Clone ID: LIB149-046-Q1-E1-F7
aacacgcgtccgcccacgcgtccgcccacgcgtccgggcacttgttgcttgcgatgattcagttagtacttcgacagacactccggtaatatcaacagaggtaccagcaccgatatcgacaagccttcgtgaagatacagtttacgtagcaacttcaaatgttcccgacccagtcttccagatagatgccgtggaagtattcaaagaagctaaggcacttcatccggttgacggtatagctttgttagaaacattttccgatttgttttacgccaaacataaagtatctggaggatggaaagttgctgaaaaatatgattacttttataatccaaatataaactacgtgtatattgaattgatggttaatgatg

SEQ ID NO: 403 - DNA, 418 bp, Diabrotica virgifera
  Clone ID: LIB149-030-Q1-E1-A7
gacccacgcgtcagcccacgcgtccgcccacgcgtccgatggtttttaaagtatcccttttgtgtacactgatggtgttagttgcttattctagtgcatacgattacagcaattgtcctggaaataccaacagacaaaaaaatctgatatacagctctttactcccatcagcgtatagcgcgaaaactcgtatcccagcaactggatattaccaaagacctatcacctgcttactgctaatcgatcaaaaaggaagcaccagctcaccaaaaattatagaaggtggatatctcgacacttttgctgtagtaaatatcacttccacaactgcgcaaccagttagttactatgcaatagtatttattgattagcctattttagtagtatttagctatatttatgcagaaatattatttat

SEQ ID NO: 404 - DNA, 433 bp, Diabrotica virgifera
  Clone ID: LIB149-007-Q1-E1-A10
gttacagacccatttactggagacataaaggtgccgttttaagtgttaaagatcaaggacagtgtggatcttgctgggctttcagtgctactggttccctggaaggacaaaattacatcatcaatggcaaatcagtaggcctcagcgagcaagaacttttggattgttcctcagactacggaaatggcgactgcgactacggtggtcttatgaccaacgctttcgaatatatcgaagaccacggaatcgaatctgaatctaactatccttacgaagctgaacaaagagaatgcagacgcagttctggcaaagctgcaattaacattcaaggttacaaagaagtaccagccaatgaagaatctttaagacaagcagttggtactgttggtccaatttctgcagcaattaacgctaatcccatccaattctactc

SEQ ID NO: 405 - DNA, 447 bp, Diabrotica virgifera
  unsure (1)..(447): unsure at all n locations
  Clone ID: LIB149-007-Q1-E1-H9
cacaagcctaaacgaaacattacatcccgatttgtagctgatcctcaattgactgttccagaatcaattgactggagagaaaagggggcagttgctcccataagggaccaagggcaatgtggatcatgttgggcatttagtgcagctggtgctcttgaaggacaaagatttttaaagcagaacgtactagaagtactgagtacccaacagttagtagattgttccggtgattacgacaatgaaggctgcaatggtggttggccccattgggcatataactacattaaagatcatggcctctgtctagagtctgactacaagtatcaaggattagacggtgactgcaaacagtgtaatccggttatcaaaaccatcaatggctatgcatctgtagatcaaaccgangaagcacttaaggaggctgtaggtactgttggcccaatatca

SEQ ID NO: 406 - DNA, 409 bp, Diabrotica virgifera
  unsure (1)..(409): unsure at all n locations
  Clone ID: LIB149-019-Q1-E1-F11
acccgaattgtagctgatcctcaattgactgttccagaatcaattgactggagagaaaagggggcagttgctcccataagggaccaagggcaatgtggatcatgttgggcatttagtgcagctggtgctcttgaaggacaaagatttttaaagcagaacgtactagaagtattgagtacccaacagttagtagattgttccggtgattacgacaatgaaggctgcaatggtggttggccccattgggcatataactacattaaagatcatggcctctgtctagagtctgattacaagtatcaagcattagacggtgactgcaaacagtgtaatccggttctcaaaaccatcaatggctatgcatctgtagatcaaaccgaagaagcacttaaggaggctgtangtactg

SEQ ID NO: 407 - DNA, 428 bp, Diabrotica virgifera
  Clone ID: LIB149-009-Q1-E1-H1
gacgatcccaatgtccaagctgtagaagaagttgattggagagatagtgccgttttgggagtcaaagatcaaggacagtgtggatcatgctgggctttcagtaccaccggatccctcgaaggtcaactcgccatccacaaaaatcaacgtgttcctctcagtgaacaagaattggtagactgtgacacatcaggaaatgctggttgtaacggaggtttgatgacagatgcctttaactatgttaaacgccatggtctctcttccgaatctcagtatgcatacaccggcagagatgatcgctgcaagaatgttgagaacaaaccactcgcttccattaatggctacgtagaacttgaaacaactgaagatgcactcgcgtccgctgttgctagcgtaggtccagtttccatcgctgttgatgctgatac

SEQ ID NO: 408 - DNA, 410 bp, Diabrotica virgifera
  Clone ID: LIB3026-014-Q1-E1-F10
accaagggcaatgtggatcatgttgggcatttagtgcagctggtgctcttgaaggacaaagatttttaaagcagaacgtactagaagtattgagtacccaacagttagtagattgttccggtgattacgacaatgaaggctgcaatggtggttggccccattgggcatataactacattaaagatcatggcctctgtctagagtctgattacaagtatcaagcattagacggtgactgcaaacagtgtaatccggttctcaaaaccatcaatggctatgcatctgtagatcaaaccgaagaagcacttaaggaggctgtaggtactgttggcccaatatcagtatgtgtcaacgctaattgggactggcaactgtacagcgggggtatccttgatagccaaagttgtcca

SEQ ID NO: 409 - DNA, 433 bp, Diabrotica virgifera
  Clone ID: LIB3026-012-Q1-E1-B6
ataccactttgtggctgatcctcaattgactgttccagaatcaattgactggagagaaaaaggggcagttgctcccataagggaccaagggcaatgcggatcaggttgggcatttagtgcagctggtgctcttgaaggacaaagatttttaaagcagaacgtactaaaggtactgagtacccaacagttagtatattgttccggtgattactacaatcaaggctgcaatggtggttggcctcattgggcatataactacattaaagatcatggcctctgtctagagtctgattacaagtatcaaggattagatggtgactgcaaacagtgtaatccggttctcaaaaccatcaatggctatacttctatagatcaaactgaagaagcacttaaggaggctgtaggtactgctggcccattatcagtatgtgtc

SEQ ID NO: 410 - DNA, 440 bp, Diabrotica virgifera
  Clone ID: LIB3026-016-Q1-E1-H2
gtagacgttttgggagtcaaagatcaaggacagtgtggatcatgctgggctttcagtaccaccggatccctcgaaggtcaactcgccatccacaaaaatcaacgtgttcctctcagtgaacaagaattggtagactgtgacacatcaagaaatgctggttgtaacggaggtttgatgacagatgcctttaactatgttaaacgccatggtctctcttccgaatctcaatatgcatacaccggcagagatgatcgctgcaagaatgttgagaacaaaccactctcttccattagtggctacgtagaacttgaaacaactgaagatgcactcgcgtccgctgttgctagcgtaggtccagtttccatcgctgttgatgctgatacatggcaattatacggaggtggacttttcaacaacaaaaactgtagaaccaacctcaa

SEQ ID NO: 411 - DNA, 364 bp, Diabrotica virgifera
  Clone ID: LIB3026-017-Q1-E1-D9
acccacgcgtccgaaatgctgaggttccagactccattgactggagacaaaaaggtgccgttttaggtgttaaagatcaaggacagtgtggatcttgctgggctttcagtgctactggttccctggaaggacaaaattacatcatcaatggcaaatcagtaggcctcagcgagcaagaacttttggattgttcctcagactacggaaatggcgactgcgactacggtggtcttatgaccagcgctttcgaatatatcgaagaccacggaatcgaatctgaatctagctatccttacgaagctgaacaaagagaatgcagacgcagttctggcaaagctgcagttaacattcaaggttacaaaga

SEQ ID NO: 412 - DNA, 439 bp, Diabrotica virgifera
  Clone ID: LIB3026-030-Q1-E1-B2
gtataatcaattcgcagatatgactccagaggaattcaaggctatgcttgactcccaactcattcacaaacctaagcgaaacattacatcccgctttgtagctgatcctcaattgactgttccagaatcaattgactggagagagaaaggggcagttgctcccataagggaccaagggcaatgcggatcatgttgggcatttagtgcagctggtgctcttgaaggacaaagatttttaaagcagaacgtactagaagtactgagtacccaacagttagtagattgttccggtgaatacgacaatgaaggctgcaatggtggttggccccattgggcatataactacattaaagatcacggcctctgtctagagtctgattacaagtatcaaggattagacggtgactgcaaacagtgtaatccggttctcaaaaacatc

SEQ ID NO: 413 - DNA, 394 bp, Diabrotica virgifera
  Clone ID: LIB3026-014-Q1-E1-F8
acaagggcaatgcggatcatgttgggcatttagtgcagctggtgctcttgaaggacaaagatttttaaagcagaacgtactagaggtactgagtacccaacagttagtagattgttccggtgattactacaatcaaggctgcaatggtggttggcctcattgggcatataactacattaaagatcatggcctctgtctagagtctgattacaagtatcaaggattagatggtgactgcaaacagtgtaatccggttctcaaaaccatcaatggctatacttctatagatcaaactgaagaagcacttaaggaggctgtaggtactgctggcccaatatcagtatgtgtcaacgctaattgggactggcaactctacagcgggggtatccttgat

SEQ ID NO: 414 - DNA, 413 bp, Diabrotica virgifera
  Clone ID: LIB149-022-Q1-E1-E10
caagcgctgacttgggagtcaaggatcaaggaaactgtggatcatgctgggctttcagtaccaccggatccctcgaaggtcaactcgccatccacaaaaatcaacgtgttcctctcagtgaacaagaattggtagactgtgacacagtaaatgctggttgtgacggaggtttgatgacagatgcctttaactatgttaaaggccatggtctctcttccgaatctcaatatgcatacaccggcagagatggtcgctgcaagaatgttcagaacaaacaagtctcttccatcagtggctacgtagaacttgcaacaactgaaaatgcactcgtttccgctcttgctagcgtaggtccagtttccatcgctgttgatgctgatacatggcaattttatggaggtggagttttcaac

SEQ ID NO: 415 - DNA, 419 bp, Diabrotica virgifera
  Clone ID: LIB149-045-Q1-E1-H7
acgctgacttgggagtcaaggatcaaggaaactgtggatcatgctgggctttcagtaccaccggatccctcgaaggtcaactcgccatccacaaaaatcaacgtgttcctctcagtgaacaagaattggtagactgtgacacagtaaatgctggttgtgacggaggtttgatgacagatgcctttaactatgttaaaggccatggtctctcttccgaatctcaatatgcatacaccggcagagatggtcgctgcaagaatgttcagaacaaacaagtctcttccatcagtggctacgtagaacttgcaacaactgaaaatgcactcgtttccgctcttgctagcgtaggtccagtttccatcgctgttgatgctgatacatggcaattttatggaggtggagttttcaacaacagaaac

SEQ ID NO: 416 - DNA, 429 bp, Diabrotica virgifera
  Clone ID: LIB3026-004-Q1-E1-D7
atcaaaaggtcccactaagtgaacaagaattggtagactgtgactcatcaaactctggttgcaatggcggtttaatgacaaatgcctttgcatatgttaagagccacggacttgcatcagaaaagcaatatgcttacaccggcagagatggtagctgcaaaagaggatcaagaacactttctactatcagtggatatgtaaatcttgccaaaactgaagctgcactggctagtgctctttctagcgtaggtccagtatccatagctgtagatgcagatacatggcagctttatggaggtggaattttcaacaataaaaattgtggaactagccttaatcacggagttcttgctgtgggatacactaatgacgtcttcatcgttaaaaactcatggggaaccagctggggtgaacttggttacatcagaa

SEQ ID NO: 417 - DNA, 405 bp, Diabrotica virgifera
  Clone ID: LIB149-036-Q1-E1-D3
aatgacaggagacataaaggtgccgttttaggtgttaaagattaaggacagtgtggattcttgctgggctttcagtgctactggttccctggaaggacaaaattacatcatcaatggcaaatcagtaagcctcagcgagcaagaacttttggattgttcctcagactacggaaatggcgactgcgactacggtggtcttatgaccagcgctttcgaatatatcgaagaccacggaatcgaatctgaatctagctatccttacgaagctgaacaaagagaatgcagacgcagttctggcaaagctgcagttaacattcaaggttacaaagaagtagcagccaatgaagaatctttaagacaagcagttggtactgttggtccaatttctgcagcaattaacgctaa

SEQ ID NO: 418 - DNA, 389 bp, Diabrotica virgifera
  Clone ID: LIB3026-008-Q1-E1-C12
gagatagtgccgttttgggagtcaaagatcaaggacagtgtggatcatgctgggctttcagtaccaccggatccctcgaaggtcaactcgccatccacaaaaatcaacgtgttcctctcagtgaacaagaattggtagactgtgacacatcaagaaatgctggttgtaacggaggtttgatgacagatgcctttaactatgttaaaagccatggtctctcttccgaatctcaatatgcatacaccggcagagatgatcgctgcaagaatgttgagaacaaaccactctcttccattagtggctacgtagaacttgaaacaactgaagatgcactcgcgtccgctcttgctaacgtaggtccagtttccatcgctgttgatgctgataca

SEQ ID NO: 419 - DNA, 456 bp, Diabrotica virgifera
  Clone ID: LIB3026-011-Q1-E1-D2
gatggctaacaagcccaaacaatcctttattgcaaaacacgtagccgatcccaatgtccaagctgtagaagaagttgattggagagatagtgccgttttgggagtcaaagatcaaggacagtgtggatcatgctgggctttcagtaccaccggatccctcgaaggtcaactcgccatccacaaaaatcaacgtgttcctctcagtgaacaagaattggtagactgtgacacatcaagaaatgctggttgtaacggaggtttgatgacagatgcctttaactatgttaaacgccatggtctctcttccgaatctcaatatgcatacaccggcagagatgatcgctgcaagaatgttgagaacaaaccactctcttccattagtggctacgtagaacttgaaacaactgaagatgcactcgcgtccgctgttgctagcgtaggtccagtttccatcgc

SEQ ID NO: 420 - DNA, 402 bp, Diabrotica virgifera
  Clone ID: LIB149-024-Q1-E1-C10
aaaaagatcaaggacagtgtggatcatgctgggctttcagtaccaccggatccctcgaaggtcaactcgccatccacaaaaatcaacgtgttcctctcagtgaacaagaattggtagactgtgacacagtaaatgctggttgtgacggaagtttgatgacagatgcctttaactatgttaaaggccatggtctctcttccgaatctcaatatgcatacaccggcagagatggtcgctgcaagaatgttcagaacaaacaagtctcttccatcagtggctacgtagaacttgcaacaactgaaaatgcactcgtttccgctcttgctaacgtaggtccagtttccatcgctgttgatgctgatacatggcaattttatggaggtggagttttcaacaacagaa

SEQ ID NO: 421 - DNA, 420 bp, Diabrotica virgifera
  Clone ID: LIB3026-020-Q1-E1-F10
gcgtccagaattagtagactgtgataaggtaaacgatggttgtgacggaggtttgatgacagatgccttcttttatattgaacatcatggtctttcatcagaagaacaatacccctatacaggcgtagatggtcattgcaatcatgtaaaagacaaacaagtctcttcgatcagtggttacgtcgaacttgatgaaactgaaagtgctctagctgatgctctcgctaatgttggtccagtgtcaatagctgtcgaagctgatacatggcaattctattcaggtggagttttcaacaataaaaattgtggagacgctcttaaccacggtgttcttgctgtgggatacactaaagatgtcttcatcgttaaaaactcatggggaacaggctggggtgaacaaggttacatcagagttgcccg

SEQ ID NO: 422 - DNA, 415 bp, Diabrotica virgifera
  Clone ID: LIB3026-014-Q1-E1-F7
cgttaaggtgccttcgtctgttgattggaggaccgagaatgcagtactgcctgtaagggaccaaggatcctgtgggtcgtgttgggcattcagtagcgttggagctctagagggacaactagcaatcaactacaaccaaagagttcctttgagtcctcaatatcttgtcgactgttctgaggaaaacgatggatgtggtggtggagaccaaaggttagctttcagatttcttaaacataaccgtatgccctccgaagaggattatccatatactatgaaagatgatgtttgccgagaagatgtcaaaatgtcgctcggtcccatctcgggatacacacatctgaatgcaacggaagaatctttaatttcagctctcgctaacgttggcccaatcgctgtttccgctgatgcaact

SEQ ID NO: 423 - DNA, 419 bp, Diabrotica virgifera
  unsure (1)..(419): unsure at all n locations
  Clone ID: LIB149-031-Q1-E1-A6
aaaaattacatcatcaatggcaaatcagtaggcctcagcgagcaagaacttttggattgttcctcagactacggaaatggcgactgcgactacggtggtcttatgaccagcgctttcgaatatatcgaagaccacggaatcgaatctgaatctagctatccttacgaagctgaacaaagagaatgcagacgcagttctggcaaagctgcagttaacattcaaggttacaaagaagtagcagccaatgaagaatctttaagacaagcagttggtactgttggtccaatttctgcagcaattaacgctaatcccatccaattctactcaagtggtgtttttgacggccagtgcgcaaatagcaagaatgacttggatcacggcatcctggtcgtangttatggtgaagaaaacaacaagcc

SEQ ID NO: 424 - DNA, 354 bp, Diabrotica virgifera
  Clone ID: LIB149-020-Q1-E1-G3
acccacgcgtccgcccacgcgtccgcccacgcgtccgcagaatcaattgactggagagaaaagggggcagttgctcccataagggaccaagggcaatgtggatcatgttgggcatttagtgcagctggtgctcttgaaggacaaagatttttaaagcagaacgtactagaagtattgagtacccaacagttagtagattgttccggtgattacgacaatgaaggctgcaatggtggttggccccattgggcatataactacattaaagatcatggcctctgtctagagtctgattacaagtatcaagcattagacggtgactgcaaacagtgtaatccggttctcaaaaccatc

SEQ ID NO: 425 - DNA, 380 bp, Diabrotica virgifera
  Clone ID: LIB149-045-Q1-E1-C4
aagatacattacatcacgatttgtagctgatcctcaattgactgttccagaatcaattgactggagagaaaagggggcagttgctcccataagggaccaagggcaatgtggatcatgttgggcatttagtgcagctggtgctcttgaaggacaaagatttttaaagcagaacgtactagaagtactgagtacccaacagttagtagattgttccggtgattacgacaatgaaggctgcaatggtggttggccccattgggcatataactacattaaagatcatggcctctgtctagagtctgactacaagtatcaaggattagacggtgactgcaaacagtgtaatccggttatcaaaaccatcaatggctatgcatctg

SEQ ID NO: 426 - DNA, 430 bp, Diabrotica virgifera
  Clone ID: LIB3026-021-Q1-E1-E9
cagggctttcagtaacaccggatccctcgaaggtcaactcgccatccacaaaaatcaacgtgttcctctcagtgaacaagaattggtagactgtgacacagtaaatgctggttgtgacggaggtttgatgacagatgcctttaactatgttaaaggccatggtctctcttccgaatctcaatatgcatacaccggcagagatggtcgctgcaagaatgttcagaacaaacaagtctcttccatcagtggctacgtagaacttgcaacaaccgaaaatgcactcgtttccgctcttgctagcgtaggtccagtttccatcgctgttgatgctgatacatggcaattttatggaggtggagttttcaacaacagaaactgtggaaccgccctcaatcacggtattcttgctgttggatacactaaagatgta

SEQ ID NO: 427 - DNA, 382 bp, Diabrotica virgifera
  Clone ID: LIB149-006-Q1-E1-G1
agatcacaatgtccaagctgtagaagaagttgattggagagatagtgccgttttgggagtcaaagatcaaggacagtgtggatcatgctgggctttcagtaccaccggatccctcgaaggtcaactcgccatccacaaaaatcaacgtgttcctctcagtgaacaagaattggtagactgtgacacatcaagaaatgctggttgtaacggaggtttgatgacagatgcctttaactatgttaaaagccatggtctctcttccgaatctcaatatgcatacaccggcagagatgatcgctgcaagaatgttgagaacaaaccactctcttccattagtggctacgtagaacttgaaacaactgaagatgcactcgcgtccgct

SEQ ID NO: 428 - DNA, 427 bp, Diabrotica virgifera
  Clone ID: LIB149-026-Q1-E1-H10
caatcctctacagtgactcgtttacagtgccacaggtgctctcgaaggtcaacttgccattcacaaaaatcaaaaggtcccactaagtgaacaagaattggtagactgtgactcatcaaactctggttgcaatggcggtttaatgacaaatgcctttgcatatgttaagagccacggacttgcatcagaaaagcaatatgcttacaccggcagagatggtagctgcaaaagaggatcaagaacactttctactatcagtggatatgtaaatcttgccaaaactgaagctgcactggctagtgctctttctagcgtaggtccagtatccatagctgtagatgcagatacatggcagctttatggaggtggaattttcaacaataaaaattgtggaactagccttaatcatggagttcttgctgtggga

SEQ ID NO: 429 - DNA, 387 bp, Diabrotica virgifera
  Clone ID: LIB149-043-Q1-E1-D11
accacgcgtccgccaatgtccaagctgtagaagaagttgattggagagatagtgccgttttgggagtcaaagatcaaggacagtgtggatcatgctgggctttcagtaccaccggatccctcgaaggtcaactcgccatccacaaaaatcaacgtgttcctctcagtgaacaagaattggtagactgtgacacatcaagaaatgctggttgtaacggaggtttgatgacagatgcctttaactatgttaaacgccatggtctctcttccgaatctcaatatgcatacaccggcagagatgatcgctgcaagaatgttgagaacaaaccactctcttccattagtggctacgtagaacttgaaacaactgaagatgcactcgcgtccg

SEQ ID NO: 430 - DNA, 411 bp, Diabrotica virgifera
  unsure (1)..(411): unsure at all n locations
  Clone ID: LIB3026-001-Q1-E1-H1
cgggtcggccacgcgtccgaacggaggtttgatgacagatgcctttaactatgttaaacgccatggtctctcttccgaatctcaatatgcatacaccggcagagatgatcgctgcaagaatgttgagaacaaaccactctcttccattagtggctacgtagaacttgaaacaactgaagatgcactcgcgtccgctgttgctagcgtaggtccagtttccatcgctgttgatgctgatacatggcaattatacggaggtggacttttcaacaacaaaaactgtagaaccaacctcaatcacggtgttcttgctgttggatacactaaagatgcattcattgtcaagaactcatggggaactagctggggtgaacaaggttacatcanagttgcccgtggggaaaacttgtg

SEQ ID NO: 431 - DNA, 393 bp, Diabrotica virgifera
  Clone ID: LIB3026-007-Q1-E1-E12
cccacgcgtccgatgcagtactgcctgtaagggaccaaggatcctgtgggtcgtgttgggcattcagtagcgttggagctctagagggacaagtagcaatcaactacaaccaaagagttcctttgagtcctcaatatcttgtcgactgttctgaggaaaacgatggatgtggtggtggagaccaaaggttagctttcaggtttcttaaacataaccgtatgccctccgaagaggattatccatatactatgaaagatgatgtttgccgagaagatgtcaaaatgtcgctcggtcccatctcgggatacacacatctgaatgcaacggaagaagctttaatttcagctctcgctaccgttggcccaatcgctgtttccgctgatgcaactaaat

SEQ ID NO: 432 - DNA, 393 bp, Diabrotica virgifera
  Clone ID: LIB149-022-Q1-E1-A10
accacacgtccgctgggctttcagtaccaccggatccctcgaaggtcaactcgccatccacaaaaatcaacgtgttcctctcagtgaacaagaattggtagactgtgacacatcaagaaatgctggttgtaacggaggtttgatgacagatgcctttaactatgttaaacgccatggtctctcttccgaatctcaatatgcatacaccggcagagatgatcgctgcaagaatgttgagaacaaaccactctcttccattagtggctacgtagaacttgaaacaactgaagatgcactcgcgtccgctgttgctagcgtaggtccagtttccatcgctgttgatgctgatacatggcaattatacggaggtggacttttcaacaacaaaaactg

SEQ ID NO: 433 - DNA, 408 bp, Diabrotica virgifera
  Clone ID: LIB149-031-Q1-E1-A7
acccacgagtcaagaattacatcatcaatggcaaatcagtatgcctcagcgagcaagaacttttggattgttcctcagactacggaaatggcgactgcgactacggtggtcttatgaccagcgctttcgaatatatcgaagaccacggaatcgaatctgaatctagctatccttacgaagctgaacaaagagaatgcagacgcagttctggcaaagctgcagttaacattcaaggttacaaagaagtagcagccaatgaagaatctttaagacaagcagttggtactgttggtccaatttctgcagcaattaacgctaatcccatccaattctactcatgtgatgtttttgacggccagtgcgcatgtatgaagaatgacttgggtcacgggatcctggtcggaggtt

SEQ ID NO: 434 - DNA, 399 bp, Diabrotica virgifera
  Clone ID: LIB3026-013-Q1-E1-B5
ggagagaaaagggggcagttaatcccgtaagggaccaagagcaatgcggatcatgttgggcatttagtgcagctggtgcccttgaaggacaaaaatttttaagggagggcaaactaaaattactgattacccaacatttagtaaattgtccccttaattacaaaattaaaggctgcattggtggttggcctcattgggcatatgacaacatcaaaaataatggcctctgtcaaaattcaaattacaggtatcaaggatatgacggttacaactgcaaagattgtattccggctatcaaaaaaatcaatggctattcatctataaatcaaactgaagaagcacttaaggaggctgtgggtacggctggcccaattgcagtatgtgtcaacgctaatgacc

SEQ ID NO: 435 - DNA, 347 bp, Diabrotica virgifera
  unsure (1)..(347): unsure at all n locations
  Clone ID: pGUT3061
ttcaaggctatgcttgactcccaacttcttcacaagccttaaacaaacattacatccccgattgtagctgatcctcaattgactgtgtccgaatcaattgactggagagaaaagggggcagctgctcccataaaggaccaagggcaatgtggatcatgttgggcatttagtgcagctggtgctcttgaaggacanacatttttaaagcacaacgtactagaagtactgagtacccaacagttagtagattgtttcggtgattacgacaatgaaggctgcaatggtggttggccccattgggcatataactacattaaagatcatggcctctgtctagagtctgatta

SEQ ID NO: 436 - DNA, 349 bp, Diabrotica virgifera
  Clone ID: LIB3026-031-Q1-E1-F1
ccaaaatcaatttactggagaaaaaaaaggggaattgcccccaaaaaggaacaaaggcaatgccgattatgttgggcatttagtgcagctggtgctcttgaaggacaaagatttttaaagcagaacgtactagaggtactgagtacccaacagttagtagattgttccggtgattactacaatcaaggctgcaatggtggttggcctcattgggcatataactacattaaagatcatggcctctgtctagagtctgattacaagtatcaaggattagatggtgactgcaaacagtgtaatccggttctcaaaaccatcaatggctatacttctatagattaaactgaag

SEQ ID NO: 437 - DNA, 354 bp, Diabrotica virgifera
  Clone ID: LIB149-042-Q1-E1-F2
aagctgggctttcagtaccaccggatccctcgaaggtcaactcgccatccacaaaaatcaacgtgttcctctcagtgaacaagaattggtagactgtgacacatcaagaaatgctggttgtaacggaggtttgatgacagatgcctttaactatgttaaacgccatggtctctcttccgaatctcaatatgcatacaccggcagagatgatcgctgcaagaatgttgagaacaaaccactctcttccattagtggctacgtagaacttgaaacaactgaagatgcactcgcgtccgctgttgctagcgtaggtccagtttccatcgctgttcatgctgatacatggcaattata

SEQ ID NO: 438 - DNA, 419 bp, Diabrotica virgifera
  unsure (1)..(419): unsure at all n locations
  Clone ID: LIB149-012-Q1-E1-C4
ctttcattaccaccggttccctcaaaggtcaactcgccatccacaaaaatcaacttgtccctctcaatgaacataaattggtatactgtgacacatcaagaaatgctggttgtaacggatgtttgatgacagatgcctttaactatgttaaacgccatggtctctcttccgaatctcaatatgcatacaccggcagagatgatcgctgcaagaatgttgagaacaaaccactctcttccattagtggctacgtagaacttgaaacaactgaagatgcactcgcgtccgctgttgctagcgtaggtccagtttccatcgctgttgatgctgatacatggcaattatacngaggtggacttttcaacaactaaaactgtagaaccaagctcaatcacagtgttcatgctgttggatacact

SEQ ID NO: 439 - DNA, 344 bp, Diabrotica virgifera
  Clone ID: LIB3026-032-Q1-E1-C1
gcgtccgctatgtaaaacgccatggtctctcttccgaatctcaatatgcatacaccggcagagatgatcgctgcaagaatgttgagaacaaaccactctcttccattagtggctacgtagaacttgaaacaactgaagatgcactcgcgtccgctgttgctagcgtaggtccagtttccatcgctgttgatgctgatacatggcaattatacggaggtggacttttcaacaacaaaaactgtagaaccaacctcaatcacggtgttcttgctgttggatacactaaagatgcattcattgtcaagaactcatggggaactagctggggtgaacaaggttacatc

SEQ ID NO: 440 - DNA, 398 bp, Diabrotica virgifera
  Clone ID: LIB149-048-Q1-E1-B9
ctcccgggccgacacacgcctcaagaataaatcactctcttccattagtggctacgtagaacttgaaacaactgaagatgcactcgcgtccgctgttgctagcgtaggtccagtttccatcgctgttgatgctgatacatggcaattatacggaggtggacttttcaacaacaaaaactgtagaaccaacctcaatcacggtgttcttgctgttggatacactaaagatgcattcattgtcaagaactcatggggaactagctggggtgaacaaggttacatcagagttgcccgtggtgaaaacttgtgtggtattaacctcatgaactcttaccctaaattgtaaatgatttaatgcaaatgaaacaccaaatagaattcaaaaataaagattaatt

SEQ ID NO: 441 - DNA, 355 bp, Diabrotica virgifera
  Clone ID: LIB3026-018-Q1-E1-C4
acgggtagactgtgacacatcaagaaatgctggttgtaacggaggtttgatgacagatgcctttaactatgttaaacgccatggtctctcttccgaatctcaatatgcatacaccggcagagatgatcgctgcaagaatgttgagaacaaaccactctcttccattagtggctacgtagaacttgaaacaactgaagatgcactcgcgtccgctgttgctagcgtaggtccagtttccatcgctgttgatgctgatacatggcaattatacggaggtggacttttcaacaacaaaaactgtagaaccaacctcaatcacggtgttcttgctgttggatacactaaagatgcattc

SEQ ID NO: 442 - DNA, 299 bp, Diabrotica virgifera
  unsure (1)..(299): unsure at all n locations
  Clone ID: pGUT4210
caaagatttttaaagcagaacgtactagaagtattgagtacccaacagttagtagattgttccggtgattacgacaatgaaggctgcaatggtggttggccccattgggcatataactacattaaagatcatggcctctgtctagagtctgattacaagtatcaagcattagacggtgactgcaaacagtgtaatccggttctcataaccatcaatggctatgcatctgtagatcanaccgaagaagcacttaaggaggctgtaggtactgttggcccaatatcagtatgtgtcaacgc

SEQ ID NO: 443 - DNA, 339 bp, Diabrotica virgifera
  Clone ID: LIB3026-023-Q1-E1-G6
acgcgtcagcaagaaggacaaaactacatcgtcaatggaaaatcagaacccctcagtgagcaggaacttctggattgttccgtagaatacggaaatggtgactgcgatgaaggtggtcttatgacccttgcttttgagttcgtcgaggaaaacggaatcgtatctgaagctagctatccgtacgaagctatccaaggagattgcagaacaaccaatgacaacgcagtacttcatattcaaggttacaatgaagtatatccaagtgaagaagctttgagacaagctgtcggtactgttggtcccatttctgcacctatttgggctgaactactccagttc

SEQ ID NO: 444 - DNA, 443 bp, Diabrotica virgifera
  Clone ID: LIB150-006-Q1-E1-H8
ccgacgaacgcgtccaattaaattgaattactctaatatttttttttattttcaatttttatttatttaataatttaaactattttaactttaattataaaccaaaatattttaaaactaaaaaaactaatttaaaattcaattgaaaatgataataaatttattttcttctttcgaccctacatctaattttaatttaccaataaactgattaagaacagtattaggtctattaattattccatctagattttgattaatcccctctcgttataattatttatgaataaagattattataacattacataaagaatttaaagttttaattggaaattataaatcccaaggaagaacattaatttttatcccactatttagattaagtttatttaataattttcttggattattcccgtaaatttttactagaacaagacata

SEQ ID NO: 445 - DNA, 444 bp, Diabrotica virgifera
  Clone ID: LIB3026-016-Q1-E1-C9
cgggccgacccaagcgtccacccacgcgtccgattaaattgaattactctaatatttttttttattttcattttttatttatttaataatttaaactattttaactttaattataaaccaaaatattttaaaactaaaaaaactaatttaaaattcaattgaaaatgataataaatttattttcttctttcgaccctacatctaattttaatttaccaataaactgattaagaacagtattaggtctattaattattccatctagattttgattaatcccctcgcgttataattatttatgaataaagattattataacattacataaagaatttaaagttttaattggaaattataaatcccaaggaagaacattaatttttatctcactatttagattaattttagttaataattttcttggattattcccgtataatttta

SEQ ID NO: 446 - DNA, 423 bp, Diabrotica virgifera
  Clone ID: LIB149-035-Q1-E1-G5
aaaattactctaatatttttttttattttcattttttatttatttaataatttaaactattttaactttaattataaaccaaaatattttaaaactaaaaaaactaatttaaaattcaattgaaaatgataataaatttattttcttctttcgaccctacatctaattttaatttaccaataaactgattaagaacagtattaggtctattaattattccatctagattttgattaatcccctctcgttataattatttatgaataaagattattataacattacataaagaatttaaagttttaattggaaattataaatcccaaggaagaacattaatttttatctcactatttagattaaatttatttagtaaatttcctgggataatccccgtaaattttaacaagaccaagacatata

SEQ ID NO: 447 - DNA, 444 bp, Diabrotica virgifera
  Clone ID: LIB3026-017-Q1-E1-G1
aataaattgaattactctaatatttttttttattttcattttttatttatttaataatttaaactattttaactttaattataaaccaaaatattttaaaactaaaaaaactaatttaaaattcaattgaaaatgataataaatttattttcttctttcgaccctacatctaattttaatttaccaataaactgattaagaacagtattaggtctattaattattccatctagattttgattaatcccctctcgttataattatttatgaataaagattattataacattacataaagaatttaaagttttaattggaaattataaatcccaaggaagaacattaatttttatctcactatttagattaattttatttaataattttcttggattattcccgtatatttttactagaacaagacatataactttaacattaaga

SEQ ID NO: 448 - DNA, 409 bp, Diabrotica virgifera
  Clone ID: LIB150-025-Q1-E1-C4
aatatttttttttattttcattttttatttatttaataatttaaactattttaactttaattataaaccaaaatattttaaaactaaaaaaactaatttaaaattcaattgaaaatgataataaatttattttcttctttcgaccctacatctaattttaatttaccaataaactgattaagaacagtattaggtctattaattattccatctagattttgattaatcccctctcgttataattatttatgaataaagattattataacattacataaagaatttaaagttttaattggaaattataaatcccaaggaagaacattaatttttatctcactatttagattaattttatttaataattttcatggattattcccgtatatttttaccagaacaagacata

SEQ ID NO: 449 - DNA, 440 bp, Diabrotica virgifera
  Clone ID: LIB3026-017-Q1-E1-F8
attaaattgaattactctaatatttttttttattttcattttttatttatttaataatttaaactattttaactttaattataaaccaaaatattttaaaactaaaaaaactaatttaaaattcaattgaaaatgataataaatttattttcttctttcgaccctacatctaattttaatttaccaataaactgattaagaacagtattaggtctattaattattccatctagattttgattaatcccctctcgttataattatttatgaataaagattattataacattacataaagaatttaaagttttaattggaaattataaatcccaaggaagaacattaatttttatctcactatttagattaatttgatttaataattttcttggattattcccgtatatttttactagaacaagacatataactttaacatt

SEQ ID NO: 450 - DNA, 451 bp, Diabrotica virgifera
  Clone ID: LIB150-013-Q1-E1-D7
cccacgcgtccgattaaattgaattactctaatatttttttttattttcattttttatttatttaataatttaaactattttaactttaattataaaccaaaatattttaaaactaaaaaaactaatttaaaattcaattgaaaatgataataaatttattttcttctttcgaccctacatctaattttaatttaccaataaactgattaagaacagtattaggtctattaattattccatctagattttgattaatcccctctcgttataattatttatgaataaagattattataacattacataaagaatttaaagttttaattggaaattataaatcccaaggaagaacattaatttttatctcactatttagattaattttatttaataattttcttggattattcccgtatatttttactagaacaagacatataactttaacat

SEQ ID NO: 451 - DNA, 438 bp, Diabrotica virgifera
  Clone ID: LIB150-014-Q1-E1-H10
aataaattgaattactctaatatttttttttattttcattttttatttatttaataatttaaactattttaactttaattataaaccaaaatattttaaaactaaaaaaactaatttaaaattcaattgaaaatgataataaatttattttcttctttcgaccctacatctaattttaatttaccaataaactgattaagaacagtattaggtctattaattattccatctagattttgattaatcccctctcgttataattatttatgaataaagattattataacattacataaagaatttaaagttttaattggaaattataaatcccaaggaagaacattaatttttatctcactatttagattaattttatttaataattttcttggattattcccgtatatttttactagaacaagacatataactttaaca

SEQ ID NO: 452 - DNA, 444 bp, Diabrotica virgifera
  Clone ID: LIB149-013-Q1-E1-B3
ccacgcctccgaataaattgaattactctaatatttttttttattttcattttttatttatttaataatttaaactattttaactttaattataaaccaaaatattttaaaactaaaaaaactaatttagaattcaattgaaaatgataataaatttattttcttctttcgaccctacatctaattttaatttaccaataaactgattaagaacagtattaggtctattaattattccatctagattttgattaatcccctctcgttataattatttatgaataaagattattataacattacataaagaatttaaagttttaattggaaattataaatcccaaggaagaacattaatttttatctcactatttagattaattttatttaataattttcttggattattcccgtatatttttactagaacaagacatataactt

SEQ ID NO: 453 - DNA, 400 bp, Diabrotica virgifera
  Clone ID: LIB149-048-Q1-E1-G10
tacaagactcaacacagacgtcctactaacgcgtccgaaattgaattactctaatatttttttttattttcattttttatttatttaataatttaaactattttaactttaattataaaccaaaatattttaaaactaaaaaaactaatttaaaattcaattgaaaatgataataaatttattttcttctttcgaccctacatctaattttaatttaccaataaactgattaagaacagtattaggtctattaattattccatctagattttgattaatcccctctcgttataattatttatgaataaagattattataacattacataaagaatttaaagttttaattggaaattataaatcccaaggaagaacattaatttttatctcactatttaga

SEQ ID NO: 454 - DNA, 436 bp, Diabrotica virgifera
  Clone ID: LIB3026-009-Q1-E1-D3
ccacgcgtccgaaaaaattgaattactctaatatttttttttattttcattttttatttatttaataatttaaactattttaactttaattataaaccaaaatattttaaaactaaaaaaactaatttaaaattcaattgaaaatgataataaatttattttcttctttcgaccctacatctaattttaatttaccaataaactgattaagaacagtattaggtctattaattattccatctagattttgattaatcccctctcgttataattatttatgaataaagattattataacattacataaagaatttaaagttttaattggaaattataaatcccaaggaagaacattaatttttatctcactatttagattaattttaattaaaaaatttcctggaatattcccgtatatttttaacagaacaagaca

SEQ ID NO: 455 - DNA, 457 bp, Diabrotica virgifera
  Clone ID: LIB150-041-Q1-E1-H5
atacaagcctctaaacagacgtcgtgataaaattgaattactctaatatttttttttattttcattttttatttatttaataatttaaactattttaactttaattataaaccaaaatattttaaaactaaaaaaactaatttaaaattcaattgaaaatgataataaatttattttcttctttcgaccctacatctaattttaatttaccaataaactgattaagaacagtattaggtctattaattattccatctagattttgattaatcccctctcgttataattatttatgaataaagattattataacattacataaagaatttaaagttttaattggaaattataaatcccaaggaagaacattaatttttatctcactatttagattaattttatttaataattttcttggattattcccgtatatttttactagaacaagacatataac

SEQ ID NO: 456 - DNA, 418 bp, Diabrotica virgifera
  Clone ID: LIB3026-026-Q1-E1-B8
aattactctaatatttttttttattttcattttttatttatttaataatttaaactattttaactttaattataaaccaaaatattttaaaactaaaaaaactaatttaaaattcaattgaaaatgataataaatttattttcttctttcgaccctacatctaattttaatttaccaataaactgattaagaacagtattaggtctattaattattccatctagattttgattaatcccctctcgttataattatttatgaataaagattattataacattacataaagaatttaaagttttaattggaaattataaatcccaaggaagaacattaatttttatctcactatttagattaattttatttaataattttcttggattattcccgtatatttttactagaacaagacata

SEQ ID NO: 457 - DNA, 430 bp, Diabrotica virgifera
  Clone ID: LIB150-044-Q1-E1-C6
taaatagattcatataatctaatatttttttttattttcattttttatttatttaataatttaaactattttaactttaattataaaccaaaatattttaaaactaaaaaaactaatttaaaattcaattgaaaatgataataaatttattttcttctttcgaccctacatctaattttaatttaccaataaactgattaagaacagtattaggtctattaattattccatctagattttgattaatcccctctcgttataattatttatgaataaagattattataacattacataaagaatttaaagttttaattggaaattataaatcccaaggaagaacattaatttttatctcactatttagattaattttatttaataattttcttggattattcccgtatatttttactagaacaagacatat

SEQ ID NO: 458 - DNA, 450 bp, Diabrotica virgifera
  Clone ID: LIB149-010-Q1-E1-D12
aggaaatactcgaataattttttttattttcattttttatttatttaataagttaaactattttaactttagttataaaccaaaatattttggaactaaaaaaactaatttaaaattcaattgaaaatgataatagatttaatttcatctttcgaccctacatctaattgtaatttaccaataaactgattaagaacagtattaggtctattaattagtccatctagattttgattaatcccctctcgtgataattatttatgaagatagattatgataggattacataaagaatttatagttttaattggcaattataaatcccaaggaagagcattaatttttatctcactagttagattaattttacttaataattttcatggattactcacgtatatttttactagaacaagacatataactttaacattaagactagctttacca

SEQ ID NO: 459 - DNA, 439 bp, Diabrotica virgifera
  Clone ID: LIB3026-016-Q1-E1-E7
aaagaattactctaatatttttttttattttcattttttatttatttaataatttaaactattttaactttaattataaaccaaaatattttaaaactaaaaaaactaatttaaaattcaattgaaaatgataataaatttattttcttctttcgaccctacatctaattttaatttaccaataaactgattaagaacagtattaggtctattaattattccatctagattttgattaatcccctctcgttataattatttatgaataaagattattataacattacataaagaatttaaagttttaattggaaaattataaatcccaaggaagaacattaatttttatctcactatttagattaattttatttaataattttcttggattattcccgtatatttttactagaacaagacatataactttaacattaag

SEQ ID NO: 460 - DNA, 401 bp, Diabrotica virgifera
  Clone ID: LIB149-024-Q1-E1-A10
acccacgcgtccgaaaaaaactaatttaaaattcaattgaaaatgataataaatttattttcttctttcgaccctacatctaattttaatttaccaataaactgattaagaacagtattaggtctattaattattccatctagattttgattaatcccctctcgttataattatttatgaataaagattattataacattacataaagaatttaaagttttaattggaaattataaatcccaaggaagaacattaatttttatctcactatttagattaattttatttaataattttcttggattattcccgtatatttttactagaacaagacatataactttaacattaagattagctttaccattatgattgagatttataatttatggatgaataaa

SEQ ID NO: 461 - DNA, 441 bp, Diabrotica virgifera
  Clone ID: LIB3026-017-Q1-E1-D5
gaattactctaatatttttttttattttcattttttatttatttaataatttaaactattttaactttaattataaaccaaaatattttaaaactaaaaaaactaatttaaaattcaattgaaaatgataataaatttattttcttctttcgaccctacatctaattttaatttaccaataaactgattaagaacagtattaggtctattaattattccatctagattttgattaatcccctctcgttataattatttatgaataaagattattataacattacataaagaatttaaagttttaattggaaattataaatcccaaggaagaacattaatttttatctcactatttagattaattttatttaataattttcttggattattcccgtatatttttactagaacaagacatataactttaacattaagattagc

SEQ ID NO: 462 - DNA, 437 bp, Diabrotica virgifera
  Clone ID: LIB150-016-Q1-E1-F9
aattgaattactctaatatttttttttattttcattttttatttatttaataatttaaactattttaactttaattataaaccaaaatattttaaaactaaaaaaactaatttaaaattcaattgaaaatgataataaatttattttcttctttcgaccctacatctaattttaatttaccaataaactgattaagaacagtattaggtctattaattaatccatctagattttgattaatcgcctctcgttataattatttatgaataaagattattataacattacataaagaattaaaagttttaattgcgaattataaatcccaatgaagaacattaatttttatctcactatttagattaatattatttaataattttcttggattattcccgtatatttttactagaacaagacatataactttaacatta

SEQ ID NO: 463 - DNA, 420 bp, Diabrotica virgifera
  Clone ID: LIB149-026-Q1-E1-B3
aagcgtccaatatttttccaattacaatttttaattaattaaaaaattaaaacaatttaaacttaaattataaaccaaaatattttaaaactaaaaaaactaatttaaaattcaattgaaaatgataataaattaatttccttctttcgaccctacatctaattttaatttaccaataaactgattaagaacagtattaggtctattaattattccatctagattttgattaatcccctctcgttataattatttatgaataaagattattataacattacataaagaatttaaagttttaattggaaattataaatcccaaggaagaacattaatttttatctcactatttagattaattttatttaataattttcttggattaatcccgtataattttactagaacaagacatataac

SEQ ID NO: 464 - DNA, 404 bp, Diabrotica virgifera
  Clone ID: LIB149-020-Q1-E1-F7
aattaaattgaattactctaatatttttttttattttcattttttatttatttaataatttaaactattttaactttaattataaaccaaaatattttaaaactaaaaaaactaatttaaaattcaattgaaaatgataataaatttattttcttctttcgaccctacatctaattttaatttaccaataaactgattaagaacagtattaggtctattaattattccatctagattttgattaatcccctctcgttataattatttatgaataaagattattataacattacataaagaatttaaagttttaattggaaattataaatcccaaggaagaacattaatttttatctcactatttagattaattttaattaataattttcctggattaatcccgt

SEQ ID NO: 465 - DNA, 462 bp, Diabrotica virgifera
  unsure (1)..(462): unsure at all n locations
  Clone ID: LIB149-029-Q1-E1-C6
gacacacgcgtcaaattaaattgaattaatctaatatttttttttattttcattttttatttatttaataatttaaactattttaactttaattataaaccaaaatattttaaaactaaaaaaactaatttaaaattcaattgaaaatgataataaatttattttcttctttcgaccctacatctaattttaatttaccaataaactgattaagaacagtattaggtctattaattattccatctagattttgattaatcncctctcgttataattatttatgaataaagattattataacattacatanagaatttaaagtttaattggaaataataaatccaaaggagaaacattaattttaacccaacaattagattaattttaattaataattttcttggattattcccgtatatttttactagaacaagacatataactttaacattaagattagct

SEQ ID NO: 466 - DNA, 404 bp, Diabrotica virgifera
  Clone ID: LIB3026-014-Q1-E1-A11
aattaaattgaattactctaatatttttttttattttcattttttatttatttaataatttaaactattttaactttaattataaaccaaaatattttaaaactaaaaaaactaatttaaaattcaattgaaaatgataataaatttattttcttctttcgaccctacatctaattttaatttaccaataaactgattaagaacagtattaggtctattaattattccatctagattttgattaatcccctctcgttataattatttatgaataaagattattataacattacataaagaatttaaagttttaattggaaattataaatcccaaggaagaacattaatttttatctcactatttagattaattttatttaataattttcttggattattcccgt

SEQ ID NO: 467 - DNA, 401 bp, Diabrotica virgifera
  Clone ID: LIB149-030-Q1-E1-B6
agcggacgcgtgggttaaattgaattactctaatatttttttttattttcattttttatttatttaataatttaaactattttaactttaattataaaccaaaatattttaaaactaaaaaaactaatttaaaattcaattgaaaatgataataaatttattttcttctttcgaccctacatctaattttaatttaccaataaactgattaagaacagtattaggtctattaattattccatctagattttgattaatcccctctcgttataattatttatgaataaagattattataacattacataaagaatttaaagttttaattggaaattataaatcccaaggaagaacattaatttttatctcactatttagattaattttatttaataattttc

SEQ ID NO: 468 - DNA, 400 bp, Diabrotica virgifera
  Clone ID: LIB3026-015-Q1-E1-G12
acccacgcgtccgattaaattgaattactctaatatttttttttattttcattttttatttatttaataatttaaactattttaactttaattataaaccaaaatattttaaaactaaaaaaactaatttaaaattcaattgaaaatgataataaatttattttcttctttcgaccctacatctaattttaatttaccaataaactgattaagaacagtattaggtctattaattattccatctagattttgattaatcccctctcgttataattatttatgaataaagattattataacattacataaagaatttaaagttttaattggaaattataaatcccaaggaagaacattaatttttatctcactatttagattaattttatttaataatttt

SEQ ID NO: 469 - DNA, 432 bp, Diabrotica virgifera
  Clone ID: LIB149-039-Q1-E1-C6
atacaagcctctaaactgacgtcgtattacgcgtccgttttcattttttatttatttaataatttaaactattttaactttaattataaaccaaaatattttaaaactaaaaaaactaatttaaaattcaattgaaaatgataataaatttattttcttctttcgaccctacatctaattttaatttaccaataaactgattaagaacagtattaggtctattaattattccatctagattttgattaatcccctctcgttataattatttatgaataaagattattataacattacataaagaatttaaagttttaattggaaattataaatcccaaggaagaacattaatttttatctcactatttagattaattttatttaataattttcttggattattcgcgttatattttactagaacaggacata

SEQ ID NO: 470 - DNA, 415 bp, Diabrotica virgifera
  Clone ID: LIB150-038-Q1-E1-A5
acgcgtctgcgcacgcgtccgaattactctaatatttttttttattttcattttttatttatttaataatttaaactattttaactttaattataaaccaaaatattttaaaactaaaaaaactaatttaaaattcaattgaaaatgataataaatttattttcttctttcgaccctacatctaattttaatttaccaataaactgattaagaacagtattaggtctattaattattccatctagattttgattaatcccctctcgttataattatttatgaataaagattattataacattacataaagaatttaaagttttaattggaaattataaatcccaaggaagaacattaatttttatctcactatttagattaattttatttaataattttcttggattattcccgt

SEQ ID NO: 471 - DNA, 412 bp, Diabrotica virgifera
  Clone ID: LIB3026-002-Q1-E1-C8
aattaaattgaattactctaatatttttttttattttcattttttatttatttaataatttaaactattttaactttaattataaaccaaaatattttaaaactaaaaaaactaatttaaaattcaattgaaaatgataataaatttattttcttctttcgaccctacatctaattttaatttaccaataaactgattaagaacagtattaggtctattaattattccatctagattttgattaatcccctctcgttataattatttatgaataaagattattataacattacataaagaatttaaagttttaattggaaattataaatcccaaggaagaacattaatttttatctcactatttagattaattttatttaataattttcttggattaatcccgtaaaatttt

SEQ ID NO: 472 - DNA, 431 bp, Diabrotica virgifera
  Clone ID: LIB149-039-Q1-E1-E8
tacaagactctacacgagacgtcgtattaacgcgtccgctctaatatttttttttattttcattttttatttatttaataatttaaactattttaactttaattataaaccaaaatattttaaaactaaaaaaactaatttaaaattcaattgaaaatgataataaatttattttcttctttcgaccctacatctaattttaatttaccaataaactgattaagaacagtattaggtctattaattattccatctagattttgattaatcccctctcgttataattatttatgaataaagattattataacattacataaagaatttaaagttttaattggaaattataaatcccaaggaagaacattaatttttatctcactatttagattaattttatttaataattttcttggattagtcccgtatat

SEQ ID NO: 473 - DNA, 416 bp, Diabrotica virgifera
  Clone ID: LIB149-039-Q1-E1-C8
atacaagcctctaaagtgagtcatataatctaatatttttttttattttcattttttatttatttaataatttaaactattttaactttaattataaaccaaaatattttaaaactaaaaaaactaatttaaaattcaattgaaaatgataataaatttattttcttctttcgaccctacatctaattttaatttaccaataaactgattaagaacagtattaggtctattaattattccatctagattttgattaatcccctctcgttataattatttatgaataaagattattataacattacataaagaatttaaagttttaattggaaattataaatcccaaggaagaacattaatttttatcgcactatttagattaattttatttaataattttcgtggattattcccgt

SEQ ID NO: 474 - DNA, 381 bp, Diabrotica virgifera
  Clone ID: LIB3026-029-Q1-E1-A2
accacgcatccgcccacgcgtccgcccacgcgtccgcccacgcgtccgattgaattactctaagatttttttttattttcattttttatttagttaataatttaaacgatgttagcgttaattataaaccaaaatattttaaaactaaaaaaactaatttaaaattcagttgaaaatgataagagatttattttcgtctttcgaccctacatctaattttaatttaccaataaactgattaagaacagtattaggtctattaattactccatctagattttgattaatcccctctcgttataattagttatgaataaagattattatgacattacataaagaatttaaagttttaagtggaaattagaaatcccaaggaag

SEQ ID NO: 475 - DNA, 370 bp, Diabrotica virgifera
  Clone ID: LIB3026-004-Q1-E1-C2
aattgaattactctaatatttttttttattttcattttttaattatttaataatttaaactattttaactttaattataaaccaaaatattttaaaactaaaaaaactaatttaaaattcaattgaaaatgataataaatttattttcttctttcgaccctacatctaattttaatttaccaataaactgattaagaacagtattaggtctattaattattccatctagattttgattaatcccctctcgttataattatttatgaataaagattattataacattacataaaagaatttaaagtttttaatgggaaattataaaccccagggaaaacaataaattttaacccaccattaaaataaattt

SEQ ID NO: 476 - DNA, 362 bp, Diabrotica virgifera
  Clone ID: LIB149-010-Q1-E1-F6
atgcaagactctagagtgagtcgaattattttttttattttcattttttatttatttaataatttaaactattttagctttaattataaaccagagtattttaaaactaaaaaaactaattgaaaattcaattgaaagtgataagtaattttaggttcttctttcgaccctacatctaattttaatttaccaatatactgattaagaagagtattaggtctattagttagtccatctagattttgattaatcgcctctcgttataattatttatgaataaagattatgataacattacataaagaatttaaagttttaattggaaattatgaatcgcaaggaagaacatgaatttttaggtc

SEQ ID NO: 477 - DNA, 436 bp, Diabrotica virgifera
  unsure (1)..(436): unsure at all n locations
  Clone ID: LIB3026-011-Q1-E1-E4
cgcgagggttcaattttttggacacatccaaatggcaccatgagcaaaccttatctggtggtggaaacaacgaatttgaatggtatacggatgatagacgtaacagctatacctccaacggccaattacacatcaaacccacttttgtcgcagatgaatatggtgaaaaattcttatattccggtactattgacttgggaaataaatgtactggttctgacaatgaaggttgtangagaactggttcagccaatgctatagttaatcccatcaaaagtgctcgtatgaggaccttagactcattttcatttaaatacggcagagttgaagtcagcgctaaagtaccttctggagattggttgtggccagctatctggatgttaccaagtaaatgggtttatggaagttggccagcatctggagaaatcgacatcat

SEQ ID NO: 478 - DNA, 410 bp, Diabrotica virgifera
  unsure (1)..(410): unsure at all n locations
  Clone ID: pGUT628
cccacttttgtcgcagatgaatatggagaagatttcttatattctggtactattgatataggagctgcctgcacaggtggcgacaacgatagttgcagaagatctggttcacccaatgccatagtcaatcccatcgtaagtgctcgtatgaagacattgcactcattctcatttaaatacggcagggttgaagttaatgctaaaataccatctggagattggttatggccagctgtctggatgtttacaactaactgggagtatgganattggccagcatctggagaaatcgacatcatggaaagtagaagataccgtcagtattatgcccccaatggacaaaacgttggaactgcaacagaatcatctactctacattggggaactactccacaattcaacaaacaact

SEQ ID NO: 479 - DNA, 437 bp, Diabrotica virgifera
  unsure (1)..(437): unsure at all n locations
  Clone ID: LIB149-046-Q1-E1-B5
aaaaaaatcggcagataagatgattttgatactgttcgcgttttccgcgatacttttcaacggtgtacattccgtatgtcttaaaaattcgataacaactgcaagtggtttacacgcacccaagaacaagagtctctgttctggacaactgatctttgaagataacttcaattttttggacacatccaaatggcaccatgagcaaaccttatctggtggtggaaacaacgaatttgaatggtatacggatgatagacgtaacagctatacctccaacggccaattacacatcaaacccacttttgtcgcagatgaatatggtgaaaaattcttatattccggtactattgacttgggaaataaatgtactggttctgacaatgaaggttgtangagaactggttcagccaatgctatagttaatcccatcaaaagtg

SEQ ID NO: 480 - DNA, 383 bp, Diabrotica virgifera
  Clone ID: LIB150-022-Q1-E1-G4
gtccgaattcgttaaacgcggaagtatgaacttaatgaagttcatggcactgatttttcacaacctacgtggttgtgaaaaatcggtcactaccgtaagtggtactcacgcgccccttctgccctgtaaaggtgatctgatttttaaagacgagtttaacaatctggatttgaaaaaatggcaacacgaggtatctcttagtggaaatggaaattgggaatttcaatggtacacaaataaccgaagtaatagttacgttgaaaatggtgttttgcatatccgaccaaccttggtagctgacgattatggtaacgaatttctctattctggaacaattgatgtcaatggcggttcgcctgctgatgagtgtacaaatccacaat

SEQ ID NO: 481 - DNA, 434 bp, Diabrotica virgifera
  Clone ID: LIB149-027-Q1-E1-D10
cccacgcctccaaaaaatattaagatacgatgattctaatactgttcgcgttttccgcgatactttttaacggtgtacattccgtatgtcttaaaaattcgataacaactgcaagtggtttacacgcacccaagaacaagagtctctgttctggtcaactgatctttgaagacaactttaattggttggacacctcgaaatgggaccatgaacaaaccttaactggaggtggaaacaacgaattccaatggtatacggataatagacgtaacagttatacttacaacggccaattacacatcaaacccacttttgtcgcagatgaatatggagaagatttcttatattctggtactattgatataggagctgcctgcacaggtggcgacaacgaaggttgcagaagaactggttcacccaatgccatagtcaat

SEQ ID NO: 482 - DNA, 417 bp, Diabrotica virgifera
  Clone ID: LIB3026-031-Q1-E1-B5
acgatggccagctgtctggatgttaccaactaactgggagtatggaaattggccagcatctggagaaatcgacatcatggaaagtagaggaaaccgtcagtattatgcccccaatggacaaaacgttggaactgcaacagaatcatctactctacattggggacctactccacaattcaacaaacaactgaagactcactgggaaaagatcaattataacggtggttgggataacgctttccatagatatcaagtggaatggacgcctgaacatattaaattttcctgcgatgatcaagaacttggtacaattacacccccatctggaggcttctgggaatacggtgatcttggaccatctggattgccaaacccatggtctggaggaactagaatggctccatttgacaaagagtt

SEQ ID NO: 483 - DNA, 408 bp, Diabrotica virgifera
  Clone ID: LIB149-023-Q1-E1-E4
cttggccaaccaagccttcggcggacccttgggcggacccttgggcggacccttgggtccgtaggtcttaaaaattcaataacaactgcaattggtttacacgcacccaaaaacaaaagtctctgtcctggtcaactgatctttgaagacaactttaattggttggacacctcgaaatgggaccatgaacaaaccttaactggaggtggaaacaacgaattccaatggtatacggataatagacgtaacagttatacttacaacggccaattacacatcaaacccacttttgtcgcagatgaatatggagaagatttcttatattctggtactattgatataggagctgcctgcacaggtggcgacaacgaaggttgcagaagaactggttcaaccaatgccatagtc

SEQ ID NO: 484 - DNA, 378 bp, Diabrotica virgifera
  Clone ID: LIB149-040-Q1-E1-F8
acggacgcgtgggaaaatattaagatacgatgattcttatactgttcgcgttttccgcgatactttttaacggtgtacattccgtatgtcttaaaaattcgataacaactgcaagtggtttacacgcacccaagaacaagagtctctgttctggtcaactgatctttgaagacaactttaattggttggacacctcgaaatgggaccatgaacaaaccttaactggtggtggaaacaacgaattccaatggtatacggataatagacgtaacagttatacttacaacggccaattacacatcaaacccacttttgtcgcagatgaatatggagaagatttcttatattctggtactattgatataggagctgcctgca

SEQ ID NO: 485 - DNA, 424 bp, Diabrotica virgifera
  Clone ID: LIB3026-030-Q1-E1-E5
ccacgcgtccgaactaactgggagtatggaaattggccagcatctggagaaatcgacatcatggaaagtagaggaaaccgtcagtattatgcccccaatggacaaaacgttggaactgcaacagaatcatctactctacattggggacctactccacaattcaacaaacaactgaagactcactgggaaaagatcaattataacggtggttgggataacgctttccatagatatcaagtggaatggacgcctgaacatattaaattttcctgcgatgatcaagaacttggtacaattacacccccatctggaggcttctgggaatacggtgatcttggaccatctggattgccaaacccatggtctggaggaactagaatggctccatttgacaaagagttccatcttataattaatttggcta

SEQ ID NO: 486 - DNA, 424 bp, Diabrotica virgifera
  unsure (1)..(424): unsure at all n locations
  Clone ID: LIB149-015-Q1-E1-E2
gatctcgattgtatataagcgttagctaggagattgtcttaacatagtccaccaaaaaaaaaatcggcagataagatgattttgatactgttcgcgttttccgcgatactttttaacggtgtacattccgtatgtcttaaaaattcgataacaactgcaagtggtttacacgcacccaagaacaagagtctctgttctggacaactgatctttgaagataacttcaattttttggacacatccaaatggcaccatgagcaaaccttatctggtggtggaaacaacgaatttgaatggtatacggatgatagacgtaacagctatacctccaacggccaattacacatcaaacccacttttgtcgcagatgaatatggtgaaaaattcttatantccggtactattgacttgggagctaaatgta

SEQ ID NO: 487 - DNA, 400 bp, Diabrotica virgifera
  Clone ID: LIB149-016-Q1-E1-A11
tcgcgggtcgacacaagcctctacagacactcgtgataaaatcggcagataagatgattttgatactgttcgcgttttccgcgatacttttcaacggtgtacattccgtatgtcttaaaaattcgataacaactgcaagtggtttacacgcacccaagaacaagagtctctgttctggacaactgatctttgaagataacttcaattttttggacacatccaaatggcaccatgagcaaaccttatctggtggtggaaacaacgaatttgaatggtatacggatgatagacgtaacagctatacctccaacggccaattacacatcaaacccacttttgtcgcagatgaatatggtgaaaaattcttatattccggtactattgactttggaaataaatg

SEQ ID NO: 488 - DNA, 425 bp, Diabrotica virgifera
  Clone ID: LIB3026-030-Q1-E1-B4
caaacgagtgggcggacgcgtgggcaagaacttggtacaattacacccccatctggcggcttttggcaatacggcgatcttggaccgtctggattgccaaacccatggtctcgtggaagtaggatggctccctttgaccaagagttccacttactgattaatttggctgttggaggagcttatttcaacgatgagtttaacaataaagcttataagaaaccctggactagcactgaaccttaccgtcagggtatgacaaaattctggcaagctaatcaaaaatggaaaccaacttggaatttaaattcagatgactcacaccttaaagttgactacgtaagagtttgggctctgtaattatttaaaaataaataaaaattaaaatacccaacctgaatggacaaatggaaacccccttttaacgg

SEQ ID NO: 489 - DNA, 407 bp, Diabrotica virgifera
  Clone ID: LIB3026-013-Q1-E1-A1
actgaagactcactgggaaaagatcaattataacggtggttgggataacgctttccatagatatcaagtggaatggacgcctgaacatattaaattttcctgcgatgatcaagaacttggtacaattacacccccatctggaggcttctgggaatacggtgatcttggaccatctggattgccaaacccatggtctggaggaactagaatggctccatttgacaaagagttccatcttataattaatttggctattggaggagcttatttcaacgatgaatttgacaataaagcttataagaaaccctggactagcactgaaccttaccgtcagggtatgacaaaattctggcaagctaatcaaaaatggaaaacaacctggaatttgaactcagatgactcacatc

SEQ ID NO: 490 - DNA, 387 bp, Diabrotica virgifera
  Clone ID: LIB3026-005-Q1-E1-E6
gacatcatggaaagtagaggaaaccgtcagtattatgcccccaatggacaaaacgttggaactgcaacagaatcatctactctacattggggacctactccacaattcaacaaacaactgaagactcactgggaaaagatcaattataacggtggttgggataacgctttccatagatatcaagtggaatggacgcctgaacatattaaattttcctgcgatgatcaagaacttggtacaattacacccccatctggaggcttctgggaatacggtgatcttggaccatctggattgccaaacccatggtctggaggaactagaatgggtccatttgacaaagagttccatcttataattaatttggctattggaggagcttatttc

SEQ ID NO: 491 - DNA, 401 bp, Diabrotica virgifera
  Clone ID: LIB149-027-Q1-E1-G12
cctaaagtgagtcatattaacatcatggaaagtagaggaaaccgtcagtattatgatcccagtggacaaaacgttggaactcaattagaagcatctactctacattggggacctaatccaaaattcaacaaatttatgaagactcactgggaacagaagaattggaacggtggttgggataacgcttatcacagatatcaagtggaatggacgcctgaacatatcaaattttcttgcgatgatcaagaacttggtacaattacacccccatctggcggcttttggcaatacggcgatcttggaccgtctggattgccaaacccatggtctcgtggaagtaggatggctccctttgaccaagagttccacttactgattaatttggctgttggaagagctta

SEQ ID NO: 492 - DNA, 331 bp, Diabrotica virgifera
  Clone ID: LIB3026-008-Q1-E1-A7
caaaaaaaaaatcggcagataagatgattttgaaactgttcgcgttttccgcgatactttttaacggtgtacattccgtatgtcttaaaaattcgataacaactgcaagtggtttacacgcacccaagaacaagagtctctgttctggacaactgatctttgaagataacttcaattttttgggcacatccaaatggcaccatgaacacaacttatctggtggtggaaacaacgaatttgaatggtatacggatgatagacgtaacagctatacctccaacggccaattacacatcaaacccacttttgtcgcagatgaatatggtgaaaa

SEQ ID NO: 493 - DNA, 414 bp, Diabrotica virgifera
  unsure (1)..(414): unsure at all n locations
  Clone ID: LIB150-009-Q1-E1-D8
acgagaaaaacgtgcaccaagatgaaagtgcttcttgtcttcgtgctagtagcggtttgtaaagtgaactcctattgtataagaagtgtgacaacggctagtgggccctttgcgcccaaaaatatatgttcgggtgatctgatatttgaagataatttcgactgtttaaatttagataaatggaaacacgaagatacgttggctggaggtggaaacaacgaatttgaatggtacacaaacagcagaaacaacagctatacttcaaatggaattttacacataaaaccaacttttgtagctgatgagctangagagcagtttttacaatcagctaccgtagatttgggaaacaagtgtaccaatccacacaattctggttggtaaagaactggctcaacaggtgaaatactaaat

SEQ ID NO: 494 - DNA, 415 bp, Diabrotica virgifera
  Clone ID: LIB3026-004-Q1-E1-A7
aaccgtcagtattatgcccccaatggacaaaacgttggaactgcaacagaatcatctactctacattggggacctactccacaattcaacaaacaactgaagactcactgggaaaagatcaattataacggtggttgggataacgctttccatagatatcaagtggaatggacgcctgaacatattaaattttcctgcgatgatcaagaacttggtacaattacacccccatctggaggcttctgggaatacggtgatcttggaccatctggattgccaaacccatggtctggaggaactagaatggctccatttgacaaagagttccatcttataattaatttggctattggaggagcttatttcaacgatgaatttggcaataaagcttataagaaaccctggactaacactg

SEQ ID NO: 495 - DNA, 400 bp, Diabrotica virgifera
  Clone ID: LIB3026-031-Q1-E1-G8
ataatccaaaattcaacaaatttatgaagactcactgggaaaagaagaattggaacggtggttgggataacgcttatcacagatatcaagtggaatggacgcctgaacatatcaaattttcttgcgatgatcaagaacttggtacaattacacccccatctggcggcttttggcaatacggcgatcttggaccgtctggattgccaaacccatggtctcgtggaagtaggatggctccctttgaccaagagttccacttactgattaatttggctgttggaggagcttatttcaacgatgagtttaacaataaagcttataagaaaccctggactagcactgaaccttaccgtcagggtatgacaaaattctggcaagctaatcaaaaatggaaaccaac

SEQ ID NO: 496 - DNA, 369 bp, Diabrotica virgifera
  Clone ID: LIB3026-017-Q1-E1-C11
acgtcagtattatgatcccagtggacaaaacgttggaactcaattagaagcatctactctacattggggacctaatccaaaattcaacaaatttatgaagactcactgggaaaagaagaattggaacggtggttgggataacgcttatcacagatatcaagtggaatggacgcctgaacatatcaaattttcttgcgatgatcaagaacttggtacaattacacccccatctggcggcttttggcaatacggcgatcttggaccgtctggattgccaaacccatggtctcgtggaagtaggatggctccctttgaccaagagttccacttactgattaatttggctgttggaggagcttatttcaacga

SEQ ID NO: 497 - DNA, 376 bp, Diabrotica virgifera
  Clone ID: LIB149-015-Q1-E1-C2
gaatcgcgtccgaatataagcgtgagctatgagattgtcttaacagagtctaccataaaaaaaaatcggcagataagatgattttggtactgttcgcgttttccgcgatactttttaacggtgtacattccgtatgtcttaaaaattcgataacaactgcaaatggtttacacgcacccaagaacaagagtctctgttctggacaactgatctttgaagataacttcacttttttggacacatccaaatggcaccatgagcaaaccttatctggtggtggaaacaacgaatttgaatggtatacggatgatagacgtaagagcgatacctccaacggccaattacacatcacacccacttttgtcgcagatgaata

SEQ ID NO: 498 - DNA, 391 bp, Diabrotica virgifera
  Clone ID: LIB3026-014-Q1-E1-E4
acccacgcgtccgcccacgcgtccgaaccgtcagtattatgcccccaatggacaaaacgttggaactgcaacagaatcatctactctacattggggacctactccacaattcaacaaacaactgaagactcactgggaaaagatcaattataacggtggttgggataacgctttccatagatatcaagtggaatggacgcctgaacatattaaattttcctgcgatgatcaagaacttggtacaattacacccccatctggaggcttctgggaatacggtgatcttggaccatctggattgccaaacccatggtctggaggaactagaatggctccatttgacaaagagttccatcttataattaatttggctattggaggagcttatttc

SEQ ID NO: 499 - DNA, 320 bp, Diabrotica virgifera
  Clone ID: pGUT2119
gcacgaaggtcgaacggatcgaatagctcgatattcgaattcgcacgattctgaagcttctggaaatacggtgatcttggaccatctggattgccaaacccatggtctggaggaactagaatggctccatttgacaaagagttccatcttataattaatttggctattggaggagcttatttcaacgatgaatttgacaataaagcttataagaaaccctggactagcactgaaccttaccgtcagggtatgacaaaattctggcaagctaatcaaaaatggaaaccaacctggaatttgaactcagatgactcacatct

SEQ ID NO: 500 - DNA, 375 bp, Diabrotica virgifera
  Clone ID: LIB3026-028-Q1-E1-C11
agcaattagaagcatctactctacattggggacctaatccaaaattcaacaaatttatgaagactcactgggaaaagaagaattggaacggtggttgggataacgcttatcacagatatcaagtggaatggacgcctgaacatatcaaattttcttgcgatgatcaagaacttggtacaattacacccccatctggcggcttttggcaatacggcgatcttggaccgtctggattgccaaacccatggtctcgtggaagtaggatggctccctttgaccaagagttccacttactgattaatttggctgttggatgagcttatttcaacgatgattttaacaataaagcttataagaaaccctggactagcactg

SEQ ID NO: 501 - DNA, 215 bp, Diabrotica virgifera
  Clone ID: pGUT1861
gttcaaattccaggttggtttccatttttgattagcttgccagaattttgtcataccctgacggtaaggttcagtgctagtccagggtttcttataagctttattgtcaaattcatcgttgaaataagctcctccaatagccaaattaattataagatggaactctttgtcaaatggagccattctagttcctccagaacatgggtttggcaatc

SEQ ID NO: 502 - DNA, 375 bp, Diabrotica virgifera
  Clone ID: LIB3026-010-Q1-E1-F7
tgagactcactgggaaaagaagaattggaacggtggttgggataacgcttatcacagatagcaagtggaagggacgcctgaacatatcaaattttcttgcgatgatcaagaacttggtacaattacacccccatctggcggcttttggcaatacggcgatcttggaccgtctggattgccaaacccatggtctcgtggaagtaggatggctccctttgaccaagagttccacttactgattaatttggctgttggaggagcttatttcaacgagtgagtttaacaataaagcttatacgaaaccctggacgagcactgaaccttaccgtcagggtatgacaaaattctggcaagctaatcaaaaatggaaaccaa

SEQ ID NO: 503 - DNA, 366 bp, Diabrotica virgifera
  Clone ID: LIB3026-020-Q1-E1-G6
cgtctgaacacgcgtacgggaaattggacagcatctggagaaatcgacatcatggaaagtagaggaaaccgtcagtattatgcccccaatggacaaaacgttggaactgcaacagaatcatctactctacattggggacctactccacaattcaacaaacaactgaagactcactgggaaaagatcaattataacggtggttgggataacgctttccatagatatcaagtggaatggacgcctgaacatattaaattttcctgcgatgatcaagaacttggtacaattacacccccatctggaggcttctgggaatacggtgatcttggaccatctggattgccaaacccatggtctggatgaact

SEQ ID NO: 504 - DNA, 332 bp, Diabrotica virgifera
  unsure (1)..(332): unsure at all n locations
  Clone ID: LIB3026-003-Q1-E1-D6
tcaagaacttggtacaattacacccccatctggaggcttctgggaatacggtgatcttggaccatctggattgccaaacccatggtctggaggaactagaatggctccatttgacaaagagttccatcttataattaatttggctattggaggagcttatttcaacgatgaatttgcgantacgctgataagagaccgcgcggcggcgagcggggaccttaccgtcangggaggggaggggtggcggaagctaatcaaaactggaaaccaacctggaatttgagctcgagatgctcacatctgagggttgattacgtaagagtttgggcttt

SEQ ID NO: 505 - DNA, 322 bp, Diabrotica virgifera
  Clone ID: LIB149-011-Q1-E1-G2
atacgatgattcttatactgttcgcgttttctgcgatagtttttaacggtgtaaattctgtaagtcttagtaattccataacatctgcaagtggtttagacgcacccaagaacacgagtctctgttctggtcaactgatctttgacgacaacttcaattggttggacacctcgacatgggaccctgagcaaaccttaactggtggtggaaacaacgaaatctagtggtatacggatactacacgtagcagttatacgtacaacggccaattacagatcatacccacttttgtcgcacatgactatcgataagagctcttaaa

SEQ ID NO: 506 - DNA, 399 bp, Diabrotica virgifera
  Clone ID: LIB150-013-Q1-E1-G4
gtgacagaaagaaccttgcacaaagataaaagtgcatctggtcttcgggctagcagcggtctgtaaagtgacatccaattgtgtacgaagtgtgacaacggcaaatgggcccctttgcgctcacaaatatatgttcgggtgatctgatattgaagatatttcgactgtttaaatttagatacatggaaacacgaagatacgtcggctggaggtggaaacaacgaatttgaatggtacacatacagcagaaacaacagcgatacttcagatggaattttacacatagtaccaacttttgtagctgatgagctaggagagcagtttttacattcaactagccgtagatttgggaaacaagtgtaccaatccacacaattctggttgtaaaagaactggctc

SEQ ID NO: 507 - DNA, 435 bp, Diabrotica virgifera
  Clone ID: LIB149-009-Q1-E1-A8
gtgggtccatacaaaactctatagtgagtcgtaggaaccatttgaccaagagttttacttcatcatcaatgttgcggtacgtggtacctcatggttccccgataactatgtatgtgacaggtagcaaaagccttggtaaaattacgatggtcgagccagtatgactaaattctggaacgcaaacaatttatggttaccaacttggaatatgacgactgatactagtcattttcaaattgactatataagagtcgacgcgatataagttagtaaattacttaaattgggtagtactttattgaacatttgttatgcaaacaatatgaaatttgtttaattatgttgtaggtatataccttaattttcagcgaaaacatttcgtttataaattcgcaaaagtgtgtgtgttattgcgttgccgctcctgcaagagtc

SEQ ID NO: 508 - DNA, 238 bp, Diabrotica virgifera
  Clone ID: LIB149-020-Q1-E1-G8
acgtcagaattaatttggctattggaggagcttatttcaacgatgaatttgacaataaagcttataagaaaccctggactagcactgaaccttaccgtcagggtatgacaaaattctggcaagctaatcaaaaatggaaaccaacctggaatttgaactcagatgactcacatcttaaggttgattacgtaagagtttgggctttgtaattatttacaaacaaattatattatataat

SEQ ID NO: 509 - DNA, 289 bp, Diabrotica virgifera
  unsure (1)..(289): unsure at all n locations
  Clone ID: pGUT1831
ctacattggggacctactccacaattcaacaaacaactgaagactcactgggaaaagatcaattataacggtggttgggataacgctttccataaatatcaagtggaatggacgcctgaacatattaaattttcctgcgatgatcaagaacttggtacaattacacccccatctggaggcttctgggaatacngtgatcttggaccatctggattngcatacccatggtctggaagaactaaaatggctccatttgacaaaaagttccatcttataattaatttggcta

SEQ ID NO: 510 - DNA, 448 bp, Diabrotica virgifera
  Clone ID: LIB3026-032-Q1-E1-H4
aaaacacgaaaatgtttggttttgtagtaactatttgtttgcttgtaatatctgcacagggacaaattcctgttgaaagatgtccagatgtaaaaggagtggaaaatttcgatggagaagcctatttgggtgattggatcgaacaagcaagatacccaactttactggaagaccacggagaatgcgttgttaccaatattgcactagaccttaatggagttgtaaaaagtcgtaccacatatactaatagcgaaacacgcgaagtacatgttctcgaaggagaaggagtatcaaattcaaccacaggagaagccaaatttttagtacatttccttaatccagatgtaactgtacctttttgggttcttggtacagactatacaacatactctgtgggattctcttgttttgaacgagatggtgttttcctagagagtctcttcctcaa

SEQ ID NO: 511 - DNA, 418 bp, Diabrotica virgifera
  Clone ID: LIB149-031-Q1-E1-B3
agtttataaaacacgaaaatgtttggttttgtagtaactatttgtttgcttgtaatatctgcacagggacaaattcctgttgaaagatgtccagatgtaaaaggagtggaaaatttcgatggagaagcctatttgggtgattggatcgaacaagcaagatacccaactttactggaagatcacggagaatgcgttgttaccaatattgcactagaccttaatggagttgtaaaaagtcgtaccacatatactaatagcgaaacacgcgaagtacatgttctcgaaggagaaggagtatcaaattcaaccacaggagaagccaaatttttagtacatttccttaatccagatgtaactgtacctttttgggttcttggtacagactatacaacatactctgtgggtttctcctgttttg

SEQ ID NO: 512 - DNA, 417 bp, Diabrotica virgifera
  Clone ID: LIB149-048-Q1-E1-F6
ataaaacacgaaaatgtttggttttgtagtaactatttgtttgcttgtaatatctgcacagggacaaattcctgttgaaagatgtccagatgtaaaaggagtggaaaatttcgatggagaagcctatttgggtgattggatcgaacaagcaagatacccaactttactggaagaccacggagaatgcgttgttaccaatattgcactagaccttaatggagttgtaaaaagtcgtaccacatatactaatagcgaaacacgcgaagtacatgttctcgaaggagaaggagtatcaaattcaaccacaggagaagccaaatttttagtacatttccttaatccagatgtaactgtacctttttgggttcttggtacagactatacaacatactctgtgggattctcttgttttgaacg

SEQ ID NO: 513 - DNA, 415 bp, Diabrotica virgifera
  Clone ID: LIB3026-034-Q1-E1-D12
aaacacgaaaatgtttggttttgtagtaactatttgtttgcttgtaatatctgcacagggacaaattcctgttgaaagatgtccagatgtaaaaggagtggaaaatttcgatggagaagcctatttgggtgattggatcgaacaagcaagatacccaactttactggaagaccacggagaatgcgttgttaccaatattgcactagaccttaatggagttgtaaaaagtcgtaccacatatactaatagcgaaacacgcgaagtacatgttctcgaaggagaaggagtatcaaattcaaccacaggagaagccaaatttttagtacatttccttaatccagatgtaactgtacctttttgggttcttggtacagactatacaacatactctgtgggattctcttgttttgaacga

SEQ ID NO: 514 - DNA, 427 bp, Diabrotica virgifera
  Clone ID: LIB149-031-Q1-E1-F1
acccaactttactggaagatcacggaagatgtgttgttaccaatattgcagtaaactcagatggatctgtaaagagtcgtacgcaatatatcaattccgaaacaaatgagacacatgttctcgaaggagaaggaatatcaaattcaaccacaggagaagccaaatttttagtacattttcttaatccagacgtaactgtacctttttggattcttggtacagactataaaagatggtctgtaggtttctcctgttttgaacgagatggtgtttttctagagagtcttttccttacaacaagacatcaatatggatcaccagatgatatagatgcaattgtggacgttctagaagctaacaatatttctcgaaaggaaataataatgactgatcaaatgggctgcgattatgattaaaataaaatata

SEQ ID NO: 515 - DNA, 423 bp, Diabrotica virgifera
  unsure (1)..(423): unsure at all n locations
  Clone ID: LIB149-025-Q1-E1-E7
ggaagatcacggaagatgtgttgttaccaatattgcagtaaactcagatggatctgtaaagagtcgtacgcaatatatcaattccgaaacaaatgagacacatgttctcgaaggagaaggaatatcaaattcaaccacaggagaagccaaatttttagtacattttcttaatccagacgtaactgtacctttttggattcttggtacagactataaaagatggtctgtaggtttctcctgttttgaacgagatggtgtttttctagagagtcttttccttacaacaagacatcaatatggatcaccagatgatatagatgcaattgtcgacgttctagaagctaacaatatttctcgaaaggaaataataatgactgatcaaatgggctgcgattatgattaanataatagtacattatatac

SEQ ID NO: 516 - DNA, 411 bp, Diabrotica virgifera
  Clone ID: LIB3026-013-Q1-E1-G9
aaaccacgaaaatgattgcttttgcagtaactttttgtttgctggtaatatctgcacagggacaaattcctgttgaaagatgtccagatgtaaaaggagttgcaaatttcgacggacgtgcatatttgggtgactggtacgaacaaggtagatatccaactttactggaagataacggaagatgtgttgttaccaatattgcagtaggcgccgatggaactataaggagtcgtacgcaatatatcaattcagagacaaatgagacacacgttctagaaggagaagcacaacaaggttcaacaactggggaaggtcgatttctagtacatttcttaaatccagacgtaactgtacctttctatgttcttggtacagactatgaaaattattctgtaggtttcgtctgttttg

SEQ ID NO: 517 - DNA, 424 bp, Diabrotica virgifera
  Clone ID: LIB149-035-Q1-E1-G4
atgtatttacaaaaccacgaaaatgattggttttgcagtaacaatttctttgcttgtaatatctgtacagggacaaattcctgttgaaagatgcccagatgtaaaaggagttgcaaatttcgatggaaaagcatatttgggtgactggttcgaacaagcaagatacccaactttactggaagatcacggaagatgtgttgttaccaatattgcagtaaactcaaatggatctgtaaagagtcgtacgcaatacatcaattccgaaacaaatgagacacatgttctcgaaggggaaggaatatcaaattcaaccacaggagaagccaaatttttagtacattttcttaatccagacgtaactgtacctttttggatccttggtacagactataaaagatggtctgtaggtttctcctgttttgaa

SEQ ID NO: 518 - DNA, 408 bp, Diabrotica virgifera
  Clone ID: LIB149-022-Q1-E1-B10
acgaaaatgattggttttgcagtaattatttctttgcttgtaatatctgcacagggacaaattcctgttgaaagatgcccagatgtaaaaggagttgcaaatttcgatggaaaagcatatttgggtgactggttcgaacaagcaagatacccaactttactggaagatcacggaagatgtgttgttaccaatattgcagtaaactcagatggatctgtaaagagtcgtacgcaatatatcaattccgaaacaaatgagacacatgttctcgaaggagaaggaatatcaaattcaaccacaggagaagccaaatttttagtacattttcttaatccagacgtaactgtacctttttggattcttggtacagactataaaagatggtctgtaagtttctcctgttttgaa

SEQ ID NO: 519 - DNA, 424 bp, Diabrotica virgifera
  Clone ID: LIB3026-010-Q1-E1-E9
taaaccacgaaaatgattgctgttgcagtaactttttgtttgctggtaatatctgcacagggacaaattcctgttgaaagatgtccagatgtaaaaggagttgcaaatttcgacggacgtgcatatttgggtgactggtacgaacaaggtagatatccaactttactggaagatcacggaagatgtgttgttaccaatattgcagtaggcaccgatggaactataaggagtcgtacgcaatatatcaattcagagacaaatgagacacacgttctagaaggagaagcacaacaaggttcaacaactggggaaggtcgatttctagtacatttcttaaatccagacgtaactgtacctttctatgttcttggtacagactatgaaaattattctgtaggtttcgtctgttttgaacgtaatggtg

SEQ ID NO: 520 - DNA, 404 bp, Diabrotica virgifera
  Clone ID: LIB149-008-Q1-E1-G4
aaaccacgaaaatgattgctgttgcagtaactttttgtttgctggtaatatctgcacagggacaaattcctgttgaaagatgtccagatgtaaaaggagttgcaaatttcgacggacgtgcatatttgggtgactggtacgaacaaggtagatatccaactttactggaagatcacggaagatgtgttgttaccaatattgcagtaggcaccgatggaactataaggagtcgtacgcaatatatcaattcagagacaaatgagacacacgttctagaaggagaagcacaacaaggttcaacaactggggaaggtcgatttctagtacatttcttaaatccagacgtaactgtacctttctatgttcttgggacagactatgaaaattattccgtaagtttcgtc

SEQ ID NO: 521 - DNA, 407 bp, Diabrotica virgifera
  Clone ID: LIB149-021-Q1-E1-A9
agaaaatgattgctgttgcagtaactttttgtttgctggtaatatctgcacagggacaaattcctgttgaaagatgtccagatgtaaaaggagttgcaaatttcgacggacgtgcatatttgggtgactggtacgaacaaggtagatatccaactttactggaagatcacggaagatgtgttgttaccaatattgcagtaggcaccgatggaactataaggagtcgtacgcaatatatcaattcagagacaaatgagacacacgttctagaaggagaagcacaacaaggttcaacaactggggaaggtcgatttctagtacatttcttaaatccagacgtaactgtacctttctatgttcttggtacagactatgaaaattattctgtaggtttcgtccgttttgaa

SEQ ID NO: 522 - DNA, 411 bp, Diabrotica virgifera
  Clone ID: LIB3026-015-Q1-E1-D5
gtatgataccaatattgcagtaaactcaaatggatctgtaaagagtcgtacgcaatacatcaattccgaaacaaatgagacacatgttctcgaaggggaaggaatatcaaattcaaccacaggagaagccaaatttttagtacattttcttaatccagacgtaactgtacctttttggattcttggtacagactataaaagatggtctgtaggtttctcctgttttgaacgagatggtgtttttctagagagtcttttccttacaacaagacatcaatatggatcaccagatgatatagatgcaattgtcgacgttctagaagctaacaatatttctcgaaaggaaataataatgactgatcaaatgggctgcgattatgattaaaataaaatatattaaataataattta

SEQ ID NO: 523 - DNA, 390 bp, Diabrotica virgifera
  Clone ID: LIB149-040-Q1-E1-D3
acccacgcgtccgaatattgcagtaaactcaaatggatctgtaaagagtcgtacgcaatacatcaattccgaaacaaatgagacacatgttctcgaaggggaaggaatatcaaattcaaccacaggagaagccaaatttttagtacattttcttaatccagacgtaactgtacctttttggattcttggtacagactataaaagatggtctgtaggtttctcctgttttgaacgagatggtgtttttctagagagtcttttccttacaacaagacatcaatatggatcaccagatgatatagatgcaattgtcgacgttctagaagctaacaatatttctcgaaaggaaataataatgactgatcaaatgggctgcgattatgattaaaa

SEQ ID NO: 524 - DNA, 391 bp, Diabrotica virgifera
  Clone ID: LIB149-022-Q1-E1-G9
aaaacacgaaaatgtttggttttgtagtaactatttgtttgcttgtaatatctgcacagggacaaattcctgttgaaagatgtccagatgtaaaaggagtggaaaatttcgatggagaagcctatttgggtgattggatcgaacaagcaagatacccaactttactggaagaccacggagaatgcgttgttaccaatattgcactagaccttaatggagttgtaaaaagtcgtaccacatatactaatagcgaaacacgcgaagtacatgttctcgaaggagaaggagtatcaaattcaaccacaggagaagccaaatttttagtacatttccttaatccagatgtaactgtacctttttgggttcttggtacagactatacaacatactc

SEQ ID NO: 525 - DNA, 420 bp, Diabrotica virgifera
  unsure (1)..(420): unsure at all n locations
  Clone ID: LIB149-030-Q1-E1-B2
cacgcgtctgcccaaacttcgcccacgcgtccgaaccacgaaaatgattggttttgcagtaactatttctttgcttgtaatatctgtacagggacaaattcctgttgaaagatgcccagatgtaaaaggagttgcaaatttcgatggaaaagcatatttgggtgactggttcgaacaagcaagatacccaactttactggaagatcacggaagatgtgttgttaccaatattgcagtaaactcaaatggatctgtaaagagtcgtacgcaatacatcaattccgaaacaaatgagacacatgttctcgaaggggaangaatatcaaattcaaccacangagaagccaaatttttagtacattttcttaatccagacgtaactgtacctttttggattcttggtacagactataaaagatg

SEQ ID NO: 526 - DNA, 394 bp, Diabrotica virgifera
  Clone ID: LIB3026-031-Q1-E1-B6
agaccacgcgtccgcgaaaatgattgctgttgcagtaactttttgtttgctggtaatatctgcacagggacaaattcctgttgaaagatgtccagatgtaaaaggagttgcaaatttcgacggacgtgcatatttgggtgactggtacgaacaaggtagatatccaactttactggaagatcacggaagatgtgttgttaccaatattgcagtaggcaccgatggaactataaggagtcgtacgcaatatatcaattcagagacaaatgagacacacgttctagaaggagaagcacaacaaggttcaacaactggggaaggtcgatttctagtacatttcttaaatccagacgtaactgtacctttctatgttcttggtacagactatgaaaat

SEQ ID NO: 527 - DNA, 391 bp, Diabrotica virgifera
  Clone ID: LIB149-013-Q1-E1-F11
agtaaaaccacgaaaatgattggttttgcagtaactatttctttgcttgtaatatctgtacagggacaaattcctgttgaaagatgcccagatgtaaaaggagttgcaaatttcgatggaaaagcatatttgggtgactggttcgaacaagcaagatacccaactttactggaagatcacggaagatgtgttgttaccaatattgcagtaaactcaaatggatctgtaaagagtcgtacgcaatacatcaattccgaaacaaatgagacacatgttctcgaaggggaaggaatatcaaattcaaccacaggagaagccaaatttttagtacattttcttaatccagacgtaactgtacctttttggattcttggtacagactataaaagat

SEQ ID NO: 528 - DNA, 409 bp, Diabrotica virgifera
  Clone ID: LIB3026-032-Q1-E1-D1
ccaacgcatccggtttataaaacacgaaaatgtttggttttgtagtaactatttgtttgcttgtaatatctgcacagggacaaattcctgttgaaagatgtccagatgtaaaaggagtggaaaatttcgatggagaagcctatttgggtgattggatcgaacaagcaagatacccaactttactggaagaccacggagaatgcgttgttaccaatattgcactagaccttaatggagttgtaaaaagtcgtaccacatatactaatagcgaaacacgcgaagtacatgttctcgaaggagaaggagtatcaaattcaaccacaggagaagccaaatttttagtacatttccttaatccagatgtaactgtacctttttgggtttctggtacagactatacaacatactc

SEQ ID NO: 529 - DNA, 418 bp, Diabrotica virgifera
  Clone ID: LIB149-003-Q1-E1-C5
aaatgattgcttttgcagtaactttttgtttgctggtaatatctgcacagggacaaattcctgttgaaaggtgtccagatgtagaagtagttacaaatttcaatggaagtgcatatttgggtgactggtacgaacaagccagatacccaactttactggaagatcacggaagatgtgttgttaccaatattgcagtaggtgacgatagaactataaggagtcgtacccaatatatcaattcagagacaaatgagagacacgtcctagaaggagaaacacaaggttcaacaactggggaaggcaaatttatagtacatttcttaaatccagacgtaactgtacctttctgggttcttggtacagactatgaaagttattctgtaggtttgtcctgttttgaacgagatggtgctcctcc

SEQ ID NO: 530 - DNA, 403 bp, Diabrotica virgifera
  Clone ID: LIB3026-001-Q1-E1-F9
agaaaatgattggttttgcagtaactatttctttgcttgtaatatctgtacatggacaaattcctgttgaaagatgcccagatgtaaaaggagttgcaaatttcgatggaaaagcatatttgggtgactggttcgaacaagcaagatacccaactttactggaagatcacggaagatgtgttgttaccaatattgcagtaaactcaaatggatctgtaaagagtcgtacgcaatacatcaagtccgaaacagatgagacacatgttctcgaacgggaatgaatatcaaattcaaccacaggagaagccaaatttttagtacattttcttaatccagacgtaactgtacctttttggattcatggtacagactataaaagatggtctgtaagtttctcctgttt

SEQ ID NO: 531 - DNA, 431 bp, Diabrotica virgifera
  Clone ID: LIB149-008-Q1-E1-G5
gtttgctggtaatatctgcacagggacaaattcctgttgaaaggtgtccagatgtagaagtagttacaaatttcaatggaagtgcatatttgggtgactggtacgaacaagccagatacccaactttactggaagatcacggaagatgtgttgttaccaatattgcagtaggtgacgatagaactataaggagtcgtacccaatatatcaattcagagacaaatgagagacacgtcctagaaggagaaacacaaggttcaacaactggggaaggcaaatttatagtacatttcttaaatccagacgtaactgtacctttctgggttcttggtacagactatgaaagttattctgtaggtttgtcctgttttgaacgagatggtgctcctctagcgagccttttcatttcaacaagaactccatttccaaca

SEQ ID NO: 532 - DNA, 454 bp, Diabrotica virgifera
  Clone ID: LIB3026-005-Q1-E1-F1
gaaaatgattgcttttgcagtaactttttgtttgctggtaatatctgcacagggacaaattcctgttgaaaggtgtccagatgtagaagtagttacaaatttcaatggaagtgcatatttgggtgactggtacgaacaagccagatacccaactttactggaagatcacggaagatgtgttgttaccaatattgcagtaggtgacgatagaactataaggagtcgtacccaatatatcaattcagagacaaatgagagacacgtcctagaaggagaaacacaaggttcaacaactggggaaggcaaatttatagtacatttcttaaatccagacgtaactgtacctttctgggttcttggtacagactatgaaagttattctgtaggtttgtcctgttttgaacgagatggtgctcctctagcgagccttttcatttcaacaggaactccattt

SEQ ID NO: 533 - DNA, 426 bp, Diabrotica virgifera
  Clone ID: LIB3026-009-Q1-E1-G10
aggacgcatgggcgaaaatgattgcttttgcagtaactttttgtttgctggtaatatctgcacagggacaaattcctgttgaaaggtgtccagatgtagaagtagttacaaatttcaatggaagtgcatatttgggtgactggtacgaacaagccagatacccaactttactggaagatcacggaagatgtgttgttaccaatattgcagtaggtgacgatagaactataaggagtcgtacccaatatatcaattcagagacaaatgagagacacgttctagaaggagaaacgcaaggttcaacaactggggaaggcaaatttatagtacatttcttaaatccagacgtaactgtacctttctgggttcttggtacagactatgaaagttattctgtaggtttgtcctgttttgaacgaaatggtg

SEQ ID NO: 534 - DNA, 414 bp, Diabrotica virgifera
  Clone ID: LIB3026-035-Q1-E1-F1
cccacgcgtccggtcgtacgcaatacatcaattccgaaacaaatgagacacatgttctcgaaggggaaggaatatcaaattcaaccacaggagaagccaaatttttagtacattttcttaatccagacgtaactgtacctttttggattcttggtacagactataaaagatggtctgtaggtttctcctgttttgaacgagatggtgtttttctagagagtcttttccttacaacaagacatcaatatggatcaccagatgatatagatgcaattgtcgacgttctagaagctaacaatatttctcgaaaggaaataataatgactgatcaaatgggctgcgattatgattaaaataaaatatattatatattattttattatgtacaaattgtaatacattttaatgggcatg

SEQ ID NO: 535 - DNA, 367 bp, Diabrotica virgifera
  unsure (1)..(367): unsure at all n locations
  Clone ID: pGUT3940
aatatataatatantttattttaatcataatcgcagcccatttgatcagtcattattatttcctttcgagaaatattgttagcttctagaacgtcgacaattgcatctatatcatctggtgatccatattgatgtcttgttgtaaggaaaagactctctagaaaaacaccatctcgttcaaaacaggagaaacctacagaccatcttttatagtctgtaccaagaatccaaaaaggtacagttacgtctggattaagaaaatgtactaaaaatttggcttctcctgtggttgaatttgatattccttccccttcgagaacatgtgtctcatttgtttcggaattgatgtattgcgtacgactcttta

SEQ ID NO: 536 - DNA, 413 bp, Diabrotica virgifera
  Clone ID: LIB149-029-Q1-E1-D9
cgcgtccggtacgcaatacatcaattccgaaacaaatgagacacatgttctcgaaggggaaggaatatcaaattcaaccacaggagaagccaaatttttagtacattttcttaatccagacgtaactgtacctttttggattcttggtacagactataaaagatggtctgtaggtttctcctgttttgaacgagatggtgtttttctagagagtcttttccttacaacaagacatcaatatggatcaccagatgatatagatgcaattgtcgacgttctagaagctaacaatatttctcgaaaggaaataataatgactgatcaaatgggctgcgattatgattaaaataaaatatattatatattattttattatgtacaaattgtaatacattttaatggccatgattgat

SEQ ID NO: 537 - DNA, 400 bp, Diabrotica virgifera
  Clone ID: LIB3026-001-Q1-E1-D11
accacacgtccgcggacgcgtgggcggacgcgtgggttcctgtcgaaagatgtcccgatgtacaaggagttgcaaatttcgatggacaagcatatttgggtgattggatcgaacaagcaagatacccaactttactggaagatcatggagaatgtgttattaccaatattgcagtatgcgctgatggagttataagaagtcgtaccaaatatactaatacaaaaacaaacgaagaccatgttctagaaggagaaggagtatcaaattcaaccacaggagaagccaaattcttagtacatttccttaatccagatgtaactgtacctttttggattcttggtacagactataaaagatggtctgtaggattctcctgttttgaacgaaatggtgtttttct

SEQ ID NO: 538 - DNA, 351 bp, Diabrotica virgifera
  Clone ID: LIB3026-020-Q1-E1-A10
gcgtccgaccacaagtccgggagtggaaaatttcgatggagaagcctatttgggtgattggatcgaacaagcaagatacccaactttactggaagatcacggagaatgcgttgttaccaatattgcactagaccttaatggagttgtaaaaagtcgtaccacatatactaatagcgaaacacgcgaagtacatgttctcgaaggagaaggagtatcaaattcaaccacaggagaagccaaatttttagtacatttccttaatccagatgtaactgtacctttttgggttcctggtacagactatacaacatactctgtgggtttcccccggtttgaaccagatggtgtttt

SEQ ID NO: 539 - DNA, 397 bp, Diabrotica virgifera
  Clone ID: LIB149-022-Q1-E1-E11
atgcttctggctaccaacttcgacaactaccaaagaaatcgcaaaggatttgaaaaacttttccgtggtttgtctgataaaaaatggaatgatggtattgaattcatcaagtaccttactgctcgtggaggtgaagtcgactttaacgagatttctgacggcgttaaaaaagaagaggcccagccagtcagctttgatttgaatgaattgaccgcagtttctaaagctttggacttggaaaagaagtatgtccatgatgccttctctatccatcttggagctgctagaagcaacaaacaattctatgatcccgaacttaccgattatctagagaaagaagttgtacacgagcaaagagaaattatcagaaaactggcagggtacagcactgatttgt

SEQ ID NO: 540 - DNA, 430 bp, Diabrotica virgifera
  Clone ID: LIB149-008-Q1-E1-E5
gcgaagtatgttgacaagttgaattgtacagccaaatttggagctatcgatgcagttgaatctgacctacagaagttcataaaccatcatttcatcagatcctttgagtatctactcctagccaccaattttgccacatatgaaagaaacagagcaggattcgaaaaacttttccgtggcttgtctgacaacaagtggcatgagggcattgaattcattaagtatctcacctctcgtggtggacacatgaacttcaacgctatttccaaagacatcaaaggagaagaggcagaagctcgtagcttcgacttgcgtgaacttactgctattgcaaaagctctggacatagagaagaagtttgttcatgaagctcactccatccatcgtgaagctaccagaaataacagacagttccacgatcctgaaattt

SEQ ID NO: 541 - DNA, 448 bp, Diabrotica virgifera
  Clone ID: LIB3026-030-Q1-E1-C7
tgactatcaagacgcagttaccgcatgcaatccaactgctgcgaagtatgttgacaagttgaattgtacagccaaatttggagctatcgatgcagttgaatctgacctacagaagttcataaaccatcatttcatcagatccttcgagtatctactcctagccaccaattttgccacatatgaaagaaacagagcaggattcgaaaaacttttccgtggcttgtctgacaacaagtggcatgaaggtattgaatttattaagtatcttacctctcgtggtggacacatgaacttcaatgctatttccaaagacatcaaaggagaagaggcagaagctcgtagctttgacttgcgtgaacttactgctattgctaaagctctggacatagagaagaagtttgttcatgaagctcactccatccatcgtgaagctatcagaaacaacaaa

SEQ ID NO: 542 - DNA, 450 bp, Diabrotica virgifera
  Clone ID: LIB150-017-Q1-E1-B9
acgcgtccggaaaagagatccagctgctgcgaggagtgttgacaagttgaataattgtaatgcaaaattcggaggtatagattcagctcaatcggatcttcaaaaattcgtaaaccacaacttcatcagatcctttgaatacctgcttctggctaccaacttcgacaactaccaaagaaatcgcaaaggatttgaaaaacttttccgtggtttgtctgataaaaaatggaatgatggtattgaattcatcaagtaccttactgctcgtggaggtgaagtcgactttaacgagatttctgacggcgttaaagaagaagaggcccagccagtcagctttgatttgaatgaattgaccacagtttctaaagctttggacttggaaaagaagtatgtccatgatgccttctctatccatcttggagctgctagaagcaacaaacaattctatga

SEQ ID NO: 543 - DNA, 381 bp, Diabrotica virgifera
  Clone ID: LIB149-022-Q1-E1-F8
acccacgcgtccgctcgtggtggacacatgaacttcaacgctatttccaaagacatcaaaggagaagaggcagaagctcgtagcttcgacttgcgtgaacttactgctattgcaaaagctctggacatagagaagaagtttgttcatgaagctcactccatccatcgtgaagctaccagaaataacaaacagttccacgatcctgaaatttccgattatttggagaaggaagttgtgcacatggagagagatcttatcaggaagttagcagggtacagtactgacttggctggtctccttaacggaccagacagttcattggctctgtttatgttcgatgactatttacaaaagcagtaaatatttatgtttaagtttgtg

SEQ ID NO: 544 - DNA, 345 bp, Diabrotica virgifera
  Clone ID: LIB3026-018-Q1-E1-C6
acgatcatttcatcagatccttcgagtatctactcctagccaccaattttgccacatatgaaagaaacagagcaggattcgaaaaacttttccgtggcttgtctgacaacaagtggcatgaaggtattgaatttattaagtatcttacctctcgtggtggacacatgaacttcaatgctatttccaaagacatcaaaggagaagaggcagaagctcgtagctttgacttgcgtgaacttactgctattgctaaagctctggacatagagaagaagtttgttcatgaagctcactccatccatcgtgaagctaccagaaacaacaaacagttccacgatcctgaaa

SEQ ID NO: 545 - DNA, 369 bp, Diabrotica virgifera
  Clone ID: LIB150-041-Q1-E1-A12
tcgcaaaggatttgaaaaacttttccgtggtttgtctgataaaaaatggaacgacggtattgaattcatcaagtaccttactgctcgtggaggtgaagtaaactttaacgagatttctgacggcgttaaagaagaagagcagcagcctgtcagctttgatttgaatgaattgaccgcagtttctaaagctttggactctgaaaagaagtatgtccatgacgccttctctatccatcttggagctgctagaagcaacaaacaattctatgatcccgaacttaccgattatctagagaaagaagttgtacacgaacaaagagaaattatcagaaaactggcaaggtacagcactgatttgtccgcccccct

SEQ ID NO: 546 - DNA, 394 bp, Diabrotica virgifera
  Clone ID: LIB149-039-Q1-E1-E7
ctcgtaggtcgatacaaccctctaaattgagtcgtatcagatcttcaaaaattcgtaaaccacaacttcatcagatcctttgaatacctgcttctggctaccaacttcgacaactaccaaagaaatcgcaaaggatttgaaaaacttttccgtggtttgtctgagaaaaaatggaatgatggtattgaattcatcaagtaccttactgctcgtggaggtgaagtcgactttaacgagatttctgacggcgttaaagaagaagaggcccagccagtcagctttgatttgaatgaattgaccacagtttctaaagctttggacttggaaaagaagtatgtccatgatgccttctctatccatcttggagctgctagaagcaacatacaattctatg

SEQ ID NO: 547 - DNA, 431 bp, Diabrotica virgifera
  Clone ID: LIB149-046-Q1-E1-D9
agccgctatggcctccgaagatttttgctatcaagacgcagttaccgcatgcaatccaactgctgcgaagtatgttgacaagttgaattgtacagccaaatttggagctatcgatgcagttgaatctgacctacagaagttcataaaccatcatttcatcagatcctttgagtatctactcctagccaccaattttgccacatatgaaagaaacagagcaggattcgaaaaacttttccgtggcttgtctgacaacaagtggcatgagggcattgaattcattaagtatctcacctctcgtggtggacacatgaacttcaacgctatttccaaagacatcaaaggagaagaggcagaagctcgtagcttcgacttgcgtgaacttactgctattgcaaaagctctggacatagagaagaagttgttcatga

SEQ ID NO: 548 - DNA, 444 bp, Diabrotica virgifera
  Clone ID: LIB149-008-Q1-E1-C9
tcgccagagatcatgaaggctttcatcgtactatccatcttttgcgtcgccgctttggcctcccaagacacctgttataatgacgcagttaccgcatgtgatccagctgctgcgaggagtgttgacaagttgaataattgtaatgcaaaattcggaggtatagattcagctcaatcggatcttcaaaaattcgtaaaccacaacttcatcagatcctttgaatacctgcttctggctaccaacttcgacaactaccaaagaaatcgcaaaggatttgaaaaacttttccgtggtttgtctgataaaaaatggaatgatggtattgaattcatcaagtaccttactgctcgtggaggtgaagtcgactttaacgagatttctgacggcgttaaagaagaagagcccagccagtcagctttgatttgaatgaattgaccacagttt

SEQ ID NO: 549 - DNA, 401 bp, Diabrotica virgifera
  Clone ID: LIB3026-031-Q1-E1-G5
gagatgccagggatcatgaaggctttcatcgtactatccatcttttgcgtcgccgctttggcctcccaagacagctgttataatgacgcagttaccgcatgtgatccagctgctgcgaggagtgttgacaagttgaataattgtaatgcaaaattcggaggtatagattcagctcaatcggatcttcaaaaattcgtaaaccacaacttcatcagatcctttgaatacctgcttctggctaccaacttcgacaactaccaaagaaatcgcaaaggatttgaaaaacttttccgtggtttgtctgataaaaaatggaatgatggtattgaattcatcaagtaccttactgctcgtggaggtgaagtcgactttaacgagatttctgacggcgttaaaaaaga

SEQ ID NO: 550 - DNA, 444 bp, Diabrotica virgifera
  Clone ID: LIB149-009-Q1-E1-F4
acgagatgccagggatcatgaaggctttcatcgtactatccatcttttgcgtcgccgctttggcctcccaagacagctgttataatgacgcagttaccgcatgtgatccagctgctgcgaggagtgttgacaagttgaataattgtaatgcaaaattcggaggtatagattcagctcaatcggatcttcaaaaattcgtaaaccacaacttcatcagatcctttgaatacctgcttctggctaccaacttcgacaactaccaaagaaatcgcaaaggatttgaaaaacttttccgtggtttgtctgataaaaaatggaatgatggtattgaattcatcaagtaccttactgctcgtggaggtgaagtcgactttaacgagatttctgacggcgttaaaaaagaagaggccagccagtcagctttgatttgaatgaattgaccgc

SEQ ID NO: 551 - DNA, 359 bp, Diabrotica virgifera
  Clone ID: LIB3026-021-Q1-E1-F6
agggagtgttgacaagttgaataattgtaatgcaaaattcggaggtatagattcagctcaatcggatcttcaaaaattcgtaaaccacaacttcatcagatcctttgaatacctgcttctggctaccaacttcgacaactaccaaagaaatcgcaaaggatttgaaaaacttttccgtggtttgtctgataaaaaatggaatgatggtattgaattcatcaagtaccttactgctcgtggaggtgaagtcgactttaacgagatttctgacggcgttaaaaaagaagaggcccagccagtcagctttgatttgaatgaattgaccgcagtttctaaagctttggacttggaaaagaagt

SEQ ID NO: 552 - DNA, 427 bp, Diabrotica virgifera
  Clone ID: LIB149-003-Q1-E1-D3
gggccgagccacgcgtccacccaaacgtccggccagggatcatgaaggctttcatcgtactatccatcttttgcgtcgccgctttggcctcccaagacacctgttataatgacgcagttaccgcatgtgatccagctgctgcgaggagtgttgacaagttgaataattgtaatgcaaaattcggaggtatagattcagctcaatcggatcttcaaaaattcgtaaaccacaacttcatcagatcctttgaatacctgcttctggctaccaacttcgacaactaccaaagaaatcgcaaaggatttgaaaaacttttccgtggtttgtctgataaaaaatggaacgacggtattgaattcatcaagtaccttactgctcgtggaagtgaagtaaactttaacgagatttctgacggcgttaaagaaga

SEQ ID NO: 553 - DNA, 407 bp, Diabrotica virgifera
  Clone ID: LIB149-044-Q1-E1-F9
gaaggctttcatcgtactatccatcttttgcgtcgccgctttggcctcccaagacacctgttataatgacgcagttaccgcatgtgatccagctgcggcgaggagtgttgacaagttgaataattgtaatgcaaaattcggaggtatagattcagctcaatcggatcttcaaaaattcgtaaaccacaacttcatcagatcctttgaatacctgcttctggctaccaacttcgacaactaccaaagaaatcgcaaaggatttgaaaaacttttccgtggtttgtctgataaaaaatggaacgacggtattgaattcatcaagtaccttactgctcgtggaggtgaagtaaactttaacgagatttctgacggcgttaaagaagaagagcagcagcctgtcagctttg

SEQ ID NO: 554 - DNA, 382 bp, Diabrotica virgifera
  Clone ID: LIB3026-002-Q1-E1-D3
tgacgagatgccagggatcatgaaggctttcatcgtactatccatcttttgcgtcgccgctttggcctcccaagacacctgttataatgacgcagttaccgcatgtgatccagctgctgcgaggagtgttgacaagttgaataattgtaatgcaaaattcggaggtatagattcagctcaatcggatcttcaaaaattcgtaaaccacaacttcatcagatcctttgaatacctgcttctggctaccaacttcgacaactaccaaagaaatcgcaaaggatttgaaaaacttttccgtggtttgtctgataaaaaatggaacgacggtattgaattcatcaagtaccttactgctcgtggaggtgaagtaaactttaacgag

SEQ ID NO: 555 - DNA, 340 bp, Diabrotica virgifera
  Clone ID: LIB149-024-Q1-E1-A5
accacgcgtccgagacatcaaaggagaagaggcagaagctcgtagctttgacttgcgtgaacttactgctattgctaaagctctggacatagagaagaagtttgttcatgaagctcactccatccatcgtgaagctaccagaaacaacaaacagttccacgatcctgaaatttccgattatttggagaaggaagttgtgcacaaggagagagatcttatcaggaagttagcagggtacagtactgacttggctggtctctttaacggaccaaacagttcattggctccgtttatgtttgatgactaattacaaaagcagttaataattaattttaagttt

SEQ ID NO: 556 - DNA, 380 bp, Diabrotica virgifera
  Clone ID: LIB149-007-Q1-E1-B9
gcaaaagatttgtcatgcttttccgtggtttgtctgatattcaatggaatgatggtattgaattcatcaagtaccttactgctcgtggaggtgaagtccactttaacgagatttctgacggcgttaaaacataagaggcccatccagtcagctttgatttgaatgaattgaccgcagtttcgaaagctttggacttggaaaagaactatgtccatgatgccttctctaaccatcttggagctgctagaaacaacacatacttctatgatcccgaacttaccgattatctaaagaatgaagttgtacacgagcaaagagacattatcagaaaactggcagggtacagcactgatttgtccggcctccttgatggaccagac

SEQ ID NO: 557 - DNA, 397 bp, Diabrotica virgifera
  Clone ID: LIB149-021-Q1-E1-G10
acgctgacgagatgccagggatcatgaagactttcattgtactatctttcctttgcgtcgccgctttggcttccgaagatttttgctatcaagacgcagttaccgcatgcaatccaactgctgcgaagtatgttgacaagttgaattgtacagccaaatttggagctatcgatgcagttgaatctgacctacagaagttcataaaccatcatttcatcagatccttcgagtatctactcctagccaccaattttgccacatatgaaagaaacagagcaggattcgaaaaacttttccgtggcttgtctgacaacaagtggcatgaaggtattgaatttattaagtatcttacctctcgtggtggacacatgaacttcaatgctatttccaaagacat

SEQ ID NO: 558 - DNA, 390 bp, Diabrotica virgifera
  Clone ID: LIB149-007-Q1-E1-D6
gagatgccagggatcatgaagactttcattgtactatctttcctttgcgtcgccgctttggcttccgaagatttttgctatcaagacgcagttaccgcatgcaatccaactgctgcgaagtatgttgacaagttgaattgtacagccaaatttggagctatcgatgcagttgaatctgacctacagaagttcataaaccatcatttcatcagatccttcgagtatctactcctagccaccaattttgccacatatgaaagaaacagagcaggattcgaaaaacttttccgtggcttgtctgacaacaagtggcatgaaggtattgaatttattaagtatcttacctctcgtggtggacacatgaacttcaatgctatttccaaagacatc

SEQ ID NO: 559 - DNA, 433 bp, Diabrotica virgifera
  Clone ID: LIB3026-012-Q1-E1-F6
gagattattgctcattaataatttcgttttgtattagggatcatgaagactttcattgtactatctttcctttgcgtcgccgctttggcctccgaagatttttgctatcaagacgcagttaccgcatgcaatccaactgctgcgaagtatgttgacaagttgaattgtacagccaaatttggagctatcgatgcagttgaatctgacctacagaagttcataaaccatcatttcatcagatccttcgagtatctactcctagccaccaattttgccacatatgaaagaaacagagcaggattcgaaaaacttttccgtggcttgtctgacaacaagtggcatgaaggtattgaatttattaagtatcttacctctcgtggtggacacatgaacttcaatgctatttccaaagacatcaaaggagaagaggcag

SEQ ID NO: 560 - DNA, 338 bp, Diabrotica virgifera
  Clone ID: pGUT367
aaggctttcatcgtactatccatcttttgcgtcgccgctttggcctcccaagacacctgttataatgacgcagttaccgcatgtgatccagctgctgcgaggagtgttgacaagttgaataattgtaatgcaaaattcggaggtatagattcagctcaatcggatcttcaaaaattcgtaaaccacaacttcatcagatcctttgaatacctgcttctggctaccaacttcgacaactaccaaagaaatcgcaaaggatttgaaaaacttttccgtggtttgtctgataaaaaatggaatgatggtattgaattcatcaagttacttactgctcgtgg

SEQ ID NO: 561 - DNA, 385 bp, Diabrotica virgifera
  Clone ID: LIB149-010-Q1-E1-C5
aggtttattgattgttattcatgattacgctgacgagatgccagggatcatgaaggctttcatcgtactatccatcttttgcgtcgccgctttggcctcccaagacagctgttataatgacgcagttaccgcatgtgatccagctgctgcgaggagtgttgacaagttgaataattgtaatgcaaaattcggaggtatagattcagctcaatcggatcttcaaaaattcgtaaaccacaacttcatcagatcctttgaatacctgcttctggctaccaacttcgacaactaccaaagaaatcgcaaaggatttgaaaaacttttccgtggtttgtctgataaaaaatggaatgatggtattgaattcatcaagtaccttactgct

SEQ ID NO: 562 - DNA, 443 bp, Diabrotica virgifera
  Clone ID: LIB149-026-Q1-E1-C11
tacaagcctctaaagtgagtcttatgatattgaattcatcaagtaccttactgctcgtggaggtgaagtcgactttaacgagatttctgacggcgttaaaaaagaagaggcccagccagtcagctttgatttgaatgaattgaccgcagtttctaaagctttggacttggaaaagaagtatgtccatgatgccttctctatccatcttggagctgctagaagcaacaaacaattctatgatcccgaacttaccgattatctagagaaagaagttgtacacgagcaaagagaaattatcagaaaactggcagggtacagcactgatttgtctggcctccttgatggaccagacagttcgttagccctgtttatgtttgacgactatttacaaaaacaatagattttaaatagctagtttaaaactattagatttactttctaaa

SEQ ID NO: 563 - DNA, 386 bp, Diabrotica virgifera
  Clone ID: LIB150-040-Q1-E1-C3
cccacgcgtccgcccacgcgtccgcccacgcgtccggacgagatgccagggatcatgaaggctttcatcgtactatccatcttttgcgtcgccgctttggcctcccaagacacctgttataatgacgcagttaccgcatgtgatccagctgctgcgaggagtgttgacaagttgaataattgtaatgcaaaattcggaggtatagattcagctcaatcggatcttcaaaaattcgtaaaccacaacttcatcagatcctttgaatacctgcttctggctaccaacttcgacaactaccaaagaaatcgcaaaggatttgaaaaacttttccgtggtttgtctgataaaaaatggaatgatggtattgaattcatcaagtaccttac

SEQ ID NO: 564 - DNA, 394 bp, Diabrotica virgifera
  Clone ID: LIB149-015-Q1-E1-D7
catgaagctcactccatccatcgtgaagctaccagaaacaacaaacagttccacgatcctgaaatttccgattatttggagaaggaagttgtgcacaaggagagagatcttatcaggaagttagcagggtacagtactgacttggctggtctccttaacggaccagacagttcattggctctgtttatgtttgatgactatttacaaaagcagtaaatatttatttttaagtttgtgatttaataatattccatagataggttagaatcacttttcgataaatgtatcatcttcgtgtgattattagcgagtaagaatgtttgtacattattcaacaaatgtctataattatgttttttaaatagtaaaataaatacatctccgataaatacta

SEQ ID NO: 565 - DNA, 398 bp, Diabrotica virgifera
  Clone ID: LIB149-015-Q1-E1-F1
attcctcgcaaatgatttagttagtatgtagatttatgacaatcaacagcttctgagagatggcctcccaagacagctgtaaaaatgacgcaaattaccgcatgtgatccaactgactgcaaggagtgttgacaagttgaaataattgtaatgcaaaattcggaggtatagattcagctcaatcggatcttcaaaaattcgtaaaccacaacttcatcagatcctttgactacctgcttctggctaccaacttcgacaactaccagagaaatcgcaaacgatttggaaaacttttccgtggtttgtctgataaacaatggaatgatggtattgaattcatcaagtaccttactgctcgtggacgtgaagtcgacctttacgagatttctgacggcgtt

SEQ ID NO: 566 - DNA, 554 bp, Diabrotica virgifera
  Clone ID: pGUT2351
tagacatcgagcgcccaacctacaccaacttgaacagacttattggccaaatcgtatcctcaatcacagcttctctaagattcgatggtgctctaaatgttgacttgacagaattccaaactaacttggttccttaccctcgtattcacttccctcttgtcacctatgccccagtaatttccgctgaaaaggcttaccatgaacaactttccgtagctgaaatcaccaatgcctgtttcgaacctgccaaccagatggtaaaatgtgatcccagacatggtaaatacatggcttgctgtatgttgtacagaggggatgttgtaccaaaggatgtaaatgctgctattgcaaccattaagaccaaacgtaccatccaattcgtagactggtgtccaactggtttcaaagtaggtatcaactaccaaccaccaactgttgtacctggaagtgatttggctaaagtacaacgtgccgtatgcatgttgtccaacactacagctattgctgaagcctgggcaagattggaccacaaattcgatcttatgtatgccaag

SEQ ID NO: 567 - DNA, 466 bp, Diabrotica virgifera
  Clone ID: LIB150-013-Q1-E1-B3
ctgcattactagctaatctgaacgtctgtcgtaattttgtttcatttgtggtgtaaaagttaaaaactcatcaaccaaaatgcgtgaatgtatctcagtccatgttggccaagccggagtccaaataggtaatgcctgctgggagttgtactgcctggaacatggcatccaacctgacggtcaaatgccatcagacaagactgttggaggaggagatgacagtttcaacacattcttcagtgaaactggtgccggcaaacatgtacctagagcagtatttgtagattttggaacaacagtagtagatgaagtacgtaccggcacataccgtcaattgttccacccagaacaactcatcactggcaaagaagatgccgccaataactacgctagaggtcactatacaattggtaaagaaatagttgacttggtattggacagaatccgtaaattggctgatcaatgt

SEQ ID NO: 568 - DNA, 378 bp, Diabrotica virgifera
  Clone ID: LIB150-001-Q1-E1-G10
tccatgttggccaagccggagtccaaatcggtaatgcctgctgggagttgtactgcctggaacatggcatccaacctgacggtcagatgccatcagacaagactgttggaggaggagatgacagtttcaacacattcttcagtgaaactggtgccggcaaacatgtacctagagcagtatttgtagatttggaaccaacagtagtagatgaagtacgtaccggcacataccgtcaattgttccacccagaacaactcatcactggcaaagaagatgccgccaataactatgctagaggtcactatacaattggtaaagaaatagttgacttggtattggacagaatccgtaaattggctgatcaatgtactggacttc

SEQ ID NO: 569 - DNA, 415 bp, Diabrotica virgifera
  Clone ID: LIB150-020-Q1-E1-G11
acccacgcgtccggtacgtaccggcacataccgtcaattgttccacccagaacaactcatcactggcaaagaagatgccgccaataactatgctagaggtcactatacaattggtaaagaaatagttgacttggtattggacagaatccgtaaattggctgatcaatgtactggacttcaaggtttcttgattttccactccttcggtggtggtactggatctggtttcacttctttgttgatggaacgtctatctgttgactatggtaaaaaatcaaaactggaattcgccatctacccagctcctcaagtatctactgctgtagtagaaccatacaactccatcttgaccacccacaccactcttgaacactcagactgtgcctttatggtagataatgaagccatctatgac

SEQ ID NO: 570 - DNA, 376 bp, Diabrotica virgifera
  Clone ID: LIB150-031-Q1-E1-H10
aacatgaagactcagaatgtgcctttatggtagataatgaagccatctatgacatctgcagacgtaatctagacatcgagcgcccaacctacaccaacttgaacagacttattggccaaatcgtatcgtcaatcacagcttctctaagattcgatggtgctctaaatgttgacttgacagaattccaaactaacttggttccttaccctcgtattcacttccctcttgtcacctatgccccagtaatttccgctgaaaaggcttaccatgaacaacttgccgtagctgaaatcaccaatgcctgtttcgaacctgccaaccagatggtaaaatgtgatcccagacatggtacatacatggcttgctgtaggttgtc

SEQ ID NO: 571 - DNA, 379 bp, Diabrotica virgifera
  Clone ID: LIB3026-008-Q1-E1-D12
cggaagcgtgggtcgccatctacccagctcctcaagtatctactgctgtagtagaaccatacaactccatcttgaccacccacaccactcttgaacactcagactgtgcctttatggtagataatgaagccatctatgacatctgcagacgtaatctcgacatcgagcgcccaacctacaccaacttgaacagacttattggccaaatcgtatcctcaatcacagcttctctaagattcgatggtgctctaaatgttgacttgacagaattccaaactaacttggttccttaccctcgtattcacttccctcttgtcacctatgccccagtaatttccgctgaaaaggcttaccatgaacaactttctgtagctgaaat

SEQ ID NO: 572 - DNA, 393 bp, Diabrotica virgifera
  unsure (1)..(393): unsure at all n locations
  Clone ID: LIB150-021-Q1-E1-F11
cccacgcgtcagtcaaaactggaattcgccatctacccagctcctcaagtatctactgctgtagtagaaccatacaactccatcttgaccacccacaccactcttgaacactcagactgtgcctttatggtagataatgaagccatctatgacatctgcagacgtaatctagacatcgagcgcccaacctacaccaacttgaacagacttattggccaaatcgtatcctcaatcacagcttctctaagattcgatggtgctctaaatgttgacttgacagaattccanactaacttggttcccttacctcgtattcacttcnctcttgtcacctatgccccagtaatttccgctgaaaaagctttacatgaacaactttccgtagctgaaatc

SEQ ID NO: 573 - DNA, 414 bp, Diabrotica virgifera
  Clone ID: LIB150-032-Q1-E1-B7
atagctaatctgaacgtctgtcgtaattttgtttcatttgtggtgtaaaagttaaaactcatcaaccaaaatgcgtgaatgtatctcagtccatgttggccaagccggagtccaaatcggtaatgcctgctgggagttgtactgcctggaacatggcatccaacctgacggtcagatgccatcagacaagactgttggaggaggagatgacagtttcaacacattcttcagtgaaactggtgccggcaaacatgtacctagagcagtatttgtagatttggaaccaacagtagtagatgaagtacgtaccggcacataccgtcaattgttccacccagaacaactcatcactggcaaagaagatgccgccaataactatgctagaggtcactatacaattggtaaagaaatagt

SEQ ID NO: 574 - DNA, 434 bp, Diabrotica virgifera
  Clone ID: LIB150-024-Q1-E1-F8
atacaacaccctaaaatgagtcgtaatactgaacgtctgtcgtaattttgtttcatttgtggtgtaaaagttaaaaactcatcaaccaaaatgcgtgaatgtatctcagtccatgttggccaagccggagtccaaataggtaatgcctgctgggagttgtactgcctggaacatggcatccaacctgacggtcagatgccatcagacaagactgttggaggaggagatgacagtttcaacacattcttcagtgaaactggtgccggcaaacatgtacctagagcagtatttgtagatttggaaccaacagtagtagatgaagtacgtaccggcacataccgtcaattgttccacccagaacaactcatcactggcaaagaagatgccgccaataactacgctagaggtcactatacaattggtaaagaaataat

SEQ ID NO: 575 - DNA, 419 bp, Diabrotica virgifera
  Clone ID: LIB150-038-Q1-E1-E8
atgcattactagctaatctgaacgtctgtcgtaattttgtttcatttgtggtgtaaaagttaaaactcatcaaccaaaatgcgtgaatgtatctcagtccatgttggccaagccggagtccaaatcggtaatgcctgctgggagttgtactgcctggaacatggcatccaacctgacggtcagatgccatcagacaagactgttggaggaggagatgacagtttcaacacattcttcagtgaaactggtgccggcaaacatgtacctagagcagtatttgtagatttggaaccaacagtagtagatgaagtacgtaccggcacataccgtcaattgttccacccagaacaactcatcactggcaaagaagatgccgccaataactatgctagaggtcactatacaattggtaaagaaat

SEQ ID NO: 576 - DNA, 358 bp, Diabrotica virgifera
  Clone ID: LIB150-050-Q1-E1-E3
aacagacgtaatctagacatcgagcgcccaacctacaccaacttgaacagacttattggccaaatcgtatcctcaatcacagcttctctaagattcgatggtgctctaaatgttgacttgacagaattccaaactaacttggttccttaccctcgtattcacttccctcttgtcacctatgccccagtaatttccgctgaaaaggcttaccatgaacaactttccgtagctgaaatcaccaatgcctgtttcgaacctgccaaccagatggtaaaatgttatcccagacatggtaaatacatggcttgctgtatgttgtacagaggggatgttgtaccaaatgatgtaaatgctgcta

SEQ ID NO: 577 - DNA, 419 bp, Diabrotica virgifera
  unsure (1)..(419): unsure at all n locations
  Clone ID: LIB150-038-Q1-E1-A6
gaaagctgcattactagctaatctgaacgtctgtcgtaattttgtttcatttgtggtgtaaaagttaaaactcatcaaccaaaatgcgtgaatgtatctcagtccatgttggccaagccggagtccaaatcggtaatgcctgctgggagttgtactgcctggaacatggcatccaacctgacggtcagatgccatcagacaagactgttggaggaggagatgacagtttcaacacattcttcagtgaaactggtgccggcaaacatgtacctagagcagtatttgtagatttggaaccaacagtagtagatgaagtacgtaccggcacataccgtcaattgttccacccagaacaactcatcactggcanagaagatgccgccaataactatgctagaggtcactatacaattggtaaa

SEQ ID NO: 578 - DNA, 427 bp, Diabrotica virgifera
  Clone ID: LIB150-048-Q1-E1-B8
acccacgcgtccgtgcattactagctaatctgaacgtctgtcgtaattttgtttcatttgtggtgtaaaagttaaaactcatcaaccaaaatgcgtgaatgtatctcagtccatgttggccaagccggagtccaaatcggtaatgcctgctgggagttgtactgcctggaacatggcatccaacctgacggtcagatgccatcagacaagactgttggaggaggagatgacagtttcaacacattcttcagtgaaactggtgccggcaaacatgtacctagagcagtatttgtagatttggaaccaacagtagtagatgaagtacgtaccggcacataccgtcaattgttccacccagaacaactcatcactggcaaagaagatgccgccaataactatgctagatgtcactatacaattggtaaag

SEQ ID NO: 579 - DNA, 414 bp, Diabrotica virgifera
  Clone ID: LIB150-049-Q1-E1-B4
agtgcattactagctaatctgaacgtctgtcgtaattttgtttcatttgtggtgtaaaagttaaaactcatcaaccaaaatgcgtgaatgtatctcagtccatgttggccaagccggagtccaaatcggtaatgcctgctgggagttgtactgcctggaacatggcatccaacctgacggtcagatgccatcagacaagactgttggaggaggagatgacagtttcaacacattcttcagtgaaactggtgccggcaaacatgtacctagagcagtatttgtagatttggaaccaacagtagtagatgaagtacgtaccgggacataccgtcaattgttccacccagaacaactcatcactggcaaagaagatgccgccaataactatgctagaggtcactatacaatttggga

SEQ ID NO: 580 - DNA, 427 bp, Diabrotica virgifera
  Clone ID: LIB150-032-Q1-E1-D1
gggtccacgcacgcgtccgaagctgcattactagctaatctgaacgtctgtcgtaattttgtttcatttgtggtgtaaaagttaaaactcatcaaccaaaatgcgtgaatgtatctcagtccatgttggccaagccggagtccaaatcggtaatgcctgctgggagttgtactgcctggaacatggcatccaacctgacggtcagatgccatcagacaagactgttggaggaggagatgacagtttcaacacattcttcagtgaaactggtgccggcaaacatgtacctagagcagtatttgtagatttggaaccaacagtagtagatgaagtacgtaccggcacataccgtcaattgttccacccagaacaactcatcactggcaaagaagatgccgccaataactatgctagaggtcactataca

SEQ ID NO: 581 - DNA, 405 bp, Diabrotica virgifera
  Clone ID: LIB150-028-Q1-E1-F1
gcattactagctaatctgaacgtctgtcgtaattttgtttcatttgtggtgtaaaagttaaaactcatcaaccaaaatgcgtgaatgtatctcagtccatgttggccaagccggagtccaaatcggtaatgcctgctgggagttgtactgcctggaacatggcatccaacctgacggtcagatgccatcagacaagactgttggaggaggagatgacagtttcaacacattcttcagtgaaactggtgccggcaaacatgtacctagagcagtatttgtagatttggaaccaacagtagtagatgaagtacgtaccggcacataccgtcaattgttccacccagaacaactcatcactggcaaagaagatgccgcaaataactatgctagaggtcactatacaat

SEQ ID NO: 582 - DNA, 485 bp, Diabrotica virgifera
  Clone ID: LIB150-031-Q1-E1-D3
cggaagcgtgggcggacgcgtggggcgccaagaaaatcatcaagttcgtttggaaagctgcattactagctaatctgaacgtctgtcgtaattttgtttcatttgtggtgtaaaagttaaaactcatcaaccaaaatgcgtgaatgtatctcagtccatgttggccaagccggagtccaaatcggtaatgcctgctgggagttgtactgcctggaacatggcatccaacctgacggtcagatgccatcagacaagactgttggaggaggagatgacagtttcaacacattcttcagtgaaactggtgccggcaaacatgtacctagagcagtatttgtagatttggaaccaacagtagtagatgaagtacgtaccggcacataccgtcaattgttccacccagaacaactcatcaatgggaaagaaaaatgccgcaaataactatgctagaggtcactatacaattggtaaagaaataattgact

SEQ ID NO: 583 - DNA, 400 bp, Diabrotica virgifera
  Clone ID: LIB150-040-Q1-E1-E9
tgcattactagctaatctgaacgtctgtcgtaattttgtttcatttgtggtgtaaaagttaaaactcatcaaccaaaatgcgtgaatgtatctcagtccatgttggccaagccggagtccaaatcggtaatgcctgctgggagttgtactgcctggaacatggcatccaacctgacggtcagatgccatcagacaagactgttggaggaggagatgacagtttcaacacattcttcagtgaaactggtgccggcaaacatgtacctagagcagtatttgtagatttggaaccaacagtagtagatgaagtacgtaccggcacataccgtcaattgttccacccagaacaactcatcactggcaaagaagatgccgccaataactatgctagaggtcacta

SEQ ID NO: 584 - DNA, 401 bp, Diabrotica virgifera
  Clone ID: LIB150-042-Q1-E1-C10
aaggacgcgtgggctgcattactagctaatctgaacgtctgtcgtaattttgtttcatttgtggtgtaaaagttaaaactcatcaaccaaaatgcgtgaatgtatctcagtccatgttggccaagccggagtccaaatcggtaatgcctgctgggagttgtactgcctggaacatggcatccaacctgacggtcagatgccatcagacaagactgttggaggaggagatgacagtttcaacacattcttcagtgaaactggtgccggcaaacatgtacctagagcagtatttgtagatttggaaccaacagtagtagatgaagtacgtaccggcacataccgtcaattgttccacccagaacaactcatcactggcaaagaagatgccgccaataactatg

SEQ ID NO: 585 - DNA, 405 bp, Diabrotica virgifera
  Clone ID: LIB150-048-Q1-E1-A9
cgtgggccgaaacaagcctctagcatgagtcgtaatactgaacgtctgtcgtaattttgtttcatttgtggtgtaaaagttaaaactcatcaaccaaaatgcgtgaatgtatctcagtccatgttggccaagccggagtccaaatcggtaatgcctgctgggagttgtactgcctggaacatggcatccaacctgacggtcagatgccatcagacaagactgttggaggaggagatgacagtttcaacacattcttcagtgaaactggtgccggcaaacatgtacctagagcagtatttgtagatttggaaccaacagtagtagatgaagtacgtaccggcacataccgtcaattgttccacccagaacaactcatcactggcaaagaagatgccgccaataact

SEQ ID NO: 586 - DNA, 396 bp, Diabrotica virgifera
  Clone ID: LIB150-027-Q1-E1-H9
cccacgcgtccgtgcattactagctaatctgaacgtctgtcgtaattttgtttcatttgtggtgtaaaagttaaaactcatcaaccaaaatgcgtgaatgtatctcagtccatgttggccaagccggagtccaaatcggtaatgcctgctgggagttgtactgcctggaacatggcatccaacctgacggtcagatgccatcagacaagactgttggaggaggagatgacagtttcaacacattcttcagtgaaactggtgccggcaaacatgtacctagagcagtatttgtagatttggaaccaacagtagtagatgaagtacgtaccggcacataccgtcaattgttccacccagaacaactcatcactggcaaagaagatgcccccaataact

SEQ ID NO: 587 - DNA, 376 bp, Diabrotica virgifera
  Clone ID: LIB150-034-Q1-E1-D7
atggaaagctgcattactagctaatctgaacgtctgtcgtaattttgtttcatttgtggtgtaaaagttaaaactcatcaaccaaaatgcgtgaatgtatctcagtccatgttggccaagccggagtccaaatcggtaatgcctgctgggagttgtactgcctggaacatggcatccaacctgacggtcagatgccatcagacaagactgttggaggaggagatgacagtttcaacacattcttcagtgaaactggtgccggcaaacatgtacctagagcagtatttgtagatttggaaccaacagtagtagatgaagtacgtaccggcacataccgtcaattgttccacccagaacagctcatcactggcaaaga

SEQ ID NO: 588 - DNA, 371 bp, Diabrotica virgifera
  Clone ID: LIB150-012-Q1-E1-E11
agctgcattactagctaatctgaacgtctgtcgtaattttgtttcatttgtggtgtaaaagttaaaactcatcagccaaaatgcgtgaatgtatctcagtccatgttggccaagccggagtccaaatcggtaatgcctgctgggagttgtactgcctggaacatggcatccaacctgacggtcagatgccatcagacaagactgttggaggaggagatgacagtttcaacacattcttcagtgaaactggtgccggcaaacatgtacctagagcagtatttgtagatttggaaccaacagtagtacatgaagtacgtaccggcacataccgtcaattgttccaaccagaacaactcatcactggcaaagaa

SEQ ID NO: 589 - DNA, 396 bp, Diabrotica virgifera
  Clone ID: LIB150-024-Q1-E1-B1
tccatacaaccctctaaagtgagtcgtattagcgtccgcccacgcgtccgattttgtttcagttgtggtgtaaaagttaaaactcatcaaccaaaatgcgtgaatgtacctcagtccatgttggccaagccggagtccaaatcggtaatgcctgctgggagttgtactgcctggaacatggcatccaacctgacggtcagatgccatcagacgagactgttggaggaggagatgacagtttcaacacattcatcagtgaaactggtgccggcaaacatgtacctagatcaatatttgtagatttggaaccagtactagtagatgaagtacgtaccggcacatagcgtcaattgttccacccagaacatctcatcactggcaaagaatatgccgcca

SEQ ID NO: 590 - DNA, 409 bp, Diabrotica virgifera
  unsure (1)..(409): unsure at all n locations
  Clone ID: LIB150-033-Q1-E1-H1
aacctgcattacaacctaacctgaactccggccgaaatttggttcaattgggggggtaaaatttaaaactccacaaacaaaatggcttgaaggtacctcaatcaaggttggcaaacccggagtcaaattaggtaaggcctgcctggagtttggtctgcctggaaacatggcatccaacctgacggtcagatgcatcagacaagactgttggaggangagatgacagtttcaacacattcttcagtgaaactggtgccggcaaacatgtacctagagcagtatttgtagatttggaaccaacagtagtagatgaagtacgtaccggcacataccgtcaattgttccacccagaacaactcatcactggcanagaagatgccgccaataactacgctagaagtcactatac

SEQ ID NO: 591 - DNA, 281 bp, Diabrotica virgifera
  Clone ID: LIB150-049-Q1-E1-D6
ccacgcgtcgggtcatgtgtcatataaatagcaagcgcgccaagaagatcatcaagttcgtttggaaagctgcattactagctaatctgaacgtctgtcgtgagtgtgtttcatctgtggtgtaagagttaagactcatcaggcaaaatgcgtgaatgtatctcagtccatgttggccaagcgggagtcgaaatcggtaatgcctgctgggagttgtattgcctggaagatggcatccaacgtgacggtcagaggccagcggacaagactggtggaggagg

SEQ ID NO: 592 - DNA, 439 bp, Diabrotica virgifera
  Clone ID: LIB3026-006-Q1-E1-A11
cccacgcgtccgcccacgcgtccgctcgttggcacacaaagaaattgccccgtaagacacacaaaggtcttcgtaaagttgcctgtattggagcatggcatccttcaagagtatcattcacagttgctcgtgctggtcaaaagggttaccatcatagaactgagatgaacaaaaagatctacagaattggtgctggaatccacactaaagatggcaaggttgttaaaaataatgcagccactgcctatgatcttagtgaaaaaactattaccccaatgggtggttttcctcattatggtgaagttaacaatgacttcgttatgattaagggatgttgtatgggaccaaagaaacgtgttattacattgaggaagtcattgttagtccacactaaacgtattgctttggagaagatcaatcttaaattcattgatacctc

SEQ ID NO: 593 - DNA, 438 bp, Diabrotica virgifera
  Clone ID: LIB150-017-Q1-E1-G2
cagacgcatgggttcaagagtatcattcacagttgctcgtgctggtcaaaagggttaccatcatagaactgagatgaacaaaaagatctacagaattggtgctggaatccacactaaagatggcaaggttgttaaaaataatgcagccactgcctatgatcttagtgaaaaaactattaccccaatgggtggttttcctcattatggtgaagttaacaatgacttcgttatgattaagggatgttgtatgggaccaaagaaacgtgttattacattgaggaagtcattgttagtccacactaaacgtattgctttggagaagatcaatcttaaattcattgatacctcatccaaattcggtcatggtagattccagacagctgctgacaaagctgcattcatgggtcctctcaagaaagatagagttaaggaagaaga

SEQ ID NO: 594 - DNA, 439 bp, Diabrotica virgifera
  Clone ID: LIB3026-028-Q1-E1-F12
cggtctagatatcccgggccctctattggatcatggcatccttcaagagtatcattcacagttgctcgtgctggtcaaaagggttaccatcacagaactgagatgaacaaaaagatctacagaattggtgctggaatccacactaaagatggcaaggttgtcaaaaataatgcagccactgcctacgatcttagtgaaaaaactattaccccaatgggtggttttcctcattatggtgaagttaacaatgactttgttatgattaaaggatgttgtatgggaccaaagaaacgtgttattacattgaggaagtcattgttagtccacactaaacgtattgctttggagaagatcaatcttaaattcattgatacctcatctaaattcggtcatggtagattccagacagctgctgacaaagctgcgttcatgggtcctc

SEQ ID NO: 595 - DNA, 433 bp, Diabrotica virgifera
  Clone ID: LIB150-019-Q1-E1-H9
gtgatgtcacacagaaagttcagtgcaccacgtcatggatcgatgggattctaccccaaaaagagatcccagagacaccgtggaaaggtaaaggctttcccaaaagatgatccctcaaaacctgtccacttaacggccttcataggttacaaagctggtatgacccacgtggtaagagaggcagacagacctggttcaaagatcaacaagaaagaaattgtagaggctgtaacaattttggaaactccacccatggtaattgttggtgttgtcggttacatcgaaactccacatggtcttagggctttagccacagtttgggctgagcatctctctgaagattgccgcaagcgcttctacaagaactggtacaagagcaagaagaaggcatttaccaaagcttccaagaaatggagtgatgatttaagaaaga

SEQ ID NO: 596 - DNA, 398 bp, Diabrotica virgifera
  Clone ID: LIB3026-001-Q1-E1-D2
accaagcgtccggaaattgccccgtaagacacacaaaggtcttcgtaaagttgcctgtattggagcatggcatccttcaagagtatcattcacagttgcacgtgctggtcaaaagggttaccatcacagaactgagatgaacaaaaagatctacagaattggtgctggaatccacactaaagatggcaaggttgtcaagaataatgcagccactgcctacgatcttagtgaaaaaactattaccccaatgggtggttttcctcattatggtgaagttaacaatgactttgttatgattaaaggatgttgtatgggaccaaagaaacgtgttattacattgaggaagtcattgttagtccacactaaacgtattgctttggagaagatcaatcttaaat

SEQ ID NO: 597 - DNA, 424 bp, Diabrotica virgifera
  Clone ID: LIB150-047-Q1-E1-H6
agtgatgtctcacagaaagttcagtgcaccacgtcatggatcgatgggattctaccccaaaaagagatcccagagacaccgtggaaaggtaaaggctttcccaaaagatgatccctcaaaacctgtccacttaacggccttcataggttacaaagctggtatgacccacgtggtaagagaggcagacagacctggttcaaagatcaacaagaaagaaattgtagaggctgtaacaattttggaaactccacccatggtaattgttggtgttgtcggttacatcgaaactccacatggtcttagggctttagccacagtttgggctgagcatctctctgaagattgccgcaagcgcttctacaagaactggtacaagagcaagaagaaggcatttaccaaagcttccaagaaatggagtgatgat

SEQ ID NO: 598 - DNA, 395 bp, Diabrotica virgifera
  Clone ID: LIB149-022-Q1-E1-D6
acccacgcgtccggtgatgtctcacagaaagttcagtgcaccacgtcatggatcgatgggattctaccccaaaaagagatcccagagacaccgtggaaaggtaaaggctttcccaaaagatgatccctcaaaacctgtccacttaacggccttcataggttacaaagctggtatgacccacgtggtaagagaggcagacagacctggttcaaagatcaacaagaaagaaattgtagaggctgtaacaattttggaaactccacccatggtaattgttggtgttgtcggttacatcgaaactccacatggtcttagggctttagccacagtttgggctgagcatctctctgaagattgccgcaagcgcttctacaagaactggtacaagagcaaga

SEQ ID NO: 599 - DNA, 417 bp, Diabrotica virgifera
  Clone ID: LIB150-019-Q1-E1-C8
gtatcacagaaagttcagtgcaccacgtcatggatcgatgggattctaccccaaaaagagatcccagagacaccgtggaaaggtaaaggctttcccaaaagatgatccctcaaaacctgtccacttaacggccttcataggttacaaagctggtatgacccacgtggtaagagaggcagacagacctggttcaaagatcaacaagaaagaaattgtagaggctgtaacaattttggaaactccacccatggtaattgttggtgttgtcggttacatcgaaactccacatggtcttagggctttagccacagtttgggctgagcatctctctgaagattgccgcaggcgcttctacaagaactggtacaagagcaagaagaaggcatttaccaaagcttccaagaaatggagtgatga

SEQ ID NO: 600 - DNA, 412 bp, Diabrotica virgifera
  Clone ID: LIB150-025-Q1-E1-G5
ctcgcgggtcgacacaagcctctatactcattctggtcaaaagggttaccatcatagaactgagatgaacaaaaagatctacagaattggtgctggaatccacactaaagatggcaaggttgttaaaaataatgcagccactgcctatgatcttagtgaaaaaactattaccccaatgggtggttttcctcattatggtgaagttaacaatgacttcgttatgattaagggatgttgtatgggaccaaagaaacgtgttattacattgaggaagtcattgttagtccacactaaacgtattgctttggagaagatcaatcttaaattcattgatacctcatccaaattcggtcatggtagattccagacagctgctgacaaagctgcattcatgggtcctctcaagaaagat

SEQ ID NO: 601 - DNA, 396 bp, Diabrotica virgifera
  Clone ID: LIB149-037-Q1-E1-H12
acgcgcagtccattactccagtcgagatgtctcacagaaagttcagtgcaccacgtcatggatcgatgggattctaccccaaaaagagatcccagagacaccgtggaaaggtaaaggctttcccaaaagatgatccctcaaaacctgtccacttgacggccttcataggttacaaagctggtatgacccacgtggtaagagaggcagacagacctggatcaaagatcaacaaaaaagaaattgtagaggctgtaacaattttagaaactccacccatggtaattgttggtgttgtcggttacatcgaaactccacatgggcttaaggctttagccacagtttgggctgagcatctctctgaagattgccgcaggcgcttctacaagaactggtaca

SEQ ID NO: 602 - DNA, 408 bp, Diabrotica virgifera
  Clone ID: LIB149-028-Q1-E1-B5
agtctcacagaaagttcagtgcaccacgtcatggatcgatgggattctaccccaaaaagagatcccagagacaccgtggaaaggtaaaggctttcccaaaagatgatccctcaaaacctgtccacttgacggccttcataggttacaaagctggtatgacccacgtggtaagagaggcagacagacctggatcaaagatcaacaaaaaagaaattgtagaggctgtaacaattttagaaactccacccatggtaattgttggtgttgtcggttacatcgaaacttcacatgggcttagggctttagccacagtttgggctgagcatctctctgaagattgccgcaggcgcttctacaagaactggtacaagagcaagaagaaggcatttaccaaagcttccaagaaat

SEQ ID NO: 603 - DNA, 382 bp, Diabrotica virgifera
  Clone ID: LIB149-006-Q1-E1-H7
gaagaaggcatttaccaaagcttccaagaaatggagtgatgatttaggaaagaagtccatcgaaaaggacttaaagaagattgttaaatactgtaaagttgtcagagttattgctcatactcagatgaaattgttgaaacaacgtcaaaagaaagcccacattatggaaattcaattgaatggtggtagtgtagctgacaaagtagcttgggctaaagaacaccttgaaaagcctattcctattgccaacgtttttgctcaagatgaaatgattgattgcattggtgttactaagggtcatggatacaaaggtgttacttctcgttggcacacaaagaaattgccccgtaagacacacaaaggtcttcgtaaagttgcctgt

SEQ ID NO: 604 - DNA, 400 bp, Diabrotica virgifera
  Clone ID: LIB149-041-Q1-E1-F6
agaaagttcagtgcaccacgtcatggatcgatgggattctaccccaaaaagagatcccagagacaccgtggaaaggtaaaggctttcccaaaagatgatccctcaaaacctgtccacttaacggccttcataggttacaaagctggtatgacccacgtggtaagagaggcagacagacctggttcaaagatcaacaagaaagaaattgtagaggctgtaacaattttggaaactccacccatggtaattgttggtgttgtcggttacatcgaaactccacatggtcttagggctttagccacagtttgggctgagcatctctctgaagattgccgcaagcgcttctacaagaactggtacaagagcaagaagaaggcatttaccaaagcttccaagaaat

SEQ ID NO: 605 - DNA, 371 bp, Diabrotica virgifera
  Clone ID: LIB150-012-Q1-E1-F7
ctcacagaaagttcagtgcaccacgtcatggatcgatgggattctaccccaaaaagagatcccagagacaccgtggaaaggtaaaggctttcccaaaagatgatccctcaaaacctgtccacttaacggccttcataggttacaaagctggtatgacccacgtggtaagagaggcagacagacctggttcaaagatcaacaagaaagaaattgtagaggctgtaacaattttggaaactccacccatggtaattgttggtgttgtcggttacatcgaaactccacatggtcttacggctttagccacagtttgggctgagcatctctctgaagattgccccaggcgcttcaacaagaactggtacaagagc

SEQ ID NO: 606 - DNA, 424 bp, Diabrotica virgifera
  unsure (1)..(424): unsure at all n locations
  Clone ID: LIB150-023-Q1-E1-H10
tacaaaaccctaaagtgagtcgtaataaagttcagtgcaccacgtcatggatcgatgggattctaccccaaaaagagatcccagagacaccgtggaaaggtaaaggctttcccaaaagatgatccctcaaaacctgtccacttaacggccttcataggttacaaagctggtatgacccacgtggtaagagaggcagacagacctggttcaaagatcaacaagaaagaaattgtagaggctgtaacaattttggaaactccacccatggtaattgttggtgttgtcggttacatcgaaactccacatggtcttagggctttagccacagtttgggctgagcatctctctgaagattgccgcaggcgcttctacaagaactggtacaagagcaagaagaaggcatttaccanagcttccaagaaat

SEQ ID NO: 607 - DNA, 400 bp, Diabrotica virgifera
  Clone ID: LIB150-029-Q1-E1-C7
gtgaaccacgtcatggatcgatgggattctaccccaaaaagagatcccagagacaccgtggaaaggtaaaggctttcccaaaagatgatccctcaaaacctgtccacttaacggccttcataggttacaaagctggtatgacccacgtggtaagagaggcagacagacctggttcaaagatcaacaagaaagaaattgtagaggctgtaacaattttggaaactccacccatggtaattgttggtgttgtcggttacatcgaaactccacatggtcttagggctttagccacagtttgggctgagcatctctctgaagattgccgcaggcgcttctacaagaactggtacaagagcaagaagaaggcatttaccaaagcttccaagaaatggagtgatga

SEQ ID NO: 608 - DNA, 368 bp, Diabrotica virgifera
  Clone ID: LIB150-006-Q1-E1-F8
acacaaagagatcccagagacaccgtggaaaggtaaatgctttcgcaaaagatgatccctcaaaacctgtccacttgacggccttcataggttacaacgctggtatgacccacgtggtaagagaggcagacagacctggatcaaagatcaacacaaaagtaattgtagaggctgtaacaattttagaaactccacccatggtaattgttggtgttgtcggttacatcgaaactccacatgggcttacggctttagccacagtttgggctgagcatctctctgaacattgccgcaagcgcttctacaagaactggtacaagagcaggaagaaggcatttaccaaagcttccaagaaatggactgacgat

SEQ ID NO: 609 - DNA, 443 bp, Diabrotica virgifera
  unsure (1)..(443): unsure at all n locations
  Clone ID: LIB150-015-Q1-E1-E4
ccaacccttcgggatgtccaacagaaagttaattgaacaacttcagggttcaatggaatccaaccccaaaaggaaatccaaaaaacaccttggaaaggtaaaggctttccaaaaagatgatccctcaaaacctggtcacttaacggccttcataggttacaaagctggtatgacccacgtggtaagagaggcagacagacctggttcaaagatcaacaagaaagaaattgtagaggctgtaacaattttggaaactccacccatggtaattgttggtgttgtcggttacatcgaaactccacatggtcttagggctttagccacagtttgggctgagcatctctctgaagattgccgcaagcgcttctacaagaactggtacaagagcaagaagaaggcatttaccanagcttccaagaaatggagtgatgatttaagaaaga

SEQ ID NO: 610 - DNA, 303 bp, Diabrotica virgifera
  Clone ID: pGUT181
tatagaaatggagtgatgatctaggaaagaagtccatcgaaaaggacttaaagaagattgttaaatactgtaaagttgtcagagttattgctcatacacagatgaaattgtggaaaccacgtctaaagaaagcccacattatggatattctattgaatggtggtagtgtatctgaccaagtggggggggcgaaacaatacttgataagcctattcctattgccgtcgtgtttgctcaagatgaaatgattgattgcattggtgtgactgagggtcatggataacaaggtgtcacttctcgttg

SEQ ID NO: 611 - DNA, 345 bp, Diabrotica virgifera
  Clone ID: LIB150-011-Q1-E1-F12
cagaaagttcagtgcaccacttcatggattcatgggatcctaccccaatgagagatcccagacactccgtggaacggtaaaggcttacccaatagatgatacctcaaaacctgtccacgtaaccgacatcataaggttccacatctggcacgacccacgttatccaagagggacacagacctgattcaaagataatcaacaacgatcttgaagaggctgatataaatttggaaacaccacccatagttattgttggagatgtcggttacatcaacaatctacatggtcacatggctttatccataatttgtgctgaacatccctctgaatattgccgcacgcgca

SEQ ID NO: 612 - DNA, 354 bp, Diabrotica virgifera
  unsure (1)..(354): unsure at all n locations
  Clone ID: pGUT3759
gtttagtgtggactaacaatgacttcctcaatgtaataacacgtttctttggagaagatcaatcttaaattcattgatacctcatccaaattcggtcatggtagattccagacagctgctgacaaagctgcattcatgggtcctctcaagaaagatagagttaaggaagaagagaaggctgctgctcctgccgcagctgcatccagttaaagtgtaaatgtttttattgtttgacaataaacagatatataactaanaaaaaaaaaaaaaaaaaaaaaancctttggggggggggccgggccccaattcccccttaaggggggggttttaaaattcccgggccggggttttaaa

SEQ ID NO: 613 - DNA, 193 bp, Diabrotica virgifera
  Clone ID: LIB3026-005-Q1-E1-C1
atcttaaattcattgatacctcatctaaattcggtcatggtagattccagacagctgctgacaaagctgcgttcatgggtcctctcaagaaagatagagttaaggaagaagagaaggctgctgctcctgccgcagctgcatccagttaaagtgtaaatgtttttattgtttgacaataaacagatatataact

SEQ ID NO: 614 - DNA, 629 bp, Diabrotica virgifera
  unsure (1)..(629): unsure at all n locations
  Clone ID: pGUT2406
agcaagttcgcttccaaattttctctcaaaatctccgcgaaattgaagaacacaatgcaagataccagaatggtgaagtgtccttctacttgggggttaatcagttcgcagatatgacttcagaggaattcaaggctatgcttgactcccaactcattcacaagcctaaacgaaacattacatcccgatttgtagctgatcctcaattgactgttcccgaatcaattgactggagagaaaagggggcagttgctcccataagggaccaagggcaatgtggatcatgttgggcatttagtgcagctggtgctcttgaaggacaaagatttttaaagcagaacgtactagaagtactgagtacccaacagttagtagattgttccggtgattacgacaatgaaggctgcaatggtggttggccccattgggcatataactacattaaagatcatggcctctgtctagagtctgattacaagtatcaaggattagacggtgactgcaaacagtgtaattcggttatcaaaaccatcaatggctatgcatctgtagatcanaccgaagaagcacttaaagaggctgtangtactggttggcccatatcagtatgtgtcaacgctaattgggac

SEQ ID NO: 615 - DNA, 438 bp, Diabrotica virgifera
  Clone ID: LIB149-009-Q1-E1-D6
gttaaaggtatatagaagaaaatgaggttctttattcttcttgccgtattggttgtagctgtgaatgctacgtcagtccaccaacaatgggctcaatttaaggtaaaccattccaagaagtacggacatcttaaagaagagcaagttcgcttccaagttttctctcaaaatctccagaaaattgaacagcacaatgcaagataccagaatggtgaagtgtccttctacttgggggttaatcagttcgcagatatgacttcagaggaattcaaggctatgcttgactcccaactcattcacaagcctaagcgagacattacatcccgctttgtagctgatcctcaattgactgttccagaatcaattgactggagagaaaagggggcagttaatcccgtaagggaccaagagcaatgcggatcatgttgggcatttagt

SEQ ID NO: 616 - DNA, 443 bp, Diabrotica virgifera
  Clone ID: LIB149-014-Q1-E1-G7
cccacgcgtccggttaaaggtatatagaagaaaatgaggttctttattcttcttgccgtattggttgtagctgtgaatgctacgtcagtccaccaacaatgggctcaatttaaggtaaaccattccaagaagtacggacatcttaaagaagagcaagttcgcttccaagttttctctcaaaatctccagaaaattgaacagcacaatgcaagataccagaatggtgaagtgtccttctacttgggggttaatcagttcgcagatatgacttcagaggaattcaaggctatgcttgactcccaactcattcacaagcctaagcgagacattacatcccgctttgtagctgatcctcaattgactgttccagaatcaattgactggagagaaaagggggcagttaatcccgtaagggaccaagagcaatgcggatcatgttgggc

SEQ ID NO: 617 - DNA, 432 bp, Diabrotica virgifera
  Clone ID: LIB149-008-Q1-E1-A7
cggacgcgtgggttaaaaatgaggttccttattctacttgccgtattggctgtagctgtgaatgctacatcaatccaccaacaatgggctacatttaaggtaaaccattccaagaagtacggacatcttaaagaagagcaagttcgcttccaaattttctctcaaaatctccgcaaaattgaagaacacaatgcaagataccagaatggtgaagtgtccttctacttgggggttaatcagttcgcagatatgacttcagaggaattcaaggctatgcttgactcccaactcattcacaagcctaaacgaaacattacatcccgatttgtagctgatcctcaattgactgttccagaatcaattgactggagagaaaatggggcagttgctcccataagggaccaagggcaatgtggatcatgttgggcattt

SEQ ID NO: 618 - DNA, 432 bp, Diabrotica virgifera
  Clone ID: LIB3026-001-Q1-E1-F6
agtgaaaggtgtttaaaaatgaggttccttattctacttgccgtattggctgtagctgtgaatgctacatcaatccaccaacaatgggctacatttaaggtaaaccattccaagaagtacggacatcttaaagaagagcaagttcgcttccaagttttctctcaaaatctccgcaaaattgaagaacacaatgcaagataccagaatggtgaagtatccttctacttgggggttaatcaattcgcagatatgactccagaggaattcaaggctatgcttgactcccaactcattcacaaacctaagcgaaacattacatcccgctttgtagctgatcctcaattgactgttccagaatcaattgactggagagagaaaggggcagttgctcccataagggaacaagggcaatgcggatcatgttgggcattt

SEQ ID NO: 619 - DNA, 375 bp, Diabrotica virgifera
  unsure (1)..(375): unsure at all n locations
  Clone ID: LIB3026-010-Q1-E1-H3
acggacatcttaaagaagagcaagttcgcttccaaattttcgctcaaaatctcggcaaaattgaagaacacaatgcaagataccagaatggtgaagtgtccttctacttgggggttaatcagttcgcagatatgacttcagaggaattcaaggctatgcttgactcccaactcattcacaagcctaaacgaaacattacatcccgatttgtagctgatcctcagttgactgttccagaatcaattgactggagagaaaagggggcagttgctcccataagggaccaagggcaatgtggatcatgttgggcatttagtgcagctggtgctcttgaaggacaaagatttttaaagcagaacgtaacanaagtactga

SEQ ID NO: 620 - DNA, 433 bp, Diabrotica virgifera
  Clone ID: LIB149-025-Q1-E1-D5
acccacgcgtccggtgttaaaggtatatagaagaaaatgaggttctttattcttcttgccgtattggttgtagctgtgaatgctacgtcagtccaccaacaatgggctcaatttaaggtaaaccattccaagaagtacggacatcttaaagaagagcaagttcgcttccaagttttctctcaaaatctccagaaaattgaacagcacaatgcaagataccagaatggtgaagtgtccttctacttgggggttaatcagttcgcagatatgacttcagaggaattcaaggctatgcttgactcccaactcattcacaagcctaagcgagacattacatcccgctttgtagctgatcctcaattgactgttccagaatcaattgactggagagaaaagggggcagttaatcccgtaagggaccaagagcaatgcg

SEQ ID NO: 621 - DNA, 409 bp, Diabrotica virgifera
  Clone ID: LIB149-020-Q1-E1-A12
aagaaaatgaggttctttattcttcttgccgtattggttgtagctgtgaatgctacgtcagtccaccaacaatgggctcaattaaggtaaaccattccaagaagtacggacatcttaaagaagagcaagttcgcttccaagttttctctcaaaatctccagaaaattgaacagcacaatgcaagataccagaatggtgaagtgtccttctacttgggggttaatcagttcgcagatatgacttcagaggaattcaaggctatgcttgactcccaactcattcacaagcctaagcgagacattacatcccgctttgtagctgatcctcaattgactgttccagaatcaattgactggagagaaaagggggcagttaatcccgtaagggaccaagagcaatgcggatcatg

SEQ ID NO: 622 - DNA, 389 bp, Diabrotica virgifera
  Clone ID: LIB3026-006-Q1-E1-A8
gtgtgaaaggtgtttaaaaatgaggttccttattctacttgccgtaatggctgtagctgtgaatgctacatcaatccaccaacaatgggctacatttaaggtaaaccattccaagaagtacggacatcttaaagaagagcaagttcgcttccaaattttctctcaaaatctccgcaaaattgaagaacacaatgcaagataccagaatggtgaagtgtccttctacttgggggttaatcagttcgcagatatgacttcagaggaattcaaggctatgcttgactcccaactcattcacaagcctaaacgagacattacatcccgatttgtagctgatcctcaattgactgttccagaatcaattgacgggagagaaaagggggcagttg

SEQ ID NO: 623 - DNA, 406 bp, Diabrotica virgifera
  Clone ID: LIB149-028-Q1-E1-B8
agtgaaattaggtgtgaaaggtgtttaaaaatgaggttccttattctacttgccgtattggctgtagctgtgaatgctacatcaatccaccaacaatgggctacatttaaggtaaaccattccaagaagtacggacatcttaaagaagagcaagttcgcttccaagttttctctcaaaatctccgcaaaattgaagaacacaatgcaagataccagaatggtgaagtatccttctacttgggggttaatcaattcgcagatatgactccagaggaattcaaggctatgcttgactcccaactcattcacaaacctaagcgaaacattacatcccgctttgtagctgatcctcaattgactgttccagaatcaattgactggagagagaaaggggcagttgctccca

SEQ ID NO: 624 - DNA, 414 bp, Diabrotica virgifera
  Clone ID: LIB149-049-Q1-E1-D6
acccacgcgtccgcccacgcgtccgtgtttaaaaatgaggttccttattctacttgccgtattggctgtagctgtgaatgctacatcaatccaccaacaatgggctacatttaaggtaaaccattccaagaagtacggacatcttaaagaagagcaagttcgcttccaagttttctctaaaaatctccgcaaaattgaagaacacaatgcaagataccagaatggtgaagtatccttctacttgggtgttaatcagttcgcagatatgacttcagaggaattcaaggctatgcttgactcccaactcattcacaagcctaagcgagacattacatcccgctttgtagttgatcctcaattgactgttccagaatcaattgactggagagaaaaaggcgcagttaatcccgtaag

SEQ ID NO: 625 - DNA, 405 bp, Diabrotica virgifera
  Clone ID: LIB149-035-Q1-E1-D6
cggacgcgtgggattaggtgttaaaggtatatagaagaaaatgaggttctttattcttcttgccgtattggttgtagctgtgaatgctacgtcagtccaccaacaatgggctcaatttaaggtaaaccattccaagaagtacggacatcttaaagaagagcaagttcgcttccaagttttctctcaaaatctccagaaaattgaacagcacaatgcaagataccagaatggtgaagtgtccttctacttgggggttaatcagttcgcagatatgacttcagaggaattcaaggctatgcttgactcccaactcattcacaagcctaagcgagacattacatcccgctttgtagctgatcctcaattgactgttccagaatcaattgactggagagaaaagggggc

SEQ ID NO: 626 - DNA, 396 bp, Diabrotica virgifera
  unsure (1)..(396): unsure at all n locations
  Clone ID: LIB149-043-Q1-E1-E8
cccacgcaaccgattaaaggtatatagaagaaaatgaggttctttattcttcttgccgtattggttgtagctgtgaatgctacgtcagtccaccaacaatgggctcaatttaaggtaaaccattccaagaagtacggacatcttaaagaagagcaagttcgcttccaagttttctctcaaaatctccagaaaattgaacagcacaatgcaagataccagaatggtgaagtgtccttctacttgggggttaatcagttcgcagatatgacttcagaggaattcaaggctatgcttgactcccaactcattcacaagcctaagcgagacattacatcncgctttgtagctgatcctcaattgactgttccagaatcaattgactggagagaaaagggg

SEQ ID NO: 627 - DNA, 423 bp, Diabrotica virgifera
  unsure (1)..(423): unsure at all n locations
  Clone ID: LIB149-039-Q1-E1-D4
tgtgaaattaggtgtgaaaggtgtttaaaaatgaggttccttattctacttgccgtattggctgtagctgtgaatgctacatcaatccaccaacaatgggctacatttaaggtaaaccattccaagaagtacggacatcttaaagaagagcaagttcgcttccaagttttctctcaaaatctccgcaaaattgaagaacacaatgcaagataccagaatggtgaagtatccttctacttgggggttaatcaattcgcagatatgactccagaggaattcaaggctatgcttgactcccaactcattcacaaacctaagcgaaacattacatcccgctttgtanctgatcctcaattgactgttccagaatcaattgactggagagagaaagggcagttgctcccataagggacaagggcaatg

SEQ ID NO: 628 - DNA, 379 bp, Diabrotica virgifera
  Clone ID: LIB149-047-Q1-E1-H4
taggtgttaaaggtatatagaagaaaatgaggttctttattcttcttgccgtattggttgtagctgtgaatgctacgtcagtccaccaacaatgggctcaatttaaggtaaaccattccaagaagtacggacatcttaaagaagagcaagttcgcttccaagttttctctcaaaatctccagaaaattgaacagcacaatgcaagataccagaatggtgaagtgtccttctacttgggggttaatcagttcgcagatatgacttcagaggaattcaaggctatgcttgactcccaactcattcacaagcctaagcgagacattacatcccgctttgtagctgatcctcaattgactgttccagaatcaattgactggag

SEQ ID NO: 629 - DNA, 384 bp, Diabrotica virgifera
  Clone ID: LIB149-041-Q1-E1-B1
accacgcatccggtgtgaaaggtgcttaaaaatgaggttccttattctacttgccgtattggctgtagctgtgaatgctacatcaatccaccaacaatgggctacatttaaggtaaaccattccaagaagtacggacatcttaaagaagagcaagttcgcttccaagttttctctcaaaatctccgcaaaattgaagaacacaatgcaagataccagaatggtgaagtatccttctacttgggggttaatcagttcgcagatatgacttcagaggaattcaaggctatgcttgactcccaactcattcacaagcctaaaagaaacattacatcccgctttgtggctgatcctcaattgactgttcccgaatcaattgactggag

SEQ ID NO: 630 - DNA, 410 bp, Diabrotica virgifera
  Clone ID: LIB149-047-Q1-E1-B8
ctcgccggtcgacacacgcatctagaatggtgcttaaaaatgaggttccttattctacttgccgtattggctgtagctgtgaatgctacatcaatccaccaacaatgggctacatttaaggtaaaccattccaagaagtacggacatcttaaagaagagcaagttcgcttccaagttttctctcaaaatctccgcaaaattgaagaacacaatgcaagataccagaatggtgaagtatccttctacttgggggttaatcaattcgcagatatgactccagaggaattcaaggctatgcttgactcccaactcattcacaaacctaagcgaaacattacatcccgctttgtagctgatcctcaattgactgttccagaatcaattgactggagagagatagagcagttgct

SEQ ID NO: 631 - DNA, 372 bp, Diabrotica virgifera
  Clone ID: LIB149-042-Q1-E1-C1
gggccgacccacgcgtcagggtgtttaaaaatgaggttccttattctacttgccgtattggctgtagctgtgaatgctacatcaatccaccaacaatgggctacatttaaggtaaaccattccaagaagtacggacatcttaaagaagagcaagttcgcttccaaattttctctcaaaatctccgcaaaattgaagaacacaatgcaagataccagaatggtgaagtgtccttctacttgggggttaatcagttcgcagatatgacttcagaggaattcaaggctatgcttgactcccaactcattcacaagcctaaacgaaacattacatcccgatttgtagctgatcctcaattgactgttccagaatca

SEQ ID NO: 632 - DNA, 345 bp, Diabrotica virgifera
  unsure (1)..(345): unsure at all n locations
  Clone ID: LIB3026-018-Q1-E1-E5
acgaaggtatatagaagaaaatgaggttctttattcttcttgccgtattggctgtagctgtgaatgctacgtcagtccaccaacaatgggctcaatttaaggtaaaccattccaagaagtacggacatcttaaagaagagcaagttcgcttccaagttttctctcaaaatctccagaaaattgaacagcacaatgcaagataccagaatggtgaagtgtccttctacttgggggttaatcagttcgcagatatgacttcagaggaattcaaggctatgcttgactcccaactcattcacaagcctaagcgagacattacatcccgctttgtanctgatcctcaat

SEQ ID NO: 633 - DNA, 328 bp, Diabrotica virgifera
  Clone ID: LIB3026-018-Q1-E1-A2
acgggtgttaatcagtgaggttccttattctacttgccgtattggctgtaactgtgaatgctacatcaatccaccaggactgggctacatttaaggtaaaccattccaagaagtacgggcatcttacagaaaagcaagttcgcttccaagttctctctcaaaatctccgcacaattgaggaacacaatgcaagataccagaatggtgaagtatccttcgacttgggggttaatcaattcgcagatatgactccataggaattcaaggcaaggcttgactcccaactcattcacaaacctaagcgacacattacatcccgccttgtagc

SEQ ID NO: 634 - DNA, 305 bp, Diabrotica virgifera
  Clone ID: LIB149-027-Q1-E1-G11
accacgcgtcagcccacgcgtccgcccacgcgtccgttccaagaagtacggacatcttaaagaagagcaagttcgcttccaagttttctctcaaaatctccagaaaattgaacagcacaatgcaagataccagaatggtgaagtgtccttccacttggggggtaatcaattcgcagatatgacttcagaggaattcaagggtatgcctgagtctcaactcactcacaagcctaagcgagacattacatcccgcgttgtatctgatactcaaatgactgttccagaatcaaatgactggggagaaa

SEQ ID NO: 635 - DNA, 418 bp, Diabrotica virgifera
  Clone ID: LIB149-033-Q1-E1-G7
aagtaactgcttagtcaaaatcttcaaagctgacggcttgggaggattatatcgtggatttggtgtatcagtacaaggtatcattatctaccgtgccgctttcttcggtttctacgatactgccaagggtattttgcccgatcctaagaacactcctcttgtagtttcatgggccattgcacagactgtaaccactgttgctggtatcatctcatatcccttcgatactgtccgtaggcgtatgatgatgcagtctggacgtaagaagaccgaaatcatctacaaaagcactgctcactgctgggccacaatcgccaagaccgaaggtaccggtgccttcttcaagggagctttctccaacgtcctccgtggtactggtggagctattgtattggtcatgtacgacgaaatcaaaaac

SEQ ID NO: 636 - DNA, 423 bp, Diabrotica virgifera
  unsure (1)..(423): unsure at all n locations
  Clone ID: LIB149-015-Q1-E1-H12
cacacgcgtccgcttaacttcgccttcaaagacaaatacaagcagatcttcttgagcggagtagacaaaaagacacaattctggcgttacttcttaggtaacttggcctctggtggtgccgccggagctacctccctctgctttgtatacccacttgatttcgccagaaccaggttggccgccgacgtcggtaaaggtgccggtgaacgtgaattctctggtttgggtaactgcttagtcaaaatcttcaaagctgacggcttgggaggattatatcgtggatttggtgtatcagtacaacgtatcattatctaccgtgccgctttcttcggtttctacgatactgccaanggcattttgcccgatcctaagaacactcctcttgtagtttcatgggccaatgcacagactgttaacactgtt

SEQ ID NO: 637 - DNA, 426 bp, Diabrotica virgifera
  Clone ID: LIB150-006-Q1-E1-F6
agttcggtgcgcggtctgttaacagccgattacaagtactctaccatattcttttgagaaaagttttaaaagaataaaacaaaatgtctctcgctgatcccgttgcctttatgaaggatttcctcgctggaggtatttccgccgctatttcaaaaacatgtgtagctccaatcgaacgtgtaaagttgcttttgcaagtacaacacatttccaagcaaatcgctgaggatcagcgttacaagggtatggtagactgcttcgtacgtatcccaaaggaacagggtgttcttgcatactggcgtggtaacaccgctaacgtcatccgttatttcccaacccaagcccttaacttcgccttcaaagacaaatacaagcagatcttcttgagcggagtagacaaaaagacacaattctggcgttacttct

SEQ ID NO: 638 - DNA, 426 bp, Diabrotica virgifera
  Clone ID: LIB150-041-Q1-E1-G2
cccaggcctccaaagcggtcagttaacagccgattacaagtactctaccatattcttttgagaaaagttttaaaagaataaaacaaaatgtctctcgctgatcccgttgcctttatgaaggatttcctcgctggaggtatttccgccgctatttcaaaaacatgtgtagctccaatcgaacgtgtaaagttgcttttgcaagtacaacacatttccaagcaaatcgctgaggatcagcgttacaagggtatggtagactgcttcgtacgtatcccaaaggaacagggtgttcttgcatactggcgtggtaacaccgctaacgtcatccgttatttcccaacccaagcccttaacttcgccttcaaagacaaatacaagcagatcttcttgagcggagtagacaaaaagacacaattctggcgttac

SEQ ID NO: 639 - DNA, 420 bp, Diabrotica virgifera
  Clone ID: LIB150-019-Q1-E1-C10
gtaaggtgcgcggtctgttaacagccgattacaagtactctaccatattcttttgagaaaagttttaaaagaataaaacaaaatgtctctcgctgatcccgttgcctttatgaaggatttcctcgctggaggtatttccgccgctatttcaaaaacatgtgtagctccaatcgaacgtgtaaagttgcttttgcaagtacaacacatttccaagcaaatcgctgaggatcagcgttacaagggtatggtagactgcttcgtacgtatcccaaaggaacaaggtgttcttgcatactggcgtggtaacaccgctaacgtcatccgttatttcccaacccaagcccttaacttcgccttcaaagacaaatacaagcagatcttcttgagcggagtagacaaaaagacacaattctggcgtta

SEQ ID NO: 640 - DNA, 378 bp, Diabrotica virgifera
  unsure (1)..(378): unsure at all n locations
  Clone ID: pGUT715
aaaagacacaattctggcgttacttcttaggtaacttggcctctggtggtgccgccggagctacctccctctgctttgtatacccacttgatttcgccagaaccaggttggccgccgacgtcggtaaaggtgccggtgaacgtgaattctctggtttgggtaactgcttantcaaaatcttcaaagctgacggcttgggaggattatatcgtggatttggtgtatcagtacaaggtatcattatctaccgtgccgctttcttcggtttctacaatactngcaagggtatnttgcccgatcctaaaatcactcctcttgtantntcatgggccattgcacaaactgtaaccactgtggctggtatcatctcatatccct

SEQ ID NO: 641 - DNA, 412 bp, Diabrotica virgifera
  Clone ID: LIB149-033-Q1-E1-D6
aggcgcggtctgttaacagccgattacaagtactctaccatattcttttgagaaaagttttaaaagaataaaacaaaatgtctctcgctgatcccgttgcctttatgaaggatttcctcgctggaggtatttccgccgctatttcaaaaacatgtgtagctccaatcgaacgtgtaaagttgcttttgcaagtacaacacatttccaagcaaatcgctgaggatcagcgttacaagggtatggtagactgcttcgtacgtatcccaaaggaacagggtgttcttgcatactggcgtggtaacaccgctaacgtcatccgttatttcccaacccaagcccttaacttcgccttcaaagacaaatacaagcagatcttcttgagcggagtagacaaaaagacacaattctggcg

SEQ ID NO: 642 - DNA, 328 bp, Diabrotica virgifera
  unsure (1)..(328): unsure at all n locations
  Clone ID: pGUT770
gtgccgccggagctacctccctctgctttgtatacccacttgatttcgccagaaccaggttggccgccgacgtcggtaaaggtgccggtgaacgtgaattctctggtttgggtaactgcttagtcaaaatcttcaaaactgacggcttgggaggattatatcgtggatttggtgtatcagtacaaggtatcattatctaccgtgccgctttcttcggtttctacgatactgccaagggtattttgcccgatcctaaaatcactcctcttgtantttcatggggcattgcacaaactgtaaccactgttgctggtatcatctcatatcc

SEQ ID NO: 643 - DNA, 401 bp, Diabrotica virgifera
  Clone ID: LIB149-022-Q1-E1-E12
gcggtctgttaacagccgattacaagtactctaccatattcttttgagaaaagttttaaaagaataaaacaaaatgtctctcgctgatcccgttgcctttatgaaggatttcctcgctggaggtatttccgccgctatttcaaaaacatgtgtagctccaatcgaacgtgtaaagttgcttttgcaagtacaacacatttccaagcaaatcgctgaggatcagcgttacaagggtatggtagactgcttcgtacgtatcccaaaggaacagggtgttcttgcatactggcgtggtaacaccgctaacgtcatccgttatttcccaacccaagcccttaacttcgccttcaaagacaaatacaagcagatcttcttgagcggagtagacaaaaagacacaat

SEQ ID NO: 644 - DNA, 405 bp, Diabrotica virgifera
  Clone ID: LIB150-001-Q1-E1-D10
gcgcggtctgttaacagccgattacaagtactctaccatattcttttgagaaaagttttaaaagaataaaacaaaatgtctctcgctgatcccgttgcctttatgaaggatttcctcgctggaggtatttccgccgctatttcaaaaacatgtgtagctccaatcgaacgtgtaaagttgcttttgcaagtacaacacatttccaagcaaatcgctgaggatcagcgttacaagggtatggtagactgcttcgtacgtatcccaaaggaacagggtgttcttgcatactggcgtggtaacaccgctaacgtcatccgttatttcccaacccaagcccttaacttcgccttcaaagacaaatacaagcagattctcttgagcggagtagacaaaaagacacaattc

SEQ ID NO: 645 - DNA, 434 bp, Diabrotica virgifera
  Clone ID: LIB149-008-Q1-E1-A4
cccacgcgtccgcccacgcgtccggttcggtgcgcggtctgttaacagccgattacaagtactctaccatattcttttgagaaaagttttaaaagaataaaacaaaatgtctctcgctgatcccgttgcctttatgaaggatttcctcgctggaggtatttccgccgctatttcaaaaacatgtgtagctccaatcgaacgtgtaaagttgcttttgcaagtacaacacatctccaagcaaatcgctgaggatcagcgttacaagggtatggtagactgcttcgtacgtatcccaaaggaacagggtgttcttgcatactggcgtggtaacaccgctaacgtcatccgttatttcccaacccaagcccttaacttcgccttcaaagacaaatacaagcagatcttcttaagcggagtagacaaaaagacacaat

SEQ ID NO: 646 - DNA, 395 bp, Diabrotica virgifera
  Clone ID: LIB149-019-Q1-E1-B1
tgtaaacagccgattacaagtactctaccatattcttttgagaaaagttttaaaagaataaaacaaaatgtctctcgctgatcccgttgcctttatgaaggatttcctcgctggaggtatttccgccgctatttcaaaaacatgtgtagctccaatcgaacgtgtaaagttgcttttgcaagtacaacacatttccaagcaaatcgctgaggatcagcgttacaagggtatggtagactgcttcgtacgtatcccaaaggaacagggtgttcttgcatactggcgtggtaacaccgctaacgtcatccgttatttcccaacccaagcccttaacttcgccttcaaagacaaatacaagcagatcttcttgagcggggtatacaaaaagacacaaa

SEQ ID NO: 647 - DNA, 401 bp, Diabrotica virgifera
  Clone ID: LIB149-006-Q1-E1-E12
agcggtctgttaacagccgattacaagtactctaccatattcttttgagaaaagttttaaaagaataaaacaaaatgtctctcgctgattccgttgcctttatgaaggatttcctcgctggaagtatttccgccgctatttcaaaaacatgtgtagctccaatcgaacgtgtaaagttgcttttgcaagtacaacacatttccaagcaaatcgctgaggatcagcgttacaagggtatggtagactgcttcgtacgtatcccaaaggaacaaggtgttcttgcatactggcgtggtaacaccgctaacgtcatccgttatttcccaacccaagcccttaacttcgccttcaaagacaaatacaagcagattttcttgagcggagtaaacaaaaagacacaa

SEQ ID NO: 648 - DNA, 374 bp, Diabrotica virgifera
  Clone ID: LIB150-046-Q1-E1-B6
agttcggtgcgcggtctgttaacagccgattacaagtactctaccatattcttttgagaaaagttttaaaagaataaaacaaaatgtctctcgctgatcccgttgcctttatgaaggatttcctcgctggaggtatttccgccgctatttcaaaaacatgtgtagctccaatcgaacgtgtaaagttgcttttgcaagtacaacacatttccaagcaaatcgctgaggatcagcgttacaagggtatggtagactgcttcgtacgtatcccaaaggaacagggtgttcttgcatactggcgtggtaacaccgctaacgtcatccgttatttcccaacccaagcccttaacttcgccttcaaagacaaatacaag

SEQ ID NO: 649 - DNA, 387 bp, Diabrotica virgifera
  Clone ID: LIB150-049-Q1-E1-F5
aagcgcggtctgttaacagccgattacaagtactctaccatattcttttgagaaaagttttaaaagaataaaacaaaatgtctctcgctgatcccgttgcctttatgaaggatttcctcgctggaggtatttccgccgctatttcaaaaacatgtgtagctccaatcgaacgtgtaaagttgcttttgcaagtacaacacatctccaagcaaatcgctgaggatcagcgttacaagggtatggtagactgcttcgtacgtatcccagaggaacagggtgttcttgcatactggcgtggtaacaccgctaacgtcatccgttatttcccaacgcaagcccttaacttccgcttcagagacaagtaccaagcagatcctcgtaaagcgg

SEQ ID NO: 650 - DNA, 396 bp, Diabrotica virgifera
  Clone ID: LIB150-001-Q1-E1-G8
ttcgccggtcgaaacacgcaaccggcgcggtctgtgaacagccgattacaagtactctaccatattcttttgagaaaagttttaaaagaataaaacaaaatgtctctcgctgatcccgttgcctttatgaaggatttcctcgctggaggtatttccgccgctatttcaaaaacatgtgtagctccaatcgaacgtgtaaagttgcttttgcaagtacaacacatttccaagcaaatcgctgaggatcagcgttacaagggtatggtagactgcttcgtacgtaacccaaaggaacatggtgttcttgcatactggcgtggtaacaccgctaacgtcatccgttatttcccaagccaagcccttaacttcgccttcatagacaaatacatgcagatc

SEQ ID NO: 651 - DNA, 311 bp, Diabrotica virgifera
  Clone ID: LIB3026-024-Q1-E1-F8
cggggccacccacgcgtccggatgctggtatcatctcatatcccttcgatactgtccgtaggcgtatgatgatgcagtctggacgtaagaagaccgagatcatctacaggagcactgctcactgctgggccacagtcgccaagaccgaaggtaccggtgccttcttcaaggcagctttctccagcgtcgtccgtggtactggtggagctattgtattggtcatgtacgacgaaatcaaagacgtgattgtgtaatttgtttttcattgcgacaagacgcgcgcatcagtatcaacactcgagtcgattttt

SEQ ID NO: 652 - DNA, 440 bp, Diabrotica virgifera
  Clone ID: LIB3026-006-Q1-E1-F11
cccacgcgtccggtatcatctcatatcccttcaatactgtccgtaagcgtatgatgatgcagtctggacgtaacaagaccgaaatcatctacaaaagcactgctcactgctgggccacaatcgccaagaccgaaggtaccggtgccttcttcaagggagctttctccaacgtcctccgtggtactggtggagctattgtattggtcatgtacgacgaaatcaaaaacttgattgtgtaatttgtttttcattgctacaagaatcgcgcatcattatcaacactccaatcgatttttcctaggaaatatttagccaaattcgatgatatattcttctagccgtgcttgttttaaaccattccgggtggaggcggaccattttatagacctttagagctcactgagatggttttgctgtcaccccaccccttgctgagcacg

SEQ ID NO: 653 - DNA, 300 bp, Diabrotica virgifera
  Clone ID: pGUT2027
acgattacaagtactctaccattattcttttgagaaaagttttaaaagaataaaacaaaatgtctctcgctgatcccgttgcctttatgaaggatttcctcgctggaggtatttccgccgctatttcaaaaacatgtgtagctccaatcgaacgtgtaaagttgcttttgcaagtacaacacatttccaagcaaatcgctgaggatcagcgttacaagggtatggtagactgcttcgtacgtatcccaaaggaacagggtgttcttgcatactggcgtggtaacaccgctaacgtcattc

SEQ ID NO: 654 - DNA, 362 bp, Diabrotica virgifera
  Clone ID: LIB150-036-Q1-E1-B4
gcgggccgatacacgactcaacagtcagtcgtcatacgattacaagtactctaccatattcttttgagaaaagttttaaaagaataaaacaaaatgtctctcgctgatcccgttgcctttatgaaggatttcctcgctggaggtatttccgccgctatttcaaaaacatgtgtatctccattcgaacgtgtaaagttgcttttgcaagtacaacacatttccaagcaaatcgctgatgatcagcgttacaaaggtatggtagactgcttcgtacgtatcacataggaagatggtgttcttgcatactggcgtggtaacaccgctaacgtcagccgttatttccgaaaccaagcccttaactt

SEQ ID NO: 655 - DNA, 345 bp, Diabrotica virgifera
  Clone ID: LIB149-006-Q1-E1-C6
acggacgcgtgggttcatgggccattgcacaaactgttaccactgttgctggtatcatctcattatcccttcgatactgtcagttggcatatgatagatcagtctggacgtaagaagatcaatttcatctacattggcactgatcaatgctgggctacaatctccatgactgatagtatcggtgtcatcttcactggagctttctccatcgtcctcggtggtactggtggagctattgtattgggcatgtacgatgaaatcagattcttgattgagctatttgtttttcattgctactagaatcacgcatcaatatcatcactccaatcgatttttcctatgaaa

SEQ ID NO: 656 - DNA, 445 bp, Diabrotica virgifera
  Clone ID: LIB149-015-Q1-E1-E8
gaaatacatggccatgggtgcatacttcgcaagagacacagtgaacagacccggttttgctgatttatttttcaaatcagctagtgaagaaagggaacatgccatcaaattgatccattatttgctcatgagaggagaacttacttctagcatcagtgatctcatcaaaagaaatcttgcacctgctcaaaccacatgggaaaacggtgtgagtgctctcaaacacgcccttaaactggaagcttcagttaccagaaagatcagagatgtcatccaagtttgcgaagacggctccaacttcaacgattaccatcttgttgattacctgaccggcgacttcttggaggaacaataccatggacaacgggacttagctggaaaagtctccaatttacaaaagatgatgggagaacacggagcccttggcgaatggctctacgacaag

SEQ ID NO: 657 - DNA, 620 bp, Diabrotica virgifera
  Clone ID: pGUT3230
taaaatttgtctttatttttgttataattccgaaacttttttttaataatacataatggtaacactaagatttacgaaaagatagacttatgatctaatacggagttttatgttggtaaaagaaaaactagtttaaatacttaagtatagaactataacatttatacgatggctttattttgaagtttcttgtcaaaaagccattctccaagtgctccgtgttctgccatcatcttttgtaaatcggatacttttccggcgaggtctctttgtccatggtattgttctcctaagaagtcgcctgccaggtagtcgacaagatgataatcgttgaaagattcagcttcttcacaaactttggtaacatctctgatcttcctagtaactgaagcttccaactgaagagcttgttttaaggcacttacaccattgtcccaagtggtaactgaaggcacaagatttcttttaatgagttcgctcaggttggatgtaagttctcctctcatgagcaaataatgaatcaatttgatggcatgttctctttcttcgctggcagcatcgaagaacaagtcagcaaaacctggtctgtttatggtgtctttcgagaaatgggcacccat

SEQ ID NO: 658 - DNA, 611 bp, Diabrotica virgifera
  unsure (1)..(611): unsure at all n locations
  Clone ID: pGUT3542
aaggccgactataacgaataaaatcttcttatttttcgttatttttcattttataacaagttttgaaaactgaaacaacatgaagtccgttggtttgtttgtatttttggcttgcattgcaggtttatatgctattcagctgaaatgtgcccaccaagaactgaacattcctaatgaatggatcgatatgcacaaagaatgtgtgcacaaaatgagaggtcaagttgaagaggaacttaaagcttcaatgcaatacatggccatgggtgcccatttctcgaaagacaccataaacagaccaggttttgctgacttgttcttcgatgctgccagcgaagaaagagaacatgccatcaaattgattcattatttgctcatgagaggagaacttacatccaacctgagcgaactcattaaaagaaatcttgtgccttcagttaccacttgggacaatggtgtaagtgccttaaaacaagctcttcagttggaagcttcagttactaggaagatcagagatgttaccaaagtttgtgaagaagctgaatctttcaacgattatcatcttgtcgactacctggcaggcgacttcttangagaaacataccatggac

SEQ ID NO: 659 - DNA, 394 bp, Diabrotica virgifera
  Clone ID: LIB149-041-Q1-E1-C5
agccatgggtgcccatttctcgaaagacaccataaacagaccaggttttgctgacttgttcttcgatgctgccagcgaagaaagagaacatgccatcaaattgattcattatttgctcatgagaggagaacttacatccaacctgagcgaactcattaaaagaaatcttgtgccttcagttaccacttgggacaatggtgtaagtgccttaaaacaagctcttcagttggaagcttcagttactaggaagatcagagatgttaccaaagtttgtgaagaagctgaatctttcaacgattatcatcttgtcgactacctggcaggcgacttcttaggagaacaataccatggacaaagagacctcgccggaaaagtatccgatttacaaaagatg

SEQ ID NO: 660 - DNA, 398 bp, Diabrotica virgifera
  Clone ID: LIB149-040-Q1-E1-D11
acgatatgcacaaagaatgtgtgcacaaaatgagaggtcaagttgaagaggaacttaaagcttcaatgcaatacatggccatgggtgcccatttctcgaaagacaccataaacagaccaggttttgctgacttgttcttcgatgctgccagcgaagaaagagaacatgccatcaaattgattcattatttgctcatgagaggagaacttacatccaacctgagcgaactcattaaaagaaatcttgtgccttcagttaccacttgggacaatggtgtaagtgccttaaaacaagctcttcagttggaagcttcagttactaggaagatcagagatgttaccaaagtttgtgaagaagctgaatctttcaacgattatcatcttgtcgactacctggca

SEQ ID NO: 661 - DNA, 407 bp, Diabrotica virgifera
  Clone ID: LIB149-030-Q1-E1-A11
gacccaagcgtcagccacgcgtccggcacaaaatgagaggtcaagttgaagaggaacttaaagcttcaatgcaatacatggccatgggtgcccatttctcgaaagacaccataaacagaccaggttttgctgacttgttcttcgatgctgccagcgaagaaagagaacatgccatcaaattgattcattatttgctcatgagaggagaacttacatccaacctgagcgaactcattaaaagaaatcttgtgccttcagttaccacttgggacaatggtgtaagtgccttaaaacaagctcttcagttggaagcttcagttactaggaagatcagagatgttaccaaagtttgtgaagaagctgaatctttcaacgattatcatcttgtcgactacctggcatgcgac

SEQ ID NO: 662 - DNA, 412 bp, Diabrotica virgifera
  Clone ID: LIB3026-012-Q1-E1-H6
cggggccccccacgcgtccgcaaatgtgcccaccaagaactgaacattcctaatgaatggatcgatatgcacaaagaatgtgtgcacaaaatgagaggtcaagttgaagaggaacttaaagcttcaatgcaatacatggccatgggtgcccatttctcgaaagacaccataaacagaccaggttttgctgacttgttcttcgatgctgccagcgaagaaagagaacatgccatcaaattgattcattatttgctcatgagaggagaacttacatccaacctgagcgaactcattaaaagaaatcttgtgccttcagttaccacttgggacaatggtgtaagtgccttaaaacaagctcttcagttggaagcttcagttactaggaagatcagagatgttaccaaagtttgtg

SEQ ID NO: 663 - DNA, 411 bp, Diabrotica virgifera
  Clone ID: LIB149-040-Q1-E1-G8
gttttgaaaactgaaacaacatgaagtccgttggtttgtttgtatttttggcttgcattgcaggtttatatgctattcagctcaaatgtgcccaccaagaactgaacattcctaatgaatggatcgatatgcacaaagaatgtgtgcacaaaatgagaggtcaagttgaagaggaacttaaagcttcaatgcaatacatggccatgggtgcccatttctcgaaagacaccataaacagaccaggttttgctgacttgttcttcgatgctgccagcgaagaaagagaacatgccatcaaattgattcattatttgctcatgagaggagaacttacatccaacctgagcgaactcattaaaagaaatcttgtgccttcagttaccacttgggacaatggtgtaagtgccttaa

SEQ ID NO: 664 - DNA, 411 bp, Diabrotica virgifera
  Clone ID: LIB149-037-Q1-E1-E3
acgcgtccgaagaactgaacattcctaatgaatgggttcaaaagcaacaaagaatgtttgcaacaaaatgagaaggcaagtttaagaaggacttaaagcctcaatgcaatacaagggcaagggtgcccatttctcgaaagacaccataaacagaccaggttttgctgacttgttcttcgatgctgccagcgaagaaagagaacatgccatcaaattgattcattatttgctcatgagaggagaacttacatccaacctgagcgaactcattaaaagaaatcttgtgccttcagttaccacttgggacaatggtgtaagtgccttaaaacaagctcttcagttggaagcttcagttactaagaagatcagagatgttaccaaagtttgtgaagaagctgaatctttcaacga

SEQ ID NO: 665 - DNA, 412 bp, Diabrotica virgifera
  unsure (1)..(412): unsure at all n locations
  Clone ID: LIB149-023-Q1-E1-A4
acccacacgtcggacctgctcaaaccacatgggaaaacggtgtgagtgctctcaaacacgcccttaaactggaagcttcagttaccagaaagatcagagatgtcatccaagtttgcgaagacggctccaacttcaacgattaccatcttgttgattacctgactggcgacttcttggaagaacaataccatggacaacgggacttagctggaaaagtctccaatttacanaagatgatgggagaacacggagcccttggcgaatggctctacgacaagaagctccaaggagcctcttcataatttcattagagttgtaaatatttttagtgcagttttcgagttgacgtccgtgaaactgtgttacgtgatatagtgatagttcttatcattttttcttttttgtaaattgt

SEQ ID NO: 666 - DNA, 416 bp, Diabrotica virgifera
  unsure (1)..(416): unsure at all n locations
  Clone ID: LIB149-044-Q1-E1-F2
accaaacgtccgtttttcgttatttttcattttataacaagttttgaaaactgaaacaacatgaagtccgttggtttgtttgtatttttggcttgcattgcaggtttatatgctattcagctcaaatgtgcccaccangaactgaacattcctaatgaatggatcgatatgcacaaagaatgtgtgcacaaaatgagaggtcaagttgaagaggaacttaaagcttcaatgcaatacatggccatgggtgcccatttctcgaaagacaccataaacagaccaggttttgctgacttgttcttcgatgctgccagcgaagaaagagaacatgccatcaaattgattcattatttgctcatgagaagagaacttacatccaacctgagcgaactcattaaaagaaatcttgtgccttc

SEQ ID NO: 667 - DNA, 373 bp, Diabrotica virgifera
  Clone ID: LIB149-023-Q1-E1-D1
aggaacacatcgcttcaatgcactacatggccatgggtgcccatttctcggaagacaccattaacacaccacgttttgctgacttgttcttccatgctgccagccaagaacgagaacatgcaatcatattgactcattagttgctcatgagaggagagcttacatccaacctgagcgagctcattaagaggaatcttgagccttcagttaccacttgggacaatggagtaactgccttaaaacacgctcttcagttggaagcttcagttactatgaagatcagagatgttaccaaagtttgtcacgaacctgaatcgttcaactattatcagcttgtcgactacctgacacgcgacttcttatgagaacaata

SEQ ID NO: 668 - DNA, 411 bp, Diabrotica virgifera
  unsure (1)..(411): unsure at all n locations
  Clone ID: LIB149-041-Q1-E1-C6
aaaggccgactataacgaacaaaatcttcttatttttcgttatttttcattttataacaagttttgaaaactgaaacaacatgaagtccgttggtttgtttgtatttttggcttgcattgcaggtttatatgctattcagctcaaatgtgcccaccaagaactgaacattcctaatgaatggatcgatatgcacaaagaatgtgtgcacaaaatgagaggtcaagttgaagaggaacttaaagcttcaatgcaatacatggccatgggtgcccatttctcgaaagacaccataaacagaccaggttttgctgacttgttcttcgatgctgccagcgaagaaagagaacatgccatcaaattgattcattatttgctcatgagangagaacttacatccaacctgagcgaac

SEQ ID NO: 669 - DNA, 416 bp, Diabrotica virgifera
  Clone ID: LIB149-033-Q1-E1-B6
agataatttgggcataatcttaaacatactgtaagcgcatgtatatatctatgtatttttaaatccctaaactttttatattatattttattgttatagaggagaacttacatccaacctgagcgaactcattaaaagaaatcttgtgccttcagttaccacttgggacaatggtgtaagtgccttaaaacaagctcttcagttggaagcttcagttactaggaagatcagagatgttaccaaagtttgtgaagaagctgaatctttcaacgattatcatcttgtcgactacctggcaggcgacttcttaggagaacaataccatggacaaagagacctcgccggaaaagtatccgatttacaaaagatgatggcagaacacggagcacttggagaatggctttttgacaagaaac

SEQ ID NO: 670 - DNA, 438 bp, Diabrotica virgifera
  Clone ID: LIB149-009-Q1-E1-B4
ggagaacttacatccaacctgagcgaactcattaaaagaaatcttgtgccttcagttaccacttgggacaatggtgtaagtgccttaaaacaagctcttcagttggaagcttcagttactaggaagatcagagatgttaccaaagtttgtgaagaagctgaatctttcaacgattatcatcttgtcgactacctggcaggcgacttcttaggagaacaataccatggacaaagagacctcgccggaaaagtatccgatttacaaaagatgatggcagaacacggagcacttggagaatggctttttgacaagaaacttcaaaataaagccatcgtataaatgttatagttctatacttaagtatttaaactagtttttcttttaccaacataaaactccgtattagatcataagtctatcttttcgtaaatcttagtg

SEQ ID NO: 671 - DNA, 407 bp, Diabrotica virgifera
  Clone ID: LIB149-046-Q1-E1-C7
aaaaaggccgactataacgaataaaatcttcttatttttcgttatttttcattttataacaggttttgaaaactgaaacaacatgaagtccgttggtttgtttgtatttttggcttgcattgcaggtttatatgctattcagctgaaatgtgcccaccaagaactgaacattcctaatgaatggatcgatatgcacaaagaatgtgtgcacaaaatgagaggtcaagttgaagaggaacttaaagcttcaatgcaatacatggccatgggtgcccatttctcgaaagagaccataaacagaccaggttttgctgacttgttcttcgatgctgccagcgaagaaagagaacatgccatcaaattgattcattatttgctcatgaaacgagaacttacatccaacctga

SEQ ID NO: 672 - DNA, 542 bp, Diabrotica virgifera
  unsure (1)..(542): unsure at all n locations
  Clone ID: pGUT3387
cttacatccaacctgagcgaactcattaaaagaaatcttgtgccttcagttaccacttgggacaatggtgtaagtgccttaaaacaagctcttcagttggaagcttcagttactaggaagatcagagatgttaccaaagtttgtgaagaagctgaatctttcaacgattatcatcttgtcgactacctggcaggcgacttcttaggagaacaataccatggacaaagagacctcgccggaaaagtatccgatttacaaaagatgatggcagaacacggagcacttggagaatggctttttgacaagaaacttcaaaataaagccatcgtataaatgttatagttctatacttaagtatttaaactagtttttcttttaccaacataaaactccgtattagatcataagtctatcttttcgtaaatcttagtgttaccattatgtattattaaaaaaaagtttcggaattataacaaaaataaagacaaattttattgaaataacaaaaaanaaaaaaaaaaaaaaaaaaaaactgggggggg

SEQ ID NO: 673 - DNA, 402 bp, Diabrotica virgifera
  Clone ID: LIB149-005-Q1-E1-B10
agagcgaaatcattaaaagaaatcttgtgccttcagttaccacttgggacaatggtgtaagtgccttaaaacaagctcttcagttggaagcttcagttactaggaagatcagagatgttaccaaagtttgtgaagaagctgaatctttcaacgattatcatcttgtcgactacctggcaggcgacttcttaggagaacaataccatggacaaagagacctcgccggaaaagtatccgatttacaaaagatgatggcagaacacggagcacttggagaatggctttttgacaagaaacttcaaaataaagccatcgtataaatgttatagttctatacttaagtatttaaactagtttttcttttaccaacataaaactccgtattagatcataagtcgatct

SEQ ID NO: 674 - DNA, 409 bp, Diabrotica virgifera
  Clone ID: pGUT2729
aacgaataaaatcttcttatttttcgttatttttcattttataacaagttttgaaaactgaaacaacatgaagtccgttggtttgtttgtatttttggcttgcattgcaggtttatatgctattcagctgaaatgtgcccaccaagaactgaacattcctaatgaatggatcgatatgcacaaagaatgtgtgcacaaaatgagaggtcaagttgaagaggaacttaaagcttcaatgcaatacatggccatgggtgcccatttctcgaaagacaccataaacagaccaggttttgctgacttgttctttgatgctgccagctaagaaagagaacatgccatcatattgattcattatttgctcatgtgaggagaacttatatttaatctgtgcgaactttatttaaag

SEQ ID NO: 675 - DNA, 372 bp, Diabrotica virgifera
  unsure (1)..(372): unsure at all n locations
  Clone ID: pGUT944
gccgactataacggacaaaatcttcttatttttcgttatttttcattttataacaagttttgaaaactgaaacaacatgaagtccgttagtttgtttgtatttttggcttgcattgcaggtttatatgctattcagctcanatgtgcccaccaagaactggacattcctaatgaatggatcgatatgcacaaaaactgtgtgaacaaaatgagatgataagttgaagatgatcttaaagcttcaatgcaatacatggccatgggtgcccatttctcgaaagataccataaacagatcaggttttgcggacttgttcttcgatgctgccagcgaagatagataacatgccatcaaattgattcattatttgct

SEQ ID NO: 676 - DNA, 418 bp, Diabrotica virgifera
  Clone ID: pGUT3392
cttacatacaacctgagcgaactcagttttaaaaatctggtgccttcaaataccagggggggacaatggtgtaagttccttaaaacaagctcttcagttggaagcttcagttactaggaagatcagagatgttaccaaagtttgtgaagaagctgaatctttcaacgattatcatcttgtcgactacctggcaggcgacttcttaggagaacaataccatggacaaagagacctcgccggaaaagtatccgatttactaaacatgacggcatgaacactgagcacttggagaatggctttttgacaagaaacttcaaaataaagccatcggataaatgttatagatctatacttaagtatttaaactagttttttttttaccaacataaaactccgtattaaatcataagtctatttt

SEQ ID NO: 677 - DNA, 616 bp, Diabrotica virgifera
  Clone ID: pGUT2417
gccagctggagaagctttacttcagatgatagccattcacttaccatcacctgtggtagcacagaaatacagaatggaaatgttgtacgaaggacctcatgatgatgaagcagctgttggtatcaagaactgtgatccaaatgcacctcttatgatgtatgtatctaaaatggtacccacttctgacaaaggtcgtttctatgcttttggtcgtgtattctctggtaaagtagctactggtatgaaagcccgtatcatgggacccaactacacccctggcaaaaaggaagatttgtatgaaaaggctatccaacgtaccattctcatgatgggtcgttatgttgaagctattgaagatgtcccatctggtaacatctgtggtttggttggtgttgatcaattcttggttaagactggtaccattaccactttcaaggatgcccacaacttgaaggtcatgaaattcagtgtatctcctgtagtacgtgttgctgttgaacctaagaaccctgctgatttgccaaaacttgtagaaagtttgaaacgtttgaccaaatccgatcctatggtccaatgtatcattgaagaatctggtgagcacatcattgcttggggg

SEQ ID NO: 678 - DNA, 417 bp, Diabrotica virgifera
  Clone ID: LIB3026-034-Q1-E1-G10
atgggtcgttatgttgaagctattgaagatgtcccatctggtaacatctgtggtttggttggtgttgatcaattcttggttaagactggtaccattaccactttcaaggatgcccacaacttgaaggtcatgaaattcagtgtatctcctgtagtacgtgttgctgttgaacctaagaaccctgctgatttgccaaaacttgtagaaggtttgaaacgtttgaccaaatccgatcctatggtccaatgtatcattgaagaatctggtgagcacatcattgctggtgccggagaattgcatcttgaaatttgccttaaggatcttgaagaagatcatgcctgcattcccattaagaaatctgaccctgttgtatcctaccgtgagacagtaagtgaagagtctgatcagatgtgcctc

SEQ ID NO: 679 - DNA, 412 bp, Diabrotica virgifera
  Clone ID: LIB149-005-Q1-E1-E10
agaaaactagagaggtgttagattcaacatttatgatgttaccttacacgctgatgctatccatcgtggaagtggtcaaatcattccaacaacccgtaggtgtttgtatgcttgtttaatgacagctgcacccacacttatggaacctatctacaagtgtgaaattatgtgtcccgaagttgctgttggtggtatttatggtgtattgaacagaagacgtggtcacgtatttgaagaaactcaaatcgctggtacacctatgttcttagtaaaagcttacttacctgtaaacgaatcattcggtttcactgctgatttacgttccaacactggaggtcaggccttcccacaatcagtcttcgatcactggcaaatcttacctggtgacccaatggaacccagtaccaaaccc

SEQ ID NO: 680 - DNA, 411 bp, Diabrotica virgifera
  Clone ID: LIB149-039-Q1-E1-A4
ttaaaaaatctgaccctgttgtatcctaccgtgagacagtaagtgaagagtctgatcagatgtgcctctcaaaatcacccaacaaacacaacagattgttcatgaaagcttgtcctatgcctgatggacttgctgaagatattgatgatggtaaagttaacccacgtgatgacttcaaagtccgtgcccgttatcttactgagaaatatgactatgatataactgaagcccgtaagatctggtgctttggacctgatggtactggacccaacatccttgttgattgtactaagggagtgcaatatcttaatgaaatcaaagactctgtggtagctggtttccaatgggcaaccaaagaaggtgtcttgtctgaagaaaacttgagaagtgttagattcaacatttatgatg

SEQ ID NO: 681 - DNA, 391 bp, Diabrotica virgifera
  Clone ID: LIB150-007-Q1-E1-F12
agtaccaataccactttcaaggatgcccacaacttgaaggtcatgaaattcagtgtatctcctgtagtacgtgttgctgttgaacctaagaaccctgctgatttgccaaaacttgtagaaggtttgaaacgtttgaccaaatccgatcctatggtccaatgtatcattgaagaatctggtgagcacatcattgctggtgccggagaattgcatcttgaaatttgccttaaggatcttgaagaagatcatgcctgcattcccattaagaaatctgaccctgttgtatcctaccgtgagacagtaagtgaagagtctgatcagatgtgcctctcaaaatcacccaacagacacaacagattgttcatgaaagcttgtcctatgcctgaaggac

SEQ ID NO: 682 - DNA, 399 bp, Diabrotica virgifera
  Clone ID: LIB149-031-Q1-E1-E10
acccacgcgtccgcgctgatgctatccatcgtggaggtggtcaaatcattccaacaacccgtaggtgtttgtatgcttgtttaatgacagctgcacccagacttatggaacctatctacaagtgtgaaattatgtgtcccgaagttgctgttggtggtatttatggtgtattgaacagaagacgtggtcacgtatttgaagaagctcaaatcgctggtacacctatgttcttagtaaaagcttacttacctgtaaacgaatcattcggtttcactgctgatttacgttccaacactggaggtcaggccttcccacaatcagtcttcgattactggcaaatcttacctggtgacccaatggaacccagtaccaaaccctatggaattgtgcaggacacac

SEQ ID NO: 683 - DNA, 427 bp, Diabrotica virgifera
  Clone ID: LIB150-037-Q1-E1-A2
acggacgaatgggttgctgttgaacctaggaaccctgctgatttgccacaacttgtagaatgtttgatacgtttgaccaaatccgatcctatggtccaatgtatcattgaagaatctggtgagcacatcattgctggtgccggagaattgcatcttgaaatttgccttaaggatcttgaagaagatcatgcctgcattcccattaagaaatctgaccctgttgtaacctaccgtgagacagtaagtgaagagtctgatcagatgtgcctcacaatatcacccaacacacacaacagattgttcatgaaagcatgtcctatgcctgatggacttgctgaagatattgatgatggtaaagttaacccacgtgatgacttcatagtccgtgcacgttatcttactgagagatatgactatgatataactg

SEQ ID NO: 684 - DNA, 401 bp, Diabrotica virgifera
  Clone ID: LIB150-028-Q1-E1-E10
gtgccctcttagaattacagttggaatctgaagaactttaccagactttccaacgtattgttgaaaacgtcaacgtcattattgccacctacaacgatgattcaggtccaatgggtgaagtcagagttgaccccagcaaaggttcagttggttttggatcaggtctccacggatgggctttcactctcaaacaattctctgaaatgtatgccgagaaattcaagattgatgtagttaaacgaatgaaccgtttgtggggtgagaacttcttcaaccccaaaaccaagaaatggtccaaacaaaaggatgatgataacaaacgttcattctgtatgtacatcttagatccaatctacaagatttttgactccatcatgaactacaagaaagaagaatatgaa

SEQ ID NO: 685 - DNA, 368 bp, Diabrotica virgifera
  Clone ID: LIB149-036-Q1-E1-A10
tataactgaagcccgtaagatctggtgctttggacctgatggtactggacccaacatccttgttgattgtactaagggagtgcaatatcttaatgaaatcaaagactctgtggtagctggtttccaatgggcaaccaaagaaggtgtcttgtctgaagaaaacttgagaggtgttagattcaacatttatgatgttaccttacacgctgatgctatccatcgtggaggtggtcaaatcattccaacaacccgtaggtgtttgtatgcttgtttaatgacagctgcacccagacttatggaacctatctacaagtgtgaaattatgtgtcccgaagttgctgttggtggtatttatggtgtactgaaca

SEQ ID NO: 686 - DNA, 401 bp, Diabrotica virgifera
  unsure (1)..(401): unsure at all n locations
  Clone ID: pGUT939
atcttaatgaaatcaaagactctgtggtagctggtttccaatgggcaaccaaagaaggtgtcttgtctgaagaaaacttgagaggtgttagattcaacatttatgatgttaccttacacgctgatgctatccatcgtggatgtggtcaaatcattccaacaacccgtaggtgtttgtatgcttgtttaatgacagctgcacccaaacttatggaacctatctacaagtgtgaaattatgtgtcctgaagttgctgttggtggtatttatggtgtattgaacagaagacgtggccacgtatttgaagaagctcanatcgctggtacacctatgttcttagtanaagcttacttacctgtaaacgattcattccgtntcactgctgatttacgttccacactg

SEQ ID NO: 687 - DNA, 390 bp, Diabrotica virgifera
  Clone ID: LIB149-034-Q1-E1-B6
attttattcatgaacaagatggaccgtgccctcttagaattacagttggaatctgaagaactttaccagactttccaacgtattgttgaaaacgtcaacgtcattattgccacctacaacgatgattcaggtccaatgggtgaagtcagagttgaccccagcaaaggttcagttggttttggatcaggtctccacggatgggctttcactctcaaacaattctctgaaatgtatgccgagaaattcaagattgatgtagttaaactaatgaaccgtttgtggggtgagaacttcttcaaccccaaaaccaagaaatggtccaaacaaaaggatgatgataacaaacgttcattctgtatgtacatcttagattcaatctacaagaatttt

SEQ ID NO: 688 - DNA, 445 bp, Diabrotica virgifera
  Clone ID: LIB150-017-Q1-E1-C2
cacacgcatccgcccacgcgtccgcaaacatccaaaatggtgaacttcaccgtagatgaaattagggccatgatggacaaaaagaggaacatccgtaacatgtccgtcattgcccatgtggaccatggtaaatctacattaacagattctctagtatcaaaagctggtattattgctggtgccaaagctggagaaaccagattcacagacacaaggaaagatgaacaggaacgttgtattaccatcaaatcaactgccatatctatgttcttcgagttagatgataaagatcttgtgttcatcaccaacgctgaccaacgtgagaaagatgtgaaaggtttcttgattaaccttattgactctcctggacacgttgatttctcatcagaagtaacagctgcccttcgtgtcactgatggtgcccttgtagtagtagattgtgtat

SEQ ID NO: 689 - DNA, 382 bp, Diabrotica virgifera
  Clone ID: LIB150-026-Q1-E1-C7
acaatcctctataatgagtcgtggtaagaacttcttcaaccccaaaaccaagaaatggtccaaacaaaaggatgatgataacaaacgttcattctgtatgtacatcttagatccaatctacaagatttttgactccatcatgaactacaagaaagaagaatatgaagcactccttccaaaattgggtattgccttaaaacatgaagataaagacaaagatggtaaacaattattgaaagtagttatgcgtacctggttgccagctggagaagctttacttcagatgatagccattcacttaccatcacctgtggtagcacagaaatacagaatggaaatgttgtacgaaggacctcatgatgatgaagcagctgttggtaac

SEQ ID NO: 690 - DNA, 432 bp, Diabrotica virgifera
  Clone ID: LIB150-018-Q1-E1-A5
cacacgcgtccgcaaaagctggtattattgctggtgccaaagctggagaaaccagattcacagacacaaggaaagatgaacaggaacgttgtattaccatcaaatcaactgccatatctatgttcttcgagttagatgataaagatcttgtgttcatcaccaacgctgaccaacgtgagaaagatgtgaaaggtttcttgattaaccttattgactctcctggacacgttgatttctcatcagaagtaacagctgcccttcgtgtcactgatggtgcccttgtagtagtagattgtgtatctggtgtatgtgtacagactgaaactgtactccgtcaagctattgcagaacgtattaagccaattttattcatgaacaagatggaccgtgccctcttagaattacagttggaatctgaagaactttaccaga

SEQ ID NO: 691 - DNA, 388 bp, Diabrotica virgifera
  Clone ID: LIB149-039-Q1-E1-B7
tcgagttagatgataaagatcttgtgttcatcaccaacgctgaccaacgtgagaaagatgtgaaaggtttcttgattaaccttattgactctcctggacacgttgatttctcatcagaagtaacagctgcccttcgtgtcactgatggtgcccttgtagtagtagattgtgtatctggtgtatgtgtacagactgaaactgtactccgtcaagctattgcagaacgtattaagccaattttattcatgaacaagatggaccgtgccctcttagaattacagttggaatctgaagaactttaccagactttccaacgtattgttgaaaacgtcaacgtcattattgccacctacaacgatgattcaggtccaatgggtgaagtcagagt

SEQ ID NO: 692 - DNA, 439 bp, Diabrotica virgifera
  Clone ID: LIB150-029-Q1-E1-F11
aggaaatcaagaatgaagtagttaaactaatgaaccgtttgtggggtgagaacttcctcaaccccaaaaccaagaaatggtccaaacaaaagggtgatgataacaaacgttcaatccgtatgtacatcctagattcaatctacaagatttttggctccaaccatgaactacaagaaagaagaattatgaaccactcctccaaaaattggttatggccttaaacaatgagattaaggccaagaatggaaaacatttattgaaagtatttatccgtacctggttgcaagctggaaaagctttacttcagatgatagccattcacttaccatcacctgtggtagcacagaaattcagaatggaaatgttgtacgaaggacctcatgatgatgaagcagctgttggtatcaagaactgtgatccaaatgcacctcttatgatg

SEQ ID NO: 693 - DNA, 314 bp, Diabrotica virgifera
  Clone ID: pGUT2164
ctcctgcccaatttcgcacccacgggacgagggaagggttcttggataaacctgatgactctcctggacacgttgatttctcatcagaagtaacagctgcccttcgtgtcactgatggtgcccttgtagtagtagattgtgtatctggtgtatgtgtacagactgaaactgtactccgtcaagctattgcagaacgtattaagccaattttattcatgaacaagatggaccgtgccctcttagaattacagttggaatctgaagaactttaccagactttccaacgtattgttgaaaacgtcctcgtgccgaat

SEQ ID NO: 694 - DNA, 402 bp, Diabrotica virgifera
  Clone ID: LIB150-006-Q1-E1-C6
agcgccatccttggtgtatcgtgatttttggttgtgcttggttatcatcgtcagcacatccaattatggtgaatcttcactcgtatgatgaagattagcggttcatgtatggtacaatgtagaggaacatccgtaatatgtccgtcattgcccatgtcgatcaaggtaaatctacattaacagattctctagtatcaacagctggtattaatgctggtgccatatctggagaaaccagattcacagccagaagagatatgaacatgaacgttgtattaccatcaattcaactgctatatctatgttcttcgagttagatgataaagatcgtgtgttcatcaccaacgtctaccattgtgtgaaagatcttaaaggtttcttgatctaaccttattgactctc

SEQ ID NO: 695 - DNA, 369 bp, Diabrotica virgifera
  Clone ID: LIB150-018-Q1-E1-A3
gatgtcaaattaatagatatacaaatatctggactgttaacaaaaatatatataacaaacataaaatattagtcagattatttagtttatttcatttctagtgttgccatcaatttgagagaactgaaaacttatcagaataaaaatatcaaaaatacaattaactataaaaaccgttgagtaaattgaaataattttattaaataatctgtacataaattaagtttcttagttgtttataatttatccagatattgtgccaggtctggaagtccttctttaagaccctttcttttacgtgtgtcctgcacaattccataaggtttggtactgggttccattgggtcaccaggtaagatttgccagtga

SEQ ID NO: 696 - DNA, 433 bp, Diabrotica virgifera
  Clone ID: LIB149-008-Q1-E1-E3
cccacgcgtccgcccacgcgtccgcccacgcgtccgggagactgtttggagctgtttcaccagtaaaagatcaagccatatgcggatcttgctggtcttttggaaccgtcggcacccttgaaggatcactttttttgaaaaatggtggtcggttggtacaattatcccagcaagctttggtggattgttcttggggctttggtaacaatggttgtgatggtggggaggattggagggcttaccaatggatccaaaaacacggtggaataccaatcgatagtcattatggaggctacaagggagaggatggattttgcgcagctgatgaggtggagaagacagctaaaattactggttgggtaaacgtaaccgaaaacgatgaaaatgctcttcgtttggcactcgtgaagcaaagaccaattagtgttagcat

SEQ ID NO: 697 - DNA, 373 bp, Diabrotica virgifera
  unsure (1)..(373): unsure at all n locations
  Clone ID: LIB149-004-Q1-E1-E4
agcagtttcaccagtaaaagatcaagccatatgcggatcttgctggtcttttggaaccgtcggcacccttgaaggatcactttttttgaaaaatggtggtcggttggtacaattatcccagcaagctttggtggattgttcttggggctttggtaacaatggttgtgatggtggggaggattggagggcttaccaatggatccaaaaacacggtggaataccaatcgatagtcattatggaggctacaagggaaaggatggattttgcgcagctgatgaggtggagaagatagctaaaattactggttgggtaaacgtaaccganaacgatgaaaatgcccttcgtttggcactcgttaagcaaggaccaatt

SEQ ID NO: 698 - DNA, 506 bp, Diabrotica virgifera
  Clone ID: pGUT2227
catggccgaatacattcgtcccgaaaaaagtgagcacgtggactcaagctttggcgattttataaataaccacaacaaaaattacgcagacacaaaagaacacgtttttagaaaagaggttttccgtcaaaacgtcaggttcatcgaatctgtcaaccgacaaaataaaggatatagtctagcaattaatcatcttgctgataagactgacaaggaaattaaatacctgaatggaagactttcaagtggaggcaacaatggaggacaacctttcccttacacagatgctgataccgatgatttacctgatcaatatgactggagactggttggagctgtttcaccagtaaaagatcaagccatatgcggatcttgctggtcttttggaaccgtcgggacccttgaaggatcactctttttgaaaaacgccccctccccggtccaaattttccaacaagctttgggggattggacctggggctttggttacaatgggtgtgattggt

SEQ ID NO: 699 - DNA, 391 bp, Diabrotica virgifera
  Clone ID: LIB149-045-Q1-E1-D1
agtggactcaaactttggcgattttataaataaccacaacaaaaattacgcagacacaaaagaacacgcatttagaaaagaggttttccgtcaaaacgtcaggttcatcgaggctgtcaaccgacaaaataaaggatatagtctagcaattaatcatcttgctgataagactgacaaggaaattaaatacctgaatggaagactttcaagtggaggcaacaatggaggacaacctttcccttacacagatgctgataccgatgatttacctgatcaatatgactggagactgtttggagctgtttcaccagtaaaagatcaagccatatgcggatcttgctggtcttttggaaccgtcggcacccttgaaggatcactttttttgaaaaat

SEQ ID NO: 700 - DNA, 423 bp, Diabrotica virgifera
  Clone ID: LIB149-007-Q1-E1-A8
aaaaactgtccagttagaaaaagaaaacgaatacactctatgggttgtccgagatgagcatggtaaagctattccagttaaatatgatatgagaggatacaattcgttattgggaagccactacgatcattactatttgctatacacatcgaagtcttacaggactcacaagattgatccctccgtttttgaagtagaaactaatagtgaatgcagaagttttcctggacccggaaatcaacatgttcacatcatgaaccccatggccgaatacattcgtcccgaaaaaagtgagcacgtggactcaagctttggcgattttataaataaccacaacataaattacgcagacacaaaagaacacgtttttagaaaagaggttttccgtcaaaacgtcaggttcatcgaatctgtcaaccgaca

SEQ ID NO: 701 - DNA, 403 bp, Diabrotica virgifera
  Clone ID: LIB149-023-Q1-E1-F4
aaaaattaacaacttgaccccaacctttgccaatttaataaataacaacaccaaaaattacccaaccacaaaaaaccactttttaaaaaaaaaggtttcccttcaaaacgtcaggttcatcgaatctgtcaaccgacaaaatagaggatatagtctagcaattaatcatcttgctgataagactgacaaggaaattaaatacctgaatggaagactttcaagtggaggcaacaatggaggacaacctttcccttacacagatgctgataccgatgatttacctgatcaatatgactggagactgtttggagctgtttcaccagtaaaagatcaagccatatgcggatcttgctggtcttttggaaccgtcggcacccttgaaggatcactttttttgaaaaat

SEQ ID NO: 702 - DNA, 433 bp, Diabrotica virgifera
  Clone ID: LIB149-009-Q1-E1-D5
atgatttcgaagttcaccctggttttcttggtttgcattgtcgcatcagcgataggcgatccaccagttccagaatggagtgacacttatagcgtagaaggaactatccatttgccttatgcagaaatagtagagcctttccatgcttggtatgatggaaaatctaaaaattcgcgcattgattactacaatgggacggctaagacataccaacttggaggaaatggaaatggtgtccaactgaaagtaattccattcactacagaggaggtcctaaaccaaataacgtgcttccagatcaatggaactgaagacgatccagtgactcctcaatcgattttgccagatttagaaggatttgaatatcaaggcatacaggaatatggagatagagaactagaggtatggtttctaaaaactgtccagttagaaa

SEQ ID NO: 703 - DNA, 428 bp, Diabrotica virgifera
  Clone ID: LIB150-018-Q1-E1-G5
gtgagatgatttcgaagttcaccctggttttcttggtttgcattgtcgcaccagcgataggtgatccaccagttccagaatggagtgacacttatagcgtagaaggaactatccatttgccttatgcagaaatagtagagcctttccatgcttggtatgatggaaaatctaaaaattcgcgcattgattactacaatgggacggctaagacataccaacttggatgaaatggaaatggtgtccaactgaaagtagttccattcactacagaggaggtcctaaaccaaataacgtgcttccagatcaatggaactgaagacgatccagtgactcctcaatcgattttgccagatttagaaggatttgaatatcaaggcatacacgagtatggagatagagaactagaggtatggtttctaaaaactgtc

SEQ ID NO: 704 - DNA, 371 bp, Diabrotica virgifera
  Clone ID: LIB149-040-Q1-E1-G12
gtgagatgatttcgaagttcaccctggttttcttggtttgcattgtcgcatcagcgataggcgatccaccagttccagaatggagtgacacttatagcgtagaaggaactatccatttgccttatgcagaaatagtagagcctttccatgcttggtatgatggaaaatctaaaaattcgcgcattgattactacaatgggacggctaagacataccaacttggaggaaatggaaatggtgtccaactgaaagtagttccattcactacagaggaggtcctaaaccaaataacgtgcttccagatcaatggaactgaagacgatccagtgactcctcaatcgattttgccagatttagaagggattgaatat

SEQ ID NO: 705 - DNA, 361 bp, Diabrotica virgifera
  Clone ID: LIB149-033-Q1-E1-F9
acccacgcgtccgatgatttcgaagttcaccctggttttcttggtttgcattgtcgcaccagcgataggtgatccaccagttccagaatggagtgacacttatagcgtagaaggaactatccatttgccttatgcagaaatagtagagcctttccatgcttggtatgatggaaaatctaaaaattcgcgcattgattactacaatgggacggctaagacataccaacttggaggaaatggaaatggtgtccaactgaaagtagttccattcactacagaggaggtcctaaaccaaataacgtgcttccagatcaatggaactgaagacgatccagtgactcctcaatcgattttgccagat

SEQ ID NO: 706 - DNA, 391 bp, Diabrotica virgifera
  unsure (1)..(391): unsure at all n locations
  Clone ID: LIB149-044-Q1-E1-C12
agaagatcaccctggttttcttggtttgcattgtcgcatcagcgataggcgatccaccagttccagaatggagtgacacttatagcgtagaaggaactatccatttgcgttatgcagaaatagtagagcctttccatgcttggtatgatggaaaatctaaaaattcgcgcattgattactacaatgggacggctaagacataccaacttggaggaaatggaaatggtgtccaactgaaagtaattccattcactacagangaggtcctaaaccaaattacgtgcttccagatcaatggaactgaagacgatccagtgactcctcaatcgattttgccagatttagaaggatttgaatatcaaggcatacangagtatggagatagagaact

SEQ ID NO: 707 - DNA, 432 bp, Diabrotica virgifera
  unsure (1)..(432): unsure at all n locations
  Clone ID: LIB149-015-Q1-E1-G8
cacacgcgtccgcgatccagtgactcctcaatcgattttgccagatttagaaggatttgaatatcaaggcatacaggagtatggagatagagaactagaggtatggtttctaaaaactgtccagttagaaaaagaaaacgaatacactctatgggttgtccgagacgagcatggtaaagctattccagttaaatatgatatgagaggatacaattcgttattgggaagccactacgatcattactatttgctatacacatggaagtcttacaggactcataagattgatccctccgtttttgaagtagaaactaatagtgaatgcagaagttttcctggacccggaaatcaacatgttcacatcatgaaccccatggccgaatacattcgtcccgaanaaagtgagcacgtggactcaaactttggcgaatt

SEQ ID NO: 708 - DNA, 390 bp, Diabrotica virgifera
  Clone ID: LIB149-048-Q1-E1-A1
aaataacgtgcttccagatcaatggaactgaagacgatccagtgactcctcaatcgattttgccagatttagaaggatttgaatatcaaggcatacaggagtatggagatagagaactagaggtatggtttctaaaaactgtccagttagaaaaagaaaacgaatacactctatgggttgtccgagatgagcatggtaaagctattccagttaaatatgatatgagaggatacaattcgttattgggaagccactacgatcattactatttgctatacacatcgaagtcttacaggactcacaagattgatccctccgtttttgaagtagaaactaatagtgaatgcagaagttttcctgaacccggaaatcaacatgttcacatcatga

SEQ ID NO: 709 - DNA, 413 bp, Diabrotica virgifera
  Clone ID: LIB149-032-Q1-E1-A10
acccacgcgtccgagatgatttcgaagttcaccctggttttcttggtttgcattgtctcatcatcgataggcgatccaccagttccagaatggagtgacacttatagcgtataaggaactatccatttgccttatgcagaaatagtatagcctttccatgcttggtatgatggaaaatctaaaaattcgcgcattgattactacaatgggacggctaagacataccaacttggaggaaatggaaatggtgtccaactgaaagtagttccattcactacagatgaggtcctaaaccatataacgtgcttccagatcaatggaactgaagacgatccagtgactcctcaatcgagtttgccagatttagcaggatttgaatatcaaggcatacatgagtatggagatagagaact

SEQ ID NO: 710 - DNA, 357 bp, Diabrotica virgifera
  unsure (1)..(357): unsure at all n locations
  Clone ID: pGUT3052
gatcactttttttgaaaaatggtggtcggttggtacaattatcccacaagctttggtggattgttcttggggctttggtaacaatggttgtgatggtggggaggattggagggcttaccaatggatccaaaaacacggtggaataccaatcgatagtcattatggaggctacaagggagaggatggattttgcgcagctgatgaggtggagaagacagctaannatactggttgggtaaacgtaacccgaaaacgatgaaaatgctcttcgtttggcactcgtgaagcaagggaccaatagtgttagcatcgacgcttgcaaaaatctttcagttttattcacatggagtctattac

SEQ ID NO: 711 - DNA, 417 bp, Diabrotica virgifera
  Clone ID: LIB150-046-Q1-E1-F12
cccacgcgtccggttagaagttgccttatggttaatggcacggaagaaattagcattactccgcaagccattttgcccgatttgactggatttaaatctgatggaaaagaagtagtaaatggatttgaaactgaaaaatggaccttagttaatatagttggacacaaagtaaatagatattccatgtggatcaaagatggaggaataccagtgagatatgaaatgaaaggatttaattctttattgggtagccactacgatcactattatctggactattatacttacgacccaagtcccatttcagatgatacatttagagttcctgccgatctagaatgcagcgccttccctgggcctggagacaaacatatttatacttttaacccaatggctgagtttatcaagacagaaaag

SEQ ID NO: 712 - DNA, 229 bp, Diabrotica virgifera
  Clone ID: pGUT3764
gttcaatcgacggcgaaaactattggttaatcaaaaacagttggtctacttattggggaaatgacggctacatcttgatgtcttccagaaacaacaactgcggagtcatgacggcggctacctatgtaactatgtagatatttaacataacatccatatttaaataagaaaataagaaatccaatttatttatattgttaatatttatcaaataaattttcttcataat

SEQ ID NO: 713 - DNA, 281 bp, Diabrotica virgifera
  unsure (1)..(281): unsure at all n locations
  Clone ID: pGUT929
cagttgcattgtcgcatcagcgataggcgatccaccagttccagaatggagtgacacttatagcgtagaaagatctatccatttgccttatgcagaaatagtagatcctttccatgcttggtatgatggaaaatctacaaattcgcgcattgattactactatgggacggctaaaatattccaacttggatgaaatggatatggtgtccaactganagtagtgccattcactacagatgatgtcctaaaccagataacgtgcttccagatctatggatctg

SEQ ID NO: 714 - DNA, 410 bp, Diabrotica virgifera
  Clone ID: LIB149-010-Q1-E1-C7
gccgaacaagaagacaaccaaaggatcatggaattcttcggaatcaaaaagaacactgtaccagcagctcgtctcatcaaattagaagaagatatggccaaatacaaaccagcatctgacgatttgaccgccgataacatcaagaacttcgtccaagacttcttggatggtaaacttaagcaacatctattgaaccaagaattgcctgaagattgggacaaaaaccctgtcaaggtgttggttagcagcaatttcgatagtgtcgctcttgacagctcaaaggacgtcctcgtagaattctacgctccatggtgcggtcattgcaagaacctcgcccccatctacgacaaactcggagaacatttcaaggacaacagcgacgttgttatcgccaaaatggactccacgca

SEQ ID NO: 715 - DNA, 429 bp, Diabrotica virgifera
  Clone ID: LIB3026-015-Q1-E1-E3
gaagatttgaccgccgataacatcaagaacttcgtccaagacttcttggatggtaaacttaagcaacatctattgaaccaagaattgcctgaagattgggacaaaaaccctgtcaaggtattggttagcagcaatttcgatagtgtcgctcttgacagctcaaaggacgtcctcgtagaattctacgctccatggtgcggtcattgcaagaacctcgcccccatctacgacaaactcggagaacatttcaaggacaacagcgacgttgttatcgccaaaatggactccaccgcaaacgaattagaacacaccaaagttgttaactacccaactatcaaattgtacaccaaaggcagtaacgaagccgttgaatacctcggcccaagaacattcgaaggtctttcaaaattcgtagaatctggcggtaaa

SEQ ID NO: 716 - DNA, 424 bp, Diabrotica virgifera
  Clone ID: LIB150-047-Q1-E1-G11
gaaacggcccaaaagatcttcggtggtgaaattaagagccatttgttattgttcttgaacagagaagacaaagacgtatatgaaaccatttccgaagccgccagatccgtagctaagccattcaaagaagaggttcttttcgtcagcatcgatgccgaacaagaagacaaccaaaggatcatggaattcttcggaatcaaaaagaacactgtaccagcagctcgtctcatcaaattagaagaagatatggccaaatacaaaccagcatctgacgatttgaccgccgataacatcaagaacttcgtccaagacttcttggatggtaaacttaagcaacatctattgaaccaagaattgcctgaagattgggacaaaaaccctgtcaaggtattggttagcagcaatttcgatagtgtcgctcttg

SEQ ID NO: 717 - DNA, 413 bp, Diabrotica virgifera
  Clone ID: LIB149-004-Q1-E1-F5
agcttacctttgttggtagaattcaaccatgaaacggcccaaaagatcttcggtggtgaaattaagagccatttgttattgttcttgaacagagaagacaaagacgtatatgaaaccatttccgaagccgccagatccgtagctaagccattcaaagaagaggttcttttcgtcagcatcgatgccgaacaagaagacaaccaaaggatcatggaattcttcggaatcaaaaagaacactgtaccagcagctcgtctcatcaaattagaagaagatatggccaaatacaaaccagcatctgacgatttgaccgccgataacatcaagaacttcgtccaagacttcttggatggtaaacttaagcaacatctattgaaccaagaattgcctgaagattgggacaaaaaccctgt

SEQ ID NO: 718 - DNA, 408 bp, Diabrotica virgifera
  Clone ID: LIB150-002-Q1-E1-C6
gtgaatattttcaatttagtttcatatatcatttgtaggtttaacaggaaaattcgtcaatatgttccggaccggttttctgctggtattctttttgaatgctgtttttgccgctgaagatatcaaaaccgaagatggagttttggtcctcaccaaagacaatttccaaggagtcctcaacgataatgagttcgtcttagtagaattttatgctccatggtgtggtcactgtaaagccctagcccctgaatatgctaaggctgcccagcaactagaacaacagggatctaacatcaaacttggtaaagtcgatgccacagaagaaggcagtcttgctgagcaattcaacattagaggataccccactctgaaattcttcagaaatggcagtccaattgaatactcagg

SEQ ID NO: 719 - DNA, 377 bp, Diabrotica virgifera
  Clone ID: LIB149-005-Q1-E1-B3
agataatttgtaggtttaacaggaaaattcgtcaatatgttccggaccggttttctgctggtattctttttgaatgccgtttttgccgctgaagatatcaaaaccgaagatggagttttggtcctcaccaaagacaatttccaaggagtcctcaacgataatgagttcgtcttagtagaattttatgctccatggtgtggtcactgtaaagccctagcccctgaatatgctaaggctgcccagcaactagaacaacagggatctaacatcaaacttggtaaagtcgatgccacagaagaaggcagtcttgctgagcaattcaacattagaggataccccactctgaaattcatcagaaatggcagtccaattgaata

SEQ ID NO: 720 - DNA, 430 bp, Diabrotica virgifera
  Clone ID: LIB149-008-Q1-E1-D6
cacacgcgtccggccacgttgatgtgtgaatattttcaatttagtttcatatatcatttgtaggtttaacaggaaaattcgtcaatatgttccggaccggttttctgctggtattctttttgaatgctgtttttgccgctgaagatatcaaaaccgaagatggagttttggtcctcaccaaagacaatttccaaggagtcctcaacgataatgagttcgtcatagtacaattttatgctccatggtgtggtcactgtaaagccctagcccctgaatatgctaaggctgcccagcaactagaacaacagggatctaacatcaaacttggtaaagtcgatgccacagaagaatgcagtcgtgctgagcagttcaacattagaggataccccactctgagattcttcacaaatggcagtccaattgaatactc

SEQ ID NO: 721 - DNA, 408 bp, Diabrotica virgifera
  Clone ID: LIB149-036-Q1-E1-G7
aaattttcttggctggtgccacgttgatgtgtgaatattttcaatttagtttcatatatcatttgtaggtttaacaggaaaattcgtcaatatgttccggaccggttttctgctggtattctttttgaatgctgtttttgccgctgaagatatcaaaaccgaagatggagttttggtcctcaccaaagacaatttccaaggagtcctcaacgataatgagttcgtcttagtagaattttatgctccatggtgtggtcactgtaaagccctagcccctgaatatgctaaagctgcccagcaactagaacaacaaggatctaacatcaaacttggtaaagtcgatgccacagaagaaggcagtcttgctgagcaattcaacattagaggataccccactctgaaattctt

SEQ ID NO: 722 - DNA, 433 bp, Diabrotica virgifera
  unsure (1)..(433): unsure at all n locations
  Clone ID: LIB150-015-Q1-E1-E10
ccacgcgtccgctatgattcggccagttctcattttcttggctggtgccacgttgatgtgtgaatattttcaatttagtttcatatatcatttgtaggtttaacaggaaaattcgtcaatatgttccggaccggttttctgctggtattctttttgaatgctgtttttgccgctgaagatatcaaaaccgaagatggagttttggtcctcaccaaagacaatttccaaggagtcctcaacgataatgagttcgtcttagtagaattttatgctccatggtgtggtcactgtaaagccctagcccctgaatatgctaaggctgcncagcaactagaacaacagggatctaacatcaaacttggtaaagtcgatgccacagaagaaggcagtcttgctgagcaattcaacattagaggataccccactctgaaat

SEQ ID NO: 723 - DNA, 397 bp, Diabrotica virgifera
  Clone ID: LIB149-007-Q1-E1-E3
cgatattccatttggaatctcagccgatcaagctgtacgtgatgaatttgaagctgccgacaacagcatcgttttgttcaagaagttcgatgaacgtaaagtagcttacgaaggtgacgctgatgaagatgcactcaagaagttcatccaatccaatgccttacctttgttggtagaattcaaccatgaaacggcccaaaagatcttcggtggtgaaattaagagccatttgttattgttcttgaacagagaagacaaagacgtatatgaaaccatttccgaagccgccagatccgtagctaagccattcaaagaagaggttcttttcgtcaacatccatgccgaacaagaggacaaccaaaggatcatggaattcttcggaatcaaaaagaacact

SEQ ID NO: 724 - DNA, 408 bp, Diabrotica virgifera
  Clone ID: LIB149-005-Q1-E1-E11
aacagttcacattttcttggctggtgccacgttgatgtgtgaatattttcaatttagtttcatatatcatttgtaggtttaacaggaaaattcgtcaatatgttccggaccggttttctgctggtattctttttgaatgctgtttttgccgctgaagatatcaaaaccgaagatggagttttggtcctcaccaaagacaatttccaaggagtcctcaacgataatgagttcgtcttagtagaattttatgctccatggtgtggtcactgtaaagccctagcccctgaatatgctaaggctgcccagcaactagaacaacagggatctaacatcaaacttggtaaagtcgatgccacagaagaaggcagtcttgctgagcaattcaacattagaggataccccactctg

SEQ ID NO: 725 - DNA, 394 bp, Diabrotica virgifera
  unsure (1)..(394): unsure at all n locations
  Clone ID: LIB150-011-Q1-E1-G10
gatgaacgtaaagtagcttacgaaggtgacgctgatgaagatgcactcaagaagttcatccaatccaatgccttacctttgttggtagaattcaaccatgaaacggcccaaaagatcttcggtggtgaaattaagagccatttgttattgttcttgaacagagaagacaaagacgtatatgaaaccatttccgaagccgccagatccgtagctaagccattcaaagaagaggttcttttcgtcagcatcgatgccgaacaagaagacaaccaaaggatcatggaattcttcggaatcaaaaagaacactgtaccagcagctcgtctcatcanatttagaagaagatatggccaaatacaaaccagtatctgacgaattgaccgccgataacatc

SEQ ID NO: 726 - DNA, 406 bp, Diabrotica virgifera
  Clone ID: LIB150-032-Q1-E1-F12
aggacgcgtgggttcttggctggtgccacgttgatgtgtgaatattttcaatttagtttcatatatcatttgtaggtttaacaggaaattcgtcaatatgttccggaccggttttctgctggtattctttttgaatgctgtttttgccgctgaagatatcaaaaccgaagatggagttttggtcctcaccaaagacaatttccaaggagtcctcaacgataatgagttcgtcttagtagaattttatgctccatggtgtggtcactgtaaagccctagcccctgaatatgctaaggctgcccagcaactagaacaacagggatctaacatcaaacttggtaaagtcgatgccacagaagaaggcagtcttgctgagcaattcaacattagaagataccccactctg

SEQ ID NO: 727 - DNA, 435 bp, Diabrotica virgifera
  Clone ID: LIB150-033-Q1-E1-F10
cgcgcatgacattactacaacgtatagtgagtcgtattaaggtgccacgttgatgtgtgaatattttcaatttagtttcatatatcatttgtaggtttaacaggaaattcgtcaatatgttccggaccggttttctgctggtattctttttgaatgctgtttttgccgctgaagatatcaaaaccgaagatggagttttggtcctcaccaaagacaatttccaaggagtcctcaacgataatgagttcgtcttagtagaattttatgctccatggtgtggtcactgtaaagccctagcccctgaatatgctaaggctgcccagcaactagaacaacagggatctaacatcaaacttggtaaagtcgatgccacagaagaaggcagtcttgctgagcaattcaacattagaggatacccaatctgaaattcttcag

SEQ ID NO: 728 - DNA, 379 bp, Diabrotica virgifera
  Clone ID: LIB150-003-Q1-E2-G4
aattttcatggctggtgccacgttgatgtgtgaatattttcaatttagtttcatatatcatttgtaggtttaacaggaaaattcgtcaatatgttccggaccggttttctgctggtattctttttgaatgctgtttttgccgctgaagatatcaaaaccgaagatggagttttggtcctcaccaaagacaatttccaaggagtcctcaacgataatgagttcgtcttagtagaattttatgctccatggtgtggtcactgtaaagccctaacccctgaatatgctaaagctgcccagcaactagaacaacagggattcaacatcaaacttggtaaagtcgatgccacagaagaaggcagtcttgctgagcaattcaaca

SEQ ID NO: 729 - DNA, 382 bp, Diabrotica virgifera
  Clone ID: LIB149-004-Q1-E1-E11
atagtgagtcgtattaagccacgttgctgtgtgtgtactttcagtttagtttcatatatcagttgtaggtttaacaggaaaattcgtcaatatgttccggaccggttttctgctggcattcgttttgaatgctgtttttgccgctgaagatatcaaagccgaagatggagttttggtcatcaccaaagacaatttccaaggagtcctcaacgataacgagttcgtcttagtagaattttatgctccatggtgtggtcactggtgaagcctatcccctgactatgctaatgctgcccatcaactataacaacagggatctagcatcaaacttgggaaagtcgatgccacagaggaaggcattcttgctgagcaattcaacatt

SEQ ID NO: 730 - DNA, 140 bp, Diabrotica virgifera
  Clone ID: pGUT2725
catggttgaattctaccaacaaaggtaaggcattggattggatgaacttgttgagtgcatcttcatcagcgtcaccttcgtaagctactttacgttcatcgaacttcttgaacaaaacgatgctgttgtcggcagcttca

SEQ ID NO: 731 - DNA, 566 bp, Diabrotica virgifera
  Clone ID: pGUT2230
gtcgtggttacgtagctggagacaccaagaacaacccacccagaggagcttcagacttcactgcccaagtcattgttctcaaccaccctggtcaaatctcaaacggatatacccctgtactcgactgtcacacagctcacattgcctgcaaattcgctgaaatcaaagaaaaggttgaccgtcgttctggtaagaccactgaagaaaatcccaaagccatcaaatctggtgatgccgccattgtcaacttggtacccaccaagcccatgtgtgtagaatcattccaagaattcccaccccttggacgttttgctgtccgtgacatgaggcaaaccgttgcagtaggagtcatcaagagcgttgccttcaaagatcccaacgccggaaaagtcacaaaagctgcagaaaaagcccaactcaagaaatagtctatttggactccactacttaaataattttgatatgtgttgactcttttatatattaatattggagtatcaatggatttttaataactaatggacttattactttgcattgcattatttgtgatctggaaattaaac

SEQ ID NO: 732 - DNA, 453 bp, Diabrotica virgifera
  Clone ID: LIB150-017-Q1-E1-G12
gtccaccgacccgtccggagtggaactcgcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaatactatgttaccatcattgatgcccctggacacagagatttcattaagaacatgatcactggtacatcacaagctgactgtgctg

SEQ ID NO: 733 - DNA, 417 bp, Diabrotica virgifera
  Clone ID: LIB150-027-Q1-E1-B3
agtggacatcgcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtgggaattcgaaacagctaaatactatgtaaccatcattgatgcccctggacacagagatttcattaagaacatgatcactgggagat

SEQ ID NO: 734 - DNA, 413 bp, Diabrotica virgifera
  Clone ID: LIB150-027-Q1-E1-B8
gtcgtacggtgtggacctcgcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaatactatgtaaccatcattgatgcccctggacacagagatttcattaagaacatg

SEQ ID NO: 735 - DNA, 416 bp, Diabrotica virgifera
  Clone ID: LIB150-036-Q1-E1-A5
gggtcgatacacgagtcaacactcactcggagtaacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaatactatgtaaccatcattgatgcccctggacacagagatttcattaagaacatg

SEQ ID NO: 736 - DNA, 415 bp, Diabrotica virgifera
  Clone ID: LIB150-020-Q1-E1-A12
acccacgcgtccgggacctcgcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaatactatgtaaccatcattgatgcccctggacacagagatttcattaagaacatga

SEQ ID NO: 737 - DNA, 394 bp, Diabrotica virgifera
  Clone ID: LIB150-048-Q1-E1-D2
tcgcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaatactatgtaaccatcattgatgcccctggacacagagatttcaataagaaca

SEQ ID NO: 738 - DNA, 416 bp, Diabrotica virgifera
  Clone ID: LIB150-039-Q1-E1-E7
atgtggacctcgcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagataacgtggtattagaattgatattgctttgtggaaattcgagtcagctaagtactatgtaagcatcattgatgcccctggacacagagatttcattaagaagatgatcagtggtag

SEQ ID NO: 739 - DNA, 418 bp, Diabrotica virgifera
  Clone ID: LIB150-042-Q1-E1-B9
cgcaggcgtccacccacgcgtccgcccacgcgtccgacctcgcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaatactatgtaaccatcattgatgcccctggacacagag

SEQ ID NO: 740 - DNA, 406 bp, Diabrotica virgifera
  unsure (1)..(406): unsure at all n locations
  Clone ID: LIB150-001-Q1-E1-G12
cccacgcgtccggcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaatactatgtaaccatcattgaatgccctggacacagagattcattangaacatga

SEQ ID NO: 741 - DNA, 349 bp, Diabrotica virgifera
  unsure (1)..(349): unsure at all n locations
  Clone ID: LIB150-036-Q1-E1-E12
gggtcgacacaagcctctacaaacattacgtgctaaagtcattgttctcaaccaccctggtcaaatctcaaacggatatacccctgtactcgactgtcacacagctcacattgcctgcaaattcgctgaaatcaaagaaaaggttgaccgtcgttctggtaagaccactgaagaaaatcccaaagccatcaaatctggtgatgccgccattgtcaacttggtacccaccaagcccatgtgtgtagaatcattccaagaattcccaccccttggacgttttgctgtccgtgacatgaggcaaaccgttgcagtangagtcatcaagagcgttgccttcaaagatccagcg

SEQ ID NO: 742 - DNA, 409 bp, Diabrotica virgifera
  Clone ID: LIB150-020-Q1-E1-H10
accacgcgtccgcggacgcgtgggcggacgcgtgggcgcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaatactatgtaaccatcattgatgcccctggaca

SEQ ID NO: 743 - DNA, 424 bp, Diabrotica virgifera
  Clone ID: LIB150-040-Q1-E1-D8
gttctagatcgcgagctgccgccctttttttttttttttttgctcgtcgtacggtgtggacctcgcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaatactatgtaaccatcattgg

SEQ ID NO: 744 - DNA, 370 bp, Diabrotica virgifera
  unsure (1)..(370): unsure at all n locations
  Clone ID: LIB150-017-Q1-E1-H8
cacgcatccgcacacgcgtccgctcgcgcctggtgttacatcccaagtagtgttccttttattctaagtttaatttcaaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcganacagctaaatacta

SEQ ID NO: 745 - DNA, 360 bp, Diabrotica virgifera
  Clone ID: LIB150-028-Q1-E1-G5
acgtacggtgtggacctcgcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaata

SEQ ID NO: 746 - DNA, 375 bp, Diabrotica virgifera
  Clone ID: LIB150-026-Q1-E1-F9
aagttacatcccaagtagtgttccttttattctaagtttaatttcgaacagttgcatttactttatttccaaacaatcaaaatgggtaaagaaaagattcatattaacatcgttgtcattggacacgtacattctggtaaatctactactactggacatttaatttacaaatgtggtggtatcgacaaacgtaccatcgaaaagttcgaaaaagaagcccaagaaatgggtaaaggttcattcacatatgcctgggtactcgacaaacttaaggccgaaagagaacgtggtaataccaatgatattgctttgtggaaattcgaaacagctaaatactatgtaaccatcactgatgcccctggaaacagagatttc

SEQ ID NO: 747 - DNA, 449 bp, Diabrotica virgifera
  Clone ID: LIB150-022-Q1-E1-B11
aggtaaacctcgcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaatactatgtaaccatcattgatgcccctggacacagagatttcattaagaacatgatcactggtacatcacaagctgactgtgctgtactcattgttgc

SEQ ID NO: 748 - DNA, 444 bp, Diabrotica virgifera
  Clone ID: LIB150-031-Q1-E1-A3
tagtgaaaatctcacgactggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaatactatgtaaccatcattgatgcccctggacacagagatttcattaagaacatgattactggtacatcacaagctgactgtgctgtactca

SEQ ID NO: 749 - DNA, 441 bp, Diabrotica virgifera
  Clone ID: LIB150-019-Q1-E1-C12
gtgaggacactcgcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaatactatgtaaccatcattgatgcccctggacacagagatttcattaagaacatgatcactggtacatcacaagctgactgtgctgtact

SEQ ID NO: 750 - DNA, 479 bp, Diabrotica virgifera
  Clone ID: LIB150-029-Q1-E1-H8
cccaagcgtccgcccacgcgtccgcccacgcgtccgcccacgcgtccggtggacctcgcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaatactatgtaaccatcattgatgcccctggacacagagatttcattaagaacatgatcactggtacatcacaagctgactgtg

SEQ ID NO: 751 - DNA, 448 bp, Diabrotica virgifera
  unsure (1)..(448): unsure at all n locations
  Clone ID: LIB150-001-Q1-E1-D8
ctcgcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgtgtactcgacaaacttaaggccgagagagaacgtggtattaccattgatattggcttgtggatattcgaaacagctagatactatgtaaccatcattgatgcccctggacacagagatttcaataggaacatgatcactggtacatcacangctgactgtgctgtactcattgttgcagctggt

SEQ ID NO: 752 - DNA, 448 bp, Diabrotica virgifera
  unsure (1)..(448): unsure at all n locations
  Clone ID: LIB150-022-Q1-E1-A10
agcccacgcgtccgggtgtggacctcgcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaacattgatattgctttgtggaaattcganacagctaaatactatgtaaccatcattgatgcccctggacacagagatttcattaagaacatgatcactggtacatcacaggctgactgtg

SEQ ID NO: 753 - DNA, 424 bp, Diabrotica virgifera
  Clone ID: LIB150-040-Q1-E1-C5
cccacgcgtccggcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaatactatgtaaccatcattgatgcccctggacacagagatttcattaagaacatgatcactggtacatcacaa

SEQ ID NO: 754 - DNA, 450 bp, Diabrotica virgifera
  Clone ID: LIB150-022-Q1-E1-A3
tcccggcatccagtcagcagacgcgacagggacctcgcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaatactatgtaaccatcattgatgcccctggacacagagatttcattaagaacatgatcactggtacatcacaagc

SEQ ID NO: 755 - DNA, 425 bp, Diabrotica virgifera
  Clone ID: LIB150-020-Q1-E1-C7
agtgtggacctcgcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaatactatgtaaccatcattgatgcccctggacacagagatttcattaagaacatgatcactggtacatcacaag

SEQ ID NO: 756 - DNA, 425 bp, Diabrotica virgifera
  unsure (1)..(425): unsure at all n locations
  Clone ID: LIB150-003-Q1-E2-H8
aacggtgtggacctcgcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccganagagaacgtggtattaccattgatattgctttgtggaaattcgaaacagctaaatactatgtaaccatcattgatgcccctggacacagagatttcattaagaacatgatcactggtacatcac

SEQ ID NO: 757 - DNA, 443 bp, Diabrotica virgifera
  Clone ID: LIB150-024-Q1-E1-B4
gtcaccaccgtcgaagtggactcgcgactggtgttacaacccaagttatggtccctttaatccaagtttaatttccaacagtttgatttactttaattccaaacaatcaaaatgggttagagaaaaaatcatattaacatcgttgtcattggacacgtagattctgggtaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaatactatgtaaccatcattgatgcccctggacacagagatttcattaagaacatgatcactggtacatcacaatctgactg

SEQ ID NO: 758 - DNA, 407 bp, Diabrotica virgifera
  Clone ID: LIB150-034-Q1-E1-F6
gtgtggacctcgcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaatactatgtaaccatcattgatgcccctggacacagagatttcattaaggaacatga

SEQ ID NO: 759 - DNA, 406 bp, Diabrotica virgifera
  unsure (1)..(406): unsure at all n locations
  Clone ID: LIB150-030-Q1-E1-H6
cacgcgactgcacacacgtctggtagacctcgcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcanatatgcctgggtactcgacanacttaaggccgagagagaacgtggtattaacattgatattgctttgtgggaaatccanacagctaaatactatgtaaccatcattgatgcccctggacacag

SEQ ID NO: 760 - DNA, 399 bp, Diabrotica virgifera
  Clone ID: LIB149-012-Q1-E1-E9
agtaatacggtgtggacctcgcgcctggtgttacatcccaagtactgttccttgtattcgaagtttaatttcgaacagttgcatttactttaattccaaacaatcaaaatgggtagaagaaaagattcatattaacatcgttgtcattggacacgtagattctggtaaatctactactactggacatttaatttacaaatgtggtggtatcgacgaacgtaccatcgaaaagttcgaaaaagaagcccaagaaatgggtaaaggttcattcacatatgcctgagtactcgacaaacttaaggccgagagagaacgtggtattaccagtgaaattgctttgtggaaattcgaaacagctaaatactatgttaccatcattgatgcccctggacacagaga

SEQ ID NO: 761 - DNA, 427 bp, Diabrotica virgifera
  unsure (1)..(427): unsure at all n locations
  Clone ID: LIB150-003-Q1-E2-F4
aacggtgtggacctcgcgcctggtgttacatcccaagtagtgttccttttattctaagtttaatttcgaacagttgcatttactttatttccaaacaatcaacatgggtaaagaaaagattcatattaacatcgttgtcattggacacgtagattctggtaaatctactacgactggacatttaatttacaaatgtggtggtatcgacaaacgtaccatcgaaaagttcgaaaaagaagcccaagaaatgggtaaaggttcattcaaatatgcctgcgtactcgacaaacttaaggccgagagagaacgtggtatttacattgatattgncttgtggaaatttcaaacagctaaatactatgtaaccatcatttgatgcccctggacacagagatttcatttaagaacatgatcactggtacatcac

SEQ ID NO: 762 - DNA, 401 bp, Diabrotica virgifera
  Clone ID: LIB150-002-Q1-E1-G12
ggtagctatccggtattagccgggcaatccaggcatcagccaacgcttcgggcacctggtgttacatcccaactagtgttccttttattctacgtttaatttcgagcacttgcatttacgttatttcgaaacacgcaatctgggtagcgtccagattcatatcaacatccttgtcattggccacgtagattctggtagatcaacaaacactggtcatttaatttacaaactgtggtggcagcgacacacgtaccatcgttgcagttcgtgcaaagaagcccaagacatgggtacaggttcattcagatatgcctgagtactcgacaatcttaaagccgatagagaacgtggtattatcattgatactgctttgtggagattcgcaacagctaaatactatg

SEQ ID NO: 763 - DNA, 482 bp, Diabrotica virgifera
  Clone ID: LIB150-029-Q1-E1-E10
cgcgggtcgacacaagactctataatgagtcgtataattggtacagcagtttcagtgctgtgctttagaataatttattttttaacatttatatagaaatcaaatactaaccaatcaacatgtgtgaagaagaagttgccgctttagtcgtagacaatggatccggtatgtgcaaagctggttttgctggggatgatgcacctcgtgctgtattcccttcaattgttggacgcccaagacatcagggtgtgatggtaggaatgggacaaaaagattcctatgtaggtgatgaagctcaaagtaaaagaggtatccttaccttaaaataccccatcgagcacggaatagtcacaaactgggatgatatggagaaaatttggcatcatacattctacaatgaactcagagtagccccagaagaacaccctgttctgttgacagaagctcctctcaaccccaaggccaacagggaaaagatgaca

SEQ ID NO: 764 - DNA, 423 bp, Diabrotica virgifera
  Clone ID: LIB150-012-Q1-E1-F12
gtgatatttagtgcttacttggtacagcagtttcagtgctgtgctttagaataatttattttttaacatttatatagaaatcaaatactaaccaatcaacatgtgtgaagaagaagttgccgctttagtcgtagacaatggatccggtatgtgcaaagctggttttgctggggatgatgcacctcgtgctgtattcccttcaattgttggacgcccaagacatcagggtgtgatggtaggaatgggacaaaaagattcctatgtaggtgatgaagctcaaagtaaaagaggtatccttaccttaaaataccccatcgagcacggaatagtcacaaactgggatgatatggagaaaatttggcatcatacattctacaatgaactcagagtagccccagaagaacaccctgttctgttgacaga

SEQ ID NO: 765 - DNA, 432 bp, Diabrotica virgifera
  Clone ID: LIB149-008-Q1-E1-B8
cacacgcgtccggatatttagtgcttacttggtacagcagtttcagtgctgtgctttagaataatttattttttaacatttatatagaaatcaaatactaaccaatcaacatgtgtgaagaagaagttgccgctttagtcgtagacaatggatccggtatgtgcaaagctggttttgctggggatgatgcacctcgtgctgtagtcccttcaattgttggacgcccaagacatcagggtgtgatggtaggaatgggacaaaaagattcctatgtaggtgatgaagctcaaagtaaaagaggtatccttaccttaaaataccccatcgagcacggaatagtcacaaactgggatgatatggagaaaatttggcatcatacattctacaatgaactcagagtagccccagaagaacaccctgttctgttgacag

SEQ ID NO: 766 - DNA, 412 bp, Diabrotica virgifera
  Clone ID: LIB149-028-Q1-E1-B10
atgatatttagtgcttacttggtacagcagtttcagtgctgtgctttagaataatttattttttaacatttatatagaaatcaaatactaaccaatcaacatgtgtgaagaagaagttgccgctttagtcgtagacaatggatccggtatgtgcaaagctggttttgctggggatgatgcacctcgtgctgtattcccttcaattgttggacgcccaagacatcagggtgtgatggtaggaatgggacaaaaagattcctatgtaggtgatgaagctcaaagtaaaagaggtatccttaccttaaaataccccatcgagcacggaatagtcacaaactgggatgatatggagaaaatttggcatcatacattctacaatgaactcagagtagccccagaagaacaccctgtt

SEQ ID NO: 767 - DNA, 431 bp, Diabrotica virgifera
  Clone ID: LIB149-049-Q1-E1-E10
gtcgacagacccgtccagtgataatcagtgcatacttggtacagcagtttcagtgctgtgctttagaataatttattttttaacatttatatagaaatcaaatactaaccaatcaacatgtgtgaagaagaagttgccgctttagtcgtagacaatggatccggtatgtgcaaagctggttttgctggggatgatgcacctcgtgctgtattcccttcaattgttggacgcccaagacatcagggtgtgatggtaggaatgggacaaaaagattcctatgtaggtgatgaagctcaaagtaaaagaggtatccttaccttaaaataccccatcgagcacggaatagtcacaaactgggatgatatggagaaaatttggcatcatacattctacaatgaactcagagtagccccagaagaacaccctgttct

SEQ ID NO: 768 - DNA, 409 bp, Diabrotica virgifera
  Clone ID: LIB150-039-Q1-E1-E8
gtgatatttagtgcttacttggtacagcagtttcagtgctgtgctttagaataatttattttttaacatttatatagaaatcaaatactaaccaatcaacatgtgtgaagaagaagttgccgctttagtcgtagacaatggatccggtatgtgcaaagctggttttgctggggatgatgcacctcgtgctgtattcccttcaattgttggacgcccaagacatcagggtgtgatggtaggaatgggacaaaaagattcctatgtaggtgatgaagctcaaagtaaaagaggtatccttaccttaaaataccccatcgagcacggaatagtcacaaactgggatgatatggagaaaatttggcatcatacattctacaatgaactcagagtagccccagaagaacacccg

SEQ ID NO: 769 - DNA, 409 bp, Diabrotica virgifera
  Clone ID: LIB150-034-Q1-E1-C9
gtgatatatagtgcttacttggtacagcagtttcagtgctgtgctttagaataatttattttttaacatttatatagaaatcaaatactaaccaatcaacatgtgtgaagaagaagttgccgctttagtcgtagacaatggatccggtatgtgcaaagctggttttgctggggatgatgcacctcgtgctgtattcccttcaattgttggacgcccaagacatcagggtgtgatggtaggaatgggacaaaaagattcctatgtaggtgatgaagctcaaagtaaaagaggtatccttaccttaaaataccccatcgagcacgggatagtcacaaactgggatgatatggagaaaatttggcatcatacattctacaatgaactcagagtaaccccagaagaacaccct

SEQ ID NO: 770 - DNA, 431 bp, Diabrotica virgifera
  Clone ID: LIB150-029-Q1-E1-G2
ccctctaggcagtgtctcgttacttgtgcttgttcattgaagttctgtgacgtgtctttggcaaaagtactaatcaatcaacatgtgtggagaagaagttgctgctttagtcgtagacaatggatccggtatgtgcaaagctggttttgccggggatgatgcacccagagctgtattcccttcaattgttggacgtccaagacatcagggtgtgatggtaggaatgggccaaaaagattcctatgttggcgatgaagctcaaagcaaaagaggtatccttacattaaagttacccatcgagcatggaatagtcacaaactgggatgatatggagaaaatttggcaacaaacaattcacaatgaactcaaaataaccccaaaagaacaacccgttccggtgaccggaactcctctaaacccaaaggcaacaa

SEQ ID NO: 771 - DNA, 406 bp, Diabrotica virgifera
  Clone ID: LIB149-022-Q1-E1-F9
agtgatatttagtgcttacttggtacagcagtttcagtgctgtgctttagaataatttattttttaacatttatatagaaatcaaatactaaccaatcaacatgtgtgaagaagaagttgccgctttagtcgtagacaatggatccggtatgtgcaaagctggttttgctggggatgatgcacctcgtgctgtattcccttcaattgttggacgcccaagacatcagggtgtgatggtaggaatgggacaaaaagattcctatgtaggtgatgaagctcaaagtacaagaggtatccttaccttaaaataccccatcgagcacggaatagtcacaaactgggatgatatggagaaaatttggcatcatacattctacaatgaactcagagtagccccagaagaaca

SEQ ID NO: 772 - DNA, 387 bp, Diabrotica virgifera
  Clone ID: LIB150-027-Q1-E1-A12
tagtgagagtcatagcatacttggtacagcagtttcagtgctgtgctttagaataatttattttttaacatttatatagaaatcaaatactaaccaatcaacatgtgtgaagaagaagttgccgctttagtcgtagacaatggatccggtatgtgcaaagctggttttgctggggatgatgcacctcgtgctgtattcccttcaattgttggacgcccaagacatcagggtgtgatggtaggaatgggacaaaaagattcctatgtaggtgatgaagctcaaagtaaaagaggtatccttaccttaaaataccccatcgagcacggaatagtcacaaactgggatgatatggagaaaatttggcatcatacattctacaatgaactc

SEQ ID NO: 773 - DNA, 386 bp, Diabrotica virgifera
  Clone ID: LIB149-044-Q1-E1-F1
agtgatatttagtgcttacttggtacagcagtttcagtgctgtgctttagaataatttattttttaacatttatatagaaatcaaatactaaccaatcaacatgtgtgaagaagaagttgccgctttagtcgtagacaatggatccggtatgtgcaaagctggttttgctggggatgatgcacctcgtgctgtattcccttcaattgttggacgcccaagacatcagggtgtgatggtaggaatgggacaaaaagattcctatgtaggtgatgaagctcaaagtaaaagaggtatccttaccttaaaataccccatcgagcacggaatagtcacaaactgggatgatatggagaaaatttggcatcatacattctacaatgaactc

SEQ ID NO: 774 - DNA, 406 bp, Diabrotica virgifera
  unsure (1)..(406): unsure at all n locations
  Clone ID: LIB150-021-Q1-E1-F3
accaagcgtcgggatattaagggcttacttggaacagcagtttcagtgctgtgctttagaataatttattttttaacatttatatagaaatcaaatactaaccaatcaacatgtgtgaagaagaagttgccgctttagtcgtagacaatggatccggtatgtgcaaagctggttttgctggggatgatgcacctcgtgctgtattcccttcaattgttggacgcccaagacatcagggtgtgatggtaggaatgggacanaaagattcctatgtaggtgatgaagctcaaagtaaaagaggtatccttaccttaaaataccccatcgagcacggaatagtcacaaactgggatgatatggagaaaatttggcatcatacattccacaatgaactcaaagtaacccc

SEQ ID NO: 775 - DNA, 387 bp, Diabrotica virgifera
  Clone ID: LIB149-009-Q1-E1-H6
gaagtttcagtgctgtgctttagaataatttattttttaacatttatatagaaatcaaatactaaccaatcaacatgtgtgaagaagaagttgccgctttagtcgtagacaatggatccggtatgtgcaaagctggttttgctggggatgatgcacctcgtgctgtattcccttcacttgttggacgcccaagacatcagggtgtgatggtaggaatgggacaaaaagattcctatgtaggtgatgaagctcaaagtacaagaggtatccttaccttaaaataccccatcgagcacggaataatcacaaactgggatgataaggagaaaatttggcatcatacaatctacaatgaactcaaagtaggcccaggaagaacaccctgtt

SEQ ID NO: 776 - DNA, 390 bp, Diabrotica virgifera
  Clone ID: LIB149-032-Q1-E1-H1
acccacgcgtccgcccacgcgtccgatttagtgcttacttggtacagcagtttcagtgctgtgctttagaataatttattttttaacatttatatagaaatcaaatactaaccaatcaacatgtgtgaagaagaagttgccgctttagtcgtagacaatggatccggtatgtgcaaagctggttttgctggggatgatgcacctcgtgctgtattcccttcaattgttggacgcccaagacatcagggtgtgatggtaggaatgggacaaaaagattcctatgtaggtgatgaagctcaaagtaaaagaggtatccttaccttaaaataccccatcgagcacggaatagtcacaaactgggatgatatggagaaaatttggcatcataca

SEQ ID NO: 777 - DNA, 341 bp, Diabrotica virgifera
  Clone ID: LIB3026-007-Q1-E1-C8
cagcgtgcagggagctgatctgacgcttaccctgttttatgaaggattatgccctggttgtcatcaatttattctaacacagctatatccttcatacgctaaattggcagatagcttgaaattggactttgtaccctatggatggagtgactcttcacgtagcgcagatggaaaagtaacatttgaatgccagcatggtgatgaggagtgttatattaacagaatacacgcttgtgttcttgatcaaaatccatcctcgttagactacgttactttcatatatcaacatttgtccaagactgacgaacgcgatcgcaacgaaagacaagaattagaactag

SEQ ID NO: 778 - DNA, 402 bp, Diabrotica virgifera
  Clone ID: LIB3026-007-Q1-E1-A12
ttcgtatcaaagttggtattgttcttcgcagccactgtgtgtgtgtcatccagcgtgcagggagctgatctgacgcttaccctgttttatgaaggattatgccctggttgtcatcaatttattctaacacagctatatccttcatacgctaaattggcagatagcttgaaattggactttgtaccctatggatggagtgactcttcacgtagcgcagatggaaaagtaacatttgaatgccagcatggtgatgaggaatgttatattaacagaatacacgcttgtgttcttgatcaaaatccatcctcgttagactacgttactttcatatatcaacatttgtccaagactgacgaacgcgatcgcaacgaaagacaagaatttagactagcccaaagtttg

SEQ ID NO: 779 - DNA, 404 bp, Diabrotica virgifera
  Clone ID: LIB149-044-Q1-E1-A12
aacacacgtccgccacgcgtccggttcgtatcaaagttggtattgttcttcgcagccactgtgtgtgtgtcatccagcgtgcagggagctgatctgacgcttaccctgttttatgaaggattatgccctggttgtcatcaatttattctaacacagctatatccttcatacgctaaattggcagatagcttgaaattggactttgtaccctatggatggagtgactcttcacgtagcgcagatggaaaagtaacatttgaatgccagcatggtgatgaggaatgttatattaacagaatacacgcttgtgttcttgatcaaaatccatcctcgttagactacgttactttcatatatcaacatttgtccaagactgacgaacgcgatcgcaacgaaagacaaga

SEQ ID NO: 780 - DNA, 409 bp, Diabrotica virgifera
  Clone ID: LIB3026-026-Q1-E1-B12
gttcgtatcaaagttggtattgttcttcgcagccactgtgtgtgtgtcatccagcgtgcagggagctgatctgacgcttaccctgttttatgaaggattatgccctggttgtcatcaatttattctaacacagctatatccttcatacgctaaattggcagatagcttgaaattggactttgtaccctatggatggagtgactcttcacgtagcgcagatggaaaagtaacatttgaatgccagcatggtgatgaggaatgttatattaacagaatacacgcttgtgttcttgatcaaaatccatcctcgttagactacgttactttcatatatcaacatttgtccaagactgacgaacgcgatcgcaacgagcgacaagaattagaactagcccaaagtttgttgcca

SEQ ID NO: 781 - DNA, 426 bp, Diabrotica virgifera
  Clone ID: LIB149-015-Q1-E1-A5
cacgcatccgataaaagttggtattgttcttcgcagccactgtgtgtgtgtcatccagcgtgcagggagctgatctgacgcttaccctgttttatgaaggattatgccctggttgtcatcaatttattctaacacagctatatccttcatacgctaaattggcagatagcttgaaattggactttgtaccctatggatggagtgactcttcacgtagcgcagatggaaaagtaacatttgaatgccagcatggtgatgaggaatgttatattaacagaatacacgcttgtgttcttgatcaaaatccatcctcgttagactacgttactttcatatatcaacatttgtccaagactgacgaacgcgatcgcaacgaaagacaagaattagaactatcccaaagtttgttgccaagcagcctttcct

SEQ ID NO: 782 - DNA, 477 bp, Diabrotica virgifera
  Clone ID: pGUT3058
ccggctgaagaatttgcacgagctgatctgacgcttacccttgtttatgaaggattatgccctggttgtcatcaatttattctaacacagctatatccttcatacgctaaattggcagatagcttgaaattggactttgtaccctatggatggagtgactcttcacgtagcgcagatggaaaagtaacatttgaatgccagcatggtgatgaggaatgttatattaacagaatacacgcttgtgttcttgatcaaaatccatcctcgttagactacgttactttcatatatcaacatttgtccaagactgacgaacgcgatcgcaacgaaagacaagaattagaactagcccaaagtttgttgccaagcagcctttcctgtgacagcgttagtgattgttatcatggtgaacgtggaactgaacttttattatgatatgagaaaagacaagcagagcttaatcccatattaccttgg

SEQ ID NO: 783 - DNA, 369 bp, Diabrotica virgifera
  Clone ID: LIB149-011-Q1-E1-E2
cccacgcgtccgaacgtgcaagatgctgatctgactcttactgtgttttatgaaggtctatgccctggttgtcatcaatttattctaacacagctatatccttcatacgctaaattggcagatagcataaaattggacctggtgccctttggatggagtgaatcttcacgtagcgcagatggaaaagtaacatttacttgccagcatggtgatgaggaatgttatattaacagaatacacgcttgtgttcttgatcaaaatccatcctcattagacttcgttactttcatatatcaacatttgtctaagactgacgaacgcgatcgcaacgaaagagaaaaattagaactaacccaaaatttgttgcca

SEQ ID NO: 784 - DNA, 379 bp, Diabrotica virgifera
  Clone ID: LIB149-022-Q1-E1-F12
acccacacgtccgcccacgcgtccgatcaaagttagtattgtttttcgcagccactgcgtgcgtgtcatccagcgtgcaggatgctgatctgactcttactgtgttttatgaaggtctatgccctggttgtcatcaatttattctaacacagctatatccttcatacgctaaattggcagatagcataaaattggacctggtgccctttggatggagtgaatcttcacgtagcgcagatggaaaagtaacatttacttgccagcatggtgatgaggaatgttatattaacagaatacacgcttgtgttcttgatcaaaatccatcctcattagacttcgttactttcatatatcaacatttgtctaagactgacgaacg

SEQ ID NO: 785 - DNA, 373 bp, Diabrotica virgifera
  Clone ID: LIB149-033-Q1-E1-C12
ggccgatgcacgcctctagtattgatcttcgcagccactgcgtgcgtgtcatccagcgtgcaggatgctgatctgactcttactgtgttttatgaaggtctatgccctggttgtcatcaatttattctaacacagctatatccttcatacgctaaattggcagatagcataaaattggacctggtgccctttggatggagtgaatcttcacgtagcgcagatggaaaagtaacatttacttgccagcatggtgatgaggaatgttatattaacagaatacacgcttgtgttcttgatcaaaatccatcctcattagacttcgttactttcatatatcaacatttgtctaagactgacgaacgcgatcgcaacg

SEQ ID NO: 786 - DNA, 409 bp, Diabrotica virgifera
  Clone ID: LIB149-031-Q1-E1-B4
acccacgcgtccgcaagatgttcgtatcaaagttagtattgtttttcgcagccactgcgtgcgtgtcatccagcgtgcaggatgctgatctgactcttactgtgttttatgaaggtctatgccctggttgtcatcaatttattctaacacagctatatccttcatacgctaaattggcagatagcataaaattggacctggtgccctttggatggagtgaatcttcacgtagcgcagatggaaaagtaacatttacttgccagcatggtgatgaggaatgttatattaacagaatacacgcttgtgttcttgatcaaaatccatcctcattagacttcgttactttcatatatcaacatttgtctaagactgacgaacgcgatcgcaacgaaagagaagaattagaact

SEQ ID NO: 787 - DNA, 388 bp, Diabrotica virgifera
  Clone ID: LIB3026-009-Q1-E1-F2
gacactgtgtgcgtgtcatccagcgtgcggggagctgatctgactcttaccctgttttatgaaggaaggtgccctgcttgtcatgaatttattctaacacagctatatccttcatacgctaaattaacagatagcttaaaattggacctagtgccctttggatggagtgaatcttcacgtagcgcaaatggaagagtatcatttacttgccagcatggtgatgaggaatgttatattaacagaatacatgcttgtgttcttgatcaaaatccatcctcattagacttcgttactttcatatatcaacatttgtccaagactgaagaacgccatcgcacccaaagagaagaattagacctagcccaaagtttgttgccaagcagccttt

SEQ ID NO: 788 - DNA, 342 bp, Diabrotica virgifera
  unsure (1)..(342): unsure at all n locations
  Clone ID: LIB3026-003-Q1-E1-G2
atcaaagttggtattgttcttcgcagccactgtgtgtgtgtcatccagcgtgcagggagctgatctgacgcttaccctgttttatgaaggattatgccctggttgtcatcaatttattctaacacagctatatccttcatacgctaaattggcagatagcttgaaattggactttgtaccctatgtggggagtcgctgttcacgtancggaggggggggggggacatttgaatgccagcatggggacgaggaatgttatattaacagaatacacgcttgtgttcttgatcaaaatccatcctcgttagactacgttactttcatatatcaacatttgtccaa

SEQ ID NO: 789 - DNA, 398 bp, Diabrotica virgifera
  Clone ID: LIB150-036-Q1-E1-G3
ctgactcttaccctgttttatgaaggaaggtgccctgcttgtcatgaatttattctaacacagctatatcctttagacgctaaattggcagatagcttaaaattggacctagtgccctttggatggagtgaatcttcacgtagcgcaaatggaagagtatcatttacttgccagcatggtgatgaggaatgttatattaacagaatacatgcttgtgttcttgatcaaaatccatcctcattagacttcgttactttcatagatcaacatttgtccaagactgaagaacgccatcgcacccaaagagaagaattagacctagcccaaagtttgttgccaagcagcctttcctgggacaaagttagtgattgttaccatggtgatcgtgcaattgaact

SEQ ID NO: 790 - DNA, 324 bp, Diabrotica virgifera
  Clone ID: LIB3026-022-Q1-E1-F10
gtccgcacacgcaatcgcccacgcgtccggttcgtatcatagttggtattgttcttcgcagccactgtgtgtgtgtcatccagcgtgcagggagctgatctgacgcttaccctgttttatgaaggattatgccctggttgtcatcaatttattcgaacacagctatatccttcatacgctaaattggcagatagcttgacattggactttgtaccctatggatggagtgactcttcacgtctcgcagatggactcgctccatttgagtgcccgcatggtgacgcggaatgttcggtcaacagatgccccccttgtgttcttgat

SEQ ID NO: 791 - DNA, 413 bp, Diabrotica virgifera
  Clone ID: LIB149-022-Q1-E1-B5
cttcgacaacagaatggtcaatcactttgttggagaattcaagaggaaatacaagaaggaccttaccacaaacaaacgtgccctccgtcgtttgagaacaagctgtgaaagagctaagcgtaccctttcctcatcaacccaagccagcattgaaatcgattctctatttgagggtattgacttctacacctcaatcaccagggctagatttgaagaactcaacgctgatttgttcagatctaccatggaacctgtagaaaaggccatcagggatgccaagatggacaaatctcaagttcacgatattgtgttggttggtggatctacccgtattccaaaggtacaaaaactgttgcaagatttcttcaatggtaaagaattgaacaagtcgatcaaccccgatgaagctgttg

SEQ ID NO: 792 - DNA, 411 bp, Diabrotica virgifera
  Clone ID: LIB150-032-Q1-E1-G6
acaaataattaattataagatggctaaagccccagctgtaggtattgatttaggaaccacatactcctgtgtaggagttttccaacatggcaaagttgaaattattgccaacgaccaaggtaacagaaccacaccatcatatgtggccttcacagacacagaacgtctcatcggagatgctgccaagaaccaggtagccatgaaccccaataacacaatttttgatgccaaacgtcttattgggcgtcgctttgatgacagtgctgtacagtctgacatgaaacattggccatttgaagtagtaaatgatgcacgtaaaccaaagattaaagttgcatacaagggcgaagacaaatccttctacccagaagaagtcagttccatggtccttacaaaaatgaaggaaacagc

SEQ ID NO: 793 - DNA, 420 bp, Diabrotica virgifera
  Clone ID: LIB149-004-Q1-E1-G6
atcagattgctgtagtgcacacgtaatttaagtatttatttaagaattgtctgcaaataattaattataagatggctaaagccccagctgtaggtattgatttaggaaccacatactcctgtgtaggagttttccaacatggcaaagttgaaattattgccaacgaccaaggtaacagaaccacaccatcatatgtggccttcacagacacagaacgtctcatcggagatgctgccaagaaccaggtagccatgaaccccaataacacaatttttgatgccaaacgtcttattgggcgtcgctttgatgacagtgctgtacagtctgacatgaaacattggccatttgaagtagtaaatgatgcaggtaaaccaaagattaaagttgcatacaagggcgaagacaaatccttctacccag

SEQ ID NO: 794 - DNA, 394 bp, Diabrotica virgifera
  Clone ID: LIB150-027-Q1-E1-F2
aggacgcgtgggtttatttaagaattgtctgcaaataattaattataagatggctaaagccccagctgtaggtattgatttaggaaccacatactcctgtgtaggagttttccaacatggcaaagttgaaattattgccaacgaccaaggtaacagaaccacaccatcatatgtggccttcacagacacagaacgtctcatcggagatgctgccaagaaccaggtagccatgaaccccaataacacaatttttgatgccaaacgtcttattgggcgtcgctttgatgacagtgctgtacagtctgacatgaaacattggccatttgaagtagtaaatgatgcaggtaaaccaaagattaaagttgcattcaagggcgaagacaaatccctctac

SEQ ID NO: 795 - DNA, 406 bp, Diabrotica virgifera
  Clone ID: LIB150-048-Q1-E1-H6
acattgctgtagtgcacacgtaatttaagtatttatttaagaattgtctgcaaataattaattataagatggctaaagccccagctgtaggtattgatttaggaaccacatactcctgtgtaggagttttccaacatggcaaagttgaaattattgccaatgaccaaggtaacagaaccacaccatcatatgtggcattcacagacacagaacgtctcatcggagatgctgccaagaaccaggtagccatgaaccccaataacacaatttttgatgccaaacgtcttattgggcgtcgctttgatgacagtgctgtacagtctgacatgaaacattggccatttgaagtagtaaatgatgcaggtaaaccaaagattaaagttgcatacaagggcgaagacaaatc

SEQ ID NO: 796 - DNA, 430 bp, Diabrotica virgifera
  unsure (1)..(430): unsure at all n locations
  Clone ID: LIB150-045-Q1-E1-D5
agtaatttaagtatttatttaagaattgtctgcaaataattaattataagatggctaaagccccagctgtaggtattgatttaggaaccacatactcctgtgtaggagttttccaacatggcaaagttgaaattattgccaatgaccaaggtaacagaaccacaccatcatatgtggcattcacagacacagaacgtctcatcggagatgctgccaagaaccaggtagccatgaaccccaataacacaatttttgatgccaaacgtcttattgggcgtcgctttgatgacagtgctgtacagtctgacatganacaatgggcaatttgaagtagtaaatgatgcaggtaaaccaaagattaaagttgcatacaagggcgaagacaaatccttctacccagaagaagtcagttccatggtccttacaaaaa

SEQ ID NO: 797 - DNA, 386 bp, Diabrotica virgifera
  Clone ID: LIB150-028-Q1-E1-D7
gtaatttacgtatttatttaagaattgtctgcaaataattaattataagatggctaaagccccagctgtaggtattgatttaggaaccacatactcctgtgtaggagttttccaacatggcaaagttgaaattattgccaatgaccaaggtaacagaaccacaccatcatatgtggcattcacagacacagaacgtctcatcggagatgctgccaagaaccaggtagccatgaaccccaataacacaatttttgatgccaaacgtcttattgggcgtcgctttgatgacagtgctgtacagtctgacatgaaacattggccatttgaagtagtaaatgatgcaggtaaaccaaagattaaagttgcatacaagggcgaaagacaat

SEQ ID NO: 798 - DNA, 316 bp, Diabrotica virgifera
  Clone ID: LIB150-049-Q1-E1-D3
cgggctcgaccacgcgtcagcagaagcatacttaggaaagaatgtcaccaacgctgtcatcacagtacctgcatatttcaatgactcacaacgtcaagctaccaaagatgctggaaccattgctggactccaggtattacgtattattaacgaacccactgctgctgccatcgcctatggtttagacaaaaagggccaaggtgaaagaaacgtcctcattttcgatctgggtggtggtacgtttgatgtatcaatcttaacaattgaagatggtatctttgaagtcaaatcaactgctggagacactcacttggga

SEQ ID NO: 799 - DNA, 330 bp, Diabrotica virgifera
  unsure (1)..(330): unsure at all n locations
  Clone ID: pGUT1737
cgtaacactaccattcccaccaagcaaacccagagggtcactacttactctgacggcgcaacccggagtacttattcaggtatatgaaggtgaacgtgccatgaccaaggacaacaacctcttgggaaaattcgaacttaccggcattcctcctgcgccccgtggtgtccctcagattgaagtaaccttcgacattgatgccaacggtatcttgaacgtcacagctattgaaaaatccaccaacaaagaaaacaagatcaccatcaccaatgataaaggtcgtctcagcanagaagacattgaaagaatggtcaacgatgcagaaaaata

SEQ ID NO: 800 - DNA, 340 bp, Diabrotica virgifera
  Clone ID: LIB150-015-Q1-E1-G9
atatcaatgactcacaacgtcaagctaccatagatgctggaaccattgctggactccaggtattacgtattactaacgatcccaccgctgctgccatcgcctatggtttagacaaaaatggccaaagtgaaagaaacgtcctcattttcgatctgggtggtggtacttttgatgtaacaatcttaacaattgaggatggtatctttgaagtcacatcaactgctggagacactcacttgggaagtgaagacttcgacaacagaatggtcaatcactttgttggggaaatcaatacggtaattcacaatgaccttaccacaaacaaacgtgccctccgtcg

SEQ ID NO: 801 - DNA, 411 bp, Diabrotica virgifera
  Clone ID: LIB150-042-Q1-E1-F1
aataaccatggctagatttgaagaactcaacgctgatttgttcagatctacaagggaacctgtaaaaaaggcatcagggatgccaagatggacaaatctcaagttcacgatattgtgttggttggtggatctacccgtattccaaaggtacaaaaactgttgcaagatttcttcaatggtaaagaattgaacaagtcgatcaaccccgatgaagctgttgcttatggtgcagccgtccaagccgccatcttgcacggagataagtctgaggaagtacaggacttgctcttgctcgatgtcactccactctcattgggtattgaaactgccggaggtgttatgactgccctcatcaaacgtaacactaccattcccaccaagcaaacccagaccttcactacttactctgac

SEQ ID NO: 802 - DNA, 319 bp, Diabrotica virgifera
  Clone ID: LIB150-034-Q1-E1-F10
caacgacaagtaaacaagtgatatcaaaaatcaaagtagtcaagcgaattatttgacaaagtttttgaacgttttgtgaagtaaaagtattattgtgtgaaattacatcaagaaaatggttaaagttccagcaattggtatcgatttgggcaccacgtattcctgcgtgggtgtctggcagcatggaaaagttgaaatcatcgccaacgaccaaggcaacaaaacaacacccaactatgttgctttcacaaatacagaacgtctcttgggaaaagctgcgaaaaatcaggttgggaataatcccaacaacacaattttt

SEQ ID NO: 803 - DNA, 164 bp, Diabrotica virgifera
  Clone ID: pGUT914
aacaaacgtgccctccgtcgtttgagaacaagctgtgaaagagctaagcgtaccctttcctcatcaacccaagccagcattgaaatcgattctctatttgaaggtattgacttctacacctccatcaccaggggtagatttgaagaactgaacgctgatttgtt

SEQ ID NO: 804 - DNA, 299 bp, Diabrotica virgifera
  Clone ID: pGUT1097
cagctcgtgcccagttcggcgggagggacaaggtcctcgaatcatactgtttcaacttcaagagcaccatggaggatgacataatcaaggatcagatctgcgaaagtgacgacgctaccgtcatggagaaatgcgacgaggttcttgcttggttggatgcgcgtcatttagacgacgacgatgattatgacccctcccaacaggagctcgaacacatctgcgaccccctcatcgtcaacttgtacctaagtgccggtggagctccaagtggcaggtccggtggtttctcatgtggagca

SEQ ID NO: 805 - DNA, 347 bp, Diabrotica virgifera
  Clone ID: LIB150-005-Q1-E1-G11
cgcgaaaacaggtcctcctcaaaaagttccctcaaaaaagccaaaaaggtctgggttcaaatgtctttcccatgttttcgcaatctcaagtagctgaattcaaagaagctttcaaacttatggaccacgacaaagatggcatcatctctaaaagcgatttgagggccaacttcgatgctgttggtaaactcgccagtgagaaagagctcgacgagatgatcaacgaagcacccggaccaatcaacttcactcaattgttgggatttgtcggtacccgtatggctgattcgggcggtactgacgatgatgaagttgtcctcaaggctttcagattctttgacgaaaac

SEQ ID NO: 806 - DNA, 403 bp, Diabrotica virgifera
  Clone ID: LIB150-003-Q1-E2-D9
acccaagcgtccgtgacaaccatggcggataaagaaaagaaggtcaagaagaagaagaaggaagagggcgaagcaccagctgccgctcctgcccccgccgaaaccaggtcctcctcaaagagttcctccaagaaagccaaaaggtctggttccaatgtcttctccatgttttcgcaatctcaagtagctgaattcaaagaagctttccaacttatggaccacgacaaagatggcatcatctctaagagcgatttgagggccaccttcgatgctgttggtaaactcgccagtgagaaagagctcgacgagatgatcaacgaagcacccggaccaatcaacttcactcaattgttgggattgttcggtacccgtatggctgattccggcggtactgacgatgatg

SEQ ID NO: 807 - DNA, 419 bp, Diabrotica virgifera
  Clone ID: LIB149-014-Q1-E1-F12
cccacgcgtccgggagaaactaacatcgttgacaaccatggcggataaagaaaagaaggtcaagaagaagaagaaggaagagggcgaagcaccagctgccgctcctgcccccgccgaaaccaggtcctcctcaaagagttcctccaagaaagccaaaaggtctggttccaatgtcttctccatgttttcgcaatctcaagtagctgaattcaaagaagctttccaacttatggaccacgacaaagatggcatcatctctaagagcgatttgagggccaccttcgatgctgttggtaaactcgccagtgagaaagagctcgacgagatgatcaacgaagcacccggaccaatcaacttcactcaattgttgggattgttcggtacccgtatggctgattccggcggtactgacgatgatg

SEQ ID NO: 808 - DNA, 410 bp, Diabrotica virgifera
  Clone ID: LIB150-038-Q1-E1-C5
acttggagatactaacatcgttgacaaccatggcggataaagaaaagaaggtcaagaagaagaataaggaagagggcgaagcaccagctgccgctcctgcccccgccgaaaccatgtcctcctcaaagagttcctccaagaaagccaaaaggtctggttccaatgtcttctccatgttttcgcaatctcaagtagctgaattcatagaagctttccaacttatggaccacgacaaagatggcatcatctctaagagcgatttgagggccaccttcgatgctgttggtaaactcgccagtgagaaagagctcgacgagatgatcaacgaatcacccggaccaatcaacttcactcaattgttgggattgttcggtacccgtatggctgattccggcggtactgacgatgat

SEQ ID NO: 809 - DNA, 431 bp, Diabrotica virgifera
  Clone ID: LIB150-018-Q1-E1-F5
cacacgcgtccggagaaactaacatcgttgacaaccatggcggataaagaaaagaaggtcaagaagaagaagaaggaataaggcgaatcacctgctgccgctcctgcccccgccgaaaccaggtcctcctcaaagagttcctccaagaaagccaaaatgtctggttccaatgtcttctccatgttttcgcaatctcaagtagctgaattcaaagaagctttccaacttatggaccacgacaaagatggcatcatctctaatagcgagttgagggccatcttccatgctgttggtaaactcgccagtgagaaagagctcgacgagatgatcaacgaagcacccggaccaatcaacttcactcaattgatgggattgttcggtacccatatagctgattccggtggtactgacgatgatgaagttgtcgtcaa

SEQ ID NO: 810 - DNA, 422 bp, Diabrotica virgifera
  Clone ID: LIB150-011-Q1-E1-G9
cttggagaaactaacatcgttgacaaccatggcggataaagaaaagaaggtcaagaagaagaagaaggaagagggcgaagcaccagctgccgctcctgcccccgccgaaaccaggtcctcctcaaagagttcctccaagaaagccaaaaggtctggttccaatgtcttctccatgttttcgcaatctcaagtagctgaattcaaagaagctttccaacttatggaccacgacaaagatggcatcatctctaagagcgatttgagggccaccttcgatgctgttggtaaactcgccagtgagaaagagctcgacgagatgatcaacgaagcacccggaccaatcaacttcactcaattgttgggattgttcggtacccgtaatggctgattccggcggtactgacgatgatgaagttgtcgtc

SEQ ID NO: 811 - DNA, 396 bp, Diabrotica virgifera
  Clone ID: LIB150-005-Q1-E2-G7
acccacgcgtccgggagaaactaacatcgttgacaaccatggcggataaagaaaagaaggtcaagaagaagaagaaggaagaaggcgaagcacctgctgccgctcctgcccccgccgaaaccaggtcctcctcaaagagttcctccaagaaagccaaaaggtctggttccaatgtcatctccatgttttcgcaatctcaagtagctgaattcaaagaagctttccaacttatggaccacgacaaagatggcatcatctctaagagcgatttgagggccaccttcgatgctgttggtaaactcgccagtgagaaagagctcgacgagatgatcaacgaagcacccggaccaatcaacttcactcaattgttgggattgttcggtacccgtatggctg

SEQ ID NO: 812 - DNA, 372 bp, Diabrotica virgifera
  Clone ID: LIB150-005-Q1-E2-G11
agggagaaactaacatcgttgacaaccatggcggataaagaaaagaaggtcaagaagaagaagaaggaagagggcgaagcaccagctgccgctcctgcccccgccgaaaccaggtcctcctcaaagagttcctccaagaaagccaaaaggtctggttccaatgtcttctccatgttttcgcaatctcaagtagctgaattcaaagaagctttccaacttatggaccacgacaaagatggcatcatctctaagagcgatttgagggccaccttcgatgctgttggtaaactcgccagtgagaaagagctcgacgagatgatcaacgaagcacccggaccaatcaacttcactcaattgttgggattgttcggt

SEQ ID NO: 813 - DNA, 359 bp, Diabrotica virgifera
  Clone ID: LIB150-003-Q1-E1-D9
cccacgcatccgtgacaaccatggcggataaagaaaagaaggtcaagaagaagaagaaggaagagggcgaagcaccagctgccgctcctgcccccgccgaaaccaggtcctcctcaaagagttcctccaagaaagccaaaaggtctggttccaatgtcttctccatgttttcgcaatctcaagtagctgaattcaaagaagctttccaacttatggaccacgacaaagatggcatcatctctaagagcgatttgagggccaccttcgatgctgttggtaaactcgccagtgagaaagagctcgacgagatgatcaacgaagcacccggaccaatcaacttcactcaattgttgggattg

SEQ ID NO: 814 - DNA, 390 bp, Diabrotica virgifera
  Clone ID: LIB150-014-Q1-E1-G12
cccacgcgtccgcggacgcgtgggggagaaactaacatcgttgacaaccatggcggataaagaaaagaaggtcaagaagaagaagaaggaagagggcgaagcaccagctgccgctcctgcccccgccgaaaccaggtcctcctcaaagagttcctccaagaaagccaaaaggtctggttccaatgtcttctccatgttttcgcaatctcaagtagctgaattcaaagaagctttccaacttatggaccacgacaaagatggcatcatctctaagagcgatttgagggccaccttcgatgctgttggtaaactcgccagtgagaaagagctcgacgagatgatcaacgaagcacccggaccaatcaacttcactcaattgttgggattgtt

SEQ ID NO: 815 - DNA, 394 bp, Diabrotica virgifera
  Clone ID: LIB150-005-Q1-E2-G8
ggagaaactaacatcgttgacaaccatggccgttaatgaaaagaaggtcatgaagaataagaaggaataatgcgaagcacctgctgccgctcctgcccccgccgaaaccaggtcctcctcaaagagttcctccaagaaagtcaaaaagtctggttccaatgtcatctccatgttttcgcaatctcaagtagctgaattcacagaagctttccaacttatggaccaagacatagatggcatcatctctaagatcgatttgagggccaccttcgatgctgttggtaaactcgccagtgagaaagagctcgactatatgatcaatgaagcacccggaccaatcaacttcactcaattgttgggattgttcggtacccgtatggctgattccagtggt

SEQ ID NO: 816 - DNA, 348 bp, Diabrotica virgifera
  Clone ID: LIB149-042-Q1-E1-H7
atcagggagaaactaacatcgttgacaaccatggcggataaagaaaagaaggtcaagaagaagaagaaggaagagggcgaagcaccagctgccgctcctgcccccgccgaaaccaggtcctcctcaaagagttcctccaagaaagccaaaaggtctggttccaatgtcttctccatgttttcgcaatctcaagtagctgaattcaaagaagctttccaacttatggaccacgacaaagatggcatcatctctaagagcgatttgagggccaccttcgatgctgttggtaaactcgccagtgagaaagagctcgacgagatgatcaacgaagcacccggaccaatcaac

SEQ ID NO: 817 - DNA, 339 bp, Diabrotica virgifera
  Clone ID: LIB150-020-Q1-E1-H12
acggacgcgtgggcttggagaaactaacatcgttgacaaccatggcggataaagaaaagaaggtcaagaagaagaagaaggaagagggcgaagcaccagctgccgctcctgcccccgccgaaaccaggtcctcctcaaagagttcctccaagaaagccaaaaggtctggttccaatgtcttctccatgttttcgcaatctcaagtagctgaattcaaagaagctttccaacttatggaccacgacaaagatggcatcatctctaagagcgatttgagggccaccttcgatgctgttggtaaactcgccagtgagaaagagctcgacgagatgatcaacg

SEQ ID NO: 818 - DNA, 330 bp, Diabrotica virgifera
  unsure (1)..(330): unsure at all n locations
  Clone ID: LIB150-030-Q1-E1-G2
gacaaccatggggggtaaagaaaagaaaggccagaagaagaagaaaggaaaaggccaaacaacaactggcggtcctggccccggcgaaaacaagtcctcctcaaagaatttctccaagaaagccaaaaaggcctggttcaaatgtcctcccccatgttttccgaatcctcaattacctgaaattcanagaaacctttccaacttatggaccacgacaaagatggcatcatctctaagagcgatttgagggccaccttcgatgctgttggtaaactcgccagtgagaaagagctcgacgagatgatcaaacaagcacccggaccaatcaac

SEQ ID NO: 819 - DNA, 500 bp, Diabrotica virgifera
  unsure (1)..(500): unsure at all n locations
  Clone ID: pGUT3516
gtcccanaggccgaggtagaggtcgtggcagaggacgtggtcgtggaaaggaagatcaaaaagaatgggtaccagtaaccaagctaggacgtttagtcaaggatggaaagatccgttctcttgaagaaatctacctgttctctttgccaatcaaagaattcgaaatcatcgatcatttcattggatcagacttgaatgatgaggtattgaaaatcatgcctgtccagaagcaaactcgtgctggtcaacgtacacgtttcaaggcgtttgttgccattggagatagcaaaggacacattggattaggtgtaaaatgcagcaaggaagtagcaactgccatcagaggtgctattattttagccaaactgtctgtcgttccagtacgaagaggatactggggtaacaagattggtcaaccccacactgtaccttgcaaggttactggaaaatgtggttctgttactgtgcgtttgatcccagctccccgtggtaccggaatc

SEQ ID NO: 820 - DNA, 436 bp, Diabrotica virgifera
  Clone ID: LIB3026-022-Q1-E1-A5
ccacgagtccggatctctttgccaatcaaagaatttgaaatcatcgatcatttcattggatcagacttgaatgatgaggtattgaaaatcatgcctgtccagaagcaaactcgtgctggtcaacgtacacgtttcaaggcgtttgttgccattggagatagcaaaggacacattggattaggtgtaaaatgcagcaaggaagtagcaactgccatcagaggtgctattattttagccaaactgtctgttgttccagtacgaagaggatactggggtaacaagattggtcaaccccacactgtaccttgcaaggttactggaaaatgtggttctgttactgtgcgtctgatcccagctccccgtggtaccggaatcgtttctgcccctgttcctaagacacttctgcagatggctggtattgaagattgctacacat

SEQ ID NO: 821 - DNA, 474 bp, Diabrotica virgifera
  Clone ID: pGUT2628
ccgatgtagaggtcgtggcagaggacgtgggcgtggaaaggaagatcaggaagaatgggtaccagtaaccaagctaggacgtttagtcaaggatggaaagatccgttctcttgaagaaatctacctgttctctttgccaatcaaagaattcgaaatcatcgatcatttcattggatcagacttgaatgatgaggtattgaaaatcatgcctgtccagaagcaaactcgtgctggtcaacgtacacgtttcaaggcgtttgttgccattggagatagcaaaggacacattggattaggtgtaaaatgcagcaaggaagtagcaactgccatcagaggtgctattattttagccaaactgtctgtcgttccagttcgaagaggatactggggtaacaagattggtcaaccccacactgtaccttgcaagggtactggaaaatgtggttctgatactgtgcgtttgatcccagcttc

SEQ ID NO: 822 - DNA, 439 bp, Diabrotica virgifera
  Clone ID: LIB3026-023-Q1-E1-E10
ccacgcctccgcaaacgcgtcagaaccaagctaggacgtttagtcaaggatggaaagatccgttctcttgaagaaatctacctgttctctttgccaatcaaagaatttgaaatcatcgatcatttcattggatcagacttgaatgatgaggtattgaaaatcatgcctgtccagaagcaaactcgtgctggtcaacgtacacgtttcaaggcgtttgttgccattggagatagcaaaggacacattggattaggtgtaaaatgcagcaaggaagtagcaactgccatcagaggtgctattattttagccaaactgtctgttgttccagtacgaagaggatactggggtaacaagattggtcaaccccacactgtaccttgcaaggttactggaaaatgtggttctgttactgtgcgtttgatcccagctccccgtggta

SEQ ID NO: 823 - DNA, 414 bp, Diabrotica virgifera
  unsure (1)..(414): unsure at all n locations
  Clone ID: LIB149-036-Q1-E1-B4
aacgtttcaaggcgtttgttgccattggagatagcanaggacacattggattaagtgtaaaatgcagcaaggaagtagcaactgccatcagaggtgctattattttagccaaactgtctgtcgttccagtacgaagaggatactggggtaacaagattggtcaaccccacactgtaccttgcaaggttactggaaaatgtggttctgttactgtgcgtttgattccagctccccgtggtaccggaatcgtttctgcccctgttcctaagaaacttctgcagatggctggtattgaagattgctacacatccgctagaggttccactggtactttaggtaactttgccanagctacatacgcagccatcgcanagacctatgcttacttgacacctgatttgtggaaggatatgg

SEQ ID NO: 824 - DNA, 444 bp, Diabrotica virgifera
  Clone ID: LIB150-023-Q1-E1-E6
ctcgcgggtcgatacaagcctctaaaatgaatcatgatataaacaatggcggacgcagctccagccggtggacgtggtggattccgaggaggttttggaggtggtggccgtggaggcggtagaggtggtcccagaggccgaggtagaggtcgtggcagaggacgtggtcgtggaaaggaagatcaaaaagaatgggtaccagtaaccaagctaggacgtttagtcaaggatggaaagatccgttctcttgaagaaatctacctgttctctttgccaatcaaagaattcgaaatcatcgatcatttcattggatcagacttgaatgatgaggtattgaaaatcatgcctgtccagaagcaaactcgtgctggtcaacgtacacgtttcaaggcgtttgttgccattggagatagcagaggacacattggattaagtgtaaaatgc

SEQ ID NO: 825 - DNA, 420 bp, Diabrotica virgifera
  unsure (1)..(420): unsure at all n locations
  Clone ID: LIB3026-015-Q1-E1-D2
caaagaagaaggaactaaacaatggcggacgcagctccagccggtggacgtggtggattccgaggaggttttggaggtggtggccgtggaggcggtagaggtggtcccagaggccgaggtagaggtcgtggcagaggacgtggtcgtggaaaggaagatcaaaaagaatgggtaccagtaaccaagctaggacgtttagtcaaggatggaaagatccgttctcttgaagaaatctacctgttctctttgccaatcaaagaattcgaaatcatcgatcatttcattggatcagacttgaatgatgaggtattgaaaatcatgcctgtccagaagcaaactcgtgctggtcaacgtacacgtttcaaggcgtntgttgccattggagatagcaaaggacacattggattaggtgtaaaatgc

SEQ ID NO: 826 - DNA, 407 bp, Diabrotica virgifera
  Clone ID: LIB150-049-Q1-E1-D11
agaaacaatggaggacgcagctccagccggtggacgtggtggattccgaggaggttttggaggtggtggccgtggaggcggtagaggtggtcccagaggcagaggtagaggtcgtggcagaggacgtggtcgtggaaaggaagatcaaaaagaatgggtaccagtaaccaagctaggacgtttagtcaaggatggaaagatccgttctcttgaagaaatctacctgttctctttgccaatcaaagaattcgaaatcatcgatcatttcattggatcagacttgaatgatgaggtattgaaaatcatgcctgtccagaagcaaactcgtgctggtcaacgtacacgtttcaaggcgtttgttgccattggagatagcaaaagacacattggattaggtgtaaaatgca

SEQ ID NO: 827 - DNA, 418 bp, Diabrotica virgifera
  unsure (1)..(418): unsure at all n locations
  Clone ID: LIB150-045-Q1-E1-A8
aaaactaaacaatggcggacgcagctccagccggtggacgtggtggattccgaggaggttttggaggtggtggccgtggaggcggtagaggtggtcccagaggcagaggtagaggtcgtggcagaggacgtggtcgtggaaaggaagatcaaaaagaatgggtaccagtaaccaagctaggacgtttagtcaaggatggaaagatccgttctcttgaagaaatctacctgttctctttgccaatcaaagaattcgaaatcatcgatcatttcattggatcagacttgaatgatgaggtattganaatcatgcctgtcaagaagcaaactcgtgctggtcaacgtacacgtttcaaggcgtntgttgccattggagatagcanaggacacattggattaggtgtaaaatgcagcaagga

SEQ ID NO: 828 - DNA, 403 bp, Diabrotica virgifera
  Clone ID: LIB150-037-Q1-E1-F10
agccgaagaagaaggaactaaacaatggcggacgcagctccagccggtggacgtggtggattccgaggaggttttggaggtggtggccgtggaggcggtagaggtggtcccagaggccgaggtagaggtcgtggcagaggacgtggtcgtggaaaggaagatcaaaaagaatgggtaccagtaaccaagctaggacgtttagtcaaggatggaaagatccgttctcttgaagaaatctacctgttctctttgccaatcaaagaattcgaaatcatcgatcatttcattggatcagacttgaatgatgaggtattgaaaatcatgcctgtccagaagcaaactcgtgctggtcaacgtacacgtttcaaggcgtttgttgccattggagatagcaaaggacaca

SEQ ID NO: 829 - DNA, 371 bp, Diabrotica virgifera
  Clone ID: LIB149-034-Q1-E1-A11
aagaatgaatcaaacaatggcggacgcagctccagccggtggacgtggtggattccgaggaggttttggaggtggtggccgtggaggcggtagaggtggtcccagaggccgaggtagaggtcgtggcagaggacgtggtcgtggaaaggaagatcaaaaagaatgggtaccagtaaccaagctaggacgtttagtcaaggatggaaagatccgttctcttgaagaaatctacctgttctctttgccaatcaaagaattcgaaatcatcgatcatttcattggatcagacttgaatgatgaggtattgaaaatcatgcctgtccagaagcaaactcgtgctggtcaacgtacacgtttcaaggcgtttgttg

SEQ ID NO: 830 - DNA, 382 bp, Diabrotica virgifera
  unsure (1)..(382): unsure at all n locations
  Clone ID: LIB150-026-Q1-E1-A3
tacaacaccctaaagtgagtcgtataaacaatggcggacgcagctccagccggtggacgtggtggattccgaagaagttttggangtggtggccgtggaggcggtagagtggtccaaagccgangtanangtcgtggcagaggacgtggtcgtggaaaggaagatcaaaaagaatgggtaccagtaaccaagctaggacgtttagtcaaggatggaaagatccgttctcttgaagaaatctacctgttctctttgccaatcaaagaattcgaaatcatcgatcatttcattggattagacttgaatgatgaggtattgaaaatcatgcctgtccagaagcaaactcgtgctggtcaacgtacacgtttcaaagcgtttgttg

SEQ ID NO: 831 - DNA, 344 bp, Diabrotica virgifera
  Clone ID: pGUT2618
gtgcgtttgatcccagctccccgtggtaccggaatcgtttctgcccctgttcctaagaaacttctgcagatggctggtattgaagattgctacacatccgctagaggttccactggtactttaggtaactttgccaaagctacatacgcagccatcgcaaagacctatgcttacttgacacctgatttgtggaaggatatggctttagctaagacaccataccaagagtttgctgactacttggctaagaatcaccgtcctgtcactggcccagctcgtgcggaaactgcttaagttcacgtgttttgtgatcttttgtatgtaaaataaataataacagcttt

SEQ ID NO: 832 - DNA, 376 bp, Diabrotica virgifera
  unsure (1)..(376): unsure at all n locations
  Clone ID: LIB150-023-Q1-E1-E7
atacaacaccctaaagtgagtcgtattaagcncagtggcgggcgcagctccagccggtggacgtggtggattccgaggaggttttggaggtggtggccgtggaggcggtagaggtggtcccaggggccgaggtagaggtcgtggcagacgacgtggtcgtggaaaggaagatcaaaaagaatgggtaacagtaagcaagctaggacgtttagtcaaggatggaaagatccgttcgcttgaagaaatctacctgttctctttgccactcaaggaattcgaaatcatcgatcatttcattggatcagacttgaatgatcatgtattgaaaatcatgcctgtcgagaagcagactcctgctggtcaacctacacgtttc

SEQ ID NO: 833 - DNA, 411 bp, Diabrotica virgifera
  Clone ID: LIB3026-007-Q1-E1-B12
gagctctccaaagtgttcatgagctgtaacctaattactggcatgcaacagagactagataagatgagaaagcaggcctttgcatctgtatgcctttttggagaagacaacaacagcacaatctccggtatctgggtatggagaggacaagaattagcttttaccttaagtcccgactggcaaatagattatgaatcctatgaatggaagaagttagatgccaaatcagaagaaacaaagaaattagtagagcaatacttctcatggacaggtactgacaaacaaggtagaaaattcaatcaaggaaaaatctttaaatgatctacatctatttaataaatcttacaaaatgctgtactgatcatgtgaagcaagagaaataaatcccaatgttttgttaataatattttt

SEQ ID NO: 834 - DNA, 549 bp, Diabrotica virgifera
  Clone ID: pGUT2534
gttgcctgcaacctattgaatgcctacaaatatgtacttgatcccaactttagaaaatcttttggtaacgtcaatagatggttcaatacacttattaaccagccacaattcatagctgtacttggagaagttaaactttgcagtgcagttgctcaacctggaactttaactgctgcagctgcaacaccaggtaaaggtaagaagaaggaagaaaagaaacaagagaagaagccacaaacacctaaagaaaagaaggaaaaggaacagccagaagaattagatgctgcagaagccgctcttgctgaagaacccaagagtaaggaccctttttctgaactacctaaaggaacctttgttatggatgactttaaacgtgtctattcaaatgaagaagagagcaaatcaattgcttatttctgggaaaaattcgaccctgaaaactattcaatctggtatggtgaatacaaataccctgaagagctctccaaagtgttcatgagctgtaacctaattactggcatgcaacagagactagataagatgagaaag

SEQ ID NO: 835 - DNA, 431 bp, Diabrotica virgifera
  Clone ID: LIB150-024-Q1-E1-G5
atgagaatggctgcaggaactctttacacttatcccgaaaatttccgggccgcaaaaactctgattgccgcacaatatgccaaggcaaacgtcaaagtagcacccaattttgtttttggagaaactaataaaactaaagagttcaccaagaaatttccaagtggaaaggttcctgcttttgaatcaaacgatggcaagtaccttcaagacagcaacgccatcgcttactatgtttccaatgaacaactaagaggaaagaacgactatgatagagcacaaattttgcaatggattggctttgctgaaggtgaaattgttccagcagcatgtgcctgggtattccctatcttgggaattgttaaaaataacagtggtaatgatgagactttccaaagagcaaaggaagaccttaaatcctctttgtctattct

SEQ ID NO: 836 - DNA, 394 bp, Diabrotica virgifera
  Clone ID: LIB150-015-Q1-E1-F9
gaaagaatagctgccggaactctttacacttatcccgaaaatttccgggccgcaaaaactctgattgccgcacagtatgccacggcaaacgtcaaagtagcacccaattttgtttttggagaaactaataatactaatgagttcaccaagaaatttccaagtggaaatgttcctgcttttgaagcaaacgatggcaagtaccttcaagacagcaacgccatcacttactatgtttccaatgaacaactaagaggaaaaaacgaatatgatagagcacaaattttgcaatggattggctttgccgaatgtgaaagtgttccaacaacatgttcctgggtattccctatcttgggaattgttaacaataacagtggtaatgatgagactttccaaa

SEQ ID NO: 837 - DNA, 445 bp, Diabrotica virgifera
  Clone ID: LIB150-001-Q1-E1-E1
gttttgagtgtagtgagaatggctgccggaactctttacacttatcccgaaaatttccgggccgcaaaaactctgattgccgcacaatatgccaaggcaaacgtcaaagtagcacccaattttgtttttggagaaactaataaaactaaagagttcaccaagaaatttccaagtggaaaggttcctgcttttgaatcaaacgatggcaagtaccttcaagacagcaacgccatcgcttactatgtttccaatgaacaactaagaggaaaaaacgaatatgatagagcacaaattttgcaatggattggctttgctgaaggtgaaattgttccagcagcatgtgcctgggtattccctatcttgggaattgttaaaaataacagtggtaatgatgagactttccaaagagcaaaggaagaacttaaatcctctttgtctattctca

SEQ ID NO: 838 - DNA, 419 bp, Diabrotica virgifera
  Clone ID: LIB150-019-Q1-E1-E11
gtgagaatggctgccggaactctttacacttatcccgaaaatttccgggccgcaaaaactctgattgccgcacaatatgccaaggcaaacgtcaaagtagcacccaattttgtttttggagaaactaataaaactaaagagttcaccaagaaatttccaagtggaaaggttcctgcttttgaatcaaacgatggcaagtaccttcaagacagcaacgccatcgcttactatgtttccaatgaacaactaagaggaaaaaacgaatatgatagagcacaaattttgcaatggattggctttgctgaaggtgaaattgttccagcagcatgtgcctgggtattccctatcttgggaattgttaaaaataacagtggtaatgatgagactttccaaagagcaaaggaagaccttaaatcctc

SEQ ID NO: 839 - DNA, 418 bp, Diabrotica virgifera
  Clone ID: LIB150-010-Q1-E2-D7
gagagaatggctgccggaactctttacacttatcccgaaaatttccgggccgcaaaaactctgattgccgcacaatatgccaaggcaaacgtcaaagtagcacccaattttgtttttggagaaactaataaaactaaagagttcaccaagaaatttccaagtggaaaggttcctgcttttgaatcaaacgatggcaagtaccttcaagacagcaacgccatcgcttactatgtttccaatgaacaactaagaggaaaaaacgaatatgatagagcacaaattttgcaatggattggctttgctgaaggtgaaattgttccagcagcatgtgcctgggtattccctatcttgggaattgttaaaaataacagtggtaatgatgagactttccaaagagcaaaggaagaccttaaatcct

SEQ ID NO: 840 - DNA, 398 bp, Diabrotica virgifera
  Clone ID: LIB150-005-Q1-E2-F11
acggacgcgtggggtagtgagaatggctgccggaactctttacacttatcccgaaaatttccgggccgcaaaaactctgattgccgcacaatatgccaaggcaaacgtcaaagtagcacccaattttgtttttggagaaactaataaaactaaagagttcaccaagaaatttccaagtggaaaggttcctgcttttgaatcaaacgatggcaagtaccttcaagacagcaacgccatcgcttactatgtttccaatgaacaactaagaggaaaaaacgaatatgatagagcacaaattttgcaatggattggctttgctgaaggtgaaattgttccagcagcatgtgcctgggtattccctatcttgggaattgttaaaaataacagtggtaatgatg

SEQ ID NO: 841 - DNA, 410 bp, Diabrotica virgifera
  Clone ID: LIB150-043-Q1-E1-A6
accacgcgtccggtgagaatggctgccggaactctttacacttatcccgaaaatttccgggccgcaaaaactctgattgccgcacaatatgccaaggcaaacgtcaaagtagcacccaattttgtttttggagaaactaataaaactaaagagttcaccaagaaatttccaagtggaaaggttcctgcttttgaatcaaacgatggcaagtaccttcaagacagcaacgccatcgcttactatgtttccaatgaacaactaagaggaaaaaaacgaatatgatagagcacaaattttgcaatggattggctttgctgaaggtgaaattgttccagcagcatgtgcctgggtattccctatcttgggaattgttaaaaataacagtggtaatgatgagactttccaaagag

SEQ ID NO: 842 - DNA, 396 bp, Diabrotica virgifera
  unsure (1)..(396): unsure at all n locations
  Clone ID: LIB150-038-Q1-E1-A9
atgagaatggctgccggaactcctttaaacttaccccgaaaatttccgggccgcaaaaactctaattgccgcacaatatgccaaggcaaacttcaaattagcacccaattttgtttttggagaaactaataaaactaaagagttcaccaagaaatttccaagtggaaaggttcctgcttttgaatcaaacgatggcaagtaccttcaagacagcaacgccatcgcttactatgtttccaatgaacaactaagaggaaaaaacgaatatgatagagcacaaattttgcaatggattggctttgctgaaggtgaaattgttccagcagcatgtgcctgngtattcnctatcttgggaattgttaaaaataacagtggtaatgatgagactttccaaag

SEQ ID NO: 843 - DNA, 280 bp, Diabrotica virgifera
  unsure (1)..(280): unsure at all n locations
  Clone ID: LIB150-005-Q1-E1-F11
tttacacttatcccgaaaatttccgggccgcaaaaactctgattgccgcacattatgccaaggcaaacgtcaaggtagcacccaattttgtttttggagaaactaatanaactaaagagttcaccaagaaatttccacgtggaaaggttcctgcttntgaatcaaacgatggcaagtaccttcaagacagcaacgccatcgcttactatgtgtccaatgaacagctaagaggaaaanacgaatatgatagagcacaaattttgcaatggattggctttgc

SEQ ID NO: 844 - DNA, 313 bp, Diabrotica virgifera
  unsure (1)..(313): unsure at all n locations
  Clone ID: pGUT164
ttcggcacgagccggaactctttacacttatcccgaaaatttccgggccgcaaaaactctgattgccgcacaatatgccaaggcaaacgtcaaagtagcacccaattttgtttttggagaaactaataaaactaaagagttcaccaagaaatttccaagtggaaaggtacctgcttttgaatcaaacgatagcaagtaccttcaagacagcaacgccatcgcttactatgtttcccatgaacaactangaggaaaaaacgactatgattgagcacaaattttgcaatggattggctttgctgaaggtgaaatt

SEQ ID NO: 845 - DNA, 286 bp, Diabrotica virgifera
  Clone ID: LIB150-017-Q1-E1-C4
gagagaatggctgccggaactctttacacttatcccgaaaatttccgggccgcaaaaactctgattgccgcacaatatgccaaggcaaacgtcaaagtagcacccaattttgtttttggagaaactaataaaactaaagagttcaccaagaaatttccaagtggaaaggttcctgcttttgaatcaaacgatggcaagtaccttcaagacagcaacgccatcgcttactatgtttccaatgaacaactaagaggaaaaaacgaatatgatagagcacaaattttgc

SEQ ID NO: 846 - DNA, 236 bp, Diabrotica virgifera
  Clone ID: pGUT1218
cggaactctttacacttatcccgaaaatttccgggccgcaaaaactctgattgccgcacaatatgccaaggcaaacgtcaaagtagcacccaattttgtttttggagaaactaataaaactaaagagttcaccaagaaatttccaagtggaaaggttcctgcttttgaatcaaacgatggcaagtaccttcaagacagcaacgccatcgcttactatgtttccaatgaacaactaa

SEQ ID NO: 847 - DNA, 477 bp, Diabrotica virgifera
  unsure (1)..(477): unsure at all n locations
  Clone ID: LIB150-031-Q1-E1-E2
cgaaggtttgacgtatcggagaaggtcctaacagtttagaataatgaaatatcttgcagtttttgtgatttttgcgtatttatacgcagctcatgctagtgtttatttagaagagaaattcagtgatgattcctgggaaaagaattggatatacagcaaaaacccagataaagaatttggaaaatttgttaggacagctggaaaattctttaatgatgaagaagaagataaaggtcttcagacatctgaagatgcacgtttctatgccttaagtagaaaattcaaatccttctccacagaaggtaaagatctagttatccaatttactgtaaaacacgaacaaaacattgattgtggaggtggatacgttaaagtatttgattgttccttgaaacctgaagaattacatggggaaactccatacaggcttatgttcggtcncgatatttgtggacctggttacaaaaaagtacatgt

SEQ ID NO: 848 - DNA, 395 bp, Diabrotica virgifera
  Clone ID: LIB3026-001-Q1-E1-C9
ataccaaaaaagtacatgttatccttaactacaaggataaaaatgtccttattaacaaggacatcagatgtaaggatgatatctacactcacgcctacactcttattgttcgcccagataacacttatgaagtacaaatcgatggtgaaaaggtagaatctggagaactagaaagtgattgggatcttcttccacccaagaaaattaaagacccagaagccaaaaaaccagaagattgggatgacagggctactattccagacccagatgattccaaacctgaagattgggacaagccagaacacatcccagacccagatgccaccaaacctgatgactgggacgatgaaatggatggcgaatgggaaccaccaatgattgataaccccgaatac

SEQ ID NO: 849 - DNA, 435 bp, Diabrotica virgifera
  Clone ID: LIB149-033-Q1-E1-F8
gcgggccgatacacgcgtctagtctaaggcttgacatatcggagaaggtcctaacagtttagaataatgaaatatcttgcagtttttgtgatttttgcgtatttatacgcagctcatgctagtgtttatttagaagagaaattcagtgatgattcctgggaaaagaattggatatacagcaaaaacccagataaagaatttggaaaatttgttaggacagctggaaaattctttaatgatgaacaagaagataaaggtcttcagacatctgaagatgcacgtttctatgccttaagtagaaaattcatatccttctccacagaatgtaaagatctagttatccaatttactgtaaaacacgaacaatacattgattgtggaagtggatacgttaaagtatttgattgttccttgaaacctgaagaattacatggg

SEQ ID NO: 850 - DNA, 425 bp, Diabrotica virgifera
  unsure (1)..(425): unsure at all n locations
  Clone ID: LIB150-038-Q1-E1-A2
atcgaaggattgacgtatcggaaaaggtcctaacagtttagaataatgaaatatcttgcagtttttgtgatttttgcgtatttatacgcagctcatgctagtgtttatttagaagagaaattcagtgatgattcctgggaaaagaattggatatacagcaaaaacccagataaagaatttggaaaatttgttaggacagctggaaaattctttaatgatgaagaagaagataaaggtcttcagacatctgaagatgcacgtttctatgccttaagtagaagattcaaatccttctccacagaaggtaaagatctagttatccaatttactgtaaaacacgaacaaaacatctgattgtggaggtggatacgttaaagtatttgattgttccttganacctgaagaagtacatggggaaactccat

SEQ ID NO: 851 - DNA, 382 bp, Diabrotica virgifera
  Clone ID: LIB150-036-Q1-E1-D1
tggtctaaggcttgacatatcggagaaggtcctaacagtttagaataatgaaatatcttgcagtttttgtgatttttgcgtatttatacgcagctcatgctagtgtttatttagaagagaaattcagtgatgattcctgggaaaagaattggatatacagcaaaaacccagataaagaatttggaaaatttgttaggacagctggaaaattctttaatgatgaagaagaagataaaggtcttcagacatctgaagatgcacgtttctatgccttaagtagaaaattcaaatccttctccacagaaggtaaagatctagttatccaatttactgtaaaacacgaacaaaacattgattgtggaggtggatacgttaaagtaat

SEQ ID NO: 852 - DNA, 381 bp, Diabrotica virgifera
  Clone ID: LIB149-005-Q1-E1-E2
agcttgtcgaaggtttgacgtatcggagaaggtcctaacagtttagaataatgaaatatcttgcagtttttgtgatttttgcgtatttatacgcagctcatgctagtgtttatttagaagagaaattcagtgatgattcctgggaaaagaattggatatacagcaaaaacccagataaagaatttggaaaatttgttaggacagctggaaaattctttaatgatgaagaagaagataaaggtcttcagacatctgaagatgcacgtttctatgccttaagtagaaaattcaaatccttctccacagaaggtaaagatctagttatccaatttactgtaaaacacgaacaaaacattgattgtggaggtggatacgttaaag

SEQ ID NO: 853 - DNA, 368 bp, Diabrotica virgifera
  Clone ID: LIB149-005-Q1-E1-E5
aaaaggtttgacgtatcggagaaggtcctaacagtttagaataatgaaatatcttgcagtttttgtgatttttgcgtatttatacgcagctcatgctagtgtttatttagaagagaaattcagtgatgattcctgggaaaagaattggatatacagcaaaaacccagataaagaatttggaaaatttgttaggacagctggaaaattctttaatgatgaagaagaagataaaggtcttcagacatctgaagatgcacgtttctatgccttaagtagaaaattcaaatccttctccacagaaggtaaagatctagttatccaatttactgtaaaacacgaacaaaacattgattgtggaggtggatacg

SEQ ID NO: 854 - DNA, 420 bp, Diabrotica virgifera
  Clone ID: LIB149-025-Q1-E1-B10
gggtcgctacacgcctctaaaatgcctcgtatctcagatgattgggatgacagggctactattccagacccagatgactccaaacctgaagattgggacaggccggaacacttcccagacccagatgccaccattcctgatgactgggacgatgaactggatggcgaatgggaaccaccaatgattgataaccccgaatacaaaggtgaatggaaaccaacgcatatcgataaccctgcatacacaggtgcctgcgttcaccctgaaatcgacaatcccgaatacactcgcgatgcacatcttttacaaacattaagaattctgtggaacctgtttcgatttatggcaagtcagatctggtaccatcttcgataatgtcctcgtcactgatgatgtagatcatgccatgaaagcactatc

SEQ ID NO: 855 - DNA, 360 bp, Diabrotica virgifera
  Clone ID: LIB150-039-Q1-E1-G8
agggtttgacgtatcggagaaggtcctaacagtttagaataatgaaatatcttgcagtttttgtgatttttgcgtatttatacgcagctcatgctagtgtttatttagaagagaaattcagtgatgattcctgggaaaagaattggatatacagcaaaaacccagataaagaatttggaaaatttgttaggacagctggaaaattctttaatgatgaagaagaagataaaggtcttcagacatctgaagatgcacgtttctatgccttaagtagaaaattcaaatccttctccacagaaggtaaagatctagttgaccaatttaacgtaaaacacgaacaagacattgattgtggaggtg

SEQ ID NO: 856 - DNA, 426 bp, Diabrotica virgifera
  unsure (1)..(426): unsure at all n locations
  Clone ID: LIB150-013-Q1-E1-B2
gtcgaagggttgacgtatcggagaagggcctaacagtttagaataatgaaatatcctgcagtttttgggaattttgcgtaattatacgcagctcaagctaatgtttaattagaagagaaattcaatgatgaatcctgggaaaagaattgggtatacagcaaaaacccaaattaagaatttggaaaatttgttaagacaactgggaaaatccttaatgaatgaagagaaggataaaggtctcaaacaatcgaaaaatgcacgttccaaggcctaaggtagaaaattcaaatctttctcacagaaggtaaggatccagttatccaatttactggtaaacacgaacanaacattgattgtggaggtggatacgttaaagtatntgattgttccttganacctgaagaattacatggggaaactccatac

SEQ ID NO: 857 - DNA, 416 bp, Diabrotica virgifera
  Clone ID: LIB3026-026-Q1-E1-C10
agaaaggtgcctgggttcaccctgaaatcgacaatcccgaatacactcccgatgcaaacctttacaaacaaaaagaaatctgtggaatcggtttcgatttatggcaagtcaaatctggtaccatcttcgataatgtcctcgtcactgatgatgtagattatgccaagaaagcactatcaggtcttaaagataaacaagagggtgaaaagaaggttaaagaagaacaagacaaagccgaaagagaatctaccagtgaagatgaaaagaaagaggatgacgatgatgatgatgaggatgatgatgcagaagaacatgtgccacaagtagaagaaggcgatcacgatgagttataaaaatagtgtaaagtgaactaaagagactttttttatatattacaggtgtgaagtgttttgttc

SEQ ID NO: 858 - DNA, 429 bp, Diabrotica virgifera
  Clone ID: LIB3026-020-Q1-E1-D8
cgtgggcaaatacacacccgatgcaaacctttacaaacaaggataaatctgtggaatcggtttcgatttatggcaagtcaaatctggtaccaacttcgattatgtcctcgtcactgatgatgtatattacgccaagaaagcattatcaagtcttaaagatacacaagactgtgacaagaatgttaacgaataacaagtacgtgcccaaggagaatctatcagtgatgatgaaaataacgaggatgacgatgatgatgatgatgatgatgatgcataacaacatgtgccacatgtagaagaaagctatcaccatgacttataataatagtctaaagtgaactgaagagacattttttatatattacaggtgtgaagtgttctgttcgatagtgtgtactgttccttgactgaattttgtacatttcgatc

SEQ ID NO: 859 - DNA, 409 bp, Diabrotica virgifera
  Clone ID: LIB149-045-Q1-E1-A12
ctcacgggtcgatacacgactctaggataagtcataacacatcccagacccagatgccaccaaacctgatgactgggacgatgaaatggatggcgaatgggaaccaccaatgattgataaccccgaatacaaaggtgaatggaaacctttacaaacaaaaagaaatctgtggaatcggtttcgatttatggcaagtcaaatctggtaccatcttcgataatgtcctcgtcactgatgatgtagattatgccaagaaagcactatcaggtcttaaagataaacaagagggtgaaaagaaggttaaagaagaacaagacaaagccgaaagagaatctaccagtgaagatgaaaagaaagaggatgacgatgatgatgatgaggatgatgatgcagaagaacatgtgccaca

SEQ ID NO: 860 - DNA, 366 bp, Diabrotica virgifera
  Clone ID: LIB149-021-Q1-E1-H8
aaaactttcgttatatttataacatcaatcaaaccatcataccaaaaacaacatgaagtccgtagcggtattcgtatttttggcctgcttcgcaggtttacaggctgtccagctgaaatgtgcccaccaagaactggatatcccaaaagattggatcgacatgaacaacgtttgtgtgaaaaagatgagaggccaagttgaagaggaacttaaagcttccatgcaatacatggccatgggtgcatatttcgcaagagacacagtgaacagacccggttttgctgatttatttttcaaatcagctagtgaagaaagggaacatgccatcaaattgatccattatttgctcatgagaggagaacttac

SEQ ID NO: 861 - DNA, 391 bp, Diabrotica virgifera
  unsure (1)..(391): unsure at all n locations
  Clone ID: LIB150-042-Q1-E1-H1
agactacagtgattacttacgtattgaataaactttcgttatatttataacatcaatcgaaccatcataccanaaacaacatgaagtccgtagcggtattcgtatttttggcctgcttcgcangtttacaggctgtccagctgaaatgtgcccaccaagaactggatatcccaaaagattggatcgacatgaacaacgtttgtgtgaaaaagatgagaggccaagttgaagaggaacttaaagcttcaatgcaatacatggccatgggtgcatacttcgcaagagacacagtgaacagacccggttttgctgatttatttttcaaatcagctagtgaagaaagggaacatgccatcaaattgatccattatttgctcatgagaggagaact

SEQ ID NO: 862 - DNA, 404 bp, Diabrotica virgifera
  unsure (1)..(404): unsure at all n locations
  Clone ID: LIB149-042-Q1-E1-A11
acgccagtgagtgtaaaggccgactataacgaataaaatcttcttatttttcgttatttttcattttataacaagttttgaaaactgaaacaacatgaagtccgttggtttgtttgtatttttggcttgcattgcaggtttatatgctattcagctgaaatgtgcccaccaagaactgaacattcctaatgaatggatcgatatgcacaaagaatgtgtgcacaaaatgagaggtcaagttgaagaggaacttanagcttcaatgcaatacatggccatgggtgcccatttctcgacagacaccataaacagaccaggttttgctgacttgttcttcgatgctgccagcgaagaaagagaacatgccatcaaattgattcattatttgctcatgagaggagaac

SEQ ID NO: 863 - DNA, 367 bp, Diabrotica virgifera
  Clone ID: LIB149-022-Q1-E1-C4
aggcagactacagtgattacttacgtattgaataaactttcgttatatttataacatcaatcaaaccatcataccaaaaacaacatgaagtccgtagcggtattcgtatttttggcctgcttcgcaggtttacaggctgtccagctgaaatgtgcccaccaagaactggatatcccaaaagattggatcgacatgaacaacgtttgtgtgaaaaagatgagaggccaagttgaagaggaacttaaagcttccatgcaatacatggccatgggtgcatatttcgcaagagacacagtgaacagacccggttttgctgatttatttttcaaatcagctagtgaagaaagggaacatgccatcaaattga

SEQ ID NO: 864 - DNA, 374 bp, Diabrotica virgifera
  Clone ID: LIB150-009-Q1-E1-F10
acgcgtcgaacacgcatccggtgattacttacgtattgaataaactcgttatatttataacatcaatcaaaccatcataccaaaaacaacatgaagtccgtagcggtattcgtatttttggcttgcttcgcaggtttacaggctgtccagctgaaatgtgcccaccaagaactggatatcccaaaagattggatcgacatgaacaacgtttgtgtgaaaaagatgagaggccaagttgaagaggaacttaaagcttcaatgcaatacatggccatgggtgcatatttcgcaagagacacagtgaacagacccggttttgctgatttatttttcaaatcagctagtgaagaaagggaacatgctatcaaattgat

SEQ ID NO: 865 - DNA, 378 bp, Diabrotica virgifera
  Clone ID: LIB149-037-Q1-E1-E1
caccaatgagtgtaaaggcagactacagtgattacttacgtattgaataaactttcgttatatttataacatcaatcgaaccatcataccaaaaacaacatgaagtccgtagcggtattcgtatttttggcctgcttcgcaggtttacaggctgtccagctgaaatgtgcccaccaagaactggatatcccaaaagattggatcgacatgaacaacgtttgtgtgaaaaagatgagaggccaagttgaagaggaacttaaagcttcaatgcaatacatggccatgggtgcatacttcgcaagagacacagtgaacagacccggttttgctgatttatttttcaaatcagctagtgaagaaagggaacatgccatcaaa

SEQ ID NO: 866 - DNA, 359 bp, Diabrotica virgifera
  Clone ID: LIB149-037-Q1-E1-D12
agcagactacagtgattacttacgtattgaataaactttcgttatatttataacatcaatcgaaccatcataccaaaaacaacatgaagtccgtaccggtattcgtatttttggcctgcttcgcaggtttacaggctgtccagctgaaatgtgcccaccaagaactggatatcccaaaagattggatcgacatgaacaacgtttgtgtgaaaaagatgagaggccaagttgaagaggaacttaaagcttcaatgcaatacatggccatgggtgcatacttcgcaagagacacagtgaacagacccggttttgctgatttatttttcaaatcagctagtgaagaaagggaacatgccatc

SEQ ID NO: 867 - DNA, 385 bp, Diabrotica virgifera
  Clone ID: LIB149-039-Q1-E1-A9
agcgccagtgagtgtaaaggccgactataacgaacaaaatcttcttatttttcgttatttttcattttataacaagttttgaaaactgaaacaacatgaagtccgttggtttgtttgtatttttggcttgcattgcaggtttatatgctattcagctcaaatgtgcccaccaagaactgaacattcctaatgaatggatcgatatgcacaaagaatgtgtgcacaaaatgagaggtcaagttgaagaggaacttaaagcttcaatgcaatacatggccatgggtgcccatttctcgaaagacaccataaacagaccaggttttgctgacttgttcttcgatgctgccagcgaagaaagagaacatgccatcaaattgattcatta

SEQ ID NO: 868 - DNA, 370 bp, Diabrotica virgifera
  Clone ID: LIB149-022-Q1-E1-H4
atgaatgtaaaggcagactacagtgattacttacgtattgaataaactcgttatatttataacatcaatcaaaccatcataccaaaaacaacatgaagtccgtagcggtattcgtatttttggcttgcttcgcaggtttacaggctgtccagctgaaatgtgcccaccaagaactggatatcccaaaagattggatcgacatgaacaacgtttgtgtgaaaaagatgagaggccaagttgaagaggaacttaaagcttcaatgcaatacatggccatgggtgcatatttcgcaagagacacagtgaacagacccggttttgctgatttaattttcaaatcagctagtgaagaaaggaacatgctatcaaa

SEQ ID NO: 869 - DNA, 397 bp, Diabrotica virgifera
  Clone ID: LIB149-010-Q1-E1-E6
gcattgtattatcatagtcatccttctgcgccagtgagtgtaaaggccgactataacgaataaaatcttcttatttttcgttatttttcattttataacaagttttgaaaactgaaacaacatgaagtccgttggtttgtttgtatttttggcttgcattgcaggtttatatgctattcagctgaaatgtgcccaccaagaactgaacattcctaatgaatggatcgatatgcacaaagaatgtgtgcacaaaatgagaggtcaagttgaagaggaacttaaagcttcaatgcaatacatggccatgggtgcccatttctcgaaagacaccataaacagaccaggttttgctgacttgttcttcgatgctgccagcgaagaaagagaacatgccatc

SEQ ID NO: 870 - DNA, 385 bp, Diabrotica virgifera
  unsure (1)..(385): unsure at all n locations
  Clone ID: LIB149-003-Q1-E1-G4
accacacgtccgcggacgcgtgggcggacgcgtggggtgagttgtaaggcagactacagtgaatacttacgtattgaatanactcgttatatttataacatcaatcagaccatcaatacaaanacaacatgaagtccgtagcggtattcgtatttttggcttgcttcgcaggtttacaggctgtccagctgaaatgtgcccaccaagaactggatatcccaaaagattggatcgacatgaacaacgtttgtgtgaaaaagatgagaggccaagttgaagaggaacttaaagcttcaatgcaatacatggccatgggtgcatatttcgcaagagacacagtgaacagacccggttttgctgatttaattttcaaatcagctagtga

SEQ ID NO: 871 - DNA, 383 bp, Diabrotica virgifera
  Clone ID: LIB149-041-Q1-E1-F11
cggtcgtaatatccggggccaaccaagcctccgcagaacccttggccgaccccttggcaattaatgttaaaggaaaccacaatgaataactaactaatgaataaaccttccgtaaaattaaaacaaccatccaaacaacattacaaaaaccacaagaaatcccttaccggaatccgaattttgggccgcctcccaaggttacaaggctgtcaagctgaaatttgcccacaaaaaacgggatatcccaaaaaattggatcgacataaacaacttttgtgtgaaaaagatgagaggcaaagttgaaaaggaacctaaagcctccatgcaatacatggccatgggtgcatatttcgcaagagacacagtgaacagacccggttttg

SEQ ID NO: 872 - DNA, 317 bp, Diabrotica virgifera
  Clone ID: LIB149-043-Q1-E1-F11
tatagtgagtcgtattataccgcactgcgtgttagtgcacgctacagtgattacttacgtattgaataaactttcgttagatgtatgacatcaatcagaccatcatagcgggggtcaacatgaagtccgttacggtactcgtatttttggcctgcttcgcaggtttacaggctgtccagctgaaatgtgcccaccaagaactggttatcccataagattggatcgacatgaacaacgtttgtgtgaaaaagatgagaggccaagttgaagaggaacttaatgcttccatgcaatacatggccatgggtgcatatttc

SEQ ID NO: 873 - DNA, 470 bp, Diabrotica virgifera
  Clone ID: LIB150-013-Q1-E1-B4
gctgcattactagctaatctgaacgtctgtcgtaattttgtttcatttgtggtgtaaaagttaaaaactcatcaaccaaaatgcgtgaatgtatctcagtccatgttggccaagccggagtccaaataggtaatgcctgctgggagttgtactgcctggaacatggcatccaacctgacggtcagatgccatcagacaagactgttggaggaggagatgacagtttcaacacattcttcagtgaaactggtgccggcaaacatgtacctagagcagtatttgtagatttggaaccaacagtagtagatgaagtacgtaccggcacataccgtcaattgttccacccagaacaactcatcactggcaaagaagatgccgccaataactacgctagaggtcactatacaattggtaaagagatagttgacttggtattggacagaatccgtaaattggctgatcaatgtact

SEQ ID NO: 874 - DNA, 435 bp, Diabrotica virgifera
  Clone ID: LIB150-019-Q1-E1-A1
cccacgcgtccgattactagctaatctgaacgtctgtcgtaattttgtttcatttgtggtgtaaaagttaaaactcatcaaccaaaatgcgtgaatgtatctcagtccatgttggccaagccggagtccaaatcggtaatgcctgctgggagttgtactgcctggaacatggcatccaacctgacggtcagatgccatcagacaagactgttggaggaggagatgacagtttcaacacattcttcagtgaaactggtgccggcaaacatgtacctagagcagtatttgtagatttggaaccaacagtagtagatgaagtacgtaccggcacataccgtcaattgttccacccagaacaactcatcactggcaaagaagatgccgccaataactatgctagaggtcactatacaattggtaaagaaatagttgact

SEQ ID NO: 875 - DNA, 542 bp, Diabrotica virgifera
  Clone ID: LIB150-021-Q1-E1-E12
cggacgcgtgagcggacgcgtgggcggacgcgtgggcggacgcgtgggcggacgcgtgggcggacgcgtgggcggacgcgtgggctgcattactagctaatctgaacgtctgtcgtaattttgtttcatttgtggtgtaaaagttaaaactcatcaaccaaaatgcgtgaatgtttcccaatccaagttgggcaaaccggagtccaaatccgtaatgcctgctgggaattgtactgcctggaacattggatccaaactgacggtcaaatgccatcagacaagactgttggaagaagagatgacagtttcaacacattcttcagtgaaactggtgccggcaaacatgtacctagagcagtatttgtagatttggaaccaacagtagtagatgaagtacgtaccggcacataccgtcaattgttccacccagaacaactcatcactggcaaagaagatgccgccaataactatgctagaggtcactatacaattggtaaagaaatagttgacttggtattggacagaatccgtaaattggctga

SEQ ID NO: 876 - DNA, 397 bp, Diabrotica virgifera
  Clone ID: LIB150-038-Q1-E1-A11
aatcattcctgcccatcagactgaattttgttccatttgtggtgtaaaagttaaaaactcatcaaccaaaatgcgtgaatgtatctcagtccatgttggccaagccggagtccaaataggtaatgcctgctgggagttgtactgcctggaacatggcatcaaacctgacggtcagatgccatcagacaagactgttggaggaggagatgacagtttcaacacattcgtcagtgaaactggtgccggcaaacatgtacctagagcagtatttgtagatttggaaccaacagtagtagatgaagtacgtaccggcacataccgtcaattgttccacccagaacaactcatcactggcaaagaagatgccgccaataactacgctagaggtcactataca

SEQ ID NO: 877 - DNA, 387 bp, Diabrotica virgifera
  Clone ID: LIB150-020-Q1-E1-H11
actgcattactagctaatctgaacgtctgtcgtaattttgtttcatttgtggtgtaaaagttaaaactcatcaaccaaaatgcgtgaatgtatctcagtccatgttggccaagccggagtccaaatcggtaatgcctgctgggagttgtactgcctggaacatggcatccaacctgacggtcagatgccatcagacaagactgttggaggaggagatgacagtttcaacacattcttcagtgaaactggtgccggcaaacatgtacctagagcagtatttgtagatttggaaccaacagtagtagatgaagtacgtagcggcacataccgtcaattgttccacccagaacaactcatcactggcaaagaagatgccgccaataacta

SEQ ID NO: 878 - DNA, 423 bp, Diabrotica virgifera
  Clone ID: LIB150-025-Q1-E1-F3
tcgcgggtcgccacacgcctctataaagactcgtagcattactagctaatctgaacgtctgtcgtaattttgtttcatttgtggtgtaaaagttaaaactcatcaaccaaaatgcgtgaatgtatctcagtccatgttggccaagccggagtccaaatcggtaatgcctgctgggagttgtactgcctggaacatggcatccaacctgacggtcagatgccatcagacaagactgttggacgaggagatgacagtttcaacacattcttcagtgaaactggtgccggcacacatgtacctagagcagtatttgtagatttggaaccaacagtagtagatgaagtacgtaccggcacataccgtcagttgttccatccagaacaactcatcactggcaaagaagatgccgccaaaaactatgct

SEQ ID NO: 879 - DNA, 392 bp, Diabrotica virgifera
  Clone ID: LIB150-045-Q1-E1-F5
cccacgcgtccgcccacgcgtccgctggaacatggcatccaacctgacggtcagatgccatcatgacaggactgttggaggaggagatgacagtttcaacacattcttcagtgagactggtgccggcaaacatgtacctagagcagtatttgtagatttggaaccaacagtagtacatgatgtacgtaccgggacataccgtcaagtgttcgacccagaacaactcatcactggtaaagaagatgccgccaataactatgctagatgtcactatacacttggtaaagaagtagttgacctggtattggtcagaatccgtaaattggctgatcaatgtactggacttcatggtttcttgaatttccactccttcggtggtgctactggatctg

SEQ ID NO: 880 - DNA, 377 bp, Diabrotica virgifera
  Clone ID: LIB150-040-Q1-E1-A12
accacgcgtccgtagctaatctgaacgtctgtcgtaattttgtttcatttgtggtgtaaaagttaaaaactcatcaaccaaaatgcgtgaatgtatctcagtccatgttggccaagccggagtccaaataggtaatgcctgctgggagttgtactgcctggaacatggcatccaacctgacggtcagatgccatcagacaagactgttggaggaggagatgacagtttcaacacattcttcagtgaaactggtgccggcaaacatgtacctagagcagtatttgtagatttggaaccaacagtagtagatgaagtacgtaccggcacataccgtcaattgttccacccagaacaactcatcactggcaaagaagatg

SEQ ID NO: 881 - DNA, 387 bp, Diabrotica virgifera
  unsure (1)..(387): unsure at all n locations
  Clone ID: LIB150-003-Q1-E1-E10
ctgcattactagctaatctgaacgtctgtcgtaattttgtttcatttgtggtgtaaaagttaaaactcatcaaccaaaatgcgtgaatgtatctcagtccatgttggccaagccggagtccaaatcggtaatgcctgctgggagttgtactgcctggaacatggcatccaacctgacggtcagatgccatcagacaagactgttggaggaggagatgacagtttcaacacattcttcagtgaaactggtgccggcaaacatgtacctagagcagttattgtagatttggnaccaacagtagtagatgaagtacgtaccggcacataacgtcaaattgtctcacccagaacaactcatcactggcaaagaagatgccgccaataacta

SEQ ID NO: 882 - DNA, 320 bp, Diabrotica virgifera
  Clone ID: LIB150-049-Q1-E1-B6
aacggacgcgtgggatctgcattactagctaatctgaacgtctgtcgtaattttgtttcatttgtggtgtaaaagttaaaactcagcagccaaaatgcgtgaatgtatctcagtccatgttggccaagccggagtccaaatcggtaatgcctgctgggagttgtactgcctggaacatggcatcgaacctgacggtcagatgccatcagacaagacggttggaggaggagatgacagtttcaagacattctgcagtgaaactggtgccggcaaacatgtacctagagcagtatttgtagatttggaaccaacaatagtag

SEQ ID NO: 883 - DNA, 387 bp, Diabrotica virgifera
  Clone ID: LIB150-026-Q1-E1-B7
tcgtatgtcgatacaacactctatagtgagtcgtattaagctgaacttctgtcgtaattttgtttcatttgtggtgtataagttaaaactcatcatccattcatgcgtgaatgtatcacagtctatgttgggcaaatcggactccaagtcggtaatgcctgctgggagttgtcctgcctggaacatggcatccaatctgacggtcagatgccatcagactcgactgttggacgaggagatgacagttacagacagattcatcagtgaaactggtgccggcaaacatgttcctacagcagtagatgtagatttggaaccaatattagtaaagaaagtatgtaccggcagatatcgtctagtgttccactcagaacaaatcatcactgg

SEQ ID NO: 884 - DNA, 234 bp, Diabrotica virgifera
  Clone ID: LIB150-008-Q1-E1-C12
ctaatctgaacgtctgtcctaaatttggttcacttgtggtgtaaaagttaaaactcatcaaccaaaatgcgtgaatgtatctcagtccatgttggccaagccggagtccaaatcggtaatgcctgctgggagttgtactgcctggaacatgggatccaacctgacggtcagatgccatcagacaagactgttggtggaggagatgacagtttcaacacattcttcagtgaaact

SEQ ID NO: 885 - DNA, 265 bp, Diabrotica virgifera
  Clone ID: LIB150-016-Q1-E1-F11
tgcattactagctaatctgaacgtctgtcgtaattttgtctcatttgtggtgtaaaagttaaaactcatcaaccaaaatgcgtgaatgtatctcagtccatgttggccaagccggagtccaaatcggtagtgcctgctgggagttgtactgcctggaacatggcatccaacctgacggtcagatgccatcagacatgactgttggacgatgagatgacagtttcaacacattcttcagtgaaactgattgcggcaggcatgtacc

SEQ ID NO: 886 - DNA, 432 bp, Diabrotica virgifera
  unsure (1)..(432): unsure at all n locations
  Clone ID: LIB150-045-Q1-E1-E4
cccacgcgtccgctgaattcgaaaggaaggaagtaacatctaaggtgaggtagcggataacatcttccaccggcccgaacatcatggctgaagcggagcaacaacaaacagcgccagaacaacctaaggcagtcccaaaacagaaggaagtacttgcaactaaggtaactggcacagtaaaatggtttaacgtcaaaagcggttatggatttatcaacagaaatgataccaaagaagacgtttttgtgcaccaatcagccataataaagaataacccgaagaaagccgtccgatcagtgggcgacggtgaagtcgtagaatttagcgtagtcgtangtgaaaagggtaacgaggcggccaatgtaaccggccctaatggtgacccagtaagaggttcgccttatgctgccgaccgaagaagaggataccgcc

SEQ ID NO: 887 - DNA, 426 bp, Diabrotica virgifera
  Clone ID: LIB150-020-Q1-E1-B6
acccacgcgtccgcggacgcgtgggcggacgcgtgggttcgaaaggaaggaagtaacatctaaggtgaggtaccggataacatcttccaccggcccgaacatcatggctgaagcggagcaacaacaaacagcgccagaacaacctaaggcagtcccaaaacagaaggaagtacttgcaactaaggtaactggcacagtaaaatggtttaacgtcaaaagcggttatggatttatcaacagaaatgataccaaagaagacgtttttgtgcaccaatcagccataataaagaataacccgaagaaagccgtccgatcagtgggcgacggtgaagtcgtagaatttagcgtagtcgtaggtgaaaagggtaacgaggcggccaatgtaaccggccctaatggtgacccaataagacgttcgccttatgc

SEQ ID NO: 888 - DNA, 373 bp, Diabrotica virgifera
  Clone ID: LIB150-007-Q1-E1-H12
ctgaatacgaaaggaaggaagtaacatctaaggtgaggtagcggataacatcttccaccggcccgaacatcatggctgaagcggagcaacaacaaacagcgccagaacaacctaaggcagtcccaaaacagaaggaagtacttgcaactaaggtaactggcacagtaaaatggtttaacgtcaaaagcggttatggatttatcaacagaaatgataccaaagaagacgtttttgtgcaccaatcagccataataaagaataacccgaagaaagccgtccgatcagtgggcgacggtgaagtcgtagaatttagcgtagtcgtaggtgaaaagggtaacgaggcggccaatgtaaccggccctaatggtgaccc

SEQ ID NO: 889 - DNA, 373 bp, Diabrotica virgifera
  Clone ID: LIB150-005-Q1-E2-E11
actgaattcgaaaggaaggaagtaacatctaaggtgaggtagcggataacatcttccaccggcccgaacatcatggctgaagcggagcaacaacaaacagcgccagaacaacctaaggcagtcccaaaacagaaggaagtacttgcaactaaggtaactggcacagtaaaatggtttaacgtcaaaagcggttatggatttatcaacagaaatgataccaaagaagacgtttttgtgcaccaatcagccataataaagaataacccgaagaaagccgtccgatcagtgggcgacggtgaagtcgtagaatttagcgtagtcgtaggtgaaaagggtaacgaggcggccaatgtaaccggccctaatgggtgac

SEQ ID NO: 890 - DNA, 405 bp, Diabrotica virgifera
  Clone ID: LIB150-036-Q1-E1-F2
tcgcgggtcgatacaagcctctacagtgactcgtactaacgcgtgggttcgaaaggaaggaagtaacatctaaggtgaggtagcggataacatcttccaccggcccgaacatcatggctgaagcggagcaacaacaaacagcgccagaacaacctaaggcagtcccaaaacagaaggaagtacttgcaactaaggtaactggcacagtaaaatggtttaacgtcaaaagcggttatggatttatcaacagaaatgataccaaagaagacgtttttgtgcaccaatcagccataataaagaataacccgaagaaagccgtccgatcagtgggcgacggtgaagtcgtagaatttagcgtagtcgtaggtgaaaagggtaacgaggcggccaatgtaaccggcccta

SEQ ID NO: 891 - DNA, 366 bp, Diabrotica virgifera
  unsure (1)..(366): unsure at all n locations
  Clone ID: LIB150-048-Q1-E1-A2
cgaaaggaaggaagtaacatctaaggtgaggtagcggataacatcttccaccggcccgaacatcatggctgaagcggaacaacaacaaacaacgccagaacaacctaaggcagtcccaaaacagaaagaagtacttgcaactaaagtaactggcacagtaaaatggtttaacgtcaaaagcggttatggatttaacaacaaaaatgataccaaagaagacgtttttgtgcaccaatcagccataataaagaataacccgaagaaagccgtccgatcagtgggcgacggtgaagtcgtagaatttagcgtagtcgtangtgaaaagggtaacgaagcggccaatgtaaccggccctaatggtgaccc

SEQ ID NO: 892 - DNA, 339 bp, Diabrotica virgifera
  Clone ID: LIB150-046-Q1-E1-F3
actgaaatccacaggaacgaagtcacatctaatgtgaggtatcggctcacatcttccaccggcccgaacatcatggctgaagcggaccaacatcaaacagctccagaacaacctacagcagtcccaaagcagaatgaagtacttgcagctaaggtaactggcacagtaaaatggtttaacgtcaatagccgttatggatttatcaacacaaatgataccaaagaagacctttttgtgcaccaatcatccataatctagaataacccgaagaaagccgtccgatcagtgggcgaccgtgaagtcgtagaatttagcgtactcgtatgtgaaaagggtaac

SEQ ID NO: 893 - DNA, 292 bp, Diabrotica virgifera
  unsure (1)..(292): unsure at all n locations
  Clone ID: LIB150-039-Q1-E1-A1
cccacgcgtccggaaggaagtaacatctaaggtgaggtancggataacatcttccaccggcccgaacatcatggctgaagcggagcaacaacaaacagcgccagaacaacctaaggcagtcccaaaacaaaaggaaatacttgcaactaaggtaactggcacagtaaaatggtttaacgtcaaaagcggttatggatttatcaacagaaatgataccaaagaagacgtttttgtgcaccaatcagccataataaagaataacccgaagaaagccgtccgatcagtgggcgac

SEQ ID NO: 894 - DNA, 348 bp, Diabrotica virgifera
  Clone ID: LIB150-018-Q1-E1-F7
tgaattcgaaaggaaggaagtaacatctaaggtgaggtagcggataacatcttccaccggcccgaacatcatggctgaagcggagcaacaacaaacagcgccagaacaacctaaggcagtcccaaaacagaaggaagtacttgcaactaaggtaactggcacagtaaaatggtttaacgtcaaaagcggttatggatttatcaacagaaatgataccaaagaagacgtttttgtgcaccaatcagccataataaagaataacccgaagaaagccgtccgatcagtgggcgacggtgaagtcgtagaatttagcgtagtcgtaggttgaaaagggtaacgaagggcggc

SEQ ID NO: 895 - DNA, 296 bp, Diabrotica virgifera
  unsure (1)..(296): unsure at all n locations
  Clone ID: LIB150-048-Q1-E1-A3
ctatagtgagtcgtataagcgctancgtgaggtagcggatgacatcttccaccggattgaacatcatggctgaagcggagcaagattatacagcgccagaacaacctagggcagtcgcattagagaacgaactacttgcaactaatgtgactggcacagtaaaatggtttatcgtcaaaaccggttatggatttatcaccagaaatgagatccaataagacgtttttgtgcaccaggcatccattataaagagtatcccgaagagagccgtccgatcagtgggcgactgtgaagtc

SEQ ID NO: 896 - DNA, 398 bp, Diabrotica virgifera
  Clone ID: LIB150-006-Q1-E1-B11
acgcgtcagtgtaatcgtccggtaggatgtatcagcggttgtgatgtacctgttaacatcttccaccggcaccgaacatcatggcggaagcggatcaacatttctcaacgcctgtcctccctatggtagtgtcaatgcacagggttgtccttgcatgctaacgtaactgtcacagtctatcggattaacgtcaaaagcggttatggatttatcaccacatctgataccagagaagacgtttttgtgcaccaatcagccataataagtcataatccaaagaaagccgtccgatcagtgcgcgactgtgaagtcgtataacttatcgtaatcgtgagtgaatatggtaactaagcggccaattgtaacggccctaatggtgacccacttagaggttcgcc

SEQ ID NO: 897 - DNA, 118 bp, Diabrotica virgifera
  Clone ID: LIB150-005-Q1-E1-E11
aacagaatgaagtacttgcaactaaggtaactggcacagtaaaatggtttaacgtcaaaagcggttatggatttatcaacagaaatgataccaaagaagacgttttttgtgcacaatc

SEQ ID NO: 898 - DNA, 389 bp, Diabrotica virgifera
  Clone ID: LIB150-010-Q1-E2-E6
gaggtaccggacgtgctgttgctcgtattccccgtgtaagaggaggtggtacccaccgttctggtcagggagctttcggtaacatgtgtagaggtgggcgcatgtttgcaccaaccaagccatggcgtcgctggcacagacgtgtaaacatcaatcaacgtcgttatgctttggcatccgctgtagctgctagtggtgtgccagccttagttatgagcaaaggacatgtcatcgaccaaatccctgaattgccattggttgtcagtgacaaggtacaagaaatgagcaaaactaaacaggctgtccagttcttgaggagaatcaaggcatgggctgacattcaaaaggtttacaagagtcaacgtttccgtgctggtaagggaaaaatg

SEQ ID NO: 899 - DNA, 383 bp, Diabrotica virgifera
  Clone ID: LIB149-029-Q1-E1-F10
agcgtcaacagtgattcatcgtaagtgacaaagctggacatcaaacatctgctgaatcatggggtaccggacgtgctgttgctcgtattccccgtgtaagaggaggtggtacccaccgttctggtcagggagctttcggtaacatgtgtagaggtgggcgcatgtttgcaccaaccaagccatggcgtcgctggcacagacgtgtaaacatcaatcaacgtcgttatgctttggcatccgctgtagctgctagtggtgtgccagccttagttatgagcaaaggacatgtcatcgaccaaatccctgaattgccattggttgtcagtgacaaggtacaagaaatgagcaaaactaaacaggctgtccagttcttgaagagaatc

SEQ ID NO: 900 - DNA, 397 bp, Diabrotica virgifera
  Clone ID: LIB150-010-Q1-E2-A5
cactagtccggaggtaccggacgtgctgttgctcgtattccccgtgtaacaggaggtggtacccagcgttctggtcagggagctttcggtaacatgtgtacacgtgggcgcatgttggcaccagccaagccatggcgtcgctggcacgggggtgtaaacatcactcaacgtcgttatgctttggcatccgctgtacctgctagtggtgtgccagccttagctatgagcacaggacatgtcatcgaccaaatccctgaattgccattggttgtcagtgacaaggtacaagacatgatcataactaaacaggctgtccagttcttgaggagaatcaaggcatgggctgacattcaaaaggtttacacgactcaacgtttccgttctggcaacggaaaaa

SEQ ID NO: 901 - DNA, 378 bp, Diabrotica virgifera
  Clone ID: LIB149-027-Q1-E1-G2
attcgcttgaagtgtgtgtgagctactgtaaataatttatagaataagagaaaatgtcgttatccaccgctcgcccattagtgagcgtatacaatgagaagtccgaggaagtaaagggttcaaatatttcacttccagcagttttcaaggctccaatcagacccgatgtagtcaatttcgttcaccaacaggtttctatgaaccatcgtcaaccctacagcgttagtgacaaagctggacatcaaacatctgctgaatcatggggtaccggacgtgctgttgctcgtattccccgtgtaagaggaggtggtacccaccgttctggtcagggagctttcggtaacatgtgtagaggtgggcgcatgtttgcaccaaaca

SEQ ID NO: 902 - DNA, 391 bp, Diabrotica virgifera
  Clone ID: LIB149-035-Q1-E1-A12
acgctcccccaataattaacctaaaaaattaaaaatcccaagaaattaaaggttcaaataattcactttcaacaattttcaaaggtccaatcaaaaccgaagtagtcaattccgtcacaaacggtttctatgaaacatcgtcaaccctacagcgttagtgacaaagctggacatcaaacatctgctgaatcatggggtaccggacgtgctgttgctcgtattccccgtgtaagaggaggtggtacccaccgttctggtcagggagctttcggtaacatgtgtaaaggtgggcgcatgtttgcaccaaccaagccatggcgtcgctggcacagacgtgtaaacatcaatcaacgtcgttatgctttggcatccgctgtagctgctagtggtg

SEQ ID NO: 903 - DNA, 353 bp, Diabrotica virgifera
  Clone ID: LIB150-004-Q1-E1-H3
catcattcgcttgatgtgtgtgtgagctactgtaaataatttatagaataagagaaaatgtcgttatccaccgctcgcccattagtgagcgtatacaatgagaagtccgaggaagtaaagggttcaaatatttcacttccagcagttttcaaggctccaatcagacccgatgtagtcaatttcgttcaccaacaggtttctatgaaccatcgtcaaccctacagcgttagtgacaaagctggacatcaaacatctgctgaatcatggggtaccggacgtgctgttgctcgtattccccgtgtaagaggaggtggtacccaccgttctggtcagggagctttcggtaacatgtg

SEQ ID NO: 904 - DNA, 392 bp, Diabrotica virgifera
  Clone ID: LIB3026-021-Q1-E1-G11
gccactgaatcagcttaccaacgtttagataaattgttcggcacatggaaaacagcatcattggaaaagaagggttacaatctaccccagcctaaaatggccaacactgatctatctagattgttgaaggctgatgaaatcaaagctgtattacgtgctcctcaaaagaaggttgtacgtcgtgtacgtcgtctcaatccattgaccaacgctaaggccatgcttaagttgaatccatatgctgctgtactcaaacgtgaagccattttgaagaatcaaaagagacagttaaacagggaagaacttttggccaagaaacgtggtattaccgtgagtgccgacaacgtcgtgattagatccagaaaattgcaagaaaggagaaaggcacaaat

SEQ ID NO: 905 - DNA, 323 bp, Diabrotica virgifera
  unsure (1)..(323): unsure at all n locations
  Clone ID: pGUT1981
cgaacgatgtgtgtgtgagctactgtaaataatttatagaataagagaaaatgtcgttatccaccgctcgcccattagtgagcgtatacaatgagaagtccgaggaagtaaagggttcaaatatttcacttccagcagttttcaaggctccaatcagacccgatgtagtcaatttcgttcaccaacaggtttctatgaaccatcgtcaaccctacagcgttagtgacaaagctggacatcaaacatctgctgaatcatggggtactggacgtgctgtngctcgtattccccgtgtaagaggaaggtggtaccaccgttctggt

SEQ ID NO: 906 - DNA, 391 bp, Diabrotica virgifera
  Clone ID: LIB150-047-Q1-E1-G4
atagttcgcttgatgtgtgtgtgagctactgtaaataatttatagaataagagaaaatgtcgttatccaccgctcgcccattagtgagcgtatacaatgagaagtccgaggaagtaaagggttcaaatatttcacttccagcagttttcaaggctccaatcagacccgatgtagtcaatttcgttcaccaacaggtttctatgaaccatcgtcaaccctacagcgttagtgacaaagctggacatcaaacatctgctgaatcatggggtatcggacgtcctgttgcgcgtataccccgtataagaagaagttgtaaccaacgtcctagtcatgcagcattacgaaataaattttgatgtaggcgcaagacagtgacaaacgcaccacagta

SEQ ID NO: 907 - DNA, 348 bp, Diabrotica virgifera
  unsure (1)..(348): unsure at all n locations
  Clone ID: LIB150-009-Q1-E1-G12
atcgttagcttgatgtgtgtgtgagctactgtaaataatttatagaataagagaaaatgtcgttatccaccgctcgcccattagtgagcgtatacaatgagaagtccgaggaagtaaagggttcaaatatttcacttccagcagttttcaaggctccaatcagacccgatgtagtcaatttcgttcaccaacaggtttctatgaaccatcgtcaaccctacagcgttagtgacaaagctggacatcaaacatctgctgaatcatggggtaccggacgtgctgttgctcgtattccccgtgtaagangangtgggtaccaacgttctggtcanggagctttcggtaaca

SEQ ID NO: 908 - DNA, 312 bp, Diabrotica virgifera
  Clone ID: pGUT2999
gtttgatgtccagctttgtcactaacgctgtaaggttgacgatggttcatataaacctgttggtgaacgaaattgactacatcgggtctgattggagccttgaaaactgctggaagtgaaatatttgaaccctttactttctcggacttctcattgtatacgctcactaatgggcgagcggtggataacgacattttctcttattctataaattatttacagtagctcacacacacatcaagcgaacgatgtgtccgccattaaaaaaaaaaaaaaaaaaactcgaggggcccaattcggcccgaggggggg

SEQ ID NO: 909 - DNA, 181 bp, Diabrotica virgifera
  Clone ID: LIB3026-033-Q1-E1-H2
acgcgtccgccaacgcatccgcagtgacaaggtacaagaaatgagcaaaactaaacaggctgtccagttcttgaggagaatcaaggcatgggctgacattcaaaaggtttacaagactcaaggtttccgtgctggtaagggaaaaatgcgtaatacgagacgcgtccaacgtaaaggacca

SEQ ID NO: 910 - DNA, 439 bp, Diabrotica virgifera
  Clone ID: LIB150-043-Q1-E1-G2
aggacacgtgggcgcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaatactatgtaaccatcattgatgcccctggacacagagatttcattaagaacatgatcactggtacatcacaagctgactgtgctgt

SEQ ID NO: 911 - DNA, 438 bp, Diabrotica virgifera
  Clone ID: LIB150-017-Q1-E1-D9
caaacgcgtccgtggacctcgcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatatcgctttgtggaaattcgaaacagctaaatactatgtaaccatcattgatgcccctggacacagagatttcattaagaacatgatcactggtacatcacaagctgac

SEQ ID NO: 912 - DNA, 430 bp, Diabrotica virgifera
  Clone ID: LIB150-022-Q1-E1-E7
cagacgcgtgggtgtggacctcgcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaatactatgtaaccatcattgatgcccctggacacagagatttcattaagaacatgatcactggtacatc

SEQ ID NO: 913 - DNA, 430 bp, Diabrotica virgifera
  unsure (1)..(430): unsure at all n locations
  Clone ID: LIB149-044-Q1-E1-A5
aggtgtggacctcgcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtatttacattgatattgcttttgtgaaattccanacagctaaatactatgtaaccatcattgatgcccctggacacagagatttcattaagaacatgatcactggtacatcacaggctga

SEQ ID NO: 914 - DNA, 437 bp, Diabrotica virgifera
  Clone ID: LIB150-009-Q1-E1-F12
aggaccacgcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaatactatgtaaccatcattgatgcccctggacacaggaaatttcagtaggaacatgatcacgggtacatcacaagctgactgtgctgtac

SEQ ID NO: 915 - DNA, 451 bp, Diabrotica virgifera
  unsure (1)..(451): unsure at all n locations
  Clone ID: LIB150-015-Q1-E1-D4
ggcaaacgcatcggcggacccttgggcgcgcctggggtaacatccaaagtagggtccctttaattcaaagttaaatttcgaacagttgcatttacttaatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcanatatgcctgggtactcgacanacttaaggccgagagagaacgtggtattaccattgatattgctttgtggaaattcganacagctaaatactatgtaaccatcattgatggcccctggacacagagaattcattaagaacatgatcactggtacatcacaagctgactgtgc

SEQ ID NO: 916 - DNA, 410 bp, Diabrotica virgifera
  Clone ID: LIB150-005-Q1-E2-D3
acccacacgtccgcggacgcgtgggctcgcgcctggtgttacatcccaagtagtgttccttttattcgaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaatactatgtaaccatcattgatgcccctggacacagagatttc

SEQ ID NO: 917 - DNA, 428 bp, Diabrotica virgifera
  unsure (1)..(428): unsure at all n locations
  Clone ID: LIB150-021-Q1-E1-H4
cgggccaaccgtcgaaccaaacgtcgggaacgcccccctggtggtaacacccaagtaaaggtccctttaatccaaagttaaattccgacaagttgaattaacttaatttcaaagcaaccaaaatgggtaaagaaaggattcaaagtaacatcgttgtcattgggcacgtagatcctggtacatctacaactactggacatttaatttacaaatgtggtggtatcgacatacgtaccatcganaagttcgaaacagaagcacacgaatgggtaaaaggtcattcaaatatgcctgggtactcgacaaacttaaggccgagagagaacgtggtattaccattgatattgctttgtggaaattcgaaacagctaaatactaagttaccatcattgatgcccctggacacagagatttcattaagaacatga

SEQ ID NO: 918 - DNA, 413 bp, Diabrotica virgifera
  unsure (1)..(413): unsure at all n locations
  Clone ID: LIB150-043-Q1-E1-A5
acattgcctgcaaattcgctgaaatcaaagaaaaggttgaccgtcgttctggtaagaccactgaagaaaatcccaaagccatcaaatctggtgatgccgccattgtcaacttggtacccaccaagcccatgtgtgtagaatcattccaagaattcccaccccttggacgttttgctgtccgtgacatgaggcaaaccgttgcagtaggagtcatcaagagcgttgccttcaaagatcccagcgccggaaaagtcacaaaagctgcagaaaaagcccaaaagaagaaatagtctatttggactccactacttaaataattttgatatgttttgtttcttttatatattaatattggagtatcaatgtatttttaataactaatggacttattacttgcattgcattanttgtga

SEQ ID NO: 919 - DNA, 373 bp, Diabrotica virgifera
  Clone ID: LIB150-048-Q1-E1-G1
cggacgcgtgggcggacgcgtggggaaaatcccaaagccatcaaatctggtgatgccgccattgtcaacttggtacccaccaagcccatgtgtgtagaatcattccaagaattcccaccccttggacgttttgctgtccgtgacatgaggcaaaccgttgcagtaggagtcatcaagagcgttgccttcaaagatcccagcgccggaaaagtcacagaagctgcagaaaaagcccaaaagaagaaatagtctatttggactccactacttaaataattttgatatgttttgtttcttttatatattaatattggagtatcaatgtatttttaataactaatggacttattacttgcaatgcattagttgtgat

SEQ ID NO: 920 - DNA, 368 bp, Diabrotica virgifera
  Clone ID: LIB150-014-Q1-E1-F9
agagtacgtcgtgccaggtgtgacatctcaagtaatgttccttttattcaaagtataattccgaataattgcattcacttaaattcaaaccagtcaatatgggtaccgaattgattcatattactagcatagccactggacacatagattcagggagatcaactactactggacatttaactctgaactgtggtggtatcgacaaacttactatcaaaaagttgcatcgagaagcccataaatatcgtaaaggttcatctcacatattcctgggtactcgacaaacttaaggccgacagagacccttctattaccacttaaaatgcattgtggacatgccaggcagctcagtaccaggtaaccatcat

SEQ ID NO: 921 - DNA, 393 bp, Diabrotica virgifera
  Clone ID: LIB150-031-Q1-E1-F7
caagactctatagtagagtcgtattaagtcgtcggcgcgcctggtgtgacatcccaagtagtgttccttttattctaagtttaatttcgaacagttgcatttactttatctccagacagtcaacatgggtaaagaagagattcatattaccatcgttgtcagtggacacgtaggattctggtgaatctactacgactggacatttactttacaaatgtggtggtatcgacaaacgtaccagccaaaagtgccaagaggaagcccatgaaatgggtaaaggttcactcaaatatgccagggtagtccaccgacttcaggcgtagagagaatgtgttattaccattgatattgcttagtcgaaatccgagacagcgtactactaagtaaccatca

SEQ ID NO: 922 - DNA, 565 bp, Diabrotica virgifera
  unsure (1)..(565): unsure at all n locations
  Clone ID: pGUT3370
ggttaaaccccccccaagcctggatggtggaccaattggggaggggttttgcccccccgccatccaccgtcctcacaagttgagagaatctttaccattagtaattttcttaagaaacagtgaagtcacaaaaattgttatgcaaagattaattaaagtcgatggaaaagtcagaacagacagtaactatcctgcaggatttatggatgttattactattgagaagactggtgaattcttccgtcttatctatgatgttaaaggtagatttgccattcaccgtattacagctgaagaagcaaaatacaaactctgcaaagtacgaagagtccaaactggaccaaaaggaattccattcttggtgacacatgatggccgtaccatcagataccctgacccanacatcaaagtcaatgacaccatccaattggaaattgccacatctaaaattctagactacattaagttcgaatctggaaacttatgtatgatcactggaggaagaaatttgggtcgtgtaggtacagntatcaatagggaacgtcatcctggatcctttgatatt

SEQ ID NO: 923 - DNA, 414 bp, Diabrotica virgifera
  Clone ID: LIB3026-010-Q1-E1-E11
gatggctcgaggacctaaaaagcatttgaagcgtttaaacgcacccaaagcatggatgttggacaaattgggaggtgtatttgccccccgtccatccaccggtcctcacaagttgagagaatctttaccattagtaattttcttaagaaacagactaaagtatgccctcaccaacagtgaagtcacaaaaattgttatgcaaagattaattaaagtcgatggaaaagtcagaacagacagtaactatcctgcaggatttatggatgttattactattgagaagactggtgaattcttccgtcttatctatgatgttaaaggtagatttgccattcaccgtattaccgctgaagaagcaaaatacaaactctgcaaagtacgaagagtccaaactggaccaaaaggaattccatt

SEQ ID NO: 924 - DNA, 419 bp, Diabrotica virgifera
  Clone ID: LIB149-006-Q1-E1-A5
cacgcgtccgtgtatttgccccccgtccatccaccggtcctcacaagttgagagaatctttaccattagtaattttcttaagaaacagactaaagtatgccctcaccaacagtgaagtcacaaaaattgttatgcaaagattaattaaagtcgatggaaaagtcagaacagacagtaactatcctgcaggatttatggatgttattactattgagaagactggtgaattcttccgtcttatctatgatgttaaaggtagatttgccattcaccgtattaccgctgaagaagcaaaatacaaactctgcaaagtacgaagagtccaaactggaccaaaaggaattccattcttggtgacacatgatggccgtaccatcagataccctgacccaaacatcaaagtcaatgacaccatccaa

SEQ ID NO: 925 - DNA, 404 bp, Diabrotica virgifera
  Clone ID: LIB150-010-Q1-E2-H8
cacgagtccgcaaacgcgtccggtcaagatggctcgaggacctaaaaagcatttgaagcgtttaaacgcacccaaagcatggatgttggacaaattgggaggtgtatttgccccccgtccatccaccggtcctcacaagttgagagaatctttaccattagtaattttcttaagaaacagactaaagtatgccctcaccaacagtgaagtcacaaaaattgttatgcaaagattaattaaagtcgatggaaaagtcagaacagacagtaactatcctgcaggatttatggatgttattactattgagaagactggtgaattcttccgtcttatctatgatgttaaaggtagatttgccattcaccgtattacagctgaagaagcaaaatacaaactctgcaaag

SEQ ID NO: 926 - DNA, 370 bp, Diabrotica virgifera
  Clone ID: LIB149-020-Q1-E1-B4
atttgaagcgtttaaacgcacccaaagcatggatgttggacaaattgggaggtgtatttgccccccgtccatccaccggtcctcacaagttgagagaatctttaccattagtaattttcttaagaaacagactaaagtatgccctcaccaacagtgaagtcacaaaaattgttatgcaaagattaattaaagtcgatggaaaagtcagaacagacagtaactatcctgcaggatttatggatgttattactattgagaagactggtgaattcttccgtcttatctatgatgttaaaggtagatttgccattcaccgtattaccgctgaagaagcaaaatacaaactctgcaaagtacgaagagtccaaac

SEQ ID NO: 927 - DNA, 416 bp, Diabrotica virgifera
  Clone ID: LIB3026-033-Q1-E1-G9
acgcgtccgaaatgacccccgtccatccaccggtcctcacaagttgagagaatctttaccattagtaattttcttaagaaacaaactaaagtatgccctcaccaacagtgaagtcacaaaaattgttatgcaaagattaattaaagtcgatggaaaagtcagaacagacagtaactatcctgcaggatttatggatgttattactattgagaagactggtgaattcttccgtcttatctatgatgttaaaggtagatttgccattcaccgtattacagctgaagaagcaaaatacaaactctgcaaagtacgaagagtccaaactggaccaaaaggaattccattcttggggacacatgatggccgtaccatcagataccctgaaccaaaacatcaaagtcaatgacaccatccaa

SEQ ID NO: 928 - DNA, 400 bp, Diabrotica virgifera
  Clone ID: LIB150-026-Q1-E1-B2
acttggggggactccttgggcgaaggacctacacagcatttgaaccgtttaacgcacccaaacatggatgttggtcaaattggggaggtgtattttgccccccgtccatccaccggtcctcacaagttgagagaatctttaccattagtaattttcttaagaaacagactaaagtatgccctcaccaacagtgaagtcacaaaaattgttatgcaaagattaattaaagtcgatggaaaagtcagaacagacagtaactatcctgcaggatttatggatgttattactattgagaagactggtgaattcttccgtcttatctatgatggtaaaggtagatttgccattcaccgtattacagctgaagaagcaaaatacagactctgcaaagtaagaagag

SEQ ID NO: 929 - DNA, 305 bp, Diabrotica virgifera
  Clone ID: LIB3026-023-Q1-E1-F3
caaagcatggatgttggacaaattgggaggtgtatttgccccccgtccatccaccggtcctcacaagttgagagaatctttaccattagtaattttcttaagaaacagactaaagtatgccctcaccaacagtgaagtcacaaaaattgttatgcaaagattaattaaagtcgatggaaaagtcagaacagacagtaactatcctgcaggatttatggatgttattactattgagaagactggtgaattcttccgtcttatctatgatgttaaaggtagatttgccattcaccgtattacagctg

SEQ ID NO: 930 - DNA, 297 bp, Diabrotica virgifera
  unsure (1)..(297): unsure at all n locations
  Clone ID: pGUT964
ctaaaaagcatttgaagcgtttaaacgcacccaaagcatggatgttggacaaattgggaggtgtatttgccccccgtccatccaccggtcctcacaagttgagagaatctnntacattagtaantttcttaagaaacagactaaagtatgccctcaccaacagtgaagtcacaaaaattgttatgcaaagattaattaaagtcgatggaaaagtcngaacagacagtanctatcctgcaggatttatggatgttattactattgagaagactggtgaattcttccgtcttatctatg

SEQ ID NO: 931 - DNA, 210 bp, Diabrotica virgifera
  Clone ID: pGUT298
atatttttaaagtcaagatggctcgaggacctaaaaagcatttgaagcgtttaaacgcacccaaagcatggatgttggacaaattgggaggtgtatttgccccccgtccatccaccggtcctcacaagttgagagaatctgtaccattattaattttcttaagatacagactacagtatgccctcaccaacagtgaagtcacaaaaattg

SEQ ID NO: 932 - DNA, 161 bp, Diabrotica virgifera
  Clone ID: LIB3026-007-Q1-E1-B8
cccacgcgtccgcgaggacctaaaaagcatttgaagcgtttaaacgcacccaaagcatggatgttggacaaattgggaagtgtaattgccccccgtccaaccaccggtcctcaaaagttgagaaaaaccttaccattagtaattttcctaagaaacagact

SEQ ID NO: 933 - DNA, 128 bp, Diabrotica virgifera
  unsure (1)..(128): unsure at all n locations
  Clone ID: pGUT4073
atgatggccggaccatcagataccctgacccaaacatcanagtcaatgacaccatccaattggaaattgccacatctaaaattctagactacattaagttcgaatctggaaacttatgtatgatcact

SEQ ID NO: 934 - DNA, 421 bp, Diabrotica virgifera
  Clone ID: LIB149-003-Q1-E1-B2
acgaaaatgaaggctgcttttattattacactactactacctattgtattaagttacaaaggtaacccaaatcctctttcaaatgactttataaactacatcaatagcaaacaaagtacatgggttgctggaaaaaactttgatgagaacctttcaatccaagagatcaaaaatttgttaggagcaaagaaaggtaaattaggcgtggctaaagaatttacacacagtgaagatattcaagttcccaattctttcgatgcaagagaaaactggaaagaatgttcagatgttatcagcaccgttgtagatcaatccgattgtggatcttgctgggccgtcgctgcagcttctgcaatgagtgacagacgatgcatagcatcccagggaaagcttaaagtacctgtttcggctgaaaatctat

SEQ ID NO: 935 - DNA, 418 bp, Diabrotica virgifera
  Clone ID: LIB149-005-Q1-E1-A12
ccgacccgtccacacgaaaatgaaggctgcttttattattacactactactacctattgtattaagttacaaaggtagcccaaatcctctttcaaatgactttataaactacatcaatagcaaacaaagtacatgggttgctggaaaaaactttgatgagaacctttcaatccaagagatcaaaaatttgttaggagcaaagaaaggtaaattaggcgtggctaaagaatttacacacagtgaagatattcaagttcccaattctttcgatgcaagagaaaactggaaagaatgttcagatgttatcagcaccgttgtagatcaatccgattgtggatcttgctgggccgtcgctgcagcttctgcaatgagtgacagacgatgcatagcatcccaaggaaagcttaaagtacctgtt

SEQ ID NO: 936 - DNA, 393 bp, Diabrotica virgifera
  Clone ID: LIB149-019-Q1-E1-B9
aacgaaaatgaaggctgcttttattattacactactactacctattgtattaagttacaaaggtaacccaaatcctctttcaaatgactttataaactacatcaatagcaaacaaagtacatgggttgctggaaaaaactttgatgagaacctttcaatccaagagatcaaaaatttgttaggagcaaagaaaggtaaattaggcgtggctaaagaatttacacacagtgaagatattcaagttcccaattctttcgatgcaagagaaaactggaaagaatgttcagatgttatcagcaccgttgtagatcaatccgattgtggatcttgctgggccgtcgctgcagcttctgcaatgagtgacagacgatgcatagcatcccaagggaaagc

SEQ ID NO: 937 - DNA, 432 bp, Diabrotica virgifera
  Clone ID: LIB149-004-Q1-E1-C12
gactcgcgggccgacacaagcctctacccacacgcctgatattcacgaaaatgaaggctgcttttattattacactactactacctattgtattaagttacaaaggtaacccaaatcctctttcaaatgactttataaactacatcaatagcaaacaaagtacatgggttgctggaaaaaactttgatgagaacctttcaatccaagagatcaaaaatttgttaggagcaaagaaaggtaaattaggcgtggctaaagaatttacacacagtgaagatattcaagttcccaattctttcgatgcaagagaaaactggaaagaatgttcagatgttatcagcaccgttgtagatcaatccgattgtggatcttgctgggccgtcgctgcagcttctgcaatgagtgacagacgatgcatagcatcccaaggaa

SEQ ID NO: 938 - DNA, 408 bp, Diabrotica virgifera
  Clone ID: LIB149-047-Q1-E1-C6
acggacgcgtgggcggacgcgtgggacgaaaatgaaggctgcttttattattacactactactacctattgtattaagttacaaaggtaacccaaatcctctttcaaatgactttataaactacatcaatagcaaacaaagtacatgggttgctggaaaaaactttgatgagaacctttcaatccaagagatcaaaaatttgttaggagcaaagaaaggtaaattaggcgtggctaaagaatttacacacagtgaagatattcaagttcccaattctttcgatgcaagagaaaactggaaagaatgttcagatgttatcagcaccgttgtagatcaatccgattgtggatcttgctgggccgtcgctgcagcttctgcaatgagtgacagacgatgcatagcatccca

SEQ ID NO: 939 - DNA, 380 bp, Diabrotica virgifera
  Clone ID: LIB149-043-Q1-E1-H11
agaaaatgaaggctgcttttattattacactactactacctattgtattaagttacaaaggtaacccaaatcctctttcaaatgactttataaactacatcaatagcaaacaaagtacatgggttgctggaaaaaactttgatgagaacctttcaatccaagagatcaaaaatttgttaggagcaaagaaaggtaaattaggcgtggctaaagaatttacacacagtgaagatattcaagttcccaattctttcgatgcaagagaaaactggaaagaatgttcagatgttatcagcaccgttgtagatcaatccgattgtggatcttgctgggccgtcgctgcagcttctgcaatgagtgacagacgatgcatagcatcc

SEQ ID NO: 940 - DNA, 396 bp, Diabrotica virgifera
  Clone ID: LIB149-010-Q1-E1-D8
gtgaatacagattcacgaaaatgaaggctgcttttattattacactactactacctattgtattaagttacaaaggtaacccaaatcctctttcaaatgactttataaactacatcaatagcaaacaaagtacatgggttgctggaaaaaactttgatgagaacctttcaatccaagagatcaaaaatttgttaggagcaaagaaaggtaaattaggcgtggctaaagaatttacacacagtgaagatattcaagttcccaattctttcgatgcaagagaaaactggaaagaatgttcagatgttatcagcaccgttgtagatcaatccgattgtggatcttgctgggccgtcgctgcagcttctgcaatgagtgacagacgatgcatagcatccc

SEQ ID NO: 941 - DNA, 410 bp, Diabrotica virgifera
  Clone ID: LIB149-004-Q1-E1-D12
gactcgcgggccgacacaagcgtctacgatgatgcatgctgcttttattattacactactactacctattgtattaagttacaaaggtaacccaaatcctctttcaaatgactttataaactacatcaatagcaaacaaagtacatgggttgctggaaaaaactttgatgagaacctttcaatccaagagatcaaaaatttgttaggagcaaagaaaggtaaattaggcgtggctaaagaatttacacacagtgaagatattcaagttcccaattctttcgatgcaagagaaaactggaaagaatgttcagatgttatcagcaccgttgtagatcaatccgattgtggatcttgctgggccgtcgctgcagcttctgcaatgagtgacagacgatgcatagcatcccaag

SEQ ID NO: 942 - DNA, 390 bp, Diabrotica virgifera
  unsure (1)..(390): unsure at all n locations
  Clone ID: LIB149-021-Q1-E1-G2
gattcacgaaaatgaaggcggcttttattattacactattactacctgttgtattaagttacacagctaacttaaatcctctttcaaatgagtttataaactacatcaatagcaaacaaagctcatgggttgctggaagaaactttgatgaaaacctttcaatccaagagatgaaaaaattattaggaacaaagaaaaggaatttaggggatgtaaaaggatttatccatagtgagaatattcaagttccagattctttcgacgccagggaaaactggaaagtgtgttcagatgtaatcaacactattgcagatcaatctgcttgtttagctggttgggccgtanctgcagcttctgcaatgagtgacagacgatgcatagcctcccaag

SEQ ID NO: 943 - DNA, 362 bp, Diabrotica virgifera
  unsure (1)..(362): unsure at all n locations
  Clone ID: LIB3026-021-Q1-E1-D4
gattgaacannatgaaagcggcttgtattattacacaattactaccggttgtattaatttacaaggctaacttaaatcccctttcaaatgagtttataaacaatatcaatagcaagcaaaacacatgggttgctggaaagaactttgatgagaaactttcaatccaagaaataaaaaatttattaggagcgagaaaaaggagtttaggagatgtaaaaggatttatgcacagtgaagatattcaagttccagattctttcgatgcaagggaaaactggaaagactgttcagatgttatcagcactattgtagaccaatctgcttgtggatcttgctgggcaatgtctgcagcatctgcaatg

SEQ ID NO: 944 - DNA, 301 bp, Diabrotica virgifera
  Clone ID: LIB149-024-Q1-E1-E4
ttgtattaagttacaaaggtaacccaaatcctctttcaaatgactttataaactacatcaatagcaaacaaagtacatgggttgctggaaaaaactttgatgagaacctttcaatccacgagatcaaaaatttgttaggagcaaagaaaggtaaattaggcgtggctaaagaatttacacacagtgaagatattcaagttcccaattctttcgatgcacgagaaaactggaaagaatgttcacatgttatcagcaccgttgtagatcaatccgattgtggattctgctgggccgtcgctgc

SEQ ID NO: 945 - DNA, 411 bp, Diabrotica virgifera
  Clone ID: LIB149-004-Q1-E1-D5
agacgaaaatgaaggcggcttttattattacactattactacctgttgtattaagttacacagctaacttaaatcctctttcaaatgagtttataaactacatcaatagcaaacaaagctcatgggttgctggaagaaactttgatgaaaacctttcaatccaagagatgaaaaaattattaggaacaaagaaaaggaatttaggggatgtaaaaggatttatccatagtgagaatattcaagttccagattctttcgacgccagggaaaactggaaagtgtgttcagatgtaatcaacactattgcagatcaatctgcttgtttagctggttgggccgtagctgcagcttctgcaatgagtgacagacgatgcatagcctcccaaggaaagcttaaagtacctgtttctg

SEQ ID NO: 946 - DNA, 383 bp, Diabrotica virgifera
  Clone ID: LIB3026-027-Q1-E1-H5
gatggcggcttccacccatcttggaacagcaaatgttgattttcaaatggaacagtatgtatacaaacgtcgtcatgacggtactcacatcatcaacttaaggaaaacgtgggaaaagattctcttggcagcccgtgccattgttgctattgaacaccctggtgaagttttcgtaatttcatctcgtccctatggccagcgtgctgttcttaagtttgctgctcacactggagctacccctattgctggaagatttactcctggggcttttaccaatcagatccaagctgcattcatggaacctcgtctgttgatcgtcactgaccctgcttttgatcagcaagctatcactgaggcctcttacgtaaacattccagttattg

SEQ ID NO: 947 - DNA, 426 bp, Diabrotica virgifera
  Clone ID: LIB150-042-Q1-E1-G8
aaccgcccaagtggcatcttgtctcgtttatcgtaactcaaattaaacgtaaagatgtcgggaggaatcgaggctttaagccttaaagaggacgatgttaccaagatgttggcggcttccacccatcttggaacagcaaatgttgattttcaaatggaacagtatgtatacaaacgtcgtcatgacggtactcacatcatcaacttaaggaaaacgtgggaaaagattctcttggcagcccgtgccattgttgctattgaacaccctggtgaagttttcgtaatttcatctcgtccctatggccagcgtgctgttcttaagtttgctgctcacactggagctacccctattgctggaagatttactcctggtgcttttaccaatcagatccaagctgcattcagggaacctcgtctgttgatcgtc

SEQ ID NO: 948 - DNA, 437 bp, Diabrotica virgifera
  unsure (1)..(437): unsure at all n locations
  Clone ID: LIB3026-016-Q1-E1-H12
gacccaagcgtccaacccaagtggcatcttgtctcgtttatcgtaactcaaattaaacgtaaagatgtcgggaggaatcgaggctttaagccttaaagaggacgatgttaccaagatgttggcggcttccacccatcttggaacagcaaatgttgattttcaaatggaacagtatgtatacaaacgtcgtcatgacggtactcacatcatcaacttaaggaaaacgtgggaaaagattctcttggcagcccgtgccattgttgctattgaacaccctggtgaagttttcgtaatttcatctcgtccctatggccagcgtgctgttcttaagtttgctgctcacactggagctacncctattgctggaagatttactcctggtgcttttaccaatcagatccaagctgcattcagggaacctcgtctgttgatcgtca

SEQ ID NO: 949 - DNA, 433 bp, Diabrotica virgifera
  unsure (1)..(433): unsure at all n locations
  Clone ID: LIB150-045-Q1-E1-D3
cacacgcgtccggtttatcgtaactcaaattaaacgtaaagatgtcgggaggaatcgaggctttaagccttaaagaggacgatgttaccaagatgttggcggcttccacccatcttggaacagcaaatgttgattttcaaatggaacagtatgtatacaaacgtcgtcatgacggtactcacatcatcaacttaaggaaaacgtgggaaaagattctcttggcagcccgtgccattgttgctattgaacaccctggtgaagttttcgtaatttcatctcgtcnctatggccagcgtgctgttcttaagtttgctgctcacactggagctacccctattgctggaagatttactcctggtgcttttaccaatcagattcaagctgcattcaggggaactcgtctgttgatcgtcactgaccctgcttttgataa

SEQ ID NO: 950 - DNA, 396 bp, Diabrotica virgifera
  Clone ID: LIB150-006-Q1-E1-E7
acccaagtggcatcttgtctcgtttatcgtaactcaaattaaacgtaaagatgtcgggaggaatcgaggctttaagccttaaagaggacgatgttaccaagatgttggcggcttccacccatcttggaacagcaaatgttgattttcaaatggaacagtatgtatacaaacgtcgtcatgacggtactcacatcatcaacttaaggaaaacgtgggaaaagattctcttggcagcccgtgccattgttgctattgaacaccctggtgaagttttcgtaatttcatctcgtccctatggccagcgtgctgttcttaagtttgctgctcacactggagctacccctattgctggaagatttactcctggtgcttttaccaatcagatccaagctgcat

SEQ ID NO: 951 - DNA, 396 bp, Diabrotica virgifera
  Clone ID: LIB149-016-Q1-E1-F4
gcgtggcatcttgtcacgtttatcgtaactcaaattaaacgtaaagatgtcgggaggaatcgaggctttaagccttaaagaggacgatgttaccaagatgttggcggcttccacccatcttggaacagcaaatgttgattttcaaatggaacagtatgtatacaaacgtcgtcatgacggtactcacatcatcaacttaaggaaaacgtgggaaaagattctcttggcagcccgtgccattgttgctattgaacaccctggtgaagttttcgtaatttcatctcgtccctatggccaacgtgctgttcttaagtttgctgctcacactggagctacccctattgctggaagatttactccaggtgcttttaccaatcagatctaagggagcattca

SEQ ID NO: 952 - DNA, 421 bp, Diabrotica virgifera
  Clone ID: LIB150-024-Q1-E1-E12
ctcgcgggtcgatacaagcctctaaagtgagtcgtaatattgtcgcgtttatcgtaactcatattaaacgtaaagatgtcgggaggaatcgaggctttacgccttagggaggacgatgttaccacgatgttggcggcttccacgcatcttggaacagcacatgttgattttcacatggaacagtatgtatacaaacgtcgtcatgacggtactcacatcatcaacttaatgaaagcgtgggaaaagattctcttggcagcccgtgccaatgatgccattgaacaccctggtgaagttttcgtaatttcatctcgtccctatggccatcgtgctgttcttaagtttgctgctcacactggagctacccctattgctggaacatttactcctggtgcttttatcaatcagattcaagctgcat

SEQ ID NO: 953 - DNA, 357 bp, Diabrotica virgifera
  Clone ID: LIB3026-021-Q1-E1-H8
agcaagtggcatcttgtctcgtttatcgtaactcaaattaaacgtaaagatgtcgggaggaatcgaggctttaagccttaaagaggacgatgttaccaagatgttggcggcttccacccatcttggaacagcaaatgttgattttcaaatggaacagtatgtatacaaacgtcgtcatgacggtactcacatcatcaacttaaggaaaacgtgggaaaagattctcttggcagcccgtgccattgttgctattgaacaccctggtgaagttttcgtaatttcatctcgtccctatggccaacgtgctgttcttaagtttgctgctcacactggagctacccctattgctggaagatt

SEQ ID NO: 954 - DNA, 361 bp, Diabrotica virgifera
  Clone ID: LIB3026-018-Q1-E1-F4
acgtgcaaataacccaagtggcatcttgtctcgtttatcgtaactcaaattaaacgtaaagatgtcgggaggaatcgaggctttaagccttaaagaggacgatgttaccaagatgttggcggcttccacccatcttggaacagcaaatgttgattttcaaatggaacagtatgtatacaaacgtcgtcatgacggtactcacatcatcaacttaaggaaaacgtgggaaaagattctcttggcagcccgtgccattgttgctattgaacaccctggtgaagttttcgtaatttcatctcgtccctatggccagcgtgctgttcttaagtttgctgctcacactggagctacccctattgct

SEQ ID NO: 955 - DNA, 236 bp, Diabrotica virgifera
  Clone ID: LIB3026-023-Q1-E1-B5
acgcgtcagccacgatgttggcggcttccacccatcttggaacagcaaatgttgattttcaaatggaacagtatgtatacaaacgtcgtcatgacggtagtcacatcatcaacttaaggaaaacgtgggaaaagattctcttggcagcccgtgccactgttgctattgaacaccctggtgacgttttcgtaatttcgtctcgtcgctatggctagcgtgctgttccgaagtttgct

SEQ ID NO: 956 - DNA, 162 bp, Diabrotica virgifera
  Clone ID: LIB3026-027-Q1-E1-H4
taaattttttgaaaagacgagaagaccctatagagttttataaaattattaataagtttttttagtagtaaatttatttagataataaatttatttaattggggtgagtaaaaaataaatttaactttttttagattattaaatgaattaataagtttgtga

SEQ ID NO: 957 - DNA, 242 bp, Diabrotica virgifera
  unsure (1)..(242): unsure at all n locations
  Clone ID: pGUT3114
tttatttcttataaatcaaaaaaaattgatcaaaaaattattaattaatataataactataaaacaaaagtttaaatttattgttttaaatcancccccaacttaaataaaatgttattatattaagataaatttaatacttaaaaaacctattaataattttataaaactctatagggtcttctcgtctttaaaaaaatttaagctttttaacttaaaaaaaaaaaaaaaaaactcggggg

SEQ ID NO: 958 - DNA, 319 bp, Diabrotica virgifera
  Clone ID: LIB3026-013-Q1-E1-H5
actggaatgaagggttggatgaaaaaaaaactgtctttatttaacttataaagaattttatttgtaggttaaaaagcttaaatttttttaaaggacgagaagacccaatggagtttaagaaactaataatcaagttttttaagaataaaattgattaacctacgaaattaattaaatgggggtgattaaaaaggaaattaaccttttttaatataatcacatgagttaagatttttgggatcaaattttttggaatacaagaataagttacctgagggaaaacagcgtaattatagtggagagtacatcgcgagaaaaa

SEQ ID NO: 959 - DNA, 115 bp, Diabrotica virgifera
  Clone ID: pGUT3207
aaatttaagctttttaacttaaaaataaaattctttataaattaaataaagacagtttttttttcatccaacccttcattccagctttcaaaaaaaaaaaaaaaaagaatttaat

SEQ ID NO: 960 - DNA, 297 bp, Diabrotica virgifera
  Clone ID: LIB149-025-Q1-E1-G7
acgcggtcgcgtgggttatttgaaagctggtatgagtggttggatgatatattaaactgtcgttatttaatttagtgagattttaattttaagttaaaaaggttaaatttttttaagagacgaggagaacctagaatgatttattaaaattttaataagtttttttagtaataaatttagttagaaaaaaaatttacttaattggggtgattaaaaaataaatttaactttttgtaaagtaatatattaattaataattttttggtacaatttttttggttaaaagaattaattaac

SEQ ID NO: 961 - DNA, 181 bp, Diabrotica virgifera
  Clone ID: LIB3026-003-Q1-E1-C3
ataaaaactgtctttatctaatttataacgaactttacttataagttaaaacgcttaaatttttttaacagatcagaaaaccctacagagttttatcaaagtaacaataagttttttcacaattaactttatttaaaaaatcaatttatttagttggggtgattactgcatcaatttaact

SEQ ID NO: 962 - DNA, 231 bp, Diabrotica virgifera
  Clone ID: LIB3026-035-Q1-E1-B10
cgggccgagccacgcgtccaggtagaatgacggtgcgaccgcagcacaatcactagttattttatgtgaccagctggcatgaagggttagatgacaaacgaactgtcttgatctaatttatacagaagtttactttgaagttaaaacgcttagagttttttaaaagaccagaagaccccacacagttttaccccagcattaaaaagtttttttagcaccaactttagttac

SEQ ID NO: 963 - DNA, 281 bp, Diabrotica virgifera
  Clone ID: pGUT2414
cgagtttttttttttttttttggattataaaaataaattcccttggggataacagcgaaattttatgggaaagtccaaatcgatattaaaaatggcaacctcaatgtgggataaaagtttataatgggggtaccaccttttttataaagtctgtccaactttaaaaatttcccatgatctgagttaaacccggggtaacccaggtgggtttctatcttaaattaatcaatattttttagtccaaagggcccaattttttaaaaaaatttttatttttagat

SEQ ID NO: 964 - DNA, 183 bp, Diabrotica virgifera
  Clone ID: LIB3026-003-Q1-E1-E2
gaagaccctatagagttttataaaattattaataagtttttttagtattaaatttatttatataataaatttatttaattggggtgattaaaaaataaatttaactttttttatattattatattaattaataattttttgatccaatttttttgattataagaataaattaccttagggata

SEQ ID NO: 965 - DNA, 230 bp, Diabrotica virgifera
  Clone ID: pGUT3894
taaaaaaaaaccggccttatttaaattattaaaaaatttatttttaacggtaaaaagcttaattttttttaaaagacgaaaaaacccttagaagtttaaaaaaattattaatacgttcttttaagattaaacttatttatataataaaattatttaattggggggaataaaaaaaaatcaaccttttttatattattactataaataaaaatttttgacccaattttttg

SEQ ID NO: 966 - DNA, 434 bp, Diabrotica virgifera
  Clone ID: LIB150-046-Q1-E1-D12
atccagagcattacaaaggagaatttacatatatacctgtcacccgtcaagcttattggcaatttaaaatggatcaagtaactgtgggttccaaaactttctgtagtgcaggctgccaggctatcgccgatactggtaccagcttgattgctggacctgtagaagagatgacagccatcaaccaggctatcggaggtacaccaattccaggaggagaatacatcgttgattgtcagctgatcccgaaactcccagttatgaacttcgttttggctggtaaaagttttcctttggaaggaaaagattacatattgagggtatctcagatgggcaaaacaatctgcttgtctggattcatgggaatcgatattcccccaccaaacggtccactatggattttgggagacgtctttattggtaaatactacactgag

SEQ ID NO: 967 - DNA, 401 bp, Diabrotica virgifera
  Clone ID: LIB3026-002-Q1-E1-G10
ctattggcaagttgttatggacagtcttaacgttggatcttccttaaaactatgttcaaatggatgtcaaattatcgtagacactggtaccagtttgatcgctggacctagcgctgaagtcgaaaagttacataaagaaataggcgctttttcattccttaatggtgaatatataattgattgcagcaaaattgatcaactacccgaaattagttttgtttttggaggaaaagaattcacactttccggaaatgattatgttttaaagcaatctaacggcggtattgacatatgtatttctggattcatgggattagacctcaacactagaactcatgtggaatggatcctaggagatgtattcattggaaagttctacaccgaatttgactttggtaata

SEQ ID NO: 968 - DNA, 432 bp, Diabrotica virgifera
  Clone ID: LIB149-025-Q1-E1-B8
gcggagtggtttatttgtgtggtaagaataagaatagaagggaatttaagttactggtttattagcagaaatacaaagaaaagtaaaaatgcggaattatctgcttttattctttatatgcagtatttatacagttaattgcgattttgtgcgaattccacttcagaaaattcaaactataagaaactcactaagagaggtgggaaccgaattaactcgtgtatctgtgaaacaaacttcaaacaaatacggtggaccaactccagaaccgttatccaattatttagatgcacaatattatggtcctattagcattggtaacccaccacagaattttaaagtcgttttcgatactggatcatctaatttgtgggtgccatcgaagaaatgtggatttactaacatagcatgcttgctacacaacaaatatga

SEQ ID NO: 969 - DNA, 395 bp, Diabrotica virgifera
  Clone ID: LIB150-030-Q1-E1-E4
aagaatagaagggaatttaagttactggtttattagcagaaatacaaagaaaagtaaaaatgcggaattatctgcttttattctttatatgcagtatttatacagttaattgcgattttgtgcgaattccacttcagaaaattcaaactataagaaactcactaagagaggtgggaaccgaattaactcgtgtatctgtgaaacaaacttcaaacaaatacggtggaccaactccagaaccgttatccaattatttagatgcacaatattatggtcctattagcattggtaacccaccacagaattttaaagtcgttttcgatactggatcatctaatttgtgggtgccatcgaagaaatgtggatttactaacatagcatgcttgctacacaac

SEQ ID NO: 970 - DNA, 425 bp, Diabrotica virgifera
  Clone ID: LIB3026-005-Q1-E1-G8
gtattttccgtttaacggagccaaacagccaatggcgatcaaggagaactagtgattggtggatcagatccaagtaaatacacaggagacttcacctacacagaagtatcaaaaaaactgtattggcaaactaagctacaaggtgtttccgtagggaaacaaagtttatgtaggaatggatgtcgatctgtaatagatactggtacttctctcatctacggaccagacgatgatgttgaagctatcaatgacgcaattggtgccttctatgactacgatcttggtatttacaccattgaatgcgatgccgatttgactaagcttcctaatgtaacatttactttcggaggcaagaaatttgacatttctccttcagcctacgtcatcagagattcacgtatttgcgtatcaagctttgtcgccgg

SEQ ID NO: 971 - DNA, 407 bp, Diabrotica virgifera
  Clone ID: LIB3026-001-Q1-E1-B2
accacgcgtccgggagaactagtgattggtggatcagatccaagtaaatacagaggagacttcacctacacagaagtatcaaaaaaactgtattggcaaactaagctacaaggtgtttccgtagggaaacaaagtttatgtaggaatggatgtcgatctgtaatagatactggtacttctctcatctacggaccaaacgatgatgttgaagctatcaatgacgcaattggtgccttctatgactacgatcttggtatttacaccattgaatgcgatgccgatttgactaagcttcctaatgtaacatttactttcggaggcaagaaatttgacatttctccttcagcctacgtcatcagagattcaggtatttgcgtatcaagctttgtcgccggagactttttcct

SEQ ID NO: 972 - DNA, 393 bp, Diabrotica virgifera
  Clone ID: LIB3026-031-Q1-E1-A1
atttccctttaatctgagccaaacagccaatggcgattcaaggaaaaactagtgattggtggatcagattcaagtaaatacacaggagacttcacctacacagaagtatcaaaaaaactgtattggcaaactaagctacaaggtgtttccgtagggaaacaaagtttatgtaggaatggatgtcgatctgtaatagatactggtacttctctcatctacggaccaaacgatgatgttgaagctatcaatgacgcaattggtgccttctatgactacgatcttggtatttacaccattgaatgcgatgccgatttgactaagcttcctaatgtaacatttactttcggaggcaagaaatttgacatttctccttcagcctacgtcatcagagat

SEQ ID NO: 973 - DNA, 430 bp, Diabrotica virgifera
  Clone ID: LIB150-037-Q1-E1-A4
acccacgcgtccgcccacgcgtccgctgtctttggcggagtggtttatttgtgtgtggtaagaataagaattgaagggaattgaagttaccggtttattagcagaaatacaaagaaaagtaaaaatgcggaattatctgcttttattctttatatgcagtatttatacagttaattgcgattttgtgcgaattccacttcagaaaattcaaactataagaaactcactaagagaggtgggaaccgaattaactcgtgtatctgtgaaacaaacttcaaacaaatacggtggaccaactccagaaccgttatccaattatttagatgcacaatattatggtcctattagcattggtaacccaccacagaattttaaagtcgttttcgatactggatcatctaatttgtgggtgccatcgaagaaatgtgga

SEQ ID NO: 974 - DNA, 465 bp, Diabrotica virgifera
  Clone ID: LIB150-026-Q1-E1-G5
actcgcgggtcgatacacgcctctaaagtgactcgtatgagtatcgaacttagacgaaagaaaagccctagacaagagttactggaaaacgaacctacccttagaaaatatggatacagactggaatttcttaaaaacagaagaattaaagaaccccgaacaaacgattctatcgctttatacagatatttggacaacgagttttatggcacaatagtcattggccatccaggaaaaacatttgatgtctcttttgataccgcatggggcctttcatggttattgtcgtcaagatgtgatacgagcctaactccaggatgccgtggccataacttgtacgatcgttacaaatcttcaacttttaaaaagaatggtacccaatattttatacaagatggagcttttaatttcactggagtttattcatacgatgatattcatatcgcccactcaaatgttacatca

SEQ ID NO: 975 - DNA, 386 bp, Diabrotica virgifera
  Clone ID: LIB150-037-Q1-E1-A5
gccgacccaagcgtccacccacgcgtccgcccacgcgtccgctgtctttggcggagtggtttatttgtgtgtggtaagaataagaattgaagggaattgaagttaccggtttattagcagaagtacaaagaaaagtaaaaatgcggaattatctgcttttattctttatatgcagtatttatacagttaattgcgattttgtgcgaattccacttcagaaaattcaaactacaagaaactcactaacagaggtgggaaccgaattaactcgtgtatctgtgaaacagacttcaaacaaatacggtggaccaactccagaaccgttatccaattagttagatgcacaatattatggtcctattagcattgggaacccaccacagaat

SEQ ID NO: 976 - DNA, 387 bp, Diabrotica virgifera
  Clone ID: LIB150-005-Q1-E1-F7
ccggggccaccaagcgtccggatttcgttaagttgaacaaggctactattaacatgcttatgatatgcgaaccttacattacatggggatatcctaacttaaagtcagtaagagaattaatctacaaaagaggatttgctaaagttaatggacagcgtgtagcaattaccagcaatcaaatcgttgaagacaggttgggaaaatctggaatcatttgtgttgaagatttaatccacgaaattttcactgttggacctaagttcaaatatgcctccaacttcttgtggcccttcaagctaaacacacccactggtggatggcgtaagaagactaaccactatgttgaacgaggtgactttggtaatagagaagatagaattaatgaac

SEQ ID NO: 977 - DNA, 398 bp, Diabrotica virgifera
  Clone ID: LIB149-012-Q1-E1-E11
atgaagctaaattggcttttgttgttcgtactaacggtatcaagatagtagcacctaaagtacgcaaggtactccaactattccggttacttcagatcaacactggagttttcgttaagttgaacaaggctactattaacatgcttaagatatgcgaaccttacattacatggggatatcctaacttaaactcagtaagagaattaatctacattcgaggatttgccagagttactggacagcgtgtagcaattaccagcaatcaaatcgttgaagacaggttgggaacatctggaatcagttgtgttgaagatttaatccacgaaattttcactgttggacctaagttcatatatgcctccaacttcctgtggcccttcaagctaaacacactcact

SEQ ID NO: 978 - DNA, 428 bp, Diabrotica virgifera
  Clone ID: LIB3026-015-Q1-E1-E10
acagtctgtcatcaaaaagaaggcagaacagatcaaaaagaggaaagatattttcaaaagagctgaacagtatgttaaggaataccgtttaaaagaaagagacgaagttaggctagttagacaagccaaaaccagaggaaatttctatgttcctgctgaggctaaattggcttttgttgttcgtattaagggtatcaataaagtagcacctaaagtacgcaaagtactccaactattccggttacttcaaatcaacaatggagttttcgttaagttgaacaaggctactattaacatgcttaggatatgcgaaccttacattacatggggatatcctaacttaaagtcagtaagagaattaatctacaaaagaggatttgccaaagttaatggacagcgtgtaacaattaccagcaatcaaatcgttg

SEQ ID NO: 979 - DNA, 455 bp, Diabrotica virgifera
  Clone ID: LIB3026-011-Q1-E1-G1
gctgacaaaactaaaacggttaaagggctccccgcagtcccagaatcagtcttaaaacaccgtaaaagacgtgaagcatcccgtgctaaacaactccagtctgtcatcaaaaagaaggcagaacagatcaaaaagaggaaagatattttcaaaagagctgaacagtatgttaaggaataccgtttaaaagaaagagacgaagttaggctagttagacaagccaaaaccagaggaaatttctatgttcctgctgaggctaaattggcttttgttgttcgtattaagggtatcaataaagtagcacctaaagtacgcaaagtactccaactattccggttacttcaaatcaacaatggagttttcgttaagttgaacaaggctactattaacatgcttaggatatgcgaaccttacattacatggggataccctaacttaaagtcagtaagagaatt

SEQ ID NO: 980 - DNA, 459 bp, Diabrotica virgifera
  Clone ID: LIB149-014-Q1-E1-D8
agcccacgcgtccgggcaccgacagctgacaaaactaaaacggttaaagggctccccgcagtcccagaatcagtcttaaaacaccgtaaaagacgtgaagcatcccgtgctaaacaactccagtctgtcatcaaaaagaaggcagaacagatcaaaaagaggaaagatattttcaaaagagctgaacagtatgttaaggaataccgtttaaaagaaagagacgaagttaggctagttagacaagccaaaaccagaggaaatttctatgttcctgctgaggctaaattggcttttgttgttcgtattaagggtatcaataaagtagcacctaaagtacgcaaagtactccaactattccggttacttcaaatcaacaatggagttttcgttaagttgaacaaggctactattaacatgcttaggatatgcgaaccttacattacatggggatatcctaac

SEQ ID NO: 981 - DNA, 317 bp, Diabrotica virgifera
  Clone ID: LIB3026-033-Q1-E1-B6
ccacgcgtccgcaatctgtcatcaaaaagaaggcagaacagatcaaaaagaggaaagatattttcaaaagagctgaacagtatgttaaggaataccgtttaaaagaaagagacgaagttaggctagttagacaagccaaaaccagaggaaatttctatgttcctgctgaggctaaattggcttttgttgttcgtattaagggtatcaataaagtagcacctaaagtacgcaaagtactccaactattccggttacttcaaatcaacaatggagttttcgttaagttgaacaaggctactattaacatgcttaggata

SEQ ID NO: 982 - DNA, 386 bp, Diabrotica virgifera
  unsure (1)..(386): unsure at all n locations
  Clone ID: LIB150-038-Q1-E1-D12
acacgcgtccggtccaaaatggcaccgacagctgacaaaactaaaacggttaaagggctccccgcagtcccagaatcagtcttaaaacaccgtaaaagacgtgaagcatcccgtgctaaacaactccagtctgtcatcaaaaagaaggcagaacagatcanaaagaggaaagatattttcaaaagagctgaacagtatgttaaggaataccgtttaaaagaaagagacgaagttaggctagttagacaagccaaaaccagaggaaatttctatgttcctgctgaagctaaattgggctttggttgttcgtattaagggtatcaataaagtagcacctaaagtacgcaaagtactccaactattccggttacttcaaatcaacaatg

SEQ ID NO: 983 - DNA, 160 bp, Diabrotica virgifera
  Clone ID: LIB150-005-Q1-E1-H8
gttaatttgaacagggctactattaacatgcttaggatatgcgaaccttacattacatggggataccctaacttaaggtcagtaggagaattaatctacaaaagaggatttgctaaagttaatggacaccgtgtaccaattaccagcaatcaaatcgttg

SEQ ID NO: 984 - DNA, 383 bp, Diabrotica virgifera
  Clone ID: LIB150-007-Q1-E1-D11
agtccataatggcaccgacagctgacaccactagcacggttacttggctctacgcagtcacagcgtcagtcttaaaacaccgtaatgagacgtgaagcatcacgtgctatgtaactccactctgtcatcaaaacgaaggcagcccagatcaactagaagtaagatattttcaaacgagctgaacagtatgtcaacgaataccgtttaaaataaagagacgaagttatgctagttagacagtccaaaaccagatgagatttccatgttcctgctgaagctaaacaggcgtctgttgttcgtattcagggtatcactaaagtgacagctaaagtacgcaaagtactccaactattccggatacatcaaatcagcaatggagtttt

SEQ ID NO: 985 - DNA, 450 bp, Diabrotica virgifera
  Clone ID: LIB150-013-Q1-E1-E5
cccacgcgtccgtccaaacgagtgaagaaggttggtttgaacatttccaaaaagtttacctgcaaccgtcgaaatgactacctcttggaactatcctgatgctgcactcagagctgaactcaagaaaatcgctgatgctatcaccgctcctggaaaaggtattttggctgccgacgaatctaccgctaccgtaggcaagcgttttgctgacatcggagtcgaaaacaacgaagagaaccgtcgtaaatacagacaacttcttttcaccaccgatccagccattggacaatacatttctggtgtaattttgttccacgaaagtttataccagaaagccgatgatggtactccattcccagaacttcttaaacagagaggaatcattcccggcattaaagtcgactctggtgtagtacctctcttcggcagcaatgacgaatgcaccacaca

SEQ ID NO: 986 - DNA, 446 bp, Diabrotica virgifera
  unsure (1)..(446): unsure at all n locations
  Clone ID: LIB150-024-Q1-E1-E11
ctcgcgggtcgatacaagcctctagatttcctcacgagagaagaaggttggtttgaacatttccaaaaagtttacctgcaaccgtcgaaatgactacctcttggaactatcctgatgctgcactcagagctgaactcaagaaaatcgctgatgctatcaccgctcctggaaaaggtattttggctgccgacgaatctaccgctaccgtaggcaagcgttttgctgacatcggagtcgaaaacaacgaagagaaccgtcgtaaatacagacaacttcttttcaccaccgatccagccattggacaatacatttctggtgtaattttgttccacgaaagtttataccaaaaagccgatgatggtactccattcccagaacttcttaaacagagaggaatcattcncggcattaaagtcgactctggtgtagtacctctcttcggcagc

SEQ ID NO: 987 - DNA, 416 bp, Diabrotica virgifera
  Clone ID: LIB150-032-Q1-E1-H10
ccgggcaagcgtctagatgtatttataccaacattttacctgcaaccgtcgaaatgactacctcttggaactatcctgatgctgcactcagagctgaactcaagaaaatcgctgatgctatcaccgctcctggaaaaggtattttggctgccgacgaatctaccgctaccgtaggcaagcgttttgctgacatcggagtcgaaaacaacgaatagaaccgtcgtaaatacagacaacttcttttcaccaccgatccagccattggacaatacatttctggtgtaattttgttccacgaaagtttataccaaaaagccgatgatggtactccatttccagaacttcttaaacagagaggaatcattcccggcattaaagtcgactctggtgtagtacctctcttcggcagaaatgac

SEQ ID NO: 988 - DNA, 414 bp, Diabrotica virgifera
  unsure (1)..(414): unsure at all n locations
  Clone ID: LIB149-019-Q1-E1-C11
acggacgcgtgggaaaagttgtgctgtgtgtatacctacattttacctgcaaccgtcgaaatgactacctcttggaactatcctgatgctgcactcagagctgaactcaagaaaatcgctgatgctatcaccgctcctggaaaaggtattttggctgccgacgaatctaccgctaccgtaggcaagcgttttgctgacatcggagtcgaaaacaacgaagagaaccgtcgtaaatacagacaacttcttttcaccaccgatccagccattggacaatacatttctggtgtaattttgttccacgaaagtttataccaaaaagccgatgatggtactccattcccagaacttcttanacagagaggaatcattcncggcattaaagtcgactctggtgtagtacctctcttcggg

SEQ ID NO: 989 - DNA, 402 bp, Diabrotica virgifera
  Clone ID: LIB150-034-Q1-E1-G8
cggacgcgtgggttgtgctgtgtgtatacctacattttacctgcaaccgtcgaaatgactacctcttggaactatcctgatgctgcactcagagctgaactcaagaaaatcgctgatgctatcaccgctcctggaaaaggtattttggctgccgacgaatctaccgctaccgtatgcaagcgttttgctgacatcggagtcgaaaacaacgaagagaaccgtcgtaaatacagacaacttcctttcaccaccgatccagccattggacaatacatttctggtgtaattttgttccacgaaagtttataccaaaaagccgatgatggtactccattcccagaacttcttaaacagagaggaatcattcccggcattaaagtcgactctggtgtagtacctctc

SEQ ID NO: 990 - DNA, 402 bp, Diabrotica virgifera
  unsure (1)..(402): unsure at all n locations
  Clone ID: LIB150-042-Q1-E1-F12
acaggcctctacaattggtaatgttggtttgaacatttccaaaaagtttacctgcaaccgtcganatgactacctcttggaactatcctgatgctgcactcagagctgaactcaagaaaatcgctgatgctatcaccgctcctggaaaaggtattttggctgccgacgaatctaccgctaccgtaggcaagcgttttgctgacatcggagtcgaaaacaacgaagagaaccgtcgtaaatacagacaacttcttttcaccaccgatccagccattggacaatacatttctggtgtaattttgttccacgaaagtttataccaaaaagccgatgatggtactccattcccagaacttcttaaacagagaggaatcattcccggcattaaagtcgactctggtg

SEQ ID NO: 991 - DNA, 369 bp, Diabrotica virgifera
  Clone ID: LIB150-050-Q1-E1-F12
aaacgagtgaagaaagttggtttgaacatttccaaaaagtttacctgcaaccgtcgaaatgactacctcttggaactatcctgatgctgcactcagagctgaactcaagaaaatcgctgatgctatcaccgctcctggaaaaggtattttggctgccgacgaatctaccgctaccgtaggcaagcgttttgctgacatcggagtcgaaaacaacgaagagaaccgtcgtaaatacagacaacttcttttcaccaccgatccagccattggacaatacatttctggtgtaattttgttccacgaaagtttataccaaaaagccgatgatggtactccattcccagaacttcttaaacagagaggaatcat

SEQ ID NO: 992 - DNA, 477 bp, Diabrotica virgifera
  Clone ID: LIB150-030-Q1-E1-D12
tgcaaaagattgaaaaatgttggtttgaacatttccaaaaagtttacctgcaaacgtcgaaatgactacctcttgggactatcctgatgctgcactcagagctgaactcaagaaaatcgctgatgctatcaccgctcctggaaaaggtattttggctgccgacgaatctaccgctaacgttaggcaagcgttttgctgacatcggagtcgaaaacaacgaagagaaaccgtcgtaaatacagacaactttcttttaacaaccgatccagccattggacaatacatttctggtgtaatttttgttccacgaaagtttattacaaaaaagccgatgatggtactccattcccagaacttcttaaacagagaagaatcattcccggcattaaagtcgactctggtgtagtacctctcttcggcagcaatgacgaatgcaccacacaaggtttggacgatttggccaagcgttgcgcccaa

SEQ ID NO: 993 - DNA, 378 bp, Diabrotica virgifera
  Clone ID: LIB150-036-Q1-E1-F12
ctctagagagaatcgtaggatagtacatttccataaagtatacctgcatccgtctaaatgactacctcatggaacgatcctgatgcagcactcagagctaatctcataattttcgctgatgctatcatagctcctgtaacatgtattttaggtaccaacaaatctaccgcaaccgtatgcaagcgtcttgctgacatcggcgtcgaaatcaacgatttataccgtcgtatatacatacaacttcatttcactaccgatccatccaatgcgcaatacatttcagctgtaattttgttccacgaatgtttataccatattgccgataatggtactccattcccagatcttcctatacagagatgaatcatttccgggatt

SEQ ID NO: 994 - DNA, 393 bp, Diabrotica virgifera
  Clone ID: LIB3026-001-Q1-E1-B8
aggacgcgtggggttttcgtaatttcatctcgtccctatggccagcgtgctgttcttaagtttgctgctcacactggagctacccctattgctggaagatttactcctggtgcttttaccaatcagatccaagctgcattcagggaacctcgtctgttgatcgtcactgaccctgcttttgatcaccaacctatcactgaagcctcttacgtaaacattccagttattgctttgtgcagtactgattctccattacgttttgttgatattgccattcccggaaacaacatagcctcacacagtattggtttactgtggtggcttttggctagagaggttctccgtcttataggaatcattccacgggataccaaatgggatgttgtagtagat

SEQ ID NO: 995 - DNA, 454 bp, Diabrotica virgifera
  Clone ID: LIB150-029-Q1-E1-B6
ttcgacacaacaccctagagagagtcgtactagtttatcgtaactcaaattaaacgtaaagatgtcgggaggaatcgaggctttaagccttaaagaggacgatgttaccaagatgttggcggcttccacccatcttggaacagcaaatgttgattttcaaatggaacagtatgtatacaaacgtcgtcatgacggtactcacatcatcaacttaaggaaaacgtgggaaaagattctcttggcagcccgtgccattgttgctattgaacaccctggtgaagttttcgtaatttcatctcgtccctatggccagcgtgctgttcttaagtttgctgctcacactggagctacccctattgctggaagatttactcctggtgcttttaccaatcagatccaagctgcattcacggaacctcgtctgttgattgtcactgaccctgcctttgatcac

SEQ ID NO: 996 - DNA, 450 bp, Diabrotica virgifera
  Clone ID: LIB150-001-Q1-E1-E3
accaaagtggcatcttgtctcgtttatcgtaactcaaattaaacgtaaagatgtcgggaggaatcgaggctttaagccttaaagaggacgatgttaccaagatgttggcggcttccacccatcttggaacagcaaatgttgattttcaaatggaacagtatgtatacaaacgtcgtcatgacggtactcacatcatcaacttaaggaaaacgtgggaaaagattctcttggcagcccgtgccattgttgccattgaacaccctggtgaagttttcgtaatttcatctcgtcgctatggccagcgtgctgttcctaagtttgctgctcacactggagctacccctattgctggaagatttactcgtggtgcttttaccaatcagattcaagctgcattcagggaaactcgtcggttgatcgtcactgaccctgcttttgatcaccaaccta

SEQ ID NO: 997 - DNA, 354 bp, Diabrotica virgifera
  Clone ID: LIB150-050-Q1-E1-C6
agggaacagcacatgttgattttcaaatggaacagtatgtatacagacgtcgtcatgacagtactcacatcatcaacttaaggaaaacgtgggaaaagattctcttggcagcccgtgccattgttgctattgaacaccctggtgaagttttcgtaatttcatcgcgtccctatggccagcgtgctgttcttaagtttgctgctcacactggagctacccctattgctggaagatttactcctggtgcttttaccaatcagatccaagctgcattcagggaacctcgtctgttgatcgtcactgaccctgcttttgatcaccaacctatcactgaagcctcgtacgtaaacattc

SEQ ID NO: 998 - DNA, 436 bp, Diabrotica virgifera
  Clone ID: LIB150-020-Q1-E1-G4
gcgtccacccaaatggcatcttgtcccgttaaccgtaacccaaattaaacgtaaaaatgtcggaaggaaccaaggctttaacccttaaaaaggacaatgttaccaaaatgttggcggcttcaacccaccttggaacagcaaatgttgattttcaaatggaacagtatgtatacaaacgtcgtcatgacggtactcacatcatcaacttaaggaaaacgtgggaaaagattctcttggcagcccgtgccattgttgctattgaacaccctggtgaagttttcgtaatttcatctcgtccctatggccaacgtgctgttcttaagtttgctgctcacactggagctacccctattgctggaagatttactcctggtgcttttaccaatcagatccaagctgcattcaaggaacctcgtctgttgatcgtcactgaccc

SEQ ID NO: 999 - DNA, 411 bp, Diabrotica virgifera
  Clone ID: LIB150-003-Q1-E2-H7
aaacccaagtggcatcgtgtcgcgtttagcgtaactcatcttaaacgtaaagatgtcgggaggaatcgaggctttaagccttaatgaggacgatgttaccaagatgttggcggcttccacccatcttggaacagcatatgttgagtttcaaatgggacagtatgtatacaaacgtcgtcatgacagtactcacatcatcaacttaaggaatacatgggaaaagattctcttggcagcccgtgccattgttgctactgaacaccctggtgaagttttcgtaatttcatctcgtccctatggccagcgtgctgttcttaagtttgctgctcacactgtagctacgcctattgctggtagatttactcctggtgcttttaccaatcagatccaagctgcattcagggaacctcg

SEQ ID NO: 1000 - DNA, 406 bp, Diabrotica virgifera
  unsure (1)..(406): unsure at all n locations
  Clone ID: LIB149-030-Q1-E1-C7
agctgcattcagggaacctcgtctgttgatcgtcactgaccctgcttttgatcaccaacctatcactgaagcctcttacgtaaacattccagttattgctttgtgcaatactgattctccattacgttttgttgatattgccattcccggaaacaacaaagcctcacacagtattggtttactgtggtggcttttggctagagaggttctccgtcttagaggaatcattccacgggataccaaatgggatgttgtagtagatcttttcttctaccgtgaaccagaagaggctgaaaaggaagaacaagctgccaaagaagctgtggctgctgttgtcaaacctgtagatatcccagctcctcttgaaggccaagacttggactggaatactactganactactgag

SEQ ID NO: 1001 - DNA, 352 bp, Diabrotica virgifera
  Clone ID: LIB149-027-Q1-E1-B2
aacctcgtctgttgatcgtcactgaccctgcttttgatcaccaacctatcactgaagcctcttacgtaaacattccagttattgctttgtgcaatactgattctccattacgttttgttgatattgccattcccggaaacaacaaagcctcacacagtattggtttactgtggtggcttttggctagagaggttctccgtcttagaggaatcattccacgggataccaaatgggatgttgtagtagatcttttcttctaccgtgaaccagaagaggctgaaaaggaagaacaagctgccaaagaagctgtggctgctgttgtcaaacctgtagatatcccagctcctcttga

SEQ ID NO: 1002 - DNA, 331 bp, Diabrotica virgifera
  Clone ID: LIB150-016-Q1-E1-F2
cgccaagtggcaacctggcccctttaacgtaactcaaattaaacgttaagatgtccggaagaatccaaggtttaagccctaaagaagacgatgttaccaagatgttggcgggttccaaccaacctgggacaacaaatgttgaatttcaaatgggacaatatgtttacaaacgtcctcatgacggtactcacaacatcaacttaaaggaaacgtgggaaaagattctcttggcaacccgtgccattgttgctattgaacaacctggtgaaattttcgtaatttcatctcgtccctatgggcagcgtgctgtccttaagtttgctgctcacac

SEQ ID NO: 1003 - DNA, 545 bp, Diabrotica virgifera
  unsure (1)..(545): unsure at all n locations
  Clone ID: pGUT3408
ctggagctgtagataaaattgaatctgcttatcatgtcgaagaagtagcaaagtatttggatatgataaatgtaatggcgtatgactaccatggggcatttgataatttagtgggacacgtatcgcctcttcatgcctcttctaaggattaccaacatggaaggaatgctacttacacagtagctactggtttagaatactggctatacaaaaacgcagatccttcaaaaatcaatcttggacttcctacttacggaagaacttttactctggcagacagaaccaaaaccgaactatactcagaagtacttggtccaggcgaaagaggactttacacgggaataagaggaagtttgggatatcacgaaatctgcgaattctattctggttccgactcaacttactactgggatgacgaacanaaggtgcctcatagggtatgggaggatcaatgggctggatacgatgaccagagatcgatacaatataaagtggactttgctgtgagtcataacctcgctggcgttttgatttgttctttggat

SEQ ID NO: 1004 - DNA, 429 bp, Diabrotica virgifera
  unsure (1)..(429): unsure at all n locations
  Clone ID: LIB149-043-Q1-E1-C10
gagaattatgtcgaacttttgaaagctcttagtgacgttcttgagcccaaaggatacttactcagtgtagccactgcaggcgccgttgaaaaaatcgacgttggatttgacgtctcagttataaatgagttggtggatatgattaacgttatggtttttgattttcatggagcatttgagaactttgtaggacacgtttcaccattgttcccagctcaagttgattacgaatatgaagctaatagtacatacaatgtagacacaggaatccaacactggatattgagtggtgcagattccgcaaaaataaacctcggtattgtcnactatggaagaaactataccttagctgataaaacaaatacttctctttatgcaaatgttaccggtggtggtaatacagggccatattctgcacaatctggatat

SEQ ID NO: 1005 - DNA, 387 bp, Diabrotica virgifera
  Clone ID: LIB149-040-Q1-E1-D5
agcaatattttgcactgctcctacctttggttcaggaaaaaatatcgtatgctatttctcgagctggacagtttatagacacggaggagacggagctggatctttcgacgtacgtaacatagacccatcgttatgtacccatatcaattttgctttcattggtcttaacacggatgcctccattcacattttagatccgtgggaatccaatgatgccggaggtcctgagggttttaaaaatctggtagctctaaaagaatcaaatccaaatcttaaaataattgtaagtatgggtggctggaacgaaggatccgaggtatactcagaagtagctgcaaatgcaatgttgagaaaaattttggccaacaacgttgcatattttcaaaa

SEQ ID NO: 1006 - DNA, 443 bp, Diabrotica virgifera
  unsure (1)..(443): unsure at all n locations
  Clone ID: LIB149-026-Q1-E1-C2
cacgcgtccaaaatcaatccttgaaaaaaggcaacttcacggaacttttacaaaaacttagtaaggttctaaaaccccagggatacttattaagtgcagcagtaccgggagcaattgaaaaaattgatgaaccttacgacattccagcgatttcaaagctactaaatttggtcaatgtaatggttttcgatttccacggcgcttttgacaactatgtaggacatatctcaccgctttttcccgctaaagttgactacgattactataataataaaacatacaatgtggatacaggaattcaatattggttgaatggtggtgcagatcctgcaaaattaaacttgggtgttgtcgcttatggaagaacttttactttggctgataaaaataataccgctctatatgctcctgtcaaaggtggaagtanagttggaccttataca

SEQ ID NO: 1007 - DNA, 387 bp, Diabrotica virgifera
  Clone ID: LIB3026-001-Q1-E1-H10
aagtcaagtgatgctggtggtcatgagggttttaaacatctcgtagagcttaaaaagaccaatcctgaccttaaggtatgtgtaagtatgggcggttggaacgaaggttccaagcagtattcagcagtagcatcagatccagcaaaaagagtaaaacttgcagatgaggttttagcttttatcgaaaattggggcttcgatggttttgatttggattgggaatatccaggattacgaggaggaaacgaaactattgataaagagaattatgtcgaacttttgaaagctcttagtgacgttcttgagcccaaaggatacttactcagtgtagccactgcaggtgccgttgaaaaaatcgacgttggatttgacgtctcagttataaat

SEQ ID NO: 1008 - DNA, 379 bp, Diabrotica virgifera
  Clone ID: LIB3026-008-Q1-E1-A5
aaagctcttagtgacgtccttgagcccaaaggatacttactcagtgtagccactgcaggcgccgttgaaaaaatcgacgttggatttgacgtctcagttataaatgagttggtggatatgattaacgttatggtttttgattttcatggagcatttgagaattttgtaggacacgtttcaccattgttcccagctcaagttgattacgaatatgaagctaatagtacatacaatgtagacacaggaatccaacactggatattgagtggtgcagatcccgcaaaaataaacctcggcattgtcacctatggaagaacctataccttagctgataaaaccaatacttctctttatgcaaatgttaccggtggtggtaata

SEQ ID NO: 1009 - DNA, 422 bp, Diabrotica virgifera
  Clone ID: LIB149-047-Q1-E1-B6
ctcgccggtcgacacacgcatctacagtaacacgtgataaaattgatgaagcttatgacattccagcgatttcaaagctactagacttgatcaatgttatggttttcgatttccacggcgcttttgacaactatgtaggacatatctcaccgctttttcccgctaaagttgactacgattactataataataaaacatacaatgtggatacaggaattcaatattggttgaatggtggtgcagatcctgcaaaattaaacttgggtgttgtcgcttatggaagaacttttactttggctgataaaaataataccgctctatatgctcctgtcaaaagtggaggtacagttggaccttattcacaacaatctggatatttgggatataatgagatttgcagatactataccgactcaacttac

SEQ ID NO: 1010 - DNA, 326 bp, Diabrotica virgifera
  Clone ID: LIB149-036-Q1-E1-C4
aggtaaatgctcaacatgaaggtgctagtgttactctcggtactatctgcatttcttgtttgccaaacatcaggtgcggaaaaacgggtcgtttgttatttcgccagttggaccatttatagagcaagaaaaggtgctttcgatgtcagtaatatagatccatcgctgtgtacacacattaattttgctttccttggtcttaatgaagatggttctattcacattttggattcctgggagtcaagtgatgctggtggtcatgaaggttttaaacatctcgtagagcttaaaaagaccaatcctgaccttaaggtatgtgtaagtat

SEQ ID NO: 1011 - DNA, 306 bp, Diabrotica virgifera
  Clone ID: LIB149-029-Q1-E1-E2
ttacaactccctatagtaagtcgtattatcccagtagcaccaacgtcgctgtaggagcagtttctagcggagcacgtatttcaggtccctacacattgggagctggataattacgatataatgaaattgttgaaaaatgaattaccaggaagatggacctatgtctgggacaatgaacagcaagttccccatatgtacaaaggagaccaatgggtaggatttgatgatccataagccgtacaggttaagaccagatatgcacaagataaaggacttggtggtgttatggcctgggctaccgaaaca

SEQ ID NO: 1012 - DNA, 641 bp, Diabrotica virgifera
  Clone ID: pGUT2262
ggccatgattgctgtcggtaaaaataagggtttgtcaaaaggtggcaaaaagggagttaaaaagaaggttgttgatcccttcacaagaaaagactggtacgatgtgaaagctccatcaatgtttgccacccgccaggtcggcaaaactttggttaaccgtacccaaggaaccaaaattgcctctgaaggtttgaaattcagagtttttgaagtgtctttagccgatttacaaaatgataatgacgccgaaaggtctttcagaaaattccgtttgatagctgaagatgttcaaggtagaaatgttttaacaaatttccacggtatggatttaaccactgacaagctgaagtccatggttaagaaatggcaaaccttaatttgaagcatctgctgatgtcaagacatcagatggatatttgcttagggtgttctgcataagctttaccaacaaagaccaactttctcaaaggaaaacatgctatgcacaacatacacaagttagagctattccgaaaaagatggtggacattattaccagagacattcatggctcagacatcaaagaaatagtcaataaactccttcctgacagcatagcccaagatattgaaaaggcctgccagggatttaccccttacatg

SEQ ID NO: 1013 - DNA, 421 bp, Diabrotica virgifera
  Clone ID: LIB150-037-Q1-E1-H5
acaaaaagggagttaaaaagaaggttgttgatcccttcacaagaaaagactggtacgatgtgaaagctccatcaatgtttgccacccgccaggtcggcaagactttggttaaccgtacccaaggaaccaaaattgcctctgaaggtttgaaattcagagtttttgaagtgtctttagccgatttacaaaatgataatgacgccgaaaggtctttcagaaagttccgtttgatagctgaagatgttcaaggtagaaatgttttaacaaatttccacggtatggatttaaccactgacaagctgaggtccatggttaagaaatggcaaaccttaattgaagcatctgctgatgtcaagacatcagatggatatttacttagggtgttctgcataggcttttacaacaaagaccaactttctca

SEQ ID NO: 1014 - DNA, 445 bp, Diabrotica virgifera
  Clone ID: LIB150-035-Q1-E1-A3
ggtaacggtccagaggtcgacggacgcgtccgcaatcatggccgtcggtaaaaataagggtttgtcaaaaggtggcaaaaagggagttaaaaagaaggttgttgatcccttcacaagaaaagactggtacgatgtgaaagctccatcaatgtttgccacccgccaggtcggcaaaactttggttaaccgtacccaagctaccaaaattgcctctgaaggtttgaaattcagagtttttgaagtgtctttagccgatttacaaaatgataatgacgccgaaaggtctttcagaaaattccgtttgatagctgaagatgttcaaggtagaaatgttttaacaaatttccacggtatggatttaaccactgacaagctgaggtccatggttaagaaatggcaaaccttaattgaagcatctgctgatgtcaagacatcagatggatat

SEQ ID NO: 1015 - DNA, 426 bp, Diabrotica virgifera
  Clone ID: LIB149-015-Q1-E1-F7
cagacgcgtggcagcaatcatggccgtcggtaaaaataagggtttgtcaaaaggtggcaaaaagggagttaaaaagaaggttgttgatcccttcacaagaaaagactggtacgatgtgaaagctccatcaatgtttgccacccgccaggtcggcaagactttggttaaccgtacccaaggaaccaaaattgcctctgaaggtttgaaattcagagtttttgaagtgtctttagccgatttacaaaatgataatgacgccgaaaggtctttcagaaagttccgtttgatagctgaagatgttcaaggtagaaatgttttaacaaatttccacggtatggatttaaccactgacaagctgaggtccatgggtaagaaatgggcaaacttaattgaagcacctgctgatgtcaagacatcagatggata

SEQ ID NO: 1016 - DNA, 368 bp, Diabrotica virgifera
  Clone ID: LIB149-027-Q1-E1-C8
accacgcgtccgcccacgcgtccggcaatcatggccgtcggtaaaaataagggtttgtcaaaaggtggcaaaaagggagttaaaaagaaggttgttgatcccttcacaagaaaagactggtacgatgtgaaagctccatcaatgtttgccacccgccaggtcggcaaaactttggttaaccgtacccaaggtaccaaaattgcctctgaaggtttgaaattcagagtttttgaagtgtctttagccgatttacaaaatgataatgacgccgaaaggtctttcagaaaattccgtttgatagctgaagatgttcaaggtagaaatgttttaacaaatttccacggtatggatttaaccactgacaagct

SEQ ID NO: 1017 - DNA, 355 bp, Diabrotica virgifera
  Clone ID: LIB149-027-Q1-E1-E2
aggacgcgtgagcggacgcgtggggccgtcggtaaaaataagggtttgtcaaaaggtggcaaaaagggagttaaaaagaaggttgttgatcccttcacaagaaaagactggtacgatgtgaaagctccatcaatgtttgccacccgccaggtcggcaagactttggttaaccgtacccaaggaaccaaaattgcctctgaaggtttgaaattcagagtttttgaagtgtctttagccgatttacaaaatgataatgacgccgaaaggtctttcagaaagttccgtttgatagctgaagatgttcaaggtagaaatgttttaacaaatttccacggtatggatttaaccactgaca

SEQ ID NO: 1018 - DNA, 381 bp, Diabrotica virgifera
  unsure (1)..(381): unsure at all n locations
  Clone ID: LIB3026-019-Q1-E1-A7
agcggacgcgtgggcggacgcgtgggttttcgagtacgacagcaatcatggccgtcggtaaaaataagggtttgtcaaaaggtggcaaaaagggagttaaaaagaaggttgttgatcccttcacaagaaaagactggtacgatgtgaaagctccatcaatgtttgccacccgccaggtcggcaagactttggttaaccgtacccaaggaaccaaaattgcctctgaaggtttgaaattcagagtttttgaagtgtctttagccgatttacaaaatgataatgacgccgaaaggtctttcagaaagttccgtttgatagctgaagatgttcaaggtanaaatgttttaacaaatttccacggtatggatttaaccactgaca

SEQ ID NO: 1019 - DNA, 259 bp, Diabrotica virgifera
  Clone ID: LIB150-049-Q1-E1-E6
agcacaagcttaggtccatggcaaagaaatggcaaaccttacttgaagcatctgctgatatcaagacatcagatggatatttacttaaggtgttctgcatatgctttaccaccaaataccatctttctcaaatgaaaacatgctatgcacaacatacacatataagatctatcctctaaaaatatggtcgacattattaccagatatatccatggcacatacatcaaataagtattgaataaactccttcctgacagca

SEQ ID NO: 1020 - DNA, 339 bp, Diabrotica virgifera
  Clone ID: LIB3026-035-Q1-E1-E5
cggtcacttggagaagttgttcatggtatagttgttgtaacaaatttccacagtatgggtttatccactaacattgtgaggtccatggttaatatttggcagcccttaattaattcatcgtcccatgtctagcacggattatgacttcttctttgggtgttcagcatatgccatttcaacagagcccaactttcccaattgataacgtgctatgcacaacatacacaatttatatctatccatatgtaaatcgtatacattattaccagaaacttccaaggctcaaacttcatttacgtagtgactaaactccttcctgacaacatatccaaggctatt

SEQ ID NO: 1021 - DNA, 429 bp, Diabrotica virgifera
  Clone ID: LIB150-014-Q1-E1-F1
atgccaagaacatgatggcggcttgtgatcccagacacggaaggtaccttacagtagctgcagtattcagaggtaggatgtcaatgaaagaagttgacgaacagatgctcaacatccagaacaagaacagcagctacttcgtcgaatggatccccaacaacgttaaaacagccgtttgtgatatcccaccaagaggtctcaagatgtctgccactttcatcggcaactcaaccgccatccaagaattgttcaaacgtatctccgaacaatttacagctatgttcaggaggaaagctttcttgcattggtacaccggagaaggtatggatgaaatggaattcacggaagcagaatccaacatgaacgacttggtatcagaataccaacagtaccaagaagccacagctgacgaagatgccgaattcgacg

SEQ ID NO: 1022 - DNA, 426 bp, Diabrotica virgifera
  Clone ID: LIB150-018-Q1-E1-H1
gtactggatcaggtatgggtaccatccctatctcaaaaatccgtgaagaatacccagacagaattatgaacacatactcagtagtcccctcacccaaagtatcagataccgtagtagaaccatacaatgccacactttcagtacatcaattggtagaaaacacagatgaaacatactgtattgataatgaagctctctatgacatttgcttcagaactttgaaactcacaacacccacatatggagacttaaaccatttggtatccctcacaatgtccggtgttaccacctgtcttaggttcccaggtcagttgaatgctgatcttagaaaattggctgtcaacatggttcccttcccccgtctccacttcttcatgcccggattcgctccactcacctcaagaggcagccaacaatacagagcgt

SEQ ID NO: 1023 - DNA, 410 bp, Diabrotica virgifera
  Clone ID: LIB150-002-Q1-E1-G3
gttcccttcccccgtctccacttcttcatgcccggattcgctccactcacctcaagaggcagccaacaatacagagcgttgacagttccagagctcacacagcaaatgtttgatgccaagaacatgatggcggcttgtgatcccagacacggaaggtaccttacagtagctgcagtattcagaggtaggatgtcaatgaaagaagttgacgaacagatgctcaacatccagaacaagaacagcagctacttcgtcgaatggatccccaacaacgttaaaacagccgtttgtgatatcccaccaagaggtctcaagatgtctgccactttcatcggcaactcaaccgccatccaagaattgttcaaacgtatctccgaacaatttacagctatgttcaggaggaaagcttt

SEQ ID NO: 1024 - DNA, 386 bp, Diabrotica virgifera
  Clone ID: LIB149-040-Q1-E1-E8
aaggtatccctcacaatgtccggtgtaaccacctgtcttaggttcccaggtcagttgaatgctgatcttagaaaattggctgtcaacatggttcccttcccccgtctccacttcttcatgcccggattcgctccactcacctcaagaggcagccaacaatacagagcgttgacagttccagagctcacacagcaaatgtttgatgccaagaacatgatggcggcttgtgatcccagacacggaaggtaccttacagtagctgcagtattcagaggtaggatgtcaatgaaagaagttgacgaacagatgctcaacatccagaacaagaacagcagctacttcgtcgaatggatccccaacaacgttaaaacagccgtttgtgatat

SEQ ID NO: 1025 - DNA, 422 bp, Diabrotica virgifera
  Clone ID: LIB150-026-Q1-E1-G6
tacaaccctctaaaatgattcgtagtattttctagtaatagttatttaatacattttataaatcaaaatgagggaaatcgttcacatccaagctggacaatgcggtaaccaaattggagccaaattctgggaaatcatctctgatgaacacggaatcgaccccaccggagcctaccatggagactctgacctccaacttgaaagaatcaatgtctactacaacgaggcctccggcggaaaatacgtaccccgcgccatcctcgtcgacttggaacccggtaccatggattcagtaaggtcgggtcccttcggacaaatcttcagaccagacaacttcgtgtttggacagtctggagctggaaacaactgggccaagggacattacacagaaggtgctgaattagttgattcagtattagatg

SEQ ID NO: 1026 - DNA, 394 bp, Diabrotica virgifera
  Clone ID: LIB149-047-Q1-E1-A8
agctggtcattgcggtaaccaaattggagccaaattctgggaaatcatctctgatgaacacggtatcgagaccaccggagcctaccatggtgactctgacctccagcttgaaagaatcaatgtctactacaactatgcctccggcggaaaatacgtaccccgcgccatcctcgtcgacttggtacccggtaccatggattcagtaaggtcaggtctcttcggacatatcttcagaccagacaacttcgtgtatggacagtctggagctggaaacaactgggccaatggacattacacagaaagtgctgaattagttgattcagtgttaaatgttgtaatgtaagaagctgaatcatgtgattgtttacaatgattccagctcacacactcactt

SEQ ID NO: 1027 - DNA, 398 bp, Diabrotica virgifera
  Clone ID: LIB150-036-Q1-E1-F7
tcgatacaacaccctattctgagtcatattactgtgttttctagtaatagttatttaatacattttataaatcaaaatgagggaaatcgttcacatccaagctggacaatgcggtaaccaaattggagccaaattctgggaaatcatctctgatgaacacggaatcgaccccaccggagcctaccatggagactctgacctccaacttgaaagaatcaatgtctactacaatgaggcctccggcggaaaatacgtaccccgtgccatcctcgtcgacttggaacccggtaccatggattcagtaaggtcgggtcccttcggacaaatcttcagaccagacaacttcgtgtttggacagtctggagctggaaacaactgggccaagggacattacacag

SEQ ID NO: 1028 - DNA, 401 bp, Diabrotica virgifera
  Clone ID: LIB150-013-Q1-E1-D12
agctgaatcatgtgattgtttacaaggattccaactcacacactcacttggaggtggtactggatcaggtatgggtaccctccttatctcaaaaatccgtgaagaatacccagacagaattatgaacacatactcagtagtcgcctcacccaaagtatcagataccgtagtagaaccatacaatgccacactttcagtacatcaattggtagaaaacacagatgaaacatactgtattgataatgaagctctctatgacatttgcttcagaactttgaaactcacaacacccacatatggagacttaaaccatttggtatccctcacaatgtccggtgtaaccacctgtcttaggttcccaggtcagttgaatgctgatcttagaaaattggctgtcaaca

SEQ ID NO: 1029 - DNA, 411 bp, Diabrotica virgifera
  Clone ID: LIB150-041-Q1-E1-B1
taccatggacgcagtacgttctggaatgtacggcaaactattcagacctgataacttcgtgttcggccaatccggagctggaaacaattgggccaaaggtcactacacagaaggggctgagctagtaaatgctgttctagatgtcgtacgaaaagaagcagaaaactgtgactgtctccagggatttcaactaacacactcgctaggtggtggtaccgggtctgggatgggtacgttgttgatttcaaagatcagagaggagtatcctgataggatcatgaacacttattcagttatgcctagtccaaaagtatctgacactgttgtggaaccatataatgctaccctatccgttcatcaacttgtagaaaataccgatgaaacctactgtatagataatgaagctcttta

SEQ ID NO: 1030 - DNA, 382 bp, Diabrotica virgifera
  Clone ID: LIB150-039-Q1-E1-C11
aacacgcgtccgagatgttctagatctgggtgacagtgatttcgcatcaagaattgccgaacatgagaccgctcttgttatgttttatgccccttggtgtggacactgcaaaagattgaaaccagagtatgctaaagctgctgaagatttactaagaaatgatcctcctattgctttggtgaaagtagactgtacagaggctggtaaagaaacttgtgataaaaacagtgtaagtggttaccccacattgaaaatcttcagaaatggtgaggtatctcaagactacaatggtcctagagatgcatcaggtattgtaaaatacatgcaatccaaggttggtcccagctcatgagaactgaaaacatctgaatgcttgaaaaac

SEQ ID NO: 1031 - DNA, 437 bp, Diabrotica virgifera
  Clone ID: LIB150-047-Q1-E1-G12
cgggtcgacgcaagcctctacatagagtcatagtaaaatttgcccacacttcattcaaggaacttttagatgcccagaaagtgaaagatggtttggtcttgttccgtccagttcatctgcaaaacaaattcgaagatagcaaagttcaatacagtggatctgctgatgcaggaagcatccaaacatttatcaccaaaaacttacatggcctagtaggacaccgcaaacctgataacaaacaagaattcgaaaaccccttgttcgttgcttacttctctgttgattacgccaaaaatcccaaaggtaccaactactggcgtaacagaatattgaaggttgccaaagaattccaagaaagggctaactttgctatcagctcaaacgatgaattccaacatgaattaaatgaatttggattggactatgtgaaaggagac

SEQ ID NO: 1032 - DNA, 409 bp, Diabrotica virgifera
  Clone ID: LIB150-001-Q1-E1-C11
cacaaccacatcccaactcggtttcgttttggagtataactttttcgggtttaggctatcacaaaactcctgtaatgatgattttatttaaagtactcactatttccatgtttttccttcttggatcagccaaagaagaagatgttctagatctgggtgacagtgatttcgcatcaagaattgccgaacatgagaccgctcttgttatgttttatgccccttggtgtggacactgcaaaagattgaaaccagagtatgctaaagctgctgaagatttactaagaaatgatcctcctattgctttggtgaaagtagactgtacagaggctggtaaagaaacttgtgataaaaacagtgtaagtggttaccccacattgaaaatcttcagaaatggtgaggtatctcaaga

SEQ ID NO: 1033 - DNA, 423 bp, Diabrotica virgifera
  unsure (1)..(423): unsure at all n locations
  Clone ID: LIB150-032-Q1-E1-G11
atgtaacacaaccacatcccaactcggtttcgttttggagtataactttttcgggtttaggctatcacaaaactcctgtaatgatgattttatttaaagtactcactatttccatgtttttccttcttggatcagccaaagaagaagatgttctagatctgggtgacagtgatttcgcatcaagaattgccgaacatgagaccgctcttgttatgttttatgccccttggtgtggacactgcaaaagattgaaaccagagtatgctaaagctgctgaagatttactaagaaatgatcctcctattgctttggtgaaagtagactgtacagaggctggtaaagaaacttgtgataaaaacagtgtaagtggttacccacattgaaaatcctcagaanatggtgaggtatctcaagactacaatg

SEQ ID NO: 1034 - DNA, 389 bp, Diabrotica virgifera
  Clone ID: LIB150-048-Q1-E1-D8
agtgtaacacaaccacatcccaactcggtttcgttttggagtataactttttcgggtttaggctatcacaaaactcctgtaatgatgattttatttaaagtactcactatttccatgtttttccttcttggatcagccaaagaagaagatgttctagatctgggtgacagtgatttcgcatcaagaattgccgaacatgagaccgctcttgttatgttttatgccccttggtgtggacactgcaaaagattgaaaccagagtatgctaaagctgctgaagatttactaagaaatgatcctcctattgctttggtgaaagtagactgtacagaggctggtaaagaaacttgtgataaaaacagtgtaagtggttaccccacattgaaaat

SEQ ID NO: 1035 - DNA, 378 bp, Diabrotica virgifera
  unsure (1)..(378): unsure at all n locations
  Clone ID: LIB3026-020-Q1-E1-G5
cacgcgtccggcccaagaattccaagaaaggaacaactttgctatcagctcaaacgatgaattccaacatgaattaaatgaatttggattggactatgtgaaaggagacaaaccagttgttggtgctagagatgctaaaaaccaaaaattcgtcctcaaagaattctccctcgaagccttcgaagtgttcgtaagcgatgttctagatggtgctctcgagccataccttaaatctgagccaattccagaagacgcagacgcaccattgaaaactttaagttgccaagaacttcgatcaagtgattgataactcanaagatgctttgattgaattctatgctccttggtgtggacacctgtaaaaaaacttgcacccaa

SEQ ID NO: 1036 - DNA, 363 bp, Diabrotica virgifera
  Clone ID: LIB150-033-Q1-E1-B1
tcgacgtacgcatacgagtccggtcttgttccgtccagttcatctgcaaaacaaattcgaagatagcagagttcaatacagtggatctgctgatgcaggaagcatccaaacatttatcaccaaaaacttacatggcctagtacgacaccgcatacctgataacaaacaagaattcgaaaacgccttgttcgttgcttacttctctgttgattacgccaaaaatcccaaaggtaccaactactggcgtaacagaatattgaaggttgccaaagaattccaagaaagggctaactttgctatcagctcaaacgatgaattccacatgaattaaatgaatttggattggactatgtgaaaggagac

SEQ ID NO: 1037 - DNA, 270 bp, Diabrotica virgifera
  Clone ID: LIB3026-033-Q1-E1-E2
acgcgtccggaaagcatccaaacatttatcaccaaagacttacatggcctagtaggacaccgcaaacctgataacagacaagaattcgaaaaccccttgttcgttgcttacttctctgttgattacgccaaaaatcccaaaggtaccaactactggcgtaacacaatattgaaggttgccaaagaattccaagaaagggctaactttgctatcagctcaaacgatgaattccaacgtgaattaaatgaatttggattggactatgtgaaa

SEQ ID NO: 1038 - DNA, 408 bp, Diabrotica virgifera
  Clone ID: LIB149-030-Q1-E1-C1
gcgtcaggtaaaacatccacatcccaactcggtttcgttttggagtataacttttgcgggtttaggctatcacaaaactcctgtaatgatgattttacttaaagtactcactatttccatgtatttccttcttggatcagccatagaagaagatgttctagatctgggtgacagtgatttcgcatcaagaattgccgaacatgagaccgctcttgtgatgttgtatgacccttggtgtggacagtgcataagattgaaaccacagtatgctaaagctgctgaagatatactaagaaatgatcctcctattgcattggtgaaagtacactgtatagaggctggtaaagaaacatgtgagataaacagtgtaagtggttaccccagagggaaaatctgcaaaaatggtga

SEQ ID NO: 1039 - DNA, 531 bp, Diabrotica virgifera
  unsure (1)..(531): unsure at all n locations
  Clone ID: pGUT3319
ttttataatgatcaaacccgacggtgtccaaaggggccttgttggaaaaattatcaaaaggttcgaacagaaaggattccgtctagtagcaatgaaattcatgtggccttctgaagaacttttgaagaaacactacgctgacttagctggcaaacctttcttcgcaggtctagtaaagtacatgagctctggcccagtagtgccaatggtatgggaaggtttaggcgtagtaaaaaccggtcgtgttctcctaggtgctaccaatcctgctgacagtgcccctggcaccatcagaggagacctctgcatccaagtaggacgtaacatctgccacggttcagacgctgttgaatcagcaaacaaggaaatcgacttgtggtttactgaaaaggaattagtaccctggacaccagctgccaaaacttgggtctacgaagactagataaaatactcttactatcttttgtatntaatangtnaccaataacacaaataaaataaagtcgctaaataaaaacatttgatacagtc

SEQ ID NO: 1040 - DNA, 434 bp, Diabrotica virgifera
  Clone ID: LIB149-009-Q1-E1-B7
gacgggttgtttgtatgatttgtactctattagcgatattctattattttcttagagcaatggccgccaaccaagaaagaacttttataatgatcaaacccgacggtgtccaaaggggccttgttggaaaaattatcaaaaggttcgaacagaaaggattccgtctagtagcaatgaaattcatgtggccttctgaagaacttttgaagaaacactacgctgacttagctggcaaacctttcttcgcaggtctagtaaagtacatgagctctgggccagtggtgccaatggtatgggaaggtttaggcgtagtaaaaaccggtcgtgttctcctaggtgctaccaatcccgctgacagtgcccctggcaccatcagaggagacctctgcatccaagtacgacgtaacatctgccacggttcagacgctgttgaa

SEQ ID NO: 1041 - DNA, 406 bp, Diabrotica virgifera
  Clone ID: LIB150-026-Q1-E1-H1
acaacaccctaaacagagtcgtatgtatgatttgtactctactagcgatattctattacttttttagagcaatggccgccaaccaagaaagaacttttataatgatcaaacccgacggtgtccaaaggggccttgttggaaaaattatcaaaaggttcgaacagaaaggattccgtctagtagcaatgaaattcatgtggccttctgaagaacttttgaagaaacactacgctgacttagctggcaaacctttcttcgcaggtctagtaaagtacatgagctctggcccagtagtgccaatggtatgggaaggtttaggcgtagtaaaaaccggtcgtgttctcctaagtgctaccaatcctgctgacagtgcccctggcaccatcagaggagacctctgcatcca

SEQ ID NO: 1042 - DNA, 424 bp, Diabrotica virgifera
  unsure (1)..(424): unsure at all n locations
  Clone ID: LIB3026-009-Q1-E1-H11
accacgcatccgggttgtttgtatgatttgtactctattaccgatattctattatttccttaaagcaatggccgccaaccacgaaagaacttttatcatgatcaaacccgacggtgtccaaaagggccttgttggaaaaattatcagaaggttcgaacagaaaggattccgtctagtagcaatgaaattcatgtggccttctgaagaacttttgaagaaacactacgctgacttagctggcaaacctttcttcgcaggtctagtaaagtacatgagctctggcccagtagtgccaatggtatgggaaggtttaggcgtattaaaaaccggtcgtgttctcctatgtgctaccaatcctgctgacagtgcccctgacaccatcacaggagacctctgcatccaagtangacgtaccatctgccac

SEQ ID NO: 1043 - DNA, 319 bp, Diabrotica virgifera
  Clone ID: LIB150-008-Q1-E1-D9
accacgcgtccgcccacgcgtccgcccacgcgtccgatgatttgtactctattagcgatattctattatttttttagagcaatggccgccaaccaagaaagaacttttataatgatcaaacccgacggtgtccaaaggggccttgttggaaaaattatcaaaaggttcgaacagaaaggattccgtctagtagcaatgaaattcatgtggccttctgaagaacttttgaagaaacactacgctgacttagctggcaaacctttcttcgcaggtctagtaaagtacatgagctctggcccagtagtgccaatggtatggg

SEQ ID NO: 1044 - DNA, 329 bp, Diabrotica virgifera
  unsure (1)..(329): unsure at all n locations
  Clone ID: LIB150-005-Q1-E1-D3
cacgcgtccgcacacgcgtccgcacacgcgtccgcccacgcgtccgatgatttgtactccattancgatattctactatttttttagagcaatggccgccaaccaagaaagaacttttataatgatcaaacccgacggtgtccaaaggggccttgttggaaaaattatcaaaaggttcgaacagaaaggattccgtctagtagcaatgaaattcatgtggccttctgaagaacttttgaagaaacactacgctgacttagctgggaaacctttcttcgcaagtctagtaaagtacatgagctctggcccactagtgccaatggtatggg

SEQ ID NO: 1045 - DNA, 232 bp, Diabrotica virgifera
  unsure (1)..(232): unsure at all n locations
  Clone ID: pGUT1653
gtatgatttgtactctattagcgatattctattattttcttagagcaatggccgccaaccaagaaagaacttttataatgatcaaacccgacggtgtccaaaggggccttgttggaaaaattatcaaaaggttcgaacagaaaggattccgtctagtancaatgaaattcatgtggccttctgaagaacttttgaagatacactacgctgacttagctggcaaacctttctt

SEQ ID NO: 1046 - DNA, 271 bp, Diabrotica virgifera
  Clone ID: LIB149-015-Q1-E1-B5
tgatttgtagcctattaccgatagtctattaatttcttagatcaatggtcgccatacattatagaacttttataatgaattatacccgacagtgtccaaaggggccatgtaggaaagattatcaaagggttcgaacagaaatgattccgtcaatatacactgaaattcaagtatccttctgaagaacttttggtttagcactattctgagttatctggcatacctctcttcgcaagtctagtagtttacataggctcagggccagtggagc

SEQ ID NO: 1047 - DNA, 317 bp, Diabrotica virgifera
  Clone ID: LIB149-010-Q1-E1-B4
acccacgcgtccgcggttcagacgctgttgaatcagcaaacaaggaaatcgacttgtggtttactgaaaaggaattagtaccctggacaccagctgccaaaacttgggtctacgaagactagataaaatactcttactatcttttgtatttaataagtaaccaataacaaaaataaaataaagtcgctaaataaaaacatttgatacagtcaaaagaaaaaaaaaaaaaaaaaaaaaaaaaaaaaagaaaaaaaaaaaagaaaaaaaaaaaaaaaaagaaaaaaaaaaaaaaaaagaaaaaaaaaaaaaggggcggc

SEQ ID NO: 1048 - DNA, 444 bp, Diabrotica virgifera
  Clone ID: LIB150-014-Q1-E1-F11
cccacgcgtccgccacgcgtccggtaatttgtgaaatcgtgaaaaaccatttaaagaagtagatagtaaagtttcagaaaatgagtgagtctccaaaagaccgtagaggtcgcgatcgagatcgtccccggaataaccgagataaccggaataacaaaggcgataacagcagagagaggagcaatgatagaggtccccgtgaacctagaagcatgaggccctcccaaaacagagtgtacgtatccaacatcccatatgaataccgctggcaggatatcaaagatctgttccgtagcaaaatcggtgatgtaactttcgtggagctttttgttgatgataacgataagccgaggggtagtggcattgtcgaatttaatgattctgatcttgttggtaaatgtctcgagcttatgcagcgttatgaggttaagggccgtaaattgg

SEQ ID NO: 1049 - DNA, 428 bp, Diabrotica virgifera
  Clone ID: LIB150-037-Q1-E1-G8
cccacgcgtccggcggaaaataggtgtagtaatttgtgaaatcgtgaaaaaccatttaaagaagtagatagtaaagtttcagaaaatgagtgagtctccaaaagaccgtagaggtcgcgatcgagatcgtccccggaataaccgagataaccggaataacaaaggcgataacagcagagagaggagcaatgatagaggtccccgtgaacctagaagcatgaggccctcccaaaacagagtgtacgtatccaacatcccatatgaataccgctggcaggatatcaaagatctgttccgtagcaaaatcggtgatgtaactttcgtggagctttttgttgatgataacgataagccgaggggtagtggcattgtcgaatttaatgattctgatcttgttggtaaatgtctcgagcttatgcagcgttatg

SEQ ID NO: 1050 - DNA, 430 bp, Diabrotica virgifera
  Clone ID: LIB149-045-Q1-E1-F4
tcgtcggtcgatacacgccactgaacacacttctggaagacgcgaatagacgccggtgactcgtttgttcccaattttcaatttatccaaagattttagaatgactgatacggaatctaacaacgaccgcggaaggcgcgataataaaagaccacgggaagatagcttcagggaccgcagccgagaccggggtaacgccagtacaacacaaaggagcactaaaccctcccaaactagagtgtttgtatcaaacattccctacgaatatcgttggcaagatgtgaaagacatcttcaggaatgaggtgggtgatgtttccttcgtggagctattttacgatgaatcaaacaaatccaaaggaaccggtatcgttgaattcgctgataaaggttctgttgacaaatgtatggagaagatgcagcgatatgaa

SEQ ID NO: 1051 - DNA, 412 bp, Diabrotica virgifera
  Clone ID: LIB150-038-Q1-E1-B7
accacgcgtccgcggacgcgtgggcgcgaatagacgccggtgactcgtttgttcccaattttcaatttatccaaagattttagaatgactgatacggaatctaacgaccgcggaaggcgcgataataaaagaccacgggaagatagcttcagggaccgcagccgagaccggggtaacgccagtacaacacaaaggagcactaaaccctcccaaactagagtgtttgtatcaaacattccctacgaatatcgttggcaagatgtgaaagacatcttcaggaatgaggtgggtgatgtttccttcgtggagctattttacgatgaatcaaacaaatccaaaggaaccggtatcgttgaattcgctgataaaggttctgttgacaaatgtatggagaagatgcagcgatatgaag

SEQ ID NO: 1052 - DNA, 401 bp, Diabrotica virgifera
  Clone ID: LIB150-041-Q1-E1-A1
gtattaagccttgggcgcaattaaaccccggtgacccgttggtccccaatttccaatttacccaaagattttagaatgactgatacggaatctaacgaccgcggaaggcgcaataataaaagaccacgggaagatagcttcagggaccgcagccgagaccggggtaacgccagtacaacacagaggagcactaaaccctcccaaactagagtgtttgtatcaaacattccctacgaatatcgttggcaagatgtgaaagacatcttcaggaatgaggtgggtgatgtttccttcgtggagctattttacgatgaatcaaacaaatccaaaggaaccggtatcgttgaattcgctgataaaggttctgttgacaaatgtatggagaagatgcagcgatatga

SEQ ID NO: 1053 - DNA, 447 bp, Diabrotica virgifera
  Clone ID: LIB150-038-Q1-E1-B3
aattggaataaatcacgaatctttcaggttaatgtgggaaaacgaacgaagaaggagaggagaagaaaagagaaatgaccaactttactttccaatttaaaccttttgtttttttaatttgttacagtccggggacctacgttcggacttgtctcaagcaatgatgaggactatttgggaggatagcttcagggaccgcagccgaaaccggggtaacgccagtacaacacaaaggagcactaaaccctcccaaactagagtgtttgtatcaaacattccctacgaatatcgttggcaagatgtgaaagacatcttcaggaatgaggtgggtgatgtttccttcgtggagctattttacgatgaatcaaacaaatccaaaggaaccggtatcgttgaattcgctgataaaggttctgttgacaaatgtatggagaagatgcagcgata

SEQ ID NO: 1054 - DNA, 382 bp, Diabrotica virgifera
  Clone ID: LIB150-045-Q1-E1-G9
agtagtaatttgtgaaatcgtgaaaaaccatttaaagaagtagatagtaaagtttcagaaaatgagtgagtctccaaaagaccgtagaggtcgcgatcgagatcgtccccggaataaccgagataaccggaataacaaaggcgataacagcagagagaggagcaatgatagaggtccccgtgaacctagaagcatgaggccctcccaaaacagagtgtacgtatccaacatcccatatgaataccgctggcaggatatcaaagatctgttccgtagcaaaatcggtgatgtaactttcgtggagctttttgttgatgataacgataagccgaggggtagtggcattgtcgaatttaatgattctgatcttgttgggaaatgt

SEQ ID NO: 1055 - DNA, 388 bp, Diabrotica virgifera
  Clone ID: LIB150-036-Q1-E1-C8
gggtcgacacacgcctctagactacgtcattatacgccggtgactcgtttgttcccaattttcaatttatccaaagattttagaatgactgatacggaatctaacaacgaccgcggaaggcgcgataataaaagaccacgggaagatagcttcagggaccgcagccgagaccggggtaacgccagtacaacacaaaggagcactaaaccctcccaaactagagtgtttgtatcaaacattccctacgaatatcgttggcaagatgtgaaagacatcttcaggaatgaggtgggtgatgtttccttcgtggagctattttacgatgaatcaaacaaatccaaaggaaccggtatcgttgaattcgctgataaaggttctgttgacaaat

SEQ ID NO: 1056 - DNA, 444 bp, Diabrotica virgifera
  Clone ID: LIB149-045-Q1-E1-A11
cccgggccgacccacaagtccacccacgcgtccgcaaaatcggtgatgtaactttcgtggagctttttgttgatgataacgataagccgaggggtagtggcattgtcgaatttaatgattctgatcttgttggtaaatgtctcgagcttatgcagcgttatgaggttaagggccgtaaattggtggtaaaagatgatcaaggcattacaagagataaatttggggctattgttagtaaccagggaggtggtaaaagaagagagtacaatcgtttcaatgataacatgaacagcatgaatattgatttgggcaatactttgaatcttggtaatgataagtggggcaacacttatggattgagtccacagtttcttgaatctttgaaaatcgatccccctcttaataataaggtgtttgtggccaatttggattacaacattgata

SEQ ID NO: 1057 - DNA, 429 bp, Diabrotica virgifera
  Clone ID: LIB150-003-Q1-E2-B6
agagacaatcagagttagaagattccgtcactttcataaaaccagccaacgtagagttaccctccgaagttgattggagaccaaagggtgccgttactgctgttaaggaccaagggcattgcggatcttgctggagtttcagtgctactggatctctcgaaggacaacactacaggaaaacaggaaaattggtttcccttttctgaacaaaacttggtcgactgctctactaaattcggcaacaacggatgcaatgggggtttaatggataacgcctttcgttatattaaagcccaacggtggtatcgacactgaagcaagctacaaatataaggccgaagacgagaagtgccacttcaatcccaagaaggtgggagccactgacaaaggtttcgtagatatcgaatctggaagcgaagatgcccttaa

SEQ ID NO: 1058 - DNA, 346 bp, Diabrotica virgifera
  Clone ID: LIB150-049-Q1-E1-A4
agcccacgcgtccgtgttgagacaatcagagttagaacattccgtcactttcataaaaccagccaacgtagagttaccctccgaagttgattggagaccaaagggtgccgttactgctgttaaggaccaatggcattgcggatcttgctggagtttcagtgctactggatctctcgaaggacaacactacaggaaaacaggaaaattggtttccctttctgaacaaaacttggtctactgctctactaaattcggcaacaacggatgcaatgggggtttaatggataacgcctttcgttatattaaagccaacggtggtatcgacactggaacaagctacaaatat

SEQ ID NO: 1059 - DNA, 440 bp, Diabrotica virgifera
  Clone ID: LIB150-030-Q1-E1-H12
tctatacagattcataataatttgttgtcaagaccttcaagttaatagttttgttaaataggatacatcatgaagtttttgctgctttttgttgcattttttgtgggttgccaagccatttcctttgttgatttggttcaagaagaatggactgctttcaagatgacacacagaaaaagttacgaaagcccaaccgaggaaaagttccgtatgaagatctttatggaaaataaacataaagttgccaaacacaacaagctctttgctttgggattggtttcttataaattaagactcaacaaatacgctgatatgctccaccacgaattcatcgatactctcaacggcttcaacaaaacgaagaacctgttgagacaatcagagttagaagattccgtcactttcataaaaccagccaacgtagagttaccctccgaagt

SEQ ID NO: 1060 - DNA, 340 bp, Diabrotica virgifera
  Clone ID: LIB150-003-Q1-E1-F12
agagacaatcagagttagaagattccgtcactttcataaaaccagccaacgtagagttaccctccgaagttgattggagaccaaagggtgccgttactgctgttaaggaccaagggcattgcggatcttgctggagtttcagtgctactggatctctcgaaggacaacactacaggaaaacaggaaaattggtttcccttttctgaacaaaacttggtcgactgctctactaaattcggcaacaacggatgcaatgggggtttaatggataacgcctttccttatattaaagccaacggtggtatcgacactgaagcaagctacaaatataaaggccaag

SEQ ID NO: 1061 - DNA, 359 bp, Diabrotica virgifera
  Clone ID: LIB150-025-Q1-E1-B2
atttttgttaaataggatacatcatgaagtttttgctgctttttgttgcattttttgtgggttgccaggccatttcctttgttgatttggttcaagaagaatggactgctttcacgaggacacacaggattagttactaaagcccaaacgaggaaaagttccgtatgaagatctttatggaaaataaacatttagttgccaaacacaacaagctctttgctttgggagtggtttcctataaatcatgactcaacatatccgctgatatgctccaccacgaattcatcgatactctcaactgcttcaacattacgaataacctgttgagacaatcagagttagatatatccatcaccttc

SEQ ID NO: 1062 - DNA, 292 bp, Diabrotica virgifera
  Clone ID: LIB150-003-Q1-E2-F12
ggtctagaataccgggtcggccacgcgtccagagaaaatcagagttagaagattccgtcactttcataaaaccagccaacgtagagttaccctccgaagttgattggcgaccaaagggtgccgttactgctgttaaggaccaagggcattgcggatcttgctggagtttcagtgctactggatctctcgaaggacaacactacaggaaaaacagaaaaattggtttccctttcctaaacaaaacttggtcgactgctccactaaattcggcaacaacggatgcattgggggt

SEQ ID NO: 1063 - DNA, 397 bp, Diabrotica virgifera
  Clone ID: LIB149-023-Q1-E1-E11
gacaaagaagaaggggtgaagtttaggattagccataccaaaggttatagaaattacattgaagaacaaaagcgatttacaatttttccaggataacctaaggaaaatcgcaaatcacaatgaccaatttgataagggactgtctacttttaagttgggtgtaaccaaatttgcagatttgactgaaaaagaatttttcgatatgttaggactttccaaaagtaacaaatcgactagaactcgtgttattcactcacttgctccagtaaaagatcttccatccaagtttgattggagagaaaaaggagcagtaactgaggtcaaggatcaaggatcttgtggatcttgttggagttttagtacgactggaacagtagaaggagcttattttcttaaa

SEQ ID NO: 1064 - DNA, 216 bp, Diabrotica virgifera
  unsure (1)..(216): unsure at all n locations
  Clone ID: LIB150-005-Q1-E1-F10
ttgttaaataggatacatcatgaagtttttgctgctttttgttgcattttttgtgggttgccaagccatttcctttgttgatttggttcaagaagaatggactgctttcaagatgacacacagaaaaagttacgaaagcccaaccgaggaaaagttccgtatgaagatcnttatggaaaataaacataaagttgccaaacacaacaagctctttgc

SEQ ID NO: 1065 - DNA, 180 bp, Diabrotica virgifera
  Clone ID: LIB150-019-Q1-E1-E5
gctattttgttgcattttttgtgggttgccaggccatttcctttgttgatttggttcaagaagaatggactgctttcaagatgacacacagaaaaagttacgaaagcccaaccgaggaaaagttccgtatgaagatctttatggaaaataaacataaagttgccaaacacaacaagctct

SEQ ID NO: 1066 - DNA, 415 bp, Diabrotica virgifera
  Clone ID: LIB150-027-Q1-E1-D7
aaacacgcgtccgcccacgcgtccgcgacgagaaagccatcatcgacgtcctggcccgtagaggcatcgtccaacgtctcgagatcgccgaaaccttcaagacctcctacggcaaagacctcgtctcagagttgaagagcgaattggggggtaagttcgaggatgtgatggtagccctcatgactccactgccacaattgtatgccaaagaactgcacgatgccgtagccggaatgggtaccgatgaggaagctatcatcgagatcttgtgcacattgtccaactacggaatccgtaccatcgcacaattttatgaacaaatgtacggcaaacctttagaaaaagagttgaaaggagatacttcaggacatttcaaaaggctctgtgtttctttagtgcaagccaacacagacga

SEQ ID NO: 1067 - DNA, 415 bp, Diabrotica virgifera
  Clone ID: LIB150-003-Q1-E2-E5
gaacaatgtacggcaaacctttagaaaaagatttgaaaggagatacttcaggacatttcaaaaggctctgtgtttctttagtgcaagccaacagagacgaaaaccaaggcgtcaatgaacaacaagccctcgccgacgccgaagctttgatcgaagccggcgaaggaaaatggggcaccgaagaatccatcttcaataccgtcctcatcaccaggagttaccaacaattaagagccacattctctgaatacgagaggctaacgggcaaagacatcgaacaatccatcaagaaagaattcagcggagatatcgaaaagggattgttaggaatcgtcaagtgcgtgaagagcaaagttggatacttcgcggaacgtcttcactggtccatgtccggtttgggcaccaacgacaagac

SEQ ID NO: 1068 - DNA, 403 bp, Diabrotica virgifera
  Clone ID: LIB150-002-Q1-E1-C11
gaacaatgtacggcaaacctttagaaaaagatttgaaaggagatacttcaggacatttcaaaaggctctgtgtttctttagtgcaagccaacagagacgaaaaccaaggcgtcaatgaacaacaagccctcgccgacgccgaagctttgatcgaagccggcgaaggaaaatggggcaccgaagaatccatcttcaataccgtcctcatcaccaggagttaccaacaattaagagccacattctctgaatacgagaggctaacgggcaaagacatcgaacaatccatcaagaaagaattcagcggagatatcgaaaagggattgttaggaatcgtcaagtgcgtgaagagcaaagttggatacttcgcggaacgtcttcactggtccatgtccggtttgggcac

SEQ ID NO: 1069 - DNA, 373 bp, Diabrotica virgifera
  Clone ID: LIB149-020-Q1-E1-C6
aagaacaacaagccctcgccgacgccgaagctttgatcgaagccggcgaaggaaaatggggcaccgaagaatccatcttcaataccgtcctcatcaccaggagttaccaacaattaagagccacattctctgaatacgagaggctaacgggcaaagacatcgaacaatccatcaagaaagaattcagcggagatatcgaaaagggattgttaggaatcgtcaagtgcgtgaagagcaaagttggatacttcgcggaacgtcttcactggtccatgtccggtttgggcaccaacgacaagactttaatccgtatcatcgtctcgagatctgaaatcgatttggccgatatcaaacaagctttcttggacaaata

SEQ ID NO: 1070 - DNA, 447 bp, Diabrotica virgifera
  unsure (1)..(447): unsure at all n locations
  Clone ID: LIB150-041-Q1-E1-G5
aaagagaatcagtgggtgtgactaaaattcaattcctctcaaatcacaagtaactgaagcaaacatgtctaaccagcagtattatcctttcaaatgtacacccactgtctaccccgccgatcccttcgaccccgtggcagatgccgccaccttgaagaaggccatgaaaggtttcggcaccgacgagaaagccatcatcgacgtcctggcccgtagaggcatcgtccaacgtctcgagatcgccgaaaccttcaagacctcctacggcaaagacctcgtctcagagttgaagagcgaattggggggtaagttcgaggatgtgatggtagccctcatgactccactgccacaattgtatgccanagaactgcacgatgccgtagccggaatgggtaccgatgaggaagctatcatcgagatcttgtgcacattgtccaactacggaat

SEQ ID NO: 1071 - DNA, 415 bp, Diabrotica virgifera
  Clone ID: LIB150-038-Q1-E1-F6
gagaaccagtgggtgtgactaaaattcaattcctctcaaatcacaagtaactgaagcaaacatgtctaaccagcagtattatcctttcaaatgtacacccactgtctaccccgccgatcccttcgaccccgtggcagatgccgccaccttgaagaaggccatgaaaggtttcggcaccgacgagaaagccatcatcgacgtcctggcccgtagaggcatcgtccaacgtctcgagatcgccgaaaccttcaagacctcctacggcaaagacctcgtctcagagttgaagagcgaattggggggtaagttcgaggatgtgatggtagccctcatgactccactgccacaattgtatgccaaagaactgcacgatgccgtagccggaatgggtaccgatgaggaagctatcatcgag

SEQ ID NO: 1072 - DNA, 407 bp, Diabrotica virgifera
  Clone ID: LIB150-024-Q1-E1-C6
aagagccactgggtgacaaaaattcaattcctctcaaatcacaagtaactgaagcaaacatgtctaaccagcagtattatcctttcaaatgtacacccactgtctaccccgccgatcccttcgaccccgtggcagatgccgccaccttgaagaaggccatgaaaggtttcggcacggacgagaaagccatcatcgacgtcctggcccgtagaggcatcgtccaacgtctcgagatcgccgaaaccttcaagacctcctacggcaaagacctcgtctcagagttgaagagcgaattggggggcaagttcgaggatgttatggtagccctcatgactccactgccacaattgtatgccaaagaactgcacgacgccgtcgccggaatgggtaccgatgaagaagctatc

SEQ ID NO: 1073 - DNA, 299 bp, Diabrotica virgifera
  Clone ID: LIB150-003-Q1-E1-E5
aaagatttgaaaggagatacttcaggacatttcaaaaggctctgtgtttctttagtgcaagccaacagagacgaaaaccaatgcgtcaatgaacaacaagccctcgccgacgccgaagctttgatcgaagccggcgaaagaaaatggggcaccgaagaatccatcttcaataccgtcctcatcaccaggagttaccaacaattaagagccacattctctgaatacgagaggctaacgggcaaagacatctaacaatccatcaagaaagaattcagcggagatatcgaaaatggattgtt

SEQ ID NO: 1074 - DNA, 298 bp, Diabrotica virgifera
  Clone ID: pGUT3859
agctcgtgccctatttctgcacgaggtatataagagaaccagtgggtgtgactaaaattcaattcctctcaaatcacaagtaactgaagcaaacatgtctaaccagcagtattatcctttcaaatgtacacccactgtctaccccgccgatcccttcgaccccgtggcagatgccgccaccttgaagaaggccatgaaaggtttcggcaccgacgagaaagccatcatcgacgttctggcccgtagaggcatcgtccaacgtctcgagatcgccgaaaccttcaagaccttctacggc

SEQ ID NO: 1075 - DNA, 350 bp, Diabrotica virgifera
  Clone ID: LIB3026-033-Q1-E1-H6
gcggggccacccacgcgtccgccatgagaagacttctttcttccaggctttgagtatccccaccaagatttccaagggtactattgaaatcatcagtgatgtccacattcttaaacccggagacaaagtaggagcttccgaagccacattactcaacatgttaaacatttctcccttctcagatggtcttcaagttgagcaagtctatgactcgggcactgtatttgctccagctattttggacatcagaccagaagatttgagggagaaattcttggctggagtagccaatttggctgctgtttgtttgtccattggatacccaacagttgcttctgctccacacagca

SEQ ID NO: 1076 - DNA, 333 bp, Diabrotica virgifera
  Clone ID: pGUT698
ccaagatttccaagggtactattgaaatcatcaatgatgtccacattcttaaacccggagacaaagtaggagcttccgaagccacattactcaacatgttaaacatttctcccttctcatatggtcttcaagttgagcaagtctatgactcaggcactgtatttgctccagctattttggacatcataccagaacatttgagggagaaattcttggctggagtatccaatttggctgctgtatgtttgtccattggataaccaacagttgcttctgctccacacagcattgccaatggattcaagatcttgttggctattgctgctgttactg

SEQ ID NO: 1077 - DNA, 294 bp, Diabrotica virgifera
  Clone ID: pGUT4301
gctgacaatgtcggctcaaaacaaatgcagcaaattcgtatttcattgcgaggaaatgctgtcgttcttatgggaaaaaataccatgatgcgtaaagctatcaagggccatattgaacacaaccctgctctggaaaagatcttgccccacatcaagggtaatgttggttttgttttcacccgaggtgacttggttgaaatcagagacaaactattggaaaacaaagtcaaagcccctgctagagctggtgccattgctccattatctgtcatcattcctgcccaaaacactgga

SEQ ID NO: 1078 - DNA, 302 bp, Diabrotica virgifera
  Clone ID: pGUT687
ccaagatttccaagggtactattgaaatcatcaatgatgtccacattcttaaacccggagacaaagtatgagcttccgaagccacattactcaacatgttaaacatttctcgctgctcataaggtcttcaagttgagcaagtctatgactcaggcactgtatttgctccagctattttggacatcacaccataacatgtgagggagaaattcttggctggagtcaccaatttggctgctgtttgtttgtccataggatatccgacagttgcttctgctccacacagcattggcaatggattc

SEQ ID NO: 1079 - DNA, 430 bp, Diabrotica virgifera
  Clone ID: LIB149-047-Q1-E1-E6
ctcgccggtcgacacacgcatctacccacacgttctgataactcaggcactgtatttgctccagctattttggacatcaaaccagaagatttgagggagaaattcttggctggagtagccaatttggctgctgtttgtttgtccattggatacccaacagttgcttctgctccacacagcattgccaatggattcaagaacttgttggctattgctgctgttactgatgttgacttcaaggaagccaagaccatcaaagaatacatcaaggatcccagcaaatttgctgctgctgctgctcctgtagctgcagccgccgctgcaccagctgccgagtctaagaaagaagagaagaatgaggaatctgaaagtgaagatgacgatatgggcttgggtctctttgactagaaagttttatatttttgatacg

SEQ ID NO: 1080 - DNA, 412 bp, Diabrotica virgifera
  Clone ID: LIB3026-002-Q1-E1-D9
actatgactcgggcactgtatttgctccagctattttggacatcaaaccagaagatttgagggagaaattcttggctggagtagccaatttggctgctgtttgtttgtccattggatacccaacagttgcttctgctccacacagcattgccaatggattcaagaacttgttggctattgctgctgttactgatgttgagttcaaggaagccaagaccatcaaagaatacatcaaggatcccagcaaatttgctgctgctgctgctcctgtagctgcagccgccgctgcaccagctgccgagtctaagaaagaagagaagaaggaggaatctgaaagtgaagatgacgatatgggcttgggtctctttgactagaaagttttatatttttgatacgttatttgctgttttgt

SEQ ID NO: 1081 - DNA, 242 bp, Diabrotica virgifera
  Clone ID: pGUT4299
aatgctgtcgttcttatgggaaaaaataccatgatgcgtaaagctatcaagggccatattgaacacaaccctgctctggaaaagatcttgccccacatcaagggtaatgttggttttgttttcacccgaggtgacttggttgaaatcagagacaaactattggaaaacaaagtcaaagcccctgctagagctggtgccattgctccattatatgtcatcatttcctgcccaaaacacttgga

SEQ ID NO: 1082 - DNA, 175 bp, Diabrotica virgifera
  Clone ID: pGUT4121
ctgtttgtttggccattggatacccaacagttgcttctgcttcacacagcattgccaagggattcaagaacttgttggctattgctgctgttactgatgttgacttcaaggaagccaagaccatcaaagaatacatcaaggatcccagcaaatttgctgctgctgctgctcctgt

SEQ ID NO: 1083 - DNA, 394 bp, Diabrotica virgifera
  unsure (1)..(394): unsure at all n locations
  Clone ID: LIB150-013-Q1-E1-H8
gtccatttggatacccaacagttgcttctgctccacacagcattgccaatggattcaagaacttgttggctattgctgctgttactgatgttgacttcaaggaagccaagaccatcaaagaatacatcaaggatcccagcaaatttgctgctgctgctgctcctgtagctgcagccgccgctgcaccagctgccgagtctaagaaagaagagaagaaggaggaatctgaaagtgaagatgacgatatgggcttgggtctctttgactagaaagttttatatttttgatacgttatttgctgttttgtcgagtcagactgtcaaataaatgaaacaggtctaaaagaaaaaaanataagaaatgaaccaaatcatgtttaaaaacctcaacacac

SEQ ID NO: 1084 - DNA, 658 bp, Diabrotica virgifera
  Clone ID: pGUT1457
cgaagagagcggtctgtgttctctagggatagttatttaatgcatggtataaatcaaaatgagggaaatcgttcacatccaagctggacaatgcggtaaccaaattggagccaaattctgggaaatcatctatgatgaacatggaatcgaccccaccggagcctaccatggagactctgacctccaacttgaaagaatcaatgtctactacaatgaggcctccggcggaaaatatgtcccccgcgccatcctcgtcaacttggaacctggtaccatggattcagtaaggtcgggtcccttcggacaaatcttcagaccagacaacttcgtgtttggacagtctggagctggaaacaactgtgccaagggacattacacagaaggtgctgaattagttgattcaggattagatgttgtaaggaaagaagctgaatcatgtgatagtttacaaggattccaacttacacactaacttggaggtggtactggatcatgtatggggaccctccttatctcaaaaatccgtgaagaatacccagacagaattatgaacacatactcagtagtccccttacccaaagtatcagataccgtaatagaaccatacaatgccacactttcagtacatcaattggtagaaacacagatgaaacatact

SEQ ID NO: 1085 - DNA, 482 bp, Diabrotica virgifera
  Clone ID: LIB150-031-Q1-E1-B7
taatcaaagtcatagtactgtgttttctagtaatagttatttaatacattttataaatcaaaatgagggaaatcgttcacatccaagctggacaatgcggtaaccaaattggagccaaattctgggaaatcatctctgatgaacacggaatcgaccccaccggagcctaccatggagactctgacctccaacttgaaagaatcaatgtctactacaatgaggcctccggcggaaaatacgtaccccgtgccatcctcgtcgacttggaacccggtaccatggattcagtaaggtcgggtcccttcggacaaatcttcagaccagacaacttcgtgtttggacagtctggagctggaaacaactgggccaagggacattacacagaatgtgctgaattagttgattcagtattagatgttgtaaggaaagaagctgaatcatgtgattgtttacaacgattccaactcacacactcacttgga

SEQ ID NO: 1086 - DNA, 421 bp, Diabrotica virgifera
  Clone ID: LIB150-013-Q1-E1-F12
cgcatcgaagagagtgttctgtgttttctagtaatagttatttaatacattttataaatcaaaatgagggaaatcgttcacatccaagctggacaatgcggtaaccaaattggagccaaattctgggaaatcatctctgatgaacacggaatcgaccccaccggagcctaccatggagactctgacctccaacttgaaagaatcaatgtctactacaacgaggcctccggcggaaaatacgtaccccgcgccatcctcgtcgacttggaacccggtaccatggattcagtaaggtcgggtcccttcggacaaatcttcagaccagacaacttcgtgtttggacagtctggagctggaaacaactgggccaagggacattacacagaaggtgctgaattagttgattcagtaatagatgttg

SEQ ID NO: 1087 - DNA, 398 bp, Diabrotica virgifera
  Clone ID: LIB149-045-Q1-E1-D12
acaagactctataataattctcagtattttctagtaatagttatttaatacattttataaatcaaaatgagggaaatcgttcacatccaagctggacaatgcggtaaccaaattggagccaaattctgggaaatcatctctgatgaacacggaatcgaccccaccggagcctaccatggagactctgacctccaacttgaaagaatcaatgtctactacaacgaggcctccggcggaaaatacgtaccccgcgccatcctcgtcgacttggaacccggtaccatggattcagtaaggtcgggtcccttcggacaaatcttcagaccagacaacttcgtgtttggacagtctggagctggaaacaactgggccaagggacattacacagaaggtgctga

SEQ ID NO: 1088 - DNA, 400 bp, Diabrotica virgifera
  Clone ID: LIB149-014-Q1-E1-D7
gttatccagtaatagttacttaacacattttataaatcaaaatgagggaaatcgttcacatccaggctggtcaatgcggtagccagattggagccaaattctgggaaatcatctctgatgaacacggaatcgagcccaccggagcctaccatggagactctgacctccaacttgaaagaatcaatgtctactacaacgaggcctccggcagtatatacgtaccccgcgccatcctcgtcgacttggaacccggtaccatggattcagtaaggtcaggtcccttcggacaaatcttcagaccagacaacttcgtgtttggacagtctggagctggtaacaactgggccaatggacattacacaggatgtgctgaaatagttgattcagtaatagatgttgt

SEQ ID NO: 1089 - DNA, 328 bp, Diabrotica virgifera
  Clone ID: LIB150-034-Q1-E1-C10
ggtcgatacacgcctctaatctaagtcattgtactgtgttttctagtaatagttagttaatacattttataaatcaacatgagggaaatcgttcacatccaagctggacaatgcggtaaccaaattggagccaaattctgggaaatcatctctgatgaacacggaatcgaccccaccggagcctaccatggagactctgacctccaacttgaaagaatcaatgtctactacaacgaggcctccggcggaaaatacgtaacccgcgccatcctcatcgacatggaacccggtaccatggattcagtaaggtcggggtccttcggacaaa

SEQ ID NO: 1090 - DNA, 296 bp, Diabrotica virgifera
  Clone ID: LIB150-024-Q1-E1-A4
ggaaatcatctctgatgagcaccgtatcgaccccaccggatcctaccatggatactctgacctccaacttgaaagaatcaatgtctaccacaaataagcctcccgcggaaaatacgtaccccgtgccatcctcgtcgacttggtacccggtatcatggattcagtaaagtcgggtcccttcggacaaatcttcagaccagacaacttcatgtttggacagtctggagctggcaacacatgggccaatggaaattacacacaacgtgctgaattagttgattcaatattacatgttg

SEQ ID NO: 1091 - DNA, 367 bp, Diabrotica virgifera
  Clone ID: LIB150-035-Q1-E1-F12
taaacacgcgtctggaatagagtgttctgtgttttctagtaatagttatttaatacattttatagatcataatgcgggaaatcgttcacatccaagctggacaatgcggtaaccaaattggagccaaattctgggaaatcatctctgatgaacacggaatcgaccccaacggagcctaccatggagactctgacctccaccttgacagattcaatgtcgactacaacgacgcctccggcggaaaatacatactccgcgacatcctcgtcgacttggaacccggtaccatggattcagtaatgtcaggtcccttcagacaaatcttcagaacatgacaacttcgtgtttggacagtctggagctggaa

SEQ ID NO: 1092 - DNA, 232 bp, Diabrotica virgifera
  Clone ID: LIB150-008-Q1-E1-E12
cgtgccatcctcgtcgacttggaacccggtaccatggattcagtaaagtcgggtcccttcggacaaatcttcagaccagacaacttcatgtttgggcagtctggaactggaaacaactgggccaagggacattacacagaatgtgctgaattagttgattcagtattagatgttgtaaggaaagaagctgaatcatgtgattgtttacaaggattccaactcacacactcac

SEQ ID NO: 1093 - DNA, 359 bp, Diabrotica virgifera
  Clone ID: LIB149-041-Q1-E1-H6
acggacgcgtgggcggacgcgtgggcggacgcgtgggttgccagtatacaacatgttcgccttcatattcttgtgtttacttctacaaactttaacctttcctccaaccttgggtcgagacgctgatcaaaatgaatatccattgatcgtagcagtagaatcatgcaattttccagtatgttatccacaatgtgctggagtggttctttccaaaagttggatacttacactaggaagctgtgcctatgttgccactaacttcgatcattacaggataaatgcaggagtagtcaatgttaccagtgaaggcgcacaactccgagacatcgaaaaagcattacttcatccagaatttaact

SEQ ID NO: 1094 - DNA, 417 bp, Diabrotica virgifera
  Clone ID: LIB150-039-Q1-E1-G7
accacgcgtccgcccacgcgtccgcccacgcgtccgcccacgcgtccgggcactcatttgtttggaaaaacgtcggtaaagtagatttattgttcgagtgtgctaccaaaaattatttccacactttttgggtctttgtctatcgaatgttgagacagtaaatatagattaatttttttgaacttttgaaaatgattgtttgatgtgtttttaaaaagccaagtgtttgtttggaattttttggataaagtcagatttggatagtttattaaagtaattccaattagtaagtaattgtcatacaaaatgggtggcaagcagtcaaagaagtcagtagatattacaaataccccaacaaaatgagaaattgaagctgtaggtgaaggaagaaggaccagtagttaagattggtgatgc

SEQ ID NO: 1095 - DNA, 396 bp, Diabrotica virgifera
  Clone ID: LIB3026-026-Q1-E1-C1
cccacacgtccgcccacgcgtccgcccacgcgtccgcccacgcgtccgaaaccacctgggcaaaactaataaaaatctcttaattgacacgtttctttgacgaaatacctaaacgaagtcttgttttgccacacaaagcacatggatgaaaaattccttatgaccatttaacgttgcaaacgggattgtttggagtcagtatgagctccgcccaattttgtgacatcagacttagccccgtgttcatggtcggtgctcaggtttgagtcgatgcttaaggtcggccttgggcatcgactcaaacttgagtgccgactatgagtacgggccttaggctgtctattgccttgtgaacataccgttagggtatcatcttgataggattcaataattttc

SEQ ID NO: 1096 - DNA, 395 bp, Diabrotica virgifera
  Clone ID: LIB150-028-Q1-E1-C5
cccacgcgtccgcccacgcgtccgcccacgcgtccggacccaccccaaacttaaggtgttacttcttcaaatcggttatatgtttataattttctttaatcacatcatattgttcattcattggaactaacttgtatgtattgtcgtcaattgcagcgtagccatataataaatgggtgcaatagcgcaaagcttcgtttaaattataaacaatatgatgtgattaaagaaaattataaacatataaccgatttgaagaagacccaccccaaacttaaggtgttactttctgtgggaggaaacgaagatgtcagtggctcaggtgacgagaaaaatgaacaatatagaacaattttggaatctaccgctcaccggttaagctttgtcaactctgc

SEQ ID NO: 1097 - DNA, 382 bp, Diabrotica virgifera
  Clone ID: LIB150-010-Q1-E2-B2
cccacgcgtacgcccacgcgtccgcccacgcgtccgcccacgcgtccggtgtttttggtgtgacttttttttatcacgggttattttttcgtgtgttgcgctcatcgacaaaccacaagaatgaaacttatcgtaggattattattaatagccacagctctggcatacccagtagcggaaaatgaagaaaaactagcccaaccagtaattgcacaagacgcgaagccagcagagcaagaactaccactaccagaccaacttcttcccatatcagaaaaacttccccaaaaacaagaaccgttacctgccagcagcgattcttcatcagaatcttcctctgagagcagcgatgagtctggagaaaagaaatcatcctcccgag

SEQ ID NO: 1098 - DNA, 411 bp, Diabrotica virgifera
  Clone ID: LIB149-045-Q1-E1-H5
cgcgtccgcccacgcgtccgcccacgcgtccgcccacgcgtccgaataattatatgttcaattatatttatattattaaatcaccctttaacttgtggtttaatattattaatacaaacaattttcacatcagttattacaggattaataaattataattactgattttcttatattttatttttaattatagtaggaggaatattaattctttttatttatataaccagaattgcttcaaatgaaaaatttaaatttaattttaatataactttaataataattagaatttttattattatttctatattaagatttattttagattatttttattttaattcttttataaaaattatagaaatgaataaccaatttaatattattaataataaattatccttaattaaa

SEQ ID NO: 1099 - DNA, 455 bp, Diabrotica virgifera
  unsure (1)..(455): unsure at all n locations
  Clone ID: LIB149-014-Q1-E1-F1
cggacgcgtgggcggacgcgtgggcggacgcgtgggcaaaactatagcactgtgggaaaaggagaaaagacccgaagccttctggtcaagctctttaagttatgtattcatgacactcctaaaatcctactacgaaagtattaaaaatggaaagattttatattactggaataaaaacaataaccttatcaatggtccttcagccgcaacattaactaatgttgaaaacagattgaaagcaattataaatgacattgataaaaatttgacggtcgatcctaacgttgttgcaaaatatattttgtcagcacaggaactcatcgaatttaagatgtcaaatatgaaagtgaaaggttaggttgaccaaaataattctataagtaagcattaagtgaaattattttttatactttgtactgcaaaattttagaaatanataacatgtgaattgtcaa

SEQ ID NO: 1100 - DNA, 415 bp, Diabrotica virgifera
  unsure (1)..(415): unsure at all n locations
  Clone ID: LIB149-005-Q1-E1-D2
agcccacgcgtccgcccacgcgtccgcccacgcgtccggtgcgacagacttccttactaaaatagaccaccttcagtgtgtacaaaaaaactgggggagttatcagaaattatatacggatggttcaaaaatggaaggaaaagttggatatgctatatattacccacaaaaaagtataaaaataaacaacagattacctgataaaatgacaattttcacagctgaactcattgcaatcaaagaagcatacaaaatatgtattaatcaaaaagaactcaattatgttatatttaaagactgccaaagcattgttaagacattgaaatataatgtacataattttgcagaaaattatatcatcagtgacatcatagcaatgaacagtgaagctttganatcgggcaaaaatataata

SEQ ID NO: 1101 - DNA, 116 bp, Diabrotica virgifera
  Clone ID: LIB3026-009-Q1-E1-D5
cagacgcgtgggcggacgcgtgggcggacgcgtgggatttaatatagaaaaaaaaaaaaaaataaaaaaaaaaagaaaaaaatataataaaaaaaataaaaaggaaaaattcaaaa

SEQ ID NO: 1102 - DNA, 439 bp, Diabrotica virgifera
  Clone ID: LIB149-014-Q1-E1-G6
gaaacatccaaatggcaccatgagcaaaccttatctggtggtggaaacaacgaatttgaatggtatacggatgatagacgtaacagctatacctccaacggccaattacacatcaaacccacttttgtcgcagatgaatatggtgaaaaattcttatattccggtactattgacttgggaaataaatgtactggttctgacaatgaaggttgtaggagaactggttcagccaatgctatagttaatcccatcaaaagtgctcgtatgaggaccttagactcattttcatttaaatacggcagagttgaagtcagcgctaaagtaccttctggagattggttgtggccagctatctggatgttaccaagtaaatgggtttatggaagttggccagcatctggagaaatcgacatcatggaaagtagaggaaaccgtcagt

SEQ ID NO: 1103 - DNA, 405 bp, Diabrotica virgifera
  Clone ID: LIB3026-027-Q1-E1-E9
atcagcggacgcgtgggaaaattcttatattccggtactattgacttgggaaataaatgtactggttctgacaatgaaggttgtaggagaactggttcagccaatgctatagttaatcccatcaaaagtgctcgtatgaggaccttagactcattttcatttaaatacggcagagttgaagtcagcgctaaagtaccttctggagattggttgtggccagctatctggatgttaccaagtaaatgggtttatggaagttggccagcatctggagaaatcgacatcatggaaagtagaggaaaccgtcagtattatgatcccagtggacaaaacgttggaactcaattagaagcatctactctacattggggacctaatccaaaattcaacaaatttatgaagact

SEQ ID NO: 1104 - DNA, 382 bp, Diabrotica virgifera
  Clone ID: LIB3026-021-Q1-E1-D8
aggtgaaaaattcttatattccggtactattgacttgggagctaaatgtactggttctgacaatgaaggttgtaggagaactggttcagccaatgctatagttaatcccatcaaaagtgctcgtatgaggaccttagactcattttcatttaaatacggcagagttgaagtcagcgctaaagtaccttctggagattggttgtggccagctatctggatgttaccaagtaaatgggtttatggaagttggccagcatctggagaaatcgacatcatggaaagtagaggaaaccgtcagtattatgatcccagtggacaaaacgttggaactcaattagaagcatctactctacattggggacctaatccaaaattcaacaaa

SEQ ID NO: 1105 - DNA, 358 bp, Diabrotica virgifera
  Clone ID: LIB3026-023-Q1-E1-G7
acgcgtccgcaatgaaggttgtaggagaactggttcagccaatgctatagttaatcccatcaaaagtgctcgtatgaggaccttagactcattttcatttaaatacggcagagttgaagtcagcgctaaagtaccttctggagattggttgtggccagctatctggatgttaccaagtaaatgggtttatggaagttggccagcatctggagaaatcgacatcatggaaagtagaggaaaccgtcagtatcactatcccagtggacaaaacgttggaactcaattagaagcatctacgctacattggggacctagtccaaaattcaacaaatttatgaagactcactgggaaaagacg

SEQ ID NO: 1106 - DNA, 423 bp, Diabrotica virgifera
  Clone ID: LIB3026-029-Q1-E1-D9
cacgcgtcagcataaaaggttgcagaagaactggttcacccaatgccatagtcaatcccatcgtaagtgctcgtatgaggacattgcactcattctcatttaaatacggcagggttgaagttaatgctaaaataccatctggagattggttatggccagctgtctggatgttaccaactaactgggagtatggaaattggccagcatctggagaaatcgacatcatggaaagtagaggaaaccgtcagtattatgcccccaatggacaaaacgttggaactgcaacagaatcatctactctacattggggacctactccacaattcaacaaacaactgaagactcactgggaaaagatcaattataacggtggttgggataaacctttccatagatatcaagtggaatggacgcctgaacata

SEQ ID NO: 1107 - DNA, 440 bp, Diabrotica virgifera
  Clone ID: LIB150-041-Q1-E1-G6
aatggaaatcacgaaattgaatggtacacaaacagcagaaacaacagctatacttcaaatggaattttacacataaaaccaacttttgtagctgatgagctaggagagcagtttttacaatcagctaccgtagatttgggaaacaagtgtaccaatccacacaattctggttgtaaaagaactggctcaccaggtgaaatactaaatccagtcaaaagtgctcgtcttagaacattagataccttttcctttatatatggcaaagttgaagttagggctaaagttcctacaggagattggttatggccagcaatttggttgctacctaataaatggatagaaaacggagactggatttcctccggagaaatagatattatggaaacacgaggaaacaaagaactgataaaacctaatggtcaaaatatcggtacaccctt

SEQ ID NO: 1108 - DNA, 310 bp, Diabrotica virgifera
  unsure (1)..(310): unsure at all n locations
  Clone ID: pGUT037
aacgaatttgaatggtatacggatgatagacgtaacagctatacctccaacggccaattacacatcaaacccacttttgtcgcagatgaatatggtgaaaaattcttatattccggtactattgacttgggaaataaatgtactggttctgacaatgaaggttgtaggataactggttcagccaatgctatagttaatcccatcaaaagtgctcgtatgaggaccttaaactcattttcatttanatacggcagatttgaagtcagcgctaaagtaccttctggagattggttgttggcagctatctgga

SEQ ID NO: 1109 - DNA, 238 bp, Diabrotica virgifera
  Clone ID: pGUT1949
cgaattcctatggtatacggataatagacgtaacagttatacttacaacggccaattacacatcaaacccacttttgtcgcagatgattatggagaggatttcttatattctggtactattgatataagagctgcctgcacaggtggcgactacgaaggttgcagaatatctggttcatccaatgccatagtcaatcccatcgtaagtgctcgtatgatgacattgcactcattctca

SEQ ID NO: 1110 - DNA, 447 bp, Diabrotica virgifera
  Clone ID: LIB150-017-Q1-E1-F5
gaccattggcataaacgaaggtccacaggaggcaagaggaagcctctccgtaagaagaggaagttcgaattaggacgtccagccgcaaataccaaacttggagcacgtagaattcactatgtccgtacacgaggaggtaacttgaagtaccgtgcattgaggattgaaaaaggaaatttcgcatggggcagcgaaggtactgctcgtaaaacacgtattattgatgtcgtttacaatgccagtaataacgaattggtacgtaccaaaacattggtaaagaatgccatcgttgttattgacgcaacccctttcagacaatggtacgacagccactatattttacctttaggacgcaagaacggggcataattgacagcggaagatgaagaaatgttcaataagaaacgtagcattaaagtacagaaaaaatatgaaactaggcacaaa

SEQ ID NO: 1111 - DNA, 437 bp, Diabrotica virgifera
  Clone ID: LIB149-010-Q1-E1-E9
agcggacgcgtgggttcagaatgggtattagtagagaccattggcataaacgaaggtccacaggaggcaagaggaagcctctccgtaagaagaggaagttcgaattaggacgtccagccgcaaataccaaacttggagcacgtagaattcactatgtccgtacacgaggaggtaacttgaagtaccgtgcattgaggattgaaaaaggaaatttcgcatggggcagcgaaggtactgctcgtaaaacacgtattattgatgtcgtttacaatgccagtaataacgaattggtacgtaccaaaacattggtaaagaatgccatcgttgttattgacgcaacccctttcagacaatggtacgaaagccactatattttacctttaggacgcaagaagggggcaaaattgacagcggaagatgaagaaatgttcaataag

SEQ ID NO: 1112 - DNA, 419 bp, Diabrotica virgifera
  Clone ID: LIB150-047-Q1-E1-B8
agtattagtagagaccattggcataaacgaaggtccacaggaggcaagaggaagcctctccgtaagaagaggaagttcgaattaggacgtccagccgcaaataccaaacttggagcacgtagaattcactatgtccgtacacgaggaggtaacttgaagtaccgtgcattgaggattgaaaaaggaaatttcgcatggggcagcgaaggtactgctcgtaaaacacgtattattgatgtcgtttacaatgccagtaataacgaattggtacgtaccaaaacattggtaaagaatgccatcgttgttattgacgcaacccctttcagacaatggtacgaaagccactatattttacctttaggacgcaagaagggggcaaaattgacagcggaagatgaagaaatgttcaataagaaacg

SEQ ID NO: 1113 - DNA, 406 bp, Diabrotica virgifera
  Clone ID: LIB150-048-Q1-E1-F7
aaacgaaggtccacaggaggcaagaggaagcctctccgtaagaagaggaagttcgaattaggacgtccagccgcaaataccaaacttggagcacgtagaattcactatgtccgtacacgaggaggtaacttgaagtaccgtgcattgaggattgaaaaaggaaatttcgcatggggcagcgaaggtactgctcgtaaaacacgtattattgatgtcgtttacaatgccagtaataacgaattggtacgtaccacaacattggtaaagaatgccatcgttgttattgacgcaacccctttcagacaatggtacgaaagccactatattttacctttaggacgcaagaagggggcaaaattgacagcggaagattaagaaatgttcacatagaaacgttaccaaaaag

SEQ ID NO: 1114 - DNA, 336 bp, Diabrotica virgifera
  unsure (1)..(336): unsure at all n locations
  Clone ID: LIB149-038-Q1-E1-A12
agtcgnnggtccacagaggcaagaggaagcctctccgtaagaagaggaagttcgaattaggacgtccagccgcaaataccaaacttggggcacgtacaattcactatgtccgtacacgaggaggtaacttgaagtaccgtgcattgaggattgaaaaaggaaatttcgcatggggcagcgaaggtactgctcgtaaaacacgtattattgatgtcgtttacaatgccagtaataacgaattggtacgtaccaaaacattggtaaagaatgccatcgttgttattgacgcaacccctttcagacagtggtacgaaagccactacattttacctttag

SEQ ID NO: 1115 - DNA, 295 bp, Diabrotica virgifera
  unsure (1)..(295): unsure at all n locations
  Clone ID: pGUT1555
gaggattgaaaaaggaaatttcgcatggggcagcgaaggtactgctcgtaaaacacgtattattgatgtcgtttacaatgccagtaataacgaattggtacgtaccaaaacattggtaaagaatgccatcgttgttattgacgcaacccctttcagacaatggtacgaaagccactatattttacctttaggacgcaagaaaggggcaaaattgacagcggaagatgaaaaaatgttcaataagaaacgtagcanaaaagtacagaaaaaatatgaaactaggcaaaaaacagct

SEQ ID NO: 1116 - DNA, 292 bp, Diabrotica virgifera
  Clone ID: LIB3026-007-Q1-E1-H6
gagaccattggtataagcgaaggtccacaggaggcaagaggaagcctctccgtaagaagaggaagttcgaattaggacgtccagccgcagataccaaacttggagcacgtagaattcactatgtccgtacacgaggaggtaacttgaagtaccgtgcattgaggattgaaaaaggaaatttcgcatggggcagcgaaggtactgctcgtaaaacacgtattattgatgtcgtttacaatgccacgaataacgacatggtgcgtgccaaaacattgggaaagaatgccatcgt

SEQ ID NO: 1117 - DNA, 363 bp, Diabrotica virgifera
  unsure (1)..(363): unsure at all n locations
  Clone ID: LIB150-026-Q1-E1-F1
caaacccccaaaggtaattcctaataccattggcataaacgaaggtccacangaggcaagaagaagcctccccgtaagaagaagaagttccaattaagacgtccagccgcaaataccaaacttggagcacgttgaattcactatgtccgtacacgaagaggtaacttgaagtaccgtgcattgaagattgaaaaaggaaatttcgcatggggcagcgaaagtactgctcgtaaaacacgtattattgatgtcgtttacaatgccagtaataacgaattggtacgtaccaaaacattggtaaagaatgccatcgttgttattgacgcaacccctttcagacaatgggtacaaaagccactatat

SEQ ID NO: 1118 - DNA, 440 bp, Diabrotica virgifera
  Clone ID: LIB150-014-Q1-E1-E9
cccacgcgtccgcccacgcgtccggcgaacgtcacttgcggaagtgaatttccaaagcagaaaattatttcaaagcggtttttacattgtgacttgtggatattttgtgaaaaaactagtccaaaatgcctgaagaaactcaaagcgcagatgtcgagaccttcgccttccaggctgaaatcgctcagctgatgagtttgatcatcaacacattctactctaataaagaaatcttccttagagagttgatctcaaactcctcagatgccttggataagatccgttaccaatcactcacaaatccatcctgtctcgactctggaaaagatttgcacattaaaattgttccaaacaagagtgaaggaaccttaaccatcattgatactggtattggtatgacgaaagcagatttagttaacaaccttggtacaatcgcaaaa

SEQ ID NO: 1119 - DNA, 432 bp, Diabrotica virgifera
  Clone ID: LIB150-013-Q1-E1-B7
cccacgcgtccgcagcgaacgtcacttgcggaagtgaatttccaaagcagaaaattatttcaaagcggtttttacattgtgacttgtggatattttgtgaaaaaactagtccaaaatgcctgaagaaactcaaagcgcagatgtcgagaccttcgccttccaggctgaaatcgctcagctgatgagtttgatcatcaacacattctactctaataaagaaatcttccttagagagttgatctcaaactcctcagatgccttggataagatccgttaccaatcactcacaaatccatcctgtctcgactctggaaaagatttgcacattaaaattgttccaaacaagagtgaaggaaccttaaccatcattgatactggtattggtatgacgaaagcagatttagttaacaaccttggtacaatcgcaaaatc

SEQ ID NO: 1120 - DNA, 419 bp, Diabrotica virgifera
  Clone ID: LIB150-022-Q1-E1-D5
aacgaacgtcacttgcggaagtgaatttccaaagcagaaaattatttcaaagcggtttttacattgtgacttgtggatattttgtgaaaaaactagtccaaaatgcctgaagaaactcaaagcgcagatgtcgagaccttcgccttccaggctgaaatcgctcagctgatgagtttgatcatcaacacattctactctaataaagaaatcttccttagagagttgatctcaaactcctcagatgccttggataagatccgttaccaatcactcacaaatccatcctgtctcgactctggaaaagatttgcacattaaaattgttccaaacaagagtgaaggaaccttaaccatcattgatactggtattggtatgacgaaagcagatttagttaacaaccttggtacaatcgcaaaatc

SEQ ID NO: 1121 - DNA, 418 bp, Diabrotica virgifera
  Clone ID: LIB149-004-Q1-E1-G4
aggagaacgtcacttgcggaagtgaatttccaaagcagaaaattatttcaaagcggtttttacattgtgacttgtggatattttgtgaaaaaactagtccaaaatgcctgaagaaactcaaagcgcagatgtcgagaccttcgccttccaggctgaaatcgctcagctgatgagtttgatcatcaacacattctactctaataaagaaatcttccttagagagttgatctcaaactcctcagatgccttggataagatccgttaccaatcactcacaaatccatcctgtctcgactctggaaaagatttgcacattaaaattgttccaaacaagagtgaaggaaccttaaccatcattgatactggtattggtatgacgaaagcagatttagttaacaaccttggtacaatcgcaaaa

SEQ ID NO: 1122 - DNA, 403 bp, Diabrotica virgifera
  Clone ID: LIB150-028-Q1-E1-E11
agcgaacgtcacttgcggaagtgaatttccaaagcagaaaattatttcaaagcggtttttacattgtgacttgtggatattttgtgaaaaaactagtccaaaatgcctgaagaaactcaaagcgcagatgtcgagaccttcgccttccaggctgaaatcgctcagctgatgagtttgatcatcaacacattctactctaataaagaaatcttccttagagagttgatctcaaactcctcagatgccttggataagatccgttaccaatcactcacaaatccatcctgtctcgactctggaaaagatttgcacattaaaattgttccaaacaagagtgaaggaaccttatccatcattgatactggtattggtatgacgaaagcagatttagttaacaaccttg

SEQ ID NO: 1123 - DNA, 382 bp, Diabrotica virgifera
  Clone ID: LIB149-032-Q1-E1-E5
acccacgcgtccggcggaagtgaatttccaaagcagaaaattatttcaaagcggtttttacattgtgacttgtggatattttgtgaaaaaactagtccaaaatgcctgaagaaactcaaagcgcagatgtcgagaccttcgccttccaggctgaaatcgctcagctgatgagtttgatcatcaacacattctactctaataaagaaatcttccttagagagttgatctcaaactcctcagatgccttggataagatccgttaccaatcactcacaaatccatcctgtctcgactctggaaaagatttgcacattaaaattgttccaaacaagagtgaaggaaccttaaccatcattgatactggtattggtatgacgaaagc

SEQ ID NO: 1124 - DNA, 423 bp, Diabrotica virgifera
  Clone ID: LIB3026-010-Q1-E1-C10
atctccgtgacacatcaactatgggttacatggcagccaagaaacacctagaaatcaaccctgaccattccatcattgaaaaccttagacagaagacagaagttgataaaaatgataaggctgtgaaagatcttgtcatcttgctcttcgagactgccctccttagctctggttttactttggatgaacctcaagtacacgcatctagaatctacagaatgatcaaacttggtttgggcattgatgaagaagaatctatgcttactgaagaaaccccatctggcgaagctcctgctgccgaggctggtgatggagaagatgcttcccgtatggaagaagtagattaaatgcattcatttaaagagcatgtgttgtaatatgttcaaatgacaatttctctcattccttatttttgtaaataat

SEQ ID NO: 1125 - DNA, 385 bp, Diabrotica virgifera
  Clone ID: LIB150-026-Q1-E1-C9
tctagagtgaatcgtatgacgaagtgaatttccaaagcagacaattatttcaaagcgggttttacattgtgacatgtggatattttgtgaaaaaactagtccaaaatgcctgaagaaactcaaagcgcagatgtcgagaccttcgccttccacgctgaaatcgctcagctgatgagtttgatcatcaacacattctactctaataaagaaatcttccttagagagttgatctcaaactcctcagatgccttggagaacatccgttaccaatcacgcacaaatccatcctgtcgcgactctggaaaagatttgcacattaaaattgttccaaacaagagtgaatgaaccttaaccatcattgatactggtattggtatgaggaaag

SEQ ID NO: 1126 - DNA, 445 bp, Diabrotica virgifera
  Clone ID: LIB150-011-Q1-E1-D12
ggttgagaaaaaggctgtacagaagcccgctggggatgcaccaaaaaaggtgcacaaaccaggaaaacctagaaactatgatttgggaaatggagtactcagattctctaggtctaaaatgttccacaaaaaagcattatacaaattcgttggcaagaaagtagaagctaccaagaaacctcaaaagccccaggttattgaaaaaccaattggtggagagaaaaatggaggaaagagatttgttttggtcaagaaacgtagagcatcctatcctacccaagacaaaattaaggccaggccagctaggagaacatttagccaacacacgaggtctattagaaatacaatcactccaggaacagttctcatccttttagctggttctcacaaaggaaagaaggttgtattccttaaacaactgtactctggtctacttttggtaact

SEQ ID NO: 1127 - DNA, 452 bp, Diabrotica virgifera
  Clone ID: LIB150-017-Q1-E1-D10
acgcttcggcagaaaaatggttgagaaaaaggctgtacagaagcccgctggggatgcaccaaaaaaggtgcacaaaccaggaaaacctagaaactatgatttgggaaatggagtactcagattctctaggtctaaaatgttccacaaaaaagcattatacaaattcgttggcaagaaagtagaagctaccaagaaacctcaaaagccccaggttattgaaaaaccaattggtggagagaaaaatggaggaaagagatttgttttggtcaagaaacgtagagcatcctatcctacccaagacaaaattaaggccaggccagctaggagaacatttagccaacacacgaggtctattagaaatacaatcactccaggaacagttctcatccttttagctggttctcacaaaggaaagagggttgtattccttaaacaactgtactctggtctac

SEQ ID NO: 1128 - DNA, 445 bp, Diabrotica virgifera
  Clone ID: LIB150-016-Q1-E1-C7
cagacgcgtgggctgaaagatggttgagaaaaaggctgtacagaagcccgctggggatgcaccaaaaaaggtgcacaaaccaggaaaacctagaaactatgatttgggaaatggagtactcagattctctaggtctaaaatgttccacaaaaaagcattatacaaattcgttggcaagaaagtagaagctaccaagaaacctcaaaagccccaggttattgaaaaaccaattggtggagagaaaaatggaggaaagagatttgttttggtcaagaaacgtagagcatcctatcctacccaagacaaaattaaggccaggccagctaggagaacatttagccaacacacgaggtctattagaaatacaatcactccaggaacagttctcatccttttagctggttctcacaaaggaaagagggttgtattccttaaacaactgtac

SEQ ID NO: 1129 - DNA, 385 bp, Diabrotica virgifera
  Clone ID: LIB150-040-Q1-E1-D11
gaaaaaggctgtacagaagcccgctggggatgcaccaaaaaaggtgcacaaaccaggaaaacctagaaactatgatttgggaaatggagtactcagattctctaggtctaaaatgttccacaaaaaagcattatacaaattcgttggcaagaaagtagaagctaccaagaaacctcaaaagccccaggttattgaaaaaccaattggtggagagaaaaatggaggaaagagatttgttttggtcaagaaacgtagagcatcctatcctacccaagacaaaattaaggccaggccagctaggagaacatttagccaacacacgaggtctattagaaatacaatcactccaggaacagttctcatccttttagctggttctcacaaa

SEQ ID NO: 1130 - DNA, 377 bp, Diabrotica virgifera
  Clone ID: LIB150-009-Q1-E1-A8
acaagttgagaaaaaggctgtacagaagcccgctggggatgcaccaaaaaaggtgcacaaaccaggaaaacctagaaactatgatttgggaaatggagtactcagattctctaggtctaaaatgttccacaaaaaagcattatacaaattcgttggcaagaaagtagaagctaccaagaaacctcaaaagccccaggttattgaaaaaccaattggtggagagaaaaatggaggaaagagatttgttttggtcaagaaacgtagagcatcctatcctacccaagacaaaattaaggccaagccagctaggagaacatttagccaacacacgaggtctattagaaatacaatcactccaggaacagttctcatccttt

SEQ ID NO: 1131 - DNA, 379 bp, Diabrotica virgifera
  Clone ID: LIB150-044-Q1-E1-E10
cgggtcgagacaagcgtctaaaataattgttgataaaaaggctgtacagaagcccgctggggatgcaccaaaaaaggtgcacaaaccaggaaaacctagaaactatgatttgggaaatggagtactcagattctctaggtctaaaatgttccacaaaaaagcattatacaaattcgttggcaagaaagtagaagctaccaagaaacctcaaaagccccaggttattgaaaaaccaattggtggagagaaaaatggaggaaagagatttgttttggtcaagaaacgtagagcatcctatcctacccaagacaaaattaaggccaggccagctaggagaacatttagccaacacacgaggtctattagaaatacaatcact

SEQ ID NO: 1132 - DNA, 335 bp, Diabrotica virgifera
  Clone ID: LIB150-016-Q1-E1-A1
gaaagatggttgaaaaaaaggctgtaaagaagcccgctggggatgcaccaaaaaaagtgcacaaaccaagaaaacctagaaactatgatttgggaaatggagtactcagattctctaggtctaaaatgttccacaaaaaagcattatacaaattcgttggcaagaaagtagaaactaccaagaaacctcaaaagccccaggttattgaaaaaccaattggtggagagaaaaatggaggaaagagatttgttttggtcaagaaacgtagagcatcctatcctacccaagacaaaattaaggccaagccagctaggagaacatttagccaacacacg

SEQ ID NO: 1133 - DNA, 410 bp, Diabrotica virgifera
  Clone ID: LIB149-021-Q1-E1-B11
acccacgcgtccgcccacgcgtccgcccacgcgtccgcccacgcgtccgcccacgcgtccggaaagatggttgagaaaaaggctgtacagaagcccgctggggatgcaccaaaaaaggtgcacaaaccaggaaaacctagaaactatgatttgggaaatggagtactcagattctctaggtctaaaatgttccacaaaaaagcattatacaaattcgttggcaagaaagtagaagctaccaagaaacctcaaaagccccaggttattgaaaaaccaattggtggagagaaaaatggaggaaagagatttgttttggtcaagaaacgtagagcatcctatcctacccaagacaaaattaaggccaggccagctaggagaacatttagccaacacacgaggtccaatacaaa

SEQ ID NO: 1134 - DNA, 424 bp, Diabrotica virgifera
  Clone ID: LIB149-006-Q1-E1-B7
aggactttcaaaaaattcacttttcgtggagtggatttagatcaacttttggacatgccaaatgagcaactcatggaactcatgcattgccgtgccacaaggcgttttacaaggggattgaaacgtaaaccaatggccctagtgaaaaaactacgtaaagcaaagaatgaagcccctccactagaaaaaccagaaatcgttaaaacccatttgagaaacatgatcattgttccagaaatggttggttctatagttggcgtttacaatggtaaagctttcacacaagttgaaatcaaacctgaaatgattggacactatctaggtgaattctctttgacttacaaacctgttaaacacggtaagccaggtaatggtggctaccacagttccaaaattaatcctcctcaaataattaatttacaag

SEQ ID NO: 1135 - DNA, 439 bp, Diabrotica virgifera
  Clone ID: LIB3026-012-Q1-E1-B4
aaaaattcacttttcgtggagtggatttagatcaacttttggacatgccaaatgagcagctcatggaactcatgcattgccgtgccagaaggcgttttacaaggggattgaaacgtaaaccaatggccctagtgaaaaaactacgtaaagcaaagaaagaagcccctccactagaaaaaccagaaatcgttaaaacccatttgagaaacatgatcattgttccagaaatggttggttctatagttggcgtttacaatggtaaagctttcacacaagttgaaatcaaacctgaaatgattggacactatctaggtgaattctctttgacttacaaacctgttaaacacggtaggccaggtattggtgctacccacagttctagatttattcctctcaaataaattatttactatgtagatttatgataataaacaatttt

SEQ ID NO: 1136 - DNA, 426 bp, Diabrotica virgifera
  Clone ID: LIB3026-028-Q1-E1-C1
agtggatttagatcaacttttggacatgccaaatgagcaactcatggaactcatgcattgccgtgccagaaggcgttttacaaggggattgaaacgtaaaccaatggccctagtgaaaaaactacgtaaagcaaagaaagaagcccctccactagaaaaaccagaaatcgttaaaacccatttgagaaacatgatcattgttccagaaatggttggttctatcgttggcgtttacaatggtaaagctttcacacaagttgaaatcaaacctgaaatgattggacactatctaggtgaattctctttgacttacaaacctgttaaacacggtaggccaggtattggtgctacccacagttctagatttattcctctcaaataaattatttactatgtagatttatgataataaacaatttttgagag

SEQ ID NO: 1137 - DNA, 432 bp, Diabrotica virgifera
  Clone ID: LIB149-026-Q1-E1-E6
acaggcgatagtcgctaatttttaaaagttgaagaatccttcgggaaattgtccatcaaaaagtttttgccgattaattagttaaactaaacaatttttcaatatggccgataaagcagaagaactagtcaagaagaagaggactttcaaaaaattcacttttcgtggagtggatttagatcaacttttggacatgccaaatgagcaactcatggaactcatgcattgccgtgccagaaggcgttttacaaggggattgaaacgtaaaccaatggccctagtgaaaaaactacgtaaagcaaagaaagaagcccctccactagaaaaaccagaaatcgttaaaacccatttgagaaacatgatcattgttccagaaatggttggttctatagttggcgtttacaatggtaaagctttcacacaagttgaaat

SEQ ID NO: 1138 - DNA, 410 bp, Diabrotica virgifera
  Clone ID: LIB149-037-Q1-E1-E5
accacgcgtccgcccacgcgtccgcggacgcgtgggcggacgcgtgggtggcgatagtcgctaatttttaaaagttgaagaatccttcgggaaattgtccatcaaaaagtttttgccgattaattagttaaactaaacaatttttcaatatggccgataaagcagaagaactagtcaagaagaagagaactttcaaaaaattcacttttcgtggagtggatttagatcaacttttggacatgccgaatgagcaactcatggaactcatgcattgccgtgccagaatgcgttttacaaggggattgaaacgtaaaccaatggccctagtgaaaaaactacgtaaagcaaagtaagaagcccctccactagaaaaaccagaaatcgttaaaacccatttgagaaacatgatc

SEQ ID NO: 1139 - DNA, 389 bp, Diabrotica virgifera
  Clone ID: LIB149-025-Q1-E1-A4
aaacaagcgtccgggagtaagccccaaatttttaaaagttgaagaatccttcgggaaattgtccatcaaaaaagtttttgccgattaattagttaaactaaacaatttttcaatatggccgataaagcagaagaactagtcaagaagaagaggactttcaaaaaattcacttttcgtggagtggatttagatcaacttttggacatgccaaatgagcaactcatggaactcatgcattgccgtgccagaaggcgttttacaaggggattgaaacgtaaaccaatggccctagtgaaaaaactacgtaaagcaaagaaagaagcccctccactagaaaaaccagaaatcgttaaaacccatttgagaaacatgatcattgttccagaaat

SEQ ID NO: 1140 - DNA, 386 bp, Diabrotica virgifera
  Clone ID: LIB150-029-Q1-E1-A5
ccacgcgtcagggcaatagccgctaatttttaaaagttgaagaatccttcgggaaattgtccatcaaaaagtttttgccgattaattagttaaactaaacaatttttcaatatggccgataaagcagaagaactagtcaagaagaagaggactttcaaaaaattcacttttcgtggagtggatttagatcaacttttggacatgccaaatgagcaactcatggaactcatgcattgccgtgccagaaggcgttttacaaggggattgaaacgtaaaccaatggccctagtgaaaaaactacgtaaagcaaagaaagaagcccctccactagaaaaaccagaaatcgttaaaacccatttgagaaacatgatcattgttccagaaat

SEQ ID NO: 1141 - DNA, 450 bp, Diabrotica virgifera
  Clone ID: LIB150-044-Q1-E1-C5
gacacaagcgatctacacagacgttctgctcaacgcgtccgcccacgcgtccgcccacgcgtccgggaatttaatggcgatagtcgctaatttttaaaagttgaagaatccttcgggaaattgtccatcaaaaagtttttgccgattaattagttaaactaaacaatttttcaatatggccgataaagcagaagaactagtcaagaagaagaggactttcaaaaaattcacttttcgtggagtggatttagatcaacttttggacatgccaaatgagcaactcatggaactcatgcattgccgtgccagaaggcgttttacaaggggattgaaacgtaaaccaatggccctagtgaaaaaactacgtaaagcaaagaaagaagcccctccactagaaaaaccagaaatcgttaaaacccatttgagaaacatgatcattgttccagaaat

SEQ ID NO: 1142 - DNA, 426 bp, Diabrotica virgifera
  Clone ID: LIB150-024-Q1-E1-H2
cgtctggattgacatatcggagaaggtcctaacagtttagaataatgaaatatcttgcagtttttgtgatttttgcgtatttatacgcagctcatgctagtgtttatttagaagagaaattcagtgatgattcctgggaaaagaattggatatacagcaaaaacccagataaagaatttggaaaatttgttaggacagctggaaaattctttaatgatgaagaagaagataaaggtcttcagacatctgaagatgcacgtttctatgccttaagtagaaaattcaaatccttctccacagaaggtaaagatctagttatccaatttactgtaaaacacgaacaaaacattgattgtggaggtggatacgttaaagtatttgattgttccttgaaacctgaagaattacatggggaaactccataca

SEQ ID NO: 1143 - DNA, 411 bp, Diabrotica virgifera
  Clone ID: LIB150-050-Q1-E1-H1
atcagagaaggtcctaacagtttagaataatgaaatatcttgcagtttttgtgatttttgcgtatttatacgcagctcatgctagtgtttatttagaagagaaattcagtgatgattcctgggaaaagaattggatatacagcaaaaacccagataaagaatttggaaaatttgttacgacagctggaaaattctttaatgatgaagaagaagataaaggtcttcagacatctgaagatgcacgtttccatgccttaagtagaaaattcaaatccttctccacagaaggtaaagatctagttatccaatttactgtaaaacacgaacaagacattgattgtggacgtggatacgttaaagtatttgattgttccttgaaacctgaagaattacatggggaaaccccataca

SEQ ID NO: 1144 - DNA, 424 bp, Diabrotica virgifera
  unsure (1)..(424): unsure at all n locations
  Clone ID: LIB150-020-Q1-E1-H6
acttgtcgaaggtttgacgtatcggagaaggtcctaacagtttagaataatgaaatatcttgcagtttttgtgatttttgcgtatttatacgcagctcatgctagtgtttatttagaagagaaattcagtgatgattcctgggaaaagaattggatatacagcaaaaacccagataaagaatttggaaaatttgttaggacagctggaaaattctttaatgatgaagaagaagataaaggtcttcagacatctgaagatgcacgtttctatgccttaagtagaaaattcaaatccttctccacagaaggtaaagatctagttatccaatttactgtaaaacacgaacaaaacattgattgtggaggtggatacgttaaagtanttgattgttccttgaaacctgaaagattacatggggaaact

SEQ ID NO: 1145 - DNA, 411 bp, Diabrotica virgifera
  unsure (1)..(411): unsure at all n locations
  Clone ID: LIB149-010-Q1-E1-C3
cgaaggtttgacgtatcggagaaggtcctaacagtttagaataatgaaatatcttgcagtttttgtgatttttgcgtatttatacgcagctcatgctagtgtttatttagaagagaaattcagtgatgattcctgggaaaagaattggatatacagcaaaaacccagataaagaatttggaaaatttgttaggacagctggaaaattctttaatgatgaagaagaagataaaggtcttcagacatctgaagatgcacgtttctatgccttaagtagaaaattcaaatccttctccacagaaggtaaagatctagttatccaatttactgtaaaacacgaacaaaacattgattgtggaggtggatacgttaaagtatttgattgttccttganaactgaagaattacatgg

SEQ ID NO: 1146 - DNA, 417 bp, Diabrotica virgifera
  Clone ID: LIB150-007-Q1-E1-E9
agtcgaaagtttgacgtatcggagaaggtcctaacagtttagaataatgaaatatcttgcagtttttgtgatttttgcgtatttatacgcagctcatgctagtgtttatttagaagagaaattcagtgatgattcctgggaaaagaattggatatacagcaaaaacccagataaagaatttggaaaatttgttaggacagctggaaaattctttaatgatgaagaagaagataaaggtcttcagacatctgaagatgcacgtttctatgccttaagtagaaaattcaaatccttctccacagaaggtaaagatctagttatccaatttactgtaaaacacgaacaaaacattgattgtggaggtggatacgttaaagtagttgattgttccttgagacctgaagaagtacatgggga

SEQ ID NO: 1147 - DNA, 437 bp, Diabrotica virgifera
  Clone ID: LIB150-025-Q1-E1-C7
gtgggaccatacaagactctatagtgacgtcgtattaacgcgtccgcgaaggtttgacgtatcggagaaggtcctaacagtttagaataatgaaatatcttgcagtttttgtgatttttgcgtatttatacgcagctcatgctagtgtttatttagaagagaaattcagtgatgattcctgggaaaagaattggatatacagcaaaaacccagataaagaatttggaaaatttgttaggacagctggaaaattctttaatgatgaagaagaagataaaggtcttcagacatctgaagatgcacgtttctatgccttaagtagaaaattcaaatccttctccacagaaggtaaagatctagttatccaatttactgtaaaacacgaacaaaacattgattgtggaggtggatacgttaaagtatttgattgttccctg

SEQ ID NO: 1148 - DNA, 442 bp, Diabrotica virgifera
  Clone ID: LIB150-009-Q1-E1-C5
accacttgtcgaaagtttgacgtatcggagaaggtcctaacagtttagaataatgaaatatcttgcagtttttgtgagttttgcgtatttatacgcagctcatgctagtgttgatttagaagagaaattcagtgatgattcctgggaaaagaattggatatacagcaaaaacccagatagagaatttggaaaatttgttacgacagctggaaaattctttaatgatgaagaagaagataaaggtcttcagacatctgaagatgcacgtttctatgccttaagtagaaaattcaagtccttctccacagaaggtaaagatctagttatccaatttactgtaaaacacgaagacggcattgattgtggatgtggatacgtttaagtatttgattgttccttgaaacctgaagaattacatggggaaactccatacaggcttatg

SEQ ID NO: 1149 - DNA, 429 bp, Diabrotica virgifera
  unsure (1)..(429): unsure at all n locations
  Clone ID: LIB150-047-Q1-E1-A2
tgcccatgcgttcgcggaagcgtgggcttgttcaaagtttgacgtatcggaaaaagtcctaacagtttagaataatgaaatatcttgcagtttttgtgatttttgcgtatttatacgcagctcatgctagtgtttatttagaagagaaattcagtgatgattcctgggaaaagaattggatatacagcaaaaacccagataaagaatttggaaaatttgttaggacagctggaaaattctttaatgatgaagaagaagataaaggtcttcagacatctgaagatgcacgtttctatgccttaagtagaaaattcaaatccttctccacagaaggtaaagatctagttatccaatttactgtaaaacacgaacaaaacattgattgtggaggtggatacgttanagtatttgattgttccttggaaactg

SEQ ID NO: 1150 - DNA, 428 bp, Diabrotica virgifera
  Clone ID: LIB149-019-Q1-E1-G12
gacgcacgcgtccacccacgcgtccgcggacgcgtgggcggacgcgtgggcgacgatgaaggtattagttcttctttctttagtcgcattcagcgctgctctaccaacacttcttggtagaaccgctctggtcaaagaagatggaactgttactctcaccgactctagaggacaccaactggtaatcctcaagagtgttaccgatcccagacaagtcgaagttattctcaggagtccaaacacaagaacccagatgttccaagttggggaaccacttagaactagagaaactatcgaccgtactctcgttggagtttcagcttaccaaagctacaaccaagctgatattcttactgatattttccgtcagtatgaaggtactcttgacgacaccaaatactacagccttcttaacagaatccaaatgt

SEQ ID NO: 1151 - DNA, 433 bp, Diabrotica virgifera
  Clone ID: LIB149-026-Q1-E1-B5
attcgggcgcccgacccacgcgtacacccacgcgtccgcccacgcgtccgcggacgcgtgggcaatggcttccaaaactgttcttttcggactcttggtagtccttttggtcaaccactctttggctagagatctgactgtctgccccaactcagacaaagcaaccaaagctgtatacgacaaagaagtagcaacatccgttgtaggaagcaccatccgtgttagagtaccagacagcttgttcttgaagaaaccaatcacctgcattgttattgtggacaataaccacagcgatagcgtacctgaagtagaagatggtggtgttgacagtacatgggtgaccgtaaacattgctcccgccattaccgaactgctcagctacagaatccaagtgtacaccaatgaataaatatagattagtgttataagtctg

SEQ ID NO: 1152 - DNA, 368 bp, Diabrotica virgifera
  Clone ID: LIB150-013-Q1-E1-H1
cccacgcgtccgcccacgcgtccgcggacgcgtgggtgcaaatctagccaaaagctagtgttatagtcacatactcacaccatggcttctcgttttttgattgcttcattccttgtgttaacccttctaggactctgtttagcaggtggtcacggaggaggagaacacaaacgagtcatcatccacgtcccattcaaagtgaagcacattcaccacacccacacagtcgtcaagcacgtcggccatgaaggaggcggcggcggtggcggagaagaatacaaagtcatcggttactccggaggcatcgacgacggtgaagttgtagcccatggaggtggaagtggcggtgattttggcggacacggaca

SEQ ID NO: 1153 - DNA, 298 bp, Diabrotica virgifera
  Clone ID: LIB150-018-Q1-E1-F4
cccacgcgtccgcggacgcgtgggcggacgcgtgggctgacaaatagttgccttataacaaggtcatttgtgccaaattgcaattatgaaatttgtcgtctcatatctgacaaatgttgaagattttaaaaacatcactgtaattgtatacattcatataaaaatgttaacaattacagtgatgtttttatatgaatgtatatttatatgataattatatttaccaaatagttgttaacattccgttgaccaatattttattgtagttttttattttcgtgaatatataattttatca

SEQ ID NO: 1154 - DNA, 435 bp, Diabrotica virgifera
  Clone ID: LIB150-043-Q1-E1-G4
accacacgtccgcccacgcgtccgcggacgcgtgggcggacgcgtgggggacaaggtagtgcttaccgagtaaaccgatacgtggttagccagagacaagttaatggacaacaaagactcaccgttcctgaacaattcgttaaccaagaagtgttaaatcaagtatacagcgaacaatccttaattaaccagagagcacaacaacttgtagaacagaaccaaccaatttctcaagaaatatatgtccaacagtatggtttgaacaaacaagtagatcagcttatccaatcattggtatatcaccaaaatgtgatctctcaacaagttgagcaattcattcaacaaggacaacgtcttccccaagacttgctttcccaacaagtattagtctacaaacaagttcgccaattgattaaagtttgagcacccaacaac

SEQ ID NO: 1155 - DNA, 403 bp, Diabrotica virgifera
  Clone ID: LIB150-002-Q1-E1-F6
cccacgcgtccgccacgcgtccgcccacgcgtccgcggacgcgtgggcggacgcgtgggctttgttgatgaggaagtttcacagaaccacttgaaaaccagaagacatcatcttaaattcattgaagctcttaaacttaaattcaaggaacaacagcgaaaggagaaggaggccaaggaagcagaggctaaggctgaagcagagaagaatggagccaatgaagatgatgaaccagcacaagaaggagatgctgaaggagatccatccatggatgtctctcaggaagatgctgtcaaggaagagactatggaagcggcagaacttgaggaagaaaagccacctgcaaatagtgctgccgccaagggggccaaggcagctccagctgctgcaacaccagcagctg

SEQ ID NO: 1156 - DNA, 415 bp, Diabrotica virgifera
  Clone ID: LIB150-042-Q1-E1-E3
accacgcgtccgcccacgcgtccgcggacgcgtgggcacacacgatatattttttagtttgatttttttcataagtgaataatcaaactaaaatagcgctttactacaaggcatcctggttttaggccttctcctacttttgctgttaccctttttttaactgaagctaaagaaagcggtggaatggttactggtctctactaattaaagaagaatcaacagccatggacaaaacggtcaaaagcaggggatggcctttaacaggtgctaagtgtaacatcaaaccattactatttgatctcgaggaagcactttctgtagagaacacctacaggcccagtgtattagcaattcaatataacgttaaaccaggagaagttactctcaagtcaagggatggtaatgtacatcctct

SEQ ID NO: 1157 - DNA, 383 bp, Diabrotica virgifera
  Clone ID: LIB3026-027-Q1-E1-F11
cgacccacgcgtcagcccacgcgtccgcggacgcgtgggcggacgcgtgggtaaaaaattaaaatttgtattgtaaaataaatattttaaataatttttttgtaatgaaatgttattcgtgggtaaatatatctaattttttaagaaataaattaaatttatttattaacaatatatttataattaaatatttttatattattactattaaatatttttagggatgagcttaaaagtaaaattttattaaaatttaattttcaaataaaaattaggattaacaattttcatattttaaaatatgttatcatctagttttatctagtattactttaagtttttacaaatttttcattacaatataaatttaaattagttaaatt

SEQ ID NO: 1158 - DNA, 429 bp, Diabrotica virgifera
  unsure (1)..(429): unsure at all n locations
  Clone ID: LIB150-035-Q1-E1-E4
gtatgtagccatccaagccgtactctccttgtacgcttctggtcgtaccactggtattgtattggactccggagatggtgtcacccacaccgtcccaatctacgaaggttacgctcttccccacgccatcctccgtttggacttggccggtcgtgacttgaccgactacctcatgaagattcttactgaaagaggttactcattcaccaccaccgctgaaagggaaattgtccgtgacatcaaagaaaaactctgctatgtcgccctcgacttcgaacaggaaatggccaccgctgctgcttccacctccctcgaaaagagctacgaattgcctgatggacaagtcatcaccattggtaacgaaagattccgttgcccagaagccctcttccaaccttccttcttgggtatggaatcttgcngtatcca

SEQ ID NO: 1159 - DNA, 432 bp, Diabrotica virgifera
  unsure (1)..(432): unsure at all n locations
  Clone ID: LIB150-037-Q1-E1-B6
aagtgtttttctgtctagtgagcagtgatcaaccacaaaagacaacatgtgtgacgacgatgttgcggctcttgtcgttgacaatggatccggtatgtgcaaagctggattcgccggagatgacgcaccccgtgccgtcttcccctcaatcgtcggtcgcccaaggcatcaaggtgtcatggttggtatgggacaaaaagactcatacgtaggagatgaagcccaaagcaaaagaggtatcctcacattgaaataccccattgaacacggtatcatcaccaactgggatgatatggaaaaaatctggcatcacaccttctacaatgaactccgtgtagctccagaagaacacccagtcctcctcactgaagctccactcaaccccaaggcanacagagaaaagatgacccaaatcatgtttgaaaccttcaa

SEQ ID NO: 1160 - DNA, 438 bp, Diabrotica virgifera
  Clone ID: LIB150-012-Q1-E1-G12
acgcatccgcagacgcgtggggcttattagctgtgtttttctgtctagtgagcagtgatcaaccacaaaagacaacatgtgtgacgacgatgttgcggctcttgtcgttgacaatggatccggtatgtgcaaagctggattcgccggagatgacgcaccccgtgccgtcttcccctcaatcgtcggtcgcccaaggcatcaaggtgtcatggttggtatgggacaaaaagactcatacgtaggagatgaagcccaaagcaaaagaggtatcctcacattgaaataccccattgaacacggtatcatcaccaactgggatgatatggaaaaaatctggcatcacaccttctacaatgaactccgtgtagctccagaagaacacccagtcctcctcactgaagctccactcaaccccaaggcaaacagagaaaagatgac

SEQ ID NO: 1161 - DNA, 419 bp, Diabrotica virgifera
  Clone ID: LIB150-048-Q1-E1-A7
ctcgcgggtcgatacaagcctctacaatgcgtccgtcaagcgtccggtttttctgtctagtgagcagtgatcaaccacaaaagacaacatgtgtgacgacgatgttgcggctcttgtcgttgacaatggatccggtatgtgcaaagctggattcgccggagatgacgcaccccgtgccgtcttcccctcaatcgtcggtcgcccaaggcatcaaggtgtcatggttggtatgggacaaaaagactcatacgtaggagatgaagcccaaagcaaaagaggtatcctcacattgaaataccccattgaacacggtatcatcaccaactgggatgatatggaaaaaatctggcatcacaccttctacaatgaactccgtgtagctccagaagaacacccagtcctcctcaatgaagctccaa

SEQ ID NO: 1162 - DNA, 405 bp, Diabrotica virgifera
  Clone ID: LIB150-007-Q1-E1-D9
acccgtccacggacgagtggggcttattagctgtgtttttctgtctagtgagcagtgatcaaccacaaaagacaacatgtgtgacgacgatgttgcggctcttgtcgttgacaatggatccggtatgtgcaaagctggattcgccggagatgacgcaccccgtgccgtcttcccctcaatcgtcggtcgcccaaggcatcaaggtgtcatggttggtatgggacaaaaagactcatacgtaggagatgaagcccaaagcaaaagaggtatcctcacattgaaataccccattgaacacggtatcatcaccaactgggatgatatggaaaaaatctggcatcacaccttctacaatgaactccgtgtagctccagaagaacacccagtcctcctcactgaagctcc

SEQ ID NO: 1163 - DNA, 424 bp, Diabrotica virgifera
  unsure (1)..(424): unsure at all n locations
  Clone ID: LIB149-011-Q1-E1-D6
gggtccacccaaacgtccgaatattagctgtgtttttctgtctagtgagcagtgatcaaccacaaaagacaacatgtgtgacgacgatgttgcggctcttgtcgttgacaatggatccggtatgtgcaaagctggattcgccggagatgacgcaccccgtgccgtcttcccctcaatcgtcggtcgcccaaggcatcaaggtgtcatggttggtatgggacaaaaagactcatacgtaggagatgaagcccaaagcaaaagaggtatcctcacattgaaataccccattgaacacggtatcatcaccaactgggatgatatggaaaaaatctggcatcacancttctacaatgaactccgtgtagctccagaagaacaccagtcctcctcactgaagctccactcacaacccaagcanacagag

SEQ ID NO: 1164 - DNA, 397 bp, Diabrotica virgifera
  Clone ID: LIB150-049-Q1-E1-C4
cccacgcgtccgcccacgcgtccggtcgctgagcgtcgagtccatacacttactcagagtcgctgtaccaccaaaccaaaaaaccataaatcatgtgtgacgacgatgtagcggctcttgtcgtcgacaatggctccggaatgtgcaaagccggtttcgccggtgatgacgcccctcgtgctgtctttccatccatcgtaggtcgtcccagacaccaaggtgtcatggtgggtatgggtcaaaaagactcctacgtaagagacgaagcccaaagcaaaagaggtatcctcaccttaaaataccccattgaacacggaattatcactaactgggacgatatggaaaagatctggcatcacaccttctacaatgaacttagagtaacccccgaagaaca

SEQ ID NO: 1165 - DNA, 436 bp, Diabrotica virgifera
  Clone ID: LIB3026-029-Q1-E1-H8
gtccacatgcctttccaaaggtttgtagaaaccggccgcgtggccgttgtatcggaaggcccacataagggcaaacttgttagtattgtagacgtaatcgaccagacaagggttttagttgatggccccaatagcaatgtacccagaggacagcttaggttaaatgaattgcatttaacaaagttccgcattaggtatccattttcagctccaactcgtgttgtaagaaaagcatggactgatgctaagattgatgaaaaatggaatgaatccgtctgggccaaaaaagtagcagccaaggaaaagagatcacaacttacagatcttgaccggttcaaacttcgtagggctcgttcacgaagaaaccacatccgtacagctactttcctttctttaaggaaggccgcatcaagaaaccgtttcctctaaggtaaaa

SEQ ID NO: 1166 - DNA, 428 bp, Diabrotica virgifera
  Clone ID: LIB3026-016-Q1-E1-H9
acctttccaaaggtttgtagaaaccggccgcgtggccgttgtatcggaaggcccacataagggcaaacttgttagtattgtagacgtaatcgaccaaacaagggttttggttgatggccccaacagcaatgtacccagaggacagcttaggttaaacgaattgcatttaacaaagttccgcattaggtatccattttcagctccaactcgtgttgtaagaaaagcatggactgatgctaagattgatgaaaaatggaatgaatctgtctgggccaaaaaagtagctgccaaggaaaagagatcacaactcacagatcttgaccggttcaaacttcgtagggctcgttcacgaagaaaccacatccgtacagcaactttccttgctttaaggaaggccgcatcaagaaacggtttcctctatggtaaaa

SEQ ID NO: 1167 - DNA, 563 bp, Diabrotica virgifera
  unsure (1)..(563): unsure at all n locations
  Clone ID: LIB150-006-Q1-E1-H10
gcaagcctttccaaaggtttgtagaaaccggccgcgtggccgttgtatcggaaggcccacataagggcaaacttgttagtattgtagacgtaatcgaccaaacaagggttttggttgatggccccaacagcaatgtacccagaggacagcttaggttaaacgaattgcatttaacaaagttccgcattaggtatccattttcagctccaactcgtgttgtaagaaaagcatggactgatgctaagattgatgaaaaatggaatgaatctgtctgggccaaaaaagtagctgccaaggaaaagagatcacaactcacagatcttgaccggttcaaacttcgtagggctcgttcacgaagaaaccacatccgtacagcaactttccttgctttaaggaaggccgcatcaagaaacggtttcctctatggtaaaaagaagatggctaaaggaggtgacaaacctaaaccaagcaagaaggcgaagaaagaaaagcctgcacccaagaagaaataatttttagattaaatgacaatatatttgtttaaaaaactaananannaanna

SEQ ID NO: 1168 - DNA, 408 bp, Diabrotica virgifera
  Clone ID: LIB3026-008-Q1-E1-F5
cctttccaaaggtttgtagaaaccggccgcgtggccgttgtatcggaaggcccacataagggcaaacttgttagtattgtagacgtaatcgaccagacaagggttttagttgatggccccaatagcaatgtacccagaggacagcttaggttaaatgaattgcatttaacaaagttccgcattaggtatccattttcagctccaactcgtgttgtaagaaaagcatggactgatgctaagattgatgaaaaatggaatgaatccgtctgggccaaaaaagtagcagccaaggaaaagagatcacaacttacagatcttgaccggttcaaacttcgtagggctcgttcacgaagaaaccacatccgtacagctactttcctttctttaaggaaggccgcatcaagaaac

SEQ ID NO: 1169 - DNA, 405 bp, Diabrotica virgifera
  unsure (1)..(405): unsure at all n locations
  Clone ID: LIB149-036-Q1-E1-E1
cccaagcgtccgtgcctttccaaaggtttgtagaaaccggccgcgtggccgttgtatcggaaggcccacataagggcaaacttgttagtattgtagacgtaatcgaccagacaagggttttagttgatggccccaatagcaatgtacccagaggacagcttaggttaaatgaattgcatttaacaaagttccgcattaggtatccattttcagctccaactcgtgttgtaagaaaagcatggactgatgctaagattgatgaaaaatggaatgaatccgtctgggccaaaaaagtagcagccaaggaaaagagatcacaacttacagatcttgaccggttcaaacttcgtanggctcgttcacgaagaaaccacatccgtacagctactttcctttctttaagga

SEQ ID NO: 1170 - DNA, 405 bp, Diabrotica virgifera
  Clone ID: LIB3026-015-Q1-E1-G10
atccttttacatttagtgtaaagcatgcctttccaaaggtttgtagaaaccggccgcgtggccgttgtatcggaaggcccacataagggcaaacttgttagtattgtagacgtaatcgaccagacaagggttttagttgatggccccaatagcaatgtacccagaggacagcttaggttaaatgaattgcatttaacaaagttccgcattaggtatccattttcagctccaactcgtgttgtaagaaaagcatggactgatgctaagattgatgaaaaatggaatgaatccgtctgggccaaaaaagtagcagccaaggaaaagagatcacaacttacagatcttgaccggttcaaacttcgtagggctcgttcacgaagaaaccacatccgtacagctactttc

SEQ ID NO: 1171 - DNA, 385 bp, Diabrotica virgifera
  Clone ID: LIB150-049-Q1-E1-E1
aggcctttccaaaggtttgtagaaaccggccgcgtggccgttgtatcggaaggcccacataagggcaaacttgttagtattgtagacgtaatcgaccaaacaagggttttggttgatggccccaacagcaatgtacccagaggacagcttaggttaaacgaattgcatttaacaaagttccgcattaggtatccattttcagctccaactcgtgttgtaagaaaagcatggactgatgctaagattgatgaaaaatggaatgaatctgtctgggccaaaaaagtagctgccaaggaaaagagatcacaactcacagatcttgaccggttcagacttcgtagggctcgttcacgaggagaccacatccgttcagcaactttccttg

SEQ ID NO: 1172 - DNA, 462 bp, Diabrotica virgifera
  unsure (1)..(462): unsure at all n locations
  Clone ID: LIB150-024-Q1-E1-A1
ctcgcgggtcgatacaagcctctaaattaatccacaataggtcgtgtaattcgtgcacaacgtaaaggtgcgggatctgtattcaaatcccacacanaaaagaggaaaggagcacccaaactacgttatttagatttctcagaaagacatggttacattaagggtgttgtaaaagatatcatacatgaccctggccgtggtgctccattggcagtagtacatttcagagatccctacaagttccaaactaggaaggaattgtttattgcccccgaaggaatgtacactggacaatttttgtactgtggaaagaaagctaaccttcaaattggaaatgtattgcctgtangaactatgcctgaaggtaccattgtatgcaacttaaaagaaaaaactggtgaccgtggtcggctagctcgtgcatctggaaactatgctaccgtaattgcccaaaatcacgac

SEQ ID NO: 1173 - DNA, 409 bp, Diabrotica virgifera
  Clone ID: LIB150-001-Q1-E1-D9
gattaatctacaatgggtcgtgtaattcgtgcacaacgtaaaggtgcgggatctgtattcaaatcccacacaaaaaagaggaaaggagcacccaaactacgttatttagatttctcagaaagacatggttacattaagggtgttgtaaaagatatcatacatgaccctggccgtggtgctccattggcagtagtacatttcagagatccctacaagttccaaactaggaaggaattgtttattgcccccgaaggaatgtacactggacaatttttgtactgtggaaagaaagctaaccttcaaattggaaatgtattgcctgtaggaactatgcctgaaggtaccattgtatgcaacttagaagaaaaaactggtgaccgtggtcggctagctcgtgcatctggaaact

SEQ ID NO: 1174 - DNA, 369 bp, Diabrotica virgifera
  unsure (1)..(369): unsure at all n locations
  Clone ID: LIB149-028-Q1-E1-G4
aaaatgggtcgtgtaattcgtgcacaacgtaaaggtgcgggatctgtattcaaatcccacacanaaaaaaggaaaggagcacccaaactacgttatttaaatttctcaaaaaaacatggttacattaagggtgttgtaaaagatatcatacatgaccctggccgtggtgctccattggcagtagtacatttcagagatccctacaagttccaaactangaaggaattgtttattgcccccgaaggaatgtacactggacaatttttgtactgtggaaagaaagctaaccttcaaattggaaatgtattgcctgtangaactatgcctgaaagttacattgtaatcaacttagaagaaaaaactggtgac

SEQ ID NO: 1175 - DNA, 442 bp, Diabrotica virgifera
  Clone ID: LIB3026-005-Q1-E1-G1
gattaatctacaatgggtcgtgtaattcgtgcacaacgtaaaggtgcgggatctgtattcaaatcccacacaaaaaagaggaaaggagcacccaaactacgttatttagatttctcagaaagacatggttacattaagggtgttgtaaaagatatcatacatgaccctggccgtggtgctccattggcagtagtacatttcagagatccctacaagttccaaactaggaaggaattgtttattgcccccgaaaggaatgtacactgggacaatttttgtactgtggaaagaaagctaaccttcaaattgggaatgtaatgcctgtaaggaacaaggcctgaaggtaccattgtatgcaacttagaagaaaaaactggtgaccgtggtcggctagctcgtgcatctggaaactatgctaccgtaattgcccataatcacgaca

SEQ ID NO: 1176 - DNA, 326 bp, Diabrotica virgifera
  Clone ID: LIB150-008-Q1-E1-G9
accacgcgtccgacaatgggtcgtgtaattcgtgcacaacgtaaaggtgcgggatctgtattcaaatcccacacaaaaaagaggaaaggagcacccaaactacgttatttagatttctcagaaagacatggttacattaagggtgttgtaaaagatatcatacatgaccctggccgtggtgctccattggcagtagtacatttcagagatccctacaagttccaaactaggaaggaattgtttattgcccccgaaggaatgtacactggacaatttttgtactgtggaaagaaagctaaccttcaaattgggaatgtattgcctgt

SEQ ID NO: 1177 - DNA, 366 bp, Diabrotica virgifera
  unsure (1)..(366): unsure at all n locations
  Clone ID: LIB150-016-Q1-E1-H8
ccacgagtccggaataatctacagtgggtcgtgtaattcgtgcacaacgtaaacgtgcgggatctgtattcaaatcccacacattgtcagaggaaaggagcacccaaactacgttatttagatttctcagaaagacatggttacattaagggtgttgtaaaagatatcatacatgaccctggccgtggtgctccattggcagtagtacatttcagagatccctacaagttccagactaggaaggaattgtttattgcccccgaacgaatgtacactggacaatttttgtactgtggaaagaaagctaaccttcaaattggaaatgtattgactgtangaactatgcctgaaggtaccattgtatgc

SEQ ID NO: 1178 - DNA, 330 bp, Diabrotica virgifera
  Clone ID: LIB150-050-Q1-E1-F4
cccacgcgtccgcgtagattaatctacaatgggtcgtgtaattcgtgcacaacgtaaaggtgcgggatctgtattcaaatcccacacaaaaaagaggaaaggagcacccaaactacgttatttagatttctcagaaagacatggttacattaagggtgttgtaaaagatatcatacatgaccctggccgtggtgctccattgggagtagtacatttcagagatccctacaagttccaaactaggaaggaattgtttattgccccccaaggaatgttcactggacaaattttgtactgtggaaagaaaactaacctttaaattggaaatgt

SEQ ID NO: 1179 - DNA, 426 bp, Diabrotica virgifera
  Clone ID: LIB150-014-Q1-E1-C8
aatacaagtacagtgatcagtggtctgcgaaacatcgaggttcagaatgccagaaacaacatcgacaaatggatattcaaacggccattccggctacgaaatggcggatggtgctgaatttctcttcacatccgaatccgtcggagagggacatccagataaaatgtgtgatcaaatcagtgacgccatcttagacgcacatcttgaacaagacccaaatgcaaaagttgcctgtgaaaccgttgcaaaaactggaatgattcttctcgccggtgaaattacatcaaaagctgtggtcgactatcaaaaagttgtcagacaaactgtaaagcacataggatatgacgactcttcaaaaggatttgaccacaagacatgcaacgttttattggcattggatcagcagtctccagacattgctgctgg

SEQ ID NO: 1180 - DNA, 414 bp, Diabrotica virgifera
  Clone ID: LIB150-035-Q1-E1-B6
tacaagtacagtgatcagtggtctgcgaaacatcgaggttcagaatgccagaaacaacatcgacaaatggatattcaaacggccattccggctacgaaatggcggatggtgctgaatttctcttcacatccgaatccgtcggagagggacatccagataaaatgtgtgatcaaatcagtgacgccatcttagacgcacatcttgaacaagacccaaatgcaaaagttgcctgtgaaaccgttgcaaaaactggaatgattcttctcgccggtgaaattacatcaaaagctgtggtcgactatcaaaaagttgtcagacaaactgtaaagcacataggatatgacgactcttcaaaaggatttgaccacaagacatgcaacgttttattggcattggatcaacagtccccagaca

SEQ ID NO: 1181 - DNA, 433 bp, Diabrotica virgifera
  Clone ID: LIB149-008-Q1-E1-H7
cgcttacgcagctagatgggtagctaaatcattggttaaagcaggactttgccgaagatgcttagtgcaagtatcatacgctattggtttagccgaacccctttccattacagtatttgattatggaacttcaaaactcactcaaaaggaattgttggacattgtaaacaagaacttcgatttaaggcctggtaaaattgtcaaagaattaaatctgagacaacccatctaccaaaagaccagcacctatggccacttcggacgggacggttttacgtgggaacagcccaaaacactacaactaaactgacaaccttccgtaacaatattttagaaatcttttattgacgcactagatgcctccttctagattttaagtttagaaaaaacttctgtgattggcgctctgaaccttgagaccgacgcgattttt

SEQ ID NO: 1182 - DNA, 425 bp, Diabrotica virgifera
  Clone ID: LIB149-007-Q1-E1-E12
cacaagcttcagctcacgcgtccgctcacgcgtccgacagcaatgctcatacagtgatcagtggtctgcgaaacatcgaggttcataatgcaatctggatcatcgatagatggatattcatgactgtcactccagctacgaaatggtcgatggtggagaatttctcttcacatcgcgattccgtcagtgagggacatccagatacaatgtgtgatcaagtcagtgatgccatcttagacgcacatcttgaagaagacccagatgctaatcttgcctgctggaccgttgcatcaactggtatgattcttctcgccggtgatgttacatcaggagctgtggacaactatcatgacgttgtcacacagagtgttgatcacatatgatatgacgactcttcagcaggatttgattggtcacccctgaat

SEQ ID NO: 1183 - DNA, 420 bp, Diabrotica virgifera
  Clone ID: LIB149-026-Q1-E1-C10
acacacgcctccaaagtcactcgtgttaaaaactcactcaaaaggaattgttggacattgtaaacaagaacttcgatttaaggcctgataaaattgtcaaagaattaaatctgagacaacccatctaccaaaagaccatcacctatggccacttcggacgggacggttttacgtgggaacagcccaaaacactacaactaaactgacaaccttccgtaacaatattttagaaatcttttattgacgcactagatgcctccttctagattttaagtttagaataaacttctgtgattggcgctctgaaccttgagaccgacgcgattttttgcctctctgaatcggaaacattctacagagcatagtatcgcgtactaacaagtaactgtcgcaaaacgtgcccacagattcccgatatag

SEQ ID NO: 1184 - DNA, 369 bp, Diabrotica virgifera
  unsure (1)..(369): unsure at all n locations
  Clone ID: LIB150-032-Q1-E1-A12
aacaaaaggaattgttggacattgtaaacaagaacttcgatttaaggcctggtanaattgtcaaagaaataaaatctgagaaaaccatctaccanaagaccagcacctatggccacttcggacgggacggttttacgtgggaacagcccagaacactacaactaaactgacaaccttccgtaacaatattttagaaatcttttattgacgcactagatgcctccttctagattttaagtttagaaaaaacttctgtgattggcgctctgaaccttgagaccgacgcgattttttgcctctctgaatcggaaacattctacagagcaaagtatcgcgtactaacaagtaactgtcgcaaaacgtgcccac

SEQ ID NO: 1185 - DNA, 446 bp, Diabrotica virgifera
  Clone ID: LIB149-015-Q1-E1-H7
cacacgcgtccgacaagatcgtgtgtatctctgtttcctatactgcgagatttaactcttctacgtttgcttatagtttttcgtttgctctctcaagtgttagtgtgatttcttaaaaaaaaaagaaagagcgtaattctgccgaaagacgccaccgcgccgccaatacccacagcgaattcaatcacgtggtcgtagcagaggttataagtagcgccgtccccgtatattccgtctcttttccaaagtaactaaagaaagaagtacaagtacagtgatcagtggtctgcgaaacatcgaggttcagaatgccagaaacaacatcgacaaatggatattcaaacggccattccggctacgaaatggcggatggtgctgaatttctcttcacatccgaatccgtcggagagggacatccagataaaatgtgtgatcaaatcagtgac

SEQ ID NO: 1186 - DNA, 521 bp, Diabrotica virgifera
  Clone ID: pGUT3664
cgtcgttcagcaagagcttgcgatttttatttttgaaaaatagagagtattctctaatatttaaggacagtatggaagacgattgggctgtggataatcagagtggtggagttgtcgccccaaaaattgcagaactacctgaaattaagttgttcgctagatggaactgcgatgatgtccaagtttcagacatgtcccttcaggactacattgcagtgaaagaaaaaaatgcaaagtatttaccccattcagctggtagatatgctgcaaaaaggttccgtaaagcacaatgcccaatcgttgagaggttaacaaactctctaatgatgcatggacgtaacaatggtaaaaaattgatggctgtcagaattgttaaacatgcttttgaaattatccatttactaactggagaaaatccattacagattttagtttctgctattatcaattcaggacctagagaagattctactcgtattggtagagctggtactgtaagaagacaagctgttgatgtgtca

SEQ ID NO: 1187 - DNA, 370 bp, Diabrotica virgifera
  unsure (1)..(370): unsure at all n locations
  Clone ID: LIB150-006-Q1-E1-B5
acccacgcgtccgagtatttaccccattcagctggtagatatgctgcaaaaaggttccgtaaagcacaatgcccaatcgttgagaggttaacaaactctctaatgatgcatggacgtaacaatggtaaaaaattgatggctgtcagaattgttaaacatgcttttgaaattatccatttactaactggagaaaatccattacagattttagtttctgctattatcaattcaggacctagagaagattctactcgtattggtagagctggtactgtaagaagacaagctgttgatgtgtcacccttgagaagggttaaccaagcaatttggttgctctgcacaggtgctanggaagcagcattccgtaata

SEQ ID NO: 1188 - DNA, 432 bp, Diabrotica virgifera
  Clone ID: LIB3026-015-Q1-E1-C12
acgccgtcgttcagcaagagcttgcgatttttatttttgaaaaatagagagtattctctaatatttaaggacagtatggaagacgattgggctgtggataatcagagtggtggagttgtcgccccaaaaattgcagaactacctgaaattaagttgttcgctagatggaactgcgatgatgtccaagtttcagacatgtcccttcaggactacattgcagtgaaagaaaaaaatgcaaagtatttaccccattcagctggtagatatgctgcaaaaaggttccgtaaagcacaatgcccaatcgttgagaggttaacaaactctctaatgatgcatggacgtaacaatggtaaaaaattgatggctgtcagaattgttaaacatgcttttgaaattatccatttactaactggagaaaatccattacagatt

SEQ ID NO: 1189 - DNA, 385 bp, Diabrotica virgifera
  Clone ID: LIB150-034-Q1-E1-A1
cgtcgttcagcaagagcttgcgatttttatttttgaaaaatagagagtattctctaatatttaaggacagtatggaagacgattgggctgtggataatcagagtggtggagttgtcgccccaaaaattgcagaactacctgaaattaagttgttcgctagatggaactgcgatgatgtccaagtttcagacatgtcccttcaggactacattgcagtgaaagaaaaaaatgcaaagtatttaccccattcagctggtagatatgctgcaaaaaggttccgtaaagcacaatgcccaatcgttgagaggttaacaaactctctaatgatgcatggacgtaacaatggtaaaaaattgatggctgtcagaattggtaaacatgcctt

SEQ ID NO: 1190 - DNA, 382 bp, Diabrotica virgifera
  Clone ID: LIB3026-015-Q1-E1-H4
tgcgatttttattttgagaaatagagagtattctctaatatttaaggacagtatggaagacgattgggctgtggataatcagagtggtggagttgtcgccccaaaaattgcagaactacctgaaattaagttgttcgctagatggaactgcgatgatgtccaagtttcagacatgtcccttcaggactacattgcagtgaaagaaaaaaatgcaaagtatttaccccattcagctggtagatatgctgcaaaaaggttccgtaaagcacaatgcccaatcgttgagaggttaaaaaactctccaatgatgcatggacgttacaatggtaaaaaattgatggctgtcagaaatgttaaacatgcttttgaaaataaccattta

SEQ ID NO: 1191 - DNA, 388 bp, Diabrotica virgifera
  unsure (1)..(388): unsure at all n locations
  Clone ID: LIB3026-020-Q1-E1-F5
ttcagcaagagcttgagatttttatttttgaaaaatagagagtattctctaatatttaaggacagtatggaagacgattgggctgtggataatcagagtggtggagttgtcgccccaaaaattgcagaactacctgaaattaagttgttcgctagatggaactgcgatgatgtccaagtttcagacatgtcccttcaggactacattgcagtgaaagaaaaaaatgcaaagtatttaccccaattcagctggtagnatatgccgccaaaaaggttccgtaaagcacaatgcccaatcgttgagaggttaacanactctctaatgatgcatggacgtaacaatggtaaaaaattgatggctgtcagaanttgtaaacatgcttttgaaa

SEQ ID NO: 1192 - DNA, 247 bp, Diabrotica virgifera
  Clone ID: LIB150-008-Q1-E1-F9
gggctgtggataatcagagtggtggagttgtcgccccaaaaattgcagaactaactgaaattaagttgttcgctagatggaactgcgatgatgtccaagtttcagacatgtcccttcaggactacattgcagtgaaagaaaaaaatgcaaagtatttaccccattcagctggtagaatagctgcaaaaaggttccgttaagcacaatgcccaatcgttgagaagttaacaaactccctaatgatgca

SEQ ID NO: 1193 - DNA, 377 bp, Diabrotica virgifera
  Clone ID: LIB3026-016-Q1-E1-E11
accaagctgtagaagaagttgattggagagatagtgccgttttgggagtcaaagatcaaggacagtgtggatcatgctgggctttcagtaccaccggatccctcgaaggtcaactcgccatccacaaaaatcaacgtgttcctctcagtgaacaagaattggtagactgtgacacatcaagaaatgctggttgtaacggaggtttgatgacagatgcctttaactatgttaaacgccatggtctctcttccgaatctcaatatgcatacaccggcagagatgatcgctgcaagaatgttgagaacaaaccactctcttccattagtggctacgtagaacttgaaacaactgaagatgcactcgcgtccgcggttgct

SEQ ID NO: 1194 - DNA, 365 bp, Diabrotica virgifera
  Clone ID: LIB149-027-Q1-E1-A7
agaagaagttgattggagagatagtgccgttttgggagtcaaagatcaaggacagtgtggatcatgctgggctttcagtaccaccggatccctcgaaggtcaactcgccatccacaaaaatcaacgtgttcctctcagtgaacaagaattggtagactgtgacacatcaagaaatgctggttgtaacggaggtttgatgacagatgcctttaactatgttaaacgccatggtctctcttccgaatctcaatatgcatacaccggcagagatgatcgctgcaagaatgttgagaacaaaccactctcttccattagtggctacgtagaacttgaaacaactgaagatgcactcgccttcgctgttg

SEQ ID NO: 1195 - DNA, 388 bp, Diabrotica virgifera
  Clone ID: LIB149-007-Q1-E1-E6
aaacaatcctttattgcaaaacacgtagccgatcccaatgtccaagctgtagaagaagttgattggagagatagtgccgttttgggagtcaaagatcaaggacagtgtggatcatgctgggctttcagtaccaccggatccctcgaaggtcaactcgccatccacaaaaatcaacgtgttcctctcagtgaacaagaattggtagactgtgacacatcaagaaatgctggttgtaacggaggtttgatgacagatgcctttaactatgttaaacgccatggtctctcttccgaatctcaatatgcatacaccggcagagatgatcgctgcaagaatgttgagaacaaaccactctcttccattagtggctacgtagaacttgaaacaa

SEQ ID NO: 1196 - DNA, 436 bp, Diabrotica virgifera
  Clone ID: LIB3026-031-Q1-E1-A12
caagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagatcaaggacagtgtggatcatgctgggctttcagtaccaccggatccctcgaaggtcaactcgccatcccacaaaatcaacgtgttcctctcagtgaacaagaattggtaaactgtgacacaacaagaaatgctggttgtaacggaggtttgatgacagatgcctttaactatgttaaacgccatggtctctcttccgaatctcaatatgcatacaccggcagagatgatcgctgcaagaatgttgagaacaaaccactctcttccattagtggctacgtagaacttgaaac

SEQ ID NO: 1197 - DNA, 412 bp, Diabrotica virgifera
  Clone ID: LIB149-006-Q1-E1-D7
gcccgggccgatgcaagactctagagtgagtcgaattagctgttaacaaattcgccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagatcaaggacagtgtggatcatgctgggctttcagtaccaccggatccctcgaaggtcaactcgccatccacaaaaatcaacgtgttcctctcagtgaacaagaattggtagactgtgacacatcaagaaatgctggttgtaacggaggtttgatgacagatgcctttaactatgtgaaacgccatggtctctcttccgaatccca

SEQ ID NO: 1198 - DNA, 325 bp, Diabrotica virgifera
  unsure (1)..(325): unsure at all n locations
  Clone ID: pGUT4017
ccaagctgtanaagaagttgattggagagaaagtggcgttttggaagtgcaaagatgggggacagtgtggatcatgctgggctttcagtaccaccggatccctcgaaggtcaactcgccatccacaaaaatcaacgtgttcctctcagtgaacaagaattggtagactgtgacacatcaagaaatgctggttgtgacggaggtttgatgacagatgcctttaactatgttaaacgtcatggtctctcttccgaatctcaatatgcatacaccggcagagatgatcgctgcaagaatgttgagaacaaaccactctctttcatcag

SEQ ID NO: 1199 - DNA, 409 bp, Diabrotica virgifera
  Clone ID: LIB149-035-Q1-E1-G9
ggtccacgacgcgtccggataccgatccaatgtccaagctgtaaaaaaaattgaatggagaaaaaatgcccttttgggaatccaagaataaaggcaagtgtggattaagccgggccttcaattacaaccggttcccccaaaggcacacccccaaccaacaaaaatcaagtgttccccccaagtgaacaaaaattggtagactgtgacacatcaagaaatgctggttgtaacggaggtttgatgacagatgcctttaactatgttaaacgccatggtctctcttccgaatctcaatatgcatacaccggcagagatgatcgctgcaagaatgttgagaacaaaccactctcttccattagtggctacgtagaacttgaaacaactgaagatgcactcgcgtccgctgttg

SEQ ID NO: 1200 - DNA, 412 bp, Diabrotica virgifera
  Clone ID: LIB149-023-Q1-E1-E7
agtactggtgaatttgaagcaggtatttcaaagaatggacaaacacgtgaacatgctcttcttgctttcacccttggtgtaaaacaacttattgttggtgtcaacaaaatggactcgactgaaccagcatacagtgaatcacgtttcgaggaaatcaagaatgaagtatcctcatacatcaagaaaattggttacaacccagctgccgttgctttcgtaccaatttcaggatggcacggagacaacatgttagaaggatctgacaagatgccatggttcaagggatggcaaatcgaacgtaaagaaggaaaagctgaaggaaagtgcttgattgaggctttggatgctatccttcccccatctcgtccaactgagaaacccctccgtcttccactccaggatgtctacaaaa

SEQ ID NO: 1201 - DNA, 400 bp, Diabrotica virgifera
  Clone ID: LIB149-024-Q1-E1-H9
acttgctttcacccttggtgtaaaacaacttattgttggtgtcaacaaaatggactcgactgaaccagcatacagtgaatcacgtttcgaggaaatcaagaaggaagtatcctcatacatcaagaaaattggttacaacccagctgccgttgctttcgtaccaatttcaggatggcacggagacaacatgttagaaggatctgacaagatgccatggttcaagggatggcaaatcgaacgtaaagaaggaaaagctgaaggaaagtgcttgattgaggctttggatgctatccttcccccatctcgtccaactgagaaacccctccgtcttccactccaggatgtctacaaaattggtggtattggaacagtacctgtaggtcgtgttgaaactggtgta

SEQ ID NO: 1202 - DNA, 391 bp, Diabrotica virgifera
  Clone ID: LIB150-046-Q1-E1-E7
actgtgctgtactcattgttgcagctggtactggtgaatttgaagcaggtatttcaaagaatggacaaacacgtgaacatgctcttcttgctttcacccttggtgtaaaacaacttattgttggtgtcaacaaaatggactcgactgaaccagcatacagtgaatcacgtttcgaggaaatcaagaaggaagtatcctcatacatcaagaaaattggttacaacccagctgccgttgctttcgtaccaatttcaggatggcacggagacaacatgttagaaggatctgacaagatgccatggttcaagggatggcaaatcgaacgtaaagaaggaaaagctgaaggaaagtgcttgattgaagctttggatgctatccttcccccaactcg

SEQ ID NO: 1203 - DNA, 418 bp, Diabrotica virgifera
  Clone ID: LIB150-011-Q1-E1-C11
catgaacatgctcttcttgctttcacccttggtgtaaaacaacttattgttggtgtcaacaaaatggactcgactgaaccagcatacagtgaatcacgtttcgaggaaatcaagaaggaagtatcctcatacatcaagaaaattggttacaacccagctgccgttgctttcgtaccaatttcaggatggcacggagacaacatgttagaaggatctgacaagatgccatggttcaagggatggcaaatcgaacgtaaagaaggaaaagctgaaggaaagtgcttgattgaggctttggatgctatccttcccccatctcgtccaactgagaaacccctccgtcttccactccagggatgtctacaaaattggtggtattggaacagtacctgtacgtcgtgttgaaactggtgtaatg

SEQ ID NO: 1204 - DNA, 404 bp, Diabrotica virgifera
  Clone ID: LIB150-046-Q1-E1-A10
acccacgcgtccgcccacgcgtccgctcgactgaaccagcatacagtgaatcacgtttcgaggaaatcaagaaggaagtatcctcatacatcaagaaaattggttacaacccagctgccgttgctttcgtaccaatttcaggatggcacggagacaacatgttagaaggatctgacaagatgccatggttcaagggatggcaaatcgaacgtaaagaaggaaaagctgaaggaaagtgcttgattgaggctttggatgctatccttcccccatctcgtccaactgagaaacccctccgtcttccactccaggatgtctacaaaattggtggtattggaacagtacctgtacgtcgtgttgaaactggtgtactgaaacctggtatggttgtagtattcgctcca

SEQ ID NO: 1205 - DNA, 401 bp, Diabrotica virgifera
  Clone ID: LIB149-024-Q1-E1-H10
tgctttcacccttggtgtaaaacaacttattgttggtgtcaacaaaatggactcgactgaaccagcatacagtgaatcacgtttcgaggaaatcaagaaggaagtatcctcatacatcaagaaaattggttacaacccagctgccgttgctttcgtaccaatttcaggatggcacggagacaacatgttagaaggatctgacaagatgccatggttcaagggatggcaaatcgaacgtaaagaaggaaaagctgaaggaaagtgcttgattgaggctttggatgctatccttcccccatctcgtccaactgagaaacccctccgtcttccactccaggatgtctacaaaattggtggtattggaacagtacctgtaggtcctgttgaaactggtgtattga

SEQ ID NO: 1206 - DNA, 311 bp, Diabrotica virgifera
  unsure (1)..(311): unsure at all n locations
  Clone ID: pGUT4194
atgctcttcttgctttcacccttggtgtaaaacaacttattgttggtgtcaacaaaatggactcgactgaaccagcatacagtgaatcacgtttcgaggaaatcaagaaggaagtatcctcatacatcaagaaaattggttacaacccagctgccgttgctttcgtaccaatttcaggatggcacggagacaacatgttagaaggatctgacaagatgccatggttcaagggatggcaaatcgaacgtaaagaaagaaaagctgaaggaaagtgcttgattgaggctttggatngctatccttccccatct

SEQ ID NO: 1207 - DNA, 349 bp, Diabrotica virgifera
  Clone ID: LIB150-046-Q1-E1-E3
aaccacgcgtccgatgaaagctcccgtatgtgcaaagtattggaaaaccgttcccaacaagatgaagaacgtatggaccaactcaccaaccaattgaaagaagcccgtctcttggctgaagacgctgacaacaaatctgatgaagtatcccgtaaacttgccttcgttgaagacgaacttgaagtagctgaagaccgtgtaaagggtggagatgccaagatcatggaactcgaagaagaattgaaagtcgtaggtaactctctcaaatctctcgaagtatccgaagaaaaagccaaccagagggtagaagaattcaagaaacaacttaagagtcttaccgtcaagctaa

SEQ ID NO: 1208 - DNA, 473 bp, Diabrotica virgifera
  unsure (1)..(473): unsure at all n locations
  Clone ID: LIB150-019-Q1-E1-H8
ccacgcgaccgccaacgcgtccgcggacgcgtgggcgtcaacctccggtcgtcctcaggcacagaggcccttgtcttttgatctagccagtaccaaaaaaacagcgccaccatggacgcgatcaagaagaaaatgcaagcgatgaagcttgaaaaagacaatgcggctgataaagccgatgcgatggaaggtcaatacaaagacgccaacggtcgtgctgaaaaggtcaatgaggaagtacgtgatcttgaaaagaaactctctcaagttgaaaatgacctcaccaccaacaaaaatgccttagaaaatgccaaccaacaacttgaaaacaaagaaaaacaattaactcaggctgaatctgaagtagcctctcttaaccgtaaagtacaacttattgaagaagacttggaaagatccgaggaacgtntgggcacagcntacactaaattggctgaagcttcccaagctgccga

SEQ ID NO: 1209 - DNA, 441 bp, Diabrotica virgifera
  unsure (1)..(441): unsure at all n locations
  Clone ID: LIB150-047-Q1-E1-B10
acgtcaacctccggtcgtcctcaggcacagaggcccttgtcttttgatctagccagtaccaaaaaaacagcgccaccatggacgcgatcaagaagaaaatgcaagcgatgaagcttgaaaaagacaatgcggctgataaagccgatgcgatggaaggtcaatacaaagacgccaacggtcgtgctgaaaaggtcaatgaggaagtacgtgatcttgaaaagaaactctctcaagttgaaaatgacctcaccaccaacaaaaatgccttagaaaatgccaaccaacaacttgaaaacaaagaaaaacaattaactcaggctgaatctgaagtagcctctcttaaccgtaaagtacaacttattgaagaagacttggaaagattcgaggaacgtntgggcacagcttacactaaattggctgaagcttcccaagctgccgatg

SEQ ID NO: 1210 - DNA, 402 bp, Diabrotica virgifera
  unsure (1)..(402): unsure at all n locations
  Clone ID: LIB150-047-Q1-E1-B4
tcgtcctcaggcacanaggcccttgtcgtttgatctagccagtaccaaggaaacagcgccaccatggacgcgatcaagaagaaaatgcaagcgatgaagcttgaaaaagacaatgcggctgataaagccgatgcgatggaaggtcaatacaaagacgccaacggtcgtgctgaaaaggtcaatgatgaagtacgtgatcttgaaaagaaactctctcaagttgaaaatgacctcaccaccaacaaaaatgccttagaaaatgccaaccagcaacttgaaaacagagaataacaattaactcaggctgaatctgaagtagcctctcttaaccgtacagtacaacttattgaagaagacttggaaagatccgaggaacgtctgggcacagctaccactaaattg

SEQ ID NO: 1211 - DNA, 420 bp, Diabrotica virgifera
  Clone ID: LIB150-010-Q1-E2-C7
aatccgcacacgcgtccgggacgcttgtagcttttaggacagcgtcaacctccggtcgtcctcaggcacagaggcccttgtcttttgatctagccagtaccaaaaaaacagcgccaccatggacgcgatcaagaagaaaatgcaagcgatgaagcttgaaaaagacaatgcggctgataaagccgatgcgatggaaggtcaatacaaagacgccaacggtcgtgctgaaaaggtcaatgaggaagtacgtgatcttgaaaagaaactctctcaagttgaaaatgacctcaccaccaacaaaaatgccttagaaaatgccaaccaacaacttgaaaacaaagaaaaacaattaactcaggctgaatctgaagtagcctctcttaaccgtaaagtacaacttattgaagaagacctgggaag

SEQ ID NO: 1212 - DNA, 411 bp, Diabrotica virgifera
  Clone ID: LIB149-004-Q1-E1-C4
aacagtcgtcctcaggcacagaggcccttgtcttttgatctagccagtaccaaaataacagcgccaccatggacgcgatcaagacgaaaatgcaagcgatgaagcttgacaaagacaatgcggctgataaagccgatgcaatggaaggtcaatacaaagacgcaaacggtcgtgctgaaaaggtcaatgaggaattacgtgatcttgaaaagaaatccgcccaggttgaaaatgacctcaccatcaacaaaaatgccttagaaaatgccaaccaacagcttgaaaacaaagaaaaacaattaactcaggctgaatctgaagtagcctctcttaaccgtaaagtacaacttattgaagaagacttggaaagatccaaggaacgtttgggcacagctaccactaaattggctg

SEQ ID NO: 1213 - DNA, 305 bp, Diabrotica virgifera
  Clone ID: pGUT2955
gatttatattaacagaggcccttgtcttttgatctagccagtaccaaaaaaacagcgccaccatggacgcgatcaagaaagaaaatgcaagcgatgaagcttgaaaaagacaatgcggctgataaagccgatgcgatggaaggtcaatacaaagacgccaacggtcgtgctgaaaaggtcaatgaggaagtacgtgatcttgaaaagaaactctctcaagttgaaaatgacctcaccaccaacaaaaatgccttagaaaatgccaaccaacaacttgaaaaaaaaaaaaaaaaaactcggggggg

SEQ ID NO: 1214 - DNA, 456 bp, Diabrotica virgifera
  Clone ID: LIB150-043-Q1-E1-F11
tcgccggtcgatacaagccactaaactgacgtcctgatattgtgaacgttttatttgaggaaatttaatttcataagccatggctcgtacgaagcagactgcacgtaaatcaacaggaggaaaagctccccgtaaacagcttgccaccaaagctgcaagaaaatcagcaccctcaaccggaggtgtgaagaagccacatcgttaccgtcctggtacagtagctctgagagaaatcagaagataccaaaaatccactgagttgttgatcagaaagttgcctttccaacgattagtaagagaaattgcccaggacttcaaaactgatctccgtttccagtctgccgctattggtgctttacaggaagccagcgaagcctacttagtaggtctctttgaagacacaaacttgtgcgccattcacgcaaagagggtaaccattatgcccaaaagatatcc

SEQ ID NO: 1215 - DNA, 404 bp, Diabrotica virgifera
  Clone ID: LIB150-047-Q1-E1-A7
acggacgcgtgggcgaggttgtaggtatcgataaattttgtgaacgttttatttgaggaaatttaatttcataagccatggctcgtacgaagcagactgcacgtaaatcaacaggaggaaaagctccccgtaaacagcttgccaccaaagctgcaagaaaatcagcaccctcaaccggaggtgtgaagaagccacatcgttaccgtcctggtacagtagctctgagagaaatcagaagataccaaaaatccactgagttgttgatcagaaagttgcctttccaacgattagtaagagaaattgcccaggacttcaaaactgatctccgtttccagtctgccgctattggtgctttacaggaagccagcgaagcctacttagtaggtctctttgaagacacaaac

SEQ ID NO: 1216 - DNA, 407 bp, Diabrotica virgifera
  Clone ID: LIB150-043-Q1-E1-E5
aaccacgcgtccgcaccgaggttgtaggtatcgataaattttgtgaacgttttatttgaggaaatttaatttcataagccatggctcgtacgaagcagactgcacgtaaatcaacaggaggaaaagctccccgaaaacagcttgccaccaaagctgcaagaaaatcagcaccctcaaccggaggtgtgaagaagccacatcgttaccgtcctggtacagtagctctgagagaaatcagaagataccaaaaatccactgagttgttgatcagaaagttgcctttccaacgattagtaagagaaattgcccaggacttcaaaactgatctccgtttccagtctgccgctattggtgctttacaggaagccagcgaagcctacttagtaggtctctttgaagacacaaac

SEQ ID NO: 1217 - DNA, 392 bp, Diabrotica virgifera
  Clone ID: LIB150-047-Q1-E1-A8
tacaaaactctatagtgagtcgtattaggttgtatgtatcgataaattttgtgaacgtattagatgaggaaatttaatttcataagccatggctcgtacgaagcagactgcacgtagatcaacaggaggaaaagctccccgtaaacagcttgggaccaaagctgcaagagaatcagcaccctcaaccggaggtgtgaagaagccacatcgttaccgtcctggtacagtagctctgagagaaatcagaagataccagaaatccactgagttgttgatcagaaagttgcctttccaacgattagtaagagaaattgcccaggacttcagaactgatctccgtttcaactctgccgctattggtgctttacaggaagccagcgtaacctacgtag

SEQ ID NO: 1218 - DNA, 416 bp, Diabrotica virgifera
  Clone ID: LIB150-042-Q1-E1-E6
cgcgcgtcgacccacgcgaccacaccgaggttgtacgtatcgataaattttgtgaacgttttatttgaggaaatttaatttcataagccatggctcgtacaaagcagactgcacgtaaagcaacaggaggaaaagctccccgtaaacagcttgccacgaaagctgcaagaaaatcagcacactcaaccggaggtgtgaagaagccatatcgttaccgtcctggtacagtagcactgagagaaatcagaagataccaaaaatccactgagttgttgatcagaaagttgcctttccaacgattaataagataaattgcccaggacgtcaaaactgatgtccgtttccagtctgccactattggtgcgttacaggatgccagctatgcctacatagtaagtctctttgaatacacctac

SEQ ID NO: 1219 - DNA, 364 bp, Diabrotica virgifera
  unsure (1)..(364): unsure at all n locations
  Clone ID: LIB150-033-Q1-E1-F12
gcgggtcgatacaagactctaaactgacgtcgtactaagttgtangtatcgataaattttgtgaacgttttatttgaggaaatttaatttcataagccatggctcgtacgaagcagactgcacgtaaatcaacaggaggaaaagctccccgaaaacagcttgccaccaaagctgcaagaaaatcagcaccctcaaccggaggtgtgaagaagccacatcgttaccgtcctggtacagtagctctgagagaaatcagaagataccaaaaatccactgagttgttgatcagaaagttgcctttccaacgattagtaagagaaattgcccaggacttcaaaactgatctccgtttccagtctgccgc

SEQ ID NO: 1220 - DNA, 654 bp, Diabrotica virgifera
  Clone ID: pGUT1456
tcggcacgagattttgtgaacgttggatttgaggaaatttaatttcatgagccatggctcgtacgaagcagactgcacgtccatcaacaggaggaaaagctatccgaataccgcttgccaccaaagcctgccgagaatcatcactctcaaccggaagtgcgaagaagccacatcgttaccgtgctggcacagtagctctgagagaaatcagaggataccacacatgcactgaggtgatgatcataaagtagactttccaacgatccagttgagaatatggcaggacttcaaaactgatctacgtttccagtctaccgctattggagctatacaagcaaccagcgaaccctacttagaatgacgctttgaagacacaaacttgtgcgccattcacgcatagagggtgaccattatgcccaaagattgcacctggctcggccaatcagaggagaaagagcttaaatcctccctttctgagtccttcaagcaactatggtgcttcatattcattgtagattttttcagttctttcatacattgataaatatatattccagctgtgtgtggtcagtgaaatacttatttatggtttcttggcggttcattgtgagacagagcatgggtttatataaaagatatcaattccacttcttc

SEQ ID NO: 1221 - DNA, 426 bp, Diabrotica virgifera
  Clone ID: LIB149-011-Q1-E1-C11
accacgcgtccgcccacgcgtccgcaagaattgaaaatcatcggagcctttggtctccgaaacaaacgtgaagtatggagagtaaaatacactctagccaaaatccgtaaggccgccagagaactgcttactctagaagagaaagaacccaaaaggttgtttgaaggtaatgcactcctacgtcgtttggttcgtattggagtactagacgagaacagaatgaagctcgattacgtattgggtctcaagattgaagatttcttggaaagacgtctgcaaacacaagtcttcaaatctggtctagctaagtcaatccatcatgctagggtattgatcagacaacgacacattcgggtccgcaaacaagttgtgaacattccctccttcatcgtccgtttggattcacaaaaacacatcgacttctct

SEQ ID NO: 1222 - DNA, 459 bp, Diabrotica virgifera
  Clone ID: LIB150-030-Q1-E1-E9
gtcattttatgttcagaggttgaaaataaaacctcaaaatggtaaacggtaggataccgtcggttcattctaaaacctatgtaacgcctaggcgtccatatgagaaggcccgtttagatcaagaattgaaaatcatcggagcctttggtctccgaaacaaacgtgaagtatggagagtaaaatacactctagccaaaatccgtaaggccgccagagaactgcttactctagaagagaaagaacccaaaaggttgtttgaaggtaatgcactcctacgtcgtttggttcgtattggagtactagacgagaacagaatgaagctcgattacgtattgggtctcaagattgaagatttcttggaaagacgtctgcaaacacaagtcttcaaatctggtctagctaagtcaatccatcatgctagggtattgatcagacaacgacacattcgggtccgcaaac

SEQ ID NO: 1223 - DNA, 380 bp, Diabrotica virgifera
  Clone ID: LIB149-006-Q1-E1-A6
actccgaaacaaacgtgaagtatggagagtaaaatacactctagccaaaatccgtaaggccgccagagaactgcttactctagaagagaaagaacccaaaaggttgtttgaaggtaatgcactcctacgtcgtttggttcgtattggagtactagacgagaacagaatgaagctcgattacgtattgggtctcaagattgaagatttcttggaaagacgtctgcaaacacaagtcttcaaatctggtctagctaagtcaatccatcatgctagggtattgatcagacaacgacacattcgggtccgcaaacaagttgtgaacattccctccttcatcgtccgtttggattcacaaaaacacatcgacttctctctgaaat

SEQ ID NO: 1224 - DNA, 471 bp, Diabrotica virgifera
  Clone ID: LIB150-016-Q1-E1-H6
gccacccacgagtccgtagaaatcagtctttttatgttcagaggttgaaaataaaacctcaaaatggtaaacggtaggataccgtcggttcattctaaaacctatgtaacgcctaggcgtccatatgagaaggcccgtttagatcaagaattgaaaatcatcggagcctttggtctccgaaacaaacgtgaagtatggagagtaaaatacactctagccaaaatccgtaaggccgccagagaactgcttactctagaagagaaagaacccaaaaggttgtttgaaggtaatgcactcctacgtcgtttggttcgtagtggagtactagacgagaacagaatgaagctcgattacgtattgggtctcaagattgaagatttcttggaaagacgtctgcaaacacaagtcttcatatctggtctagctaagtcaatccatcatgctagggtattgatcagacaacgacacatt

SEQ ID NO: 1225 - DNA, 416 bp, Diabrotica virgifera
  Clone ID: pGUT2407
ctcgtgccgaatcggcacgaggctcgattacgtattgggtctcaagattgaagatttcttggaaagacgtctgcaaacacaagtcttcaaatctggtctagctaagtcaatccatcatgctagggtattgatcagacaacgacacattcgggtccgcaaacaagttgtgaacattccctccttcatcgtccgtttggattcacaaaaacacatcgacttctctctgaaatcacctttgggaggcggtcgtccaggacgtgttaagaggaagaacctcaccaagaagagcggtggtggaggtgcagctgaagaagaggaagactaagctgtatgtcgtgctagttgtactagtacttacatattaatatacttatgtattaagttaaaaaaaaaacataaaaaaaaactcagggggg

SEQ ID NO: 1226 - DNA, 271 bp, Diabrotica virgifera
  unsure (1)..(271): unsure at all n locations
  Clone ID: pGUT329
cactcctacgtcgtttggttcgtattggagtactaaacgagaacagaatgaagctcgattacgtattgggtctcaagattgaagatttcttggagagacgtctgcaaacacaagtcttcaaatctggtctagctaagtcaatccatcatgctagggtattgatcagacaacgacacattcgggtccgcaaacaagttgtgaacattccctccttcatcgtccgtntggattcacaaaaacacatcgacttctctctganatcacctttggg

SEQ ID NO: 1227 - DNA, 286 bp, Diabrotica virgifera
  unsure (1)..(286): unsure at all n locations
  Clone ID: pGUT305
cactcctacgtcgtttggttcgtattggagtactaaacgagaacagaatgaagctcgatgacgtattgggtctcacgatcgaagatttcttggaaagacgtctgcaaacacgagtcttcaaatctggtctagctaagtcaatccatcatgctagggtattgatcagacaacgacacattcgggtccgcaaacaagttgtgaacattccctccttcatcgtccgtntggatgcacaaaaacacatcgacttctctctganatcacctttgggatgcggtcgtccagg

SEQ ID NO: 1228 - DNA, 368 bp, Diabrotica virgifera
  Clone ID: LIB3026-018-Q1-E1-D5
acgcattaatatataagtattttatatagaattaattcaaaatgccacccaagttcgatcccaccgaaattaaatatgtttacatgagatgtgtcggaggagaagttggagctacctcttctttggctcctaaaattggtcctctaggtttgtctcccaaaaaagttggtgacgatattgccaaaggtactgctgactggaaaggtcttaaaatcacagttcagttgaaaatccaaaatcgtcaagctaccatttctgtagtcccatctgcctcctccctgatcattagggctcttaaagaaccaccacgcgataggaagaagcaaaagaacattaaacacactggtaacattactttcgatgaaatc

SEQ ID NO: 1229 - DNA, 387 bp, Diabrotica virgifera
  unsure (1)..(387): unsure at all n locations
  Clone ID: LIB150-032-Q1-E1-A1
gcgtagaatcgccattaatatataagtattttatatagaattaattcaaaatgccacccaagttcgatcccaccgaaattaaatatgtttacatgagatgtgtcggangagaagttggagctacctcttctttggctcctaaaattggtcctctaggtttgtctcccaaaaaagttggtgacgatattgccaaaggtactgctgattggaaaggtcttaaaatcacagttcaattgaaaatccaaaatcgtcaagctaccatttctgtagtcccatctgcttcctccctgatcattagggctcttaaagaaccaccacgcgataggaagaagcaaaagaacattaaacacactggtaacattactttcgatgaaatcatcgctattg

SEQ ID NO: 1230 - DNA, 418 bp, Diabrotica virgifera
  unsure (1)..(418): unsure at all n locations
  Clone ID: LIB150-043-Q1-E1-D7
aatgaaaatattttcactattgtaaaaatctgtaaacatcggcgtagaatcgccattaatatataagtattttatatagaattaattcaaaatgccacccaagttcgatcccaccgaaattaaatatgtttacatgagatgtgtcggaggagaagttggagctacctcttctttggctcctaaaattggtcctctaggtttgtctcccaaaaaagttggtgacgatattgccaaaggtactgctgattggaaaggtcttaaaatcacagttcaattgaaaatccaaaatcgtcaagctaccatttctgtagtcccatctgcttcctccctgatcattagggctcttaaagaaccaccacgcgataggaagaagcanaagaacattaaacacactggtaacattactttcgatgaaatc

SEQ ID NO: 1231 - DNA, 388 bp, Diabrotica virgifera
  unsure (1)..(388): unsure at all n locations
  Clone ID: LIB149-020-Q1-E1-B2
aaaatattttcactattgtaaaaatctgtaaacatcggcgtagaatcgccattaatatataagtattttatatagaattaattcaaaatgccacccaagttcgatcccaccgaaattaaatatgtttacatgagatgtgtcggaggagaagttggagctacctcttctttggctcctaaaattggtcctctaggtttgtctcccaaaaaagttggtgacgatattgccaaaggcactgctgactggaaaggtcttaaaatcacagttcagttgaaaatccaaaatcgtcaagctaccatttctgtagtcccatctgcctcctccctgatcattanggctcttaaagaaccaccacgcgataagaagaagcaaaagaacattaaacaca

SEQ ID NO: 1232 - DNA, 392 bp, Diabrotica virgifera
  unsure (1)..(392): unsure at all n locations
  Clone ID: LIB149-020-Q1-E1-G4
atgaaaatattttcactattgtaaaaatctgtaaacatcggcgtagaatcgccattaatatataagtattttatatagaattaattcaaaatgccacccaagttcgatcccaccgaaattaaatatgtttacatgagatgtgtcggaggagaagttggagctacctcttctttggctcctaaaattggtcctctaggtttgtctcccaaaaaagttggtgacgatattgccaaaggtactgctgattggaaaggtcttaaaatcacagttcaattgaaaatccaaaatcgtcaagctaccatttctgtagtcccatctgcttcctccctgatcattanggctcttaaagaaccaccacgcgataagaagaagcaaaagaacattaaacacac

SEQ ID NO: 1233 - DNA, 414 bp, Diabrotica virgifera
  unsure (1)..(414): unsure at all n locations
  Clone ID: LIB149-034-Q1-E1-C12
actcgcgggtcgatacaagcctcaacacagacgtcctgtgaaaaggtcttaaaatcacagttcaattgaaaatccaaaatcgtcaagctaccatttctgtagtcccatctgcttcctccctgatcattagggctcttaaagaaccaccacgcgataggaagaagcaaaagaacattaaacacactggtaacattactttcgatgaaatcatcgctattgccagacagatgaggcccaggtcgatggccaaacagttatccggaactgtaaaagaggttttaggaacagcccaatcagttggatgtacaattgatggtaaagcagcacatgatgttattgacgaggttaatgaaggaaccatagaagtaccagatgaataaactattattagaatattttttctaagtanaaaaa

SEQ ID NO: 1234 - DNA, 420 bp, Diabrotica virgifera
  unsure (1)..(420): unsure at all n locations
  Clone ID: LIB150-036-Q1-E1-E10
tcgcgggtcgacacaagcctctataatgagtccatctaatgtaaaaatctgtaaacatcggcgtagaatcgccattaatatataagtattttatatagaattaattcaaaatgccacccaagttcgatcccaccgaaattaaatatgtttacatgagatgtgtcggaggagaagttggagctacctcttctttggctcctaaaattggtcctctaggtttgtctcccaaaaaaagttggtgacgatattgccaaaggtactgctgattggaaaggtcttaaaatcacagttcaattgaaaatccaaaatcgtcaagctaccatttctgtagtcccatctgcttcctccctgatcattanggctcttanagaaccaccacgcgataggaagaancaaaagaacaataaacacactgggaac

SEQ ID NO: 1235 - DNA, 407 bp, Diabrotica virgifera
  Clone ID: LIB150-034-Q1-E1-F7
atacaagctctctttagagaggtgtggacatgaaataaatctaaaaaaatacaaagcatcccaaaagaaacgtactttaaacaaaagtttaaaaaatgggccggtacgcacgtgagccagaaaatgctgcaaaatcttgtaaagctaaaggttcaaacttaagagtacactttaagaacacatgtgaaactgcaaatgcaataaggaagatgcccctcaaaagggccgtagcatatttaaagaatgtaattattcagaaggagtgtattccatttagaaggtttaatggtggagtaggtcgttgtgcccaagcaaaacaatttggtaccactcagggaagatggcctaaaaagtcagcagagtttcttttacaactcttgagaaatgctgaaagcaatgcagattac

SEQ ID NO: 1236 - DNA, 400 bp, Diabrotica virgifera
  Clone ID: LIB150-036-Q1-E1-B3
ctttagagaggtgtggacatgaaataaatctaaaaaaatacaaagcatcccaaaagaaacgtactttaaacaaaagtttaaaaaatgggccggtacgcacgtgagccagaaaatgctgcaaaatcttgtaaagctaaaggttcaaacttaagagtacactttaagaacacatgtgaaactgcaaatgcaataaggaagatgcccctcaaaagggccgtagcatatttaaagaatgtaattattcagaaggagtgtattccatttagaaggtttaatggtggagtaggtcgttgtgcccaagcaaaacaatttggtaccactcagggaagatggcctaaaaagtcagcagagtttcttttacaactcttgagaaatgctgaaagcaatgcagattacagtg

SEQ ID NO: 1237 - DNA, 425 bp, Diabrotica virgifera
  Clone ID: LIB150-024-Q1-E1-A10
acaacacacgcctgctaacgcgtccgctctttagagaggtgtggacatgaaataaatctaaaaaaatacaaagcatcccaaaagaaacgtactttaaacaaaagtttaaaaaatgggccggtacgcacgtgagccagaaaatgctgcaaaatcttgtaaagctaaaggttcaaacttaagagtacactttaagaacacatgtgaaactgcaaatgcaataaggaagatgcccctcaaaagggccgtagcatatttaaagaatgtaattattcagaaggagtgtattccatttagaaggtttaatggtggagtacgtcgttgtgcccaagcaaaacaatttggtaccactcagggaagatggcctaaaaagtcagcagagtttcttttacaactcttgagaaatgctgaaagcaatgcagattaca

SEQ ID NO: 1238 - DNA, 423 bp, Diabrotica virgifera
  Clone ID: LIB3026-035-Q1-E1-C10
gtaattattcagaaggagtgtattccatttaaaaggtttaatggtggagtaggtcgttgtgcccaagcaaaacaattgtggtaccactcagggaagatggcctaaaaagtcagcagagtttcttttacaactcttgagaaatgctgaaagcagtgcaaattacagtggacccgaggtagacagattagtagtagaacatattcaggtaaacagagctgcttgtttgaggcgtcgtacatacagagcccatggtatgattaaaccttacatgtcgtcaccttgccatatcgaattatggttaactgaaggagaatcctcacaagatgctcccaaaaaagcttcacagagtaagaaatcaacccttgacagagtgaagagaccaaaagcaactccagctgtgacccattaaatgttcttactgtc

SEQ ID NO: 1239 - DNA, 379 bp, Diabrotica virgifera
  Clone ID: LIB3026-019-Q1-E1-H10
agcccacgcgtccgaaactctctttagagaggtgtggacatgaaataaatctaaaaaaatacaaagcatcccaaaagaaacgtactttaaacaaaagtttaaaaaatgggccggtacgcacgtgagccagaaaatgcggcaaaatcttgttaagctaaaggttcaaacttaagagtacactttaagaacacatgtgaaactgcaaatgcaataaggaagatgcccctcaaaagggccgtagcatatttaaagaatgtaattattcagaaggagtgtattccatttagaaggtttaatggtggagtaggtcgttgtgcccaagcaaaacaatttggtaccactcagggaagatggcctaaaaagtcagcagagtttcctt

SEQ ID NO: 1240 - DNA, 355 bp, Diabrotica virgifera
  Clone ID: LIB149-019-Q1-E1-C8
agtcatcttttcattcctttttgtaaaaaaattgtcacgttttaggtgatagtttatagaaatcaagaaaataaacaaaagttatcaaaatgggtcgatatgcacgtgaacccgaaaatgctgcaaaaacctgcaaagctaaaggttcaaacttgagagtacattttaagaacacatgtgagactgcaaatgcaatcaaaaagatgcccctcaaaagagctgtagcctatttaaagaatgtagtaatccagaaggaatgtattccatttagaagattcaatggtggagttggtaggtgttctcaagctaaacagtttggtactactcaaggaaggtggcccaaaaaatcagcaga

SEQ ID NO: 1241 - DNA, 284 bp, Diabrotica virgifera
  unsure (1)..(284): unsure at all n locations
  Clone ID: pGUT3818
ctttagagaggtgtggacatgaaataaatctaaaaaaatacaaagcatcccanaagaaacgtactttanacaaaagtttanaaaatgggccggtacgcacgtgagccagaaaatgctgcaaaatcttgtaaagctaaaggttcaaacttaagagtacactntaagaacacatgtgagactgcaaatgcaataaggaagatgcccctcanaagggccgtagcatatttaaagaatggtattattcagaaggagtgtattccatttagaaggtttaatggtggagt

SEQ ID NO: 1242 - DNA, 454 bp, Diabrotica virgifera
  Clone ID: LIB3026-012-Q1-E1-A12
gaaaaactctgctatgtagctttggacttcgaacaagaaatggcaacagctgctagttccagttcccttgaaaagagttatgaacttcctgatggacaagtcatcaccattggtaatgaaagattccgttgcccagaagctctcttccaaccatccttcttgggtatggaagctgctggtattcatgaaacaacctacaattccatcatgaagtgtgatgttgaaatccgtaaggacctatatgccaagactgtactctctggaggtaccaccatgtaccctggtattgctgatagaatgcagaatgaaatcactgccttggctcctagcacaatgaagattaagatcatcgccccaccagaaagaaaatactctgtatggatcggtggttccattttggcctctctatccaccttccagcagatgtggatttccaaacaagaatatgatgaat

SEQ ID NO: 1243 - DNA, 431 bp, Diabrotica virgifera
  Clone ID: LIB150-023-Q1-E1-C9
aaagatattaaagaaaaactctgctatgtagctttggacttcgaacaagaaatggcaacagctgctagttccagttcccttgaaaagagttatgaacttcctgatggacaagtcatcaccattggtaatgaaagattccgttgcccagaagctctcttccaaccatccttcttgggtatggaagctgctggtattcatgaaacaacctacaattccatcatgaagtgtgatgttgatatccgtaaggacctataggccaacactgtactctctggaggtaccaccatgtaccctggtattgctgatagaatgcagaaagaaatcactgccttggctcctagcacaatgaagattaagatcatcgccccaccagaaagaaaatactctgtatggatcggtggttccattttggcctctctatccaccttcca

SEQ ID NO: 1244 - DNA, 410 bp, Diabrotica virgifera
  Clone ID: LIB150-050-Q1-E1-A5
agaaattgttagagatattaaagaaaaactctgctatgtagctttggacttcgaacaagaaatggcaacagctgctagttccagttcccttgaaaagagttatgaacttcctgatggacaagtcatcaccattggtaatgaaagattccgttgcccagaagctctcttccaaccatccttcttgggtatggaagctgctggtattcatgaaacaacctacaattccatcatgaagtgtgatgttgatatccgtaaggacctatatgccaacactgtactctctggaggtaccaccatgtaccctggtattgctgatagaatgcagaaagaaatcactgccttggctcctagcacaatgaagattaagatcatcgccccaccagaaagaaaatactctgtagggatcggtg

SEQ ID NO: 1245 - DNA, 403 bp, Diabrotica virgifera
  Clone ID: LIB149-045-Q1-E1-D4
tctatgaaggttatgctcttcctcatgcaatccttcgtttggacttagctggtagagacttgactgattacctcatgaaaattttgactgaacgtggctactctttcaccaccacagcagaaagagaaattgttagagatattaaagaaaaactctgctatgtagctttggacttcgaacaagaaatggcaacagctgctagttccagttcccttgaaaagagttatgaacttcctgatggacaagtcatcaccattggtaatgaaagattccgttgcccagaagctctcttccaaccatccttcttgggtatggaagctgctggtattcatgaaacaacctacaattccatcatgaagtgtgatgttgatatccgtaaggacctatatgccaacactgtact

SEQ ID NO: 1246 - DNA, 433 bp, Diabrotica virgifera
  Clone ID: LIB3026-031-Q1-E1-B12
acggagaaattgttagagatattaaagaaaaactctgctatgtagctttggacttcgaacaagaaatggcaacagctgctagttccagttcccttgaaaagagttatgaacttcctgatggacaagtcatcaccattggtaatgaaagattccgttgcccagaagctctcttccaaccatccttcttgggtatggaagctgctggtattcatgaaacaacctacaattccatcatgaaattgtgatgttgatatccgtaaggacctatatgccaacactgtactctctggaggtaccaccatgtaccctggtattgctgatagaatgcagaaagaaatcactgccttggctcctagcacaatgaagattaagatcatcgccccaccagaaagaaaatactctgtatggatcggtggttccattttggcctctc

SEQ ID NO: 1247 - DNA, 406 bp, Diabrotica virgifera
  Clone ID: LIB149-027-Q1-E1-A6
tccagggtccacaacgcgtccgagcaacagctgctagttccagttcccttgaaaagagttatgaacttcctgatggacaagtcatcaccattggtaatgaaagattccgttgcccagaagctctcttccaaccatccttcttgggtatggaagctgctggtattcatgaaacaacctacaattccatcatgaagtgtgatgttgatatccgtaaggacctatatgccaacactgtactctctggaggtaccaccatgtaccctggtattgctgatagaatgcagaaagaaatcactgccttggctcctagcacaatgaagattaagatcatcgccccaccagaaagaaaatactctgtatggatcggtggttccattttggcctctctatccaactttcaacaaat

SEQ ID NO: 1248 - DNA, 389 bp, Diabrotica virgifera
  Clone ID: LIB149-032-Q1-E1-D5
aggattccgttgcccagaagctctcttccaaccatccttcttgggtatggaagctgctggtattcatgaaacaacctacaattccatcatgaagtgtgatgttgatatccgtaaggacctatatgccaacactgtactctctggaggtaccaccatgtaccctggtattgctgatagaatgcagaaagaaatcactgccttggctcctagcacaatgaagattaagatcatcgccccaccagaaagaaaatactctgtatggatcggtggttccattttggcctctctatccaccttccaacaaatgtggatttccaaacaagaatatgatgaatctggtccatccatcgtccacagaaaatgcttctaatttgtttttgtccgcattt

SEQ ID NO: 1249 - DNA, 440 bp, Diabrotica virgifera
  Clone ID: LIB149-008-Q1-E1-D2
ggcagaaggtcttattgacaccaaaatccgaataatccacagaaatgagaatctacaaagacattttcacaggggacgagatgttttccgatacctacaaaatgaagttagtggatgaagtaatctacgaagtctatggaaagctcatccaacgtaaacaaggagacatccaactcgatggagctaacccttctgccgaagaagccgatgaaggtactgaagctggtgtagaatctggtgttgatatagtactcaatcacagattatgtgaaacatacgcctttggagacaagaaatcttacaccgcatatctcaaggaatatatgaaaaaactagtagaaaaattacaagagagatcacccgaccaagtagacgttttcaaatccaacatgaacaaagtattgaaagacatcctatgaaggtttaaagaactccaattc

SEQ ID NO: 1250 - DNA, 397 bp, Diabrotica virgifera
  Clone ID: LIB149-046-Q1-E1-H2
tgaaaccaaaaaccgaataatccacaaaaatgagaatctacaaagacattttcacaggggacgagatgttttccgatacctacaaaatgaagttagtggatgaagtaatctacgaagtctatggaaagctcatccaacgtaaacaaggagacatccaactcgatggagctaacccttctgccgaagaagccgatgaaggtactgaagctggtgtagaatctggtgttgatatagtactcaatcacagattatgtgaaacatacgcctttggagacaagaaatcttacaccgcatatctcaaggaatatatgaaaaaactagtagaaaaattacaagagagatcacccgaccaagtagacgttttcaaatccaacatgaacaaagtaatgaaagacat

SEQ ID NO: 1251 - DNA, 437 bp, Diabrotica virgifera
  Clone ID: LIB150-049-Q1-E1-H2
gggccgacccacgcgtcaacccacgcgtccgagaaggtcttattgacaccaaaatccgaataatccacaaaaatgagaatctacaaagacattttcacaggggacgagatgttttccgatacctacaaaatgaagttagtggatgaagtaatctacgaagtctatggaaagctcatccaacgtaaacaaggagacatccaactcgatggagctaacccttctgccgaagaagccgatgaaggtactgaagctggtgtagaatctggtgttgatatagtactcaatcacagattatgtgaaacatacgcctttggagacaagaaatcttacaccgcatatctcaagggatatatgaaaaaactagtagaaaaattacaagagagataacctgaccaagtagacgttttcaaatccaacatgaacaaaagtgatgaaag

SEQ ID NO: 1252 - DNA, 413 bp, Diabrotica virgifera
  unsure (1)..(413): unsure at all n locations
  Clone ID: LIB150-038-Q1-E1-H8
ttgcataacgtcttatttgacaccaanatccgagtaatccacaagaatgagaatctacatagacattttcacaggggacgagatgttttccgatacctacaaaatgaagttagtggatgaagtaatctacgaagtctatggaaagctcatccaacgtaaacaaggagacatccaactcgatggagctaacccttctgccgaagaagccgatgaaggtactgaagctggtgtagaatctggtgttgatatagtactcaatcacagattatgtgaaacatacgcctttggagacaagaaatcttacaccgcatatctcaaggaatatatgaaaaaactagtagaaaaattacaagagagatcacccgaccaagtagacgttttcaaatccaacatgaacaaagtaatgaaagaca

SEQ ID NO: 1253 - DNA, 400 bp, Diabrotica virgifera
  Clone ID: LIB3026-020-Q1-E1-A8
gacgcagaaggtctatattgacaccaaaatccgaataatccacaaaaatgagaatctacaaagacattttcacaggggacgagatgttttccgatacctacaaaatgaagttagtggatgaagtaatctacgaagtctatggaaagctcatccaacgtaaacaaggagacatccaactcgatggagctaacccttctgccgaagaagccgatgaaggtactgaagctggtgtagaatctggtgttgatatagtactcaatcacagattatgtgaaacatacgcctttggagacaagaaatcttacaccgcatatctcaaggaatatatgaaaaaactagtagaaaaattaccacgagagatcacctgaccaagttagacgtgttcaaatccaacatgaac

SEQ ID NO: 1254 - DNA, 355 bp, Diabrotica virgifera
  unsure (1)..(355): unsure at all n locations
  Clone ID: LIB149-029-Q1-E1-H9
ctgcgctctcaaggcagaaggtcttattgacaccaaaatccgaataatccacaaaaatgagaatctacaaagacattttcacaggggacgagatgttttccgatacctacaaaatgaagttagtggatgaagtaatctacgaagtctatggaaagctcatccaacgtaaacaaggagacatccaactcgatggagctaacccttctgccgaagaagccgatgaaggtactgaagctggtgtagaatctggtgttgatatagtactcaatcacagattatgtgaaacatacgcctttggagacaagaaatcttacacggcatatctcaaggaatatatganaaaactagtagaaaa

SEQ ID NO: 1255 - DNA, 238 bp, Diabrotica virgifera
  Clone ID: LIB149-015-Q1-E1-C10
gtcggcaaacacgtctggtaatagtgacaccataatccgaataatccacaaaaatgagaatctagatagacattttcacaggggacgagatgttttccgatacgtacaaaatgaagttagtggatgaagtactctacgaagtccatggaaagctcatccaacgtaaacagcgagacatccaactcgatggagctaagccttctgccgaacaagccgatgaaggtacagaaactggtgt

SEQ ID NO: 1256 - DNA, 411 bp, Diabrotica virgifera
  Clone ID: LIB149-033-Q1-E1-A4
acagaatctgtttcgtcaagatcctcattaaaatacatataaaaatggcttttggaaatttaaaaacagaaaagggatttaaggagctcaactccttcctagaagacaaaagctatgttggaggctatatcttaagccaagccgatgtaaacgctttcaatcagcttccaaaagctccagctgccaatttaccccatgctttacgttggtacaatcacatcaaatctttctcagctgatgagcttaaacaggccggagtctcaggtaacccttgaaatctgctctaacaacaaaacacctgcaaagatgattaccaatattaagttgatctaatttcccccgaccaagaagaagatgctgaagcagctaaagtacgtgaagaaagacttaaagcctatgcagaaaagaaat

SEQ ID NO: 1257 - DNA, 429 bp, Diabrotica virgifera
  Clone ID: LIB150-018-Q1-E1-E3
cacacgcatccgcccacgcgtccggtttcgtccagatcctcattaaaatacatataaaaatggcttttggagatttaaaaacagaaaagggagttaaggagctcaactccttcctagaagacaaaagctatgttggaggctatatcttaagccaagccgatgtaaacgctttcaatcagcttccaaaagctccagctgccaatttaccccatgctttacgttggtacaatcacatcaaatctttctcagctgatgagcttaaacaaggcggagtctcaagtaaccccttgaaatctgctcctaccaccacagcacctgccaaggatgatgacgatgatgatgttgatctatttgcctccgacgaagaagaagatgctgaagcagctaaagtacgtgaagaaagacttaaagcctatgcagaaaagaaat

SEQ ID NO: 1258 - DNA, 424 bp, Diabrotica virgifera
  Clone ID: LIB150-039-Q1-E1-E5
acccacgcgtccgaaaaaccattacatctcttgttacacaattgaaagccttggaactaagagtagctgctttggaaaaaacagacagtcagaccaaacctgtacaccaaatcaacatacagtcagtaccttcagcgaaacctgccgttaatgatgatgacgacgacgacgtcgatctttttggttcagattctgatgaagatgatgaagcagcagccaaagttagagaagatagactcaaagcatatgaagcaaaaaaatcaaaaaaacctgtattgattgccaaatccaatgtcatcttggacgtgaagccttgggatgatgagaccgacatgaaattaatggaacaacatgttagaaaggttgaagctgatggacttttatggggtgctgctaaactagtccctctagcttatggaattca

SEQ ID NO: 1259 - DNA, 342 bp, Diabrotica virgifera
  Clone ID: LIB3026-014-Q1-E1-B7
acagcatctgtttcgtccagatcctcattaaaatacatataaaaatggcttttggagatttaaaaacagaaaagggagttaaggagctcaactccttcctagaagacaaaagctatgttggaggctatatcttaagccaagccgatgtaaacgctttcaatcagcttccaaaagctccagctgccaatttaccccatgctttacgttggtacaatcacatcaaatctttctcagctgatgagcttaaacaggccggagtctcaagtaaccccttgaaatctgctcctagcagcacagcacctgccaaggatgatgacgatgatgatgttgatccatttgcct

SEQ ID NO: 1260 - DNA, 422 bp, Diabrotica virgifera
  Clone ID: LIB150-014-Q1-E1-B6
cacacgcgtccgattttttgaaaggaggtatcagcatctgtttcgtccagatcctcattaaaatacatataaaaatggcttttggagatttaaaaacagaaaagggagttaaggagctcaactccttcctagaagacaaaagctatgttggaggctatatcttaagccaagccgatgtaaacgctttcaatcagcttccaaaagctccagctgccaatttaccccatgctttacgttggtacaatcacatcaaatctttctcagctgatgagcttaaacaggccggagtctcaggtaaccccttgaaatctgctcctaccaccacagcacctgccaaggatgatgacgatgatgatgttgatctatttgcctccgacgaagaagaagatgctgaagcagctaaagtacgtgaagaaagactt

SEQ ID NO: 1261 - DNA, 322 bp, Diabrotica virgifera
  Clone ID: pGUT3805
gtccagatcctcattaaaatacatataaaaatggcttttggagatttaaaaacagaaaagggagttaaggagctcaactccttcctagaagacaaaagctatgttggaggctatatcttaagccaagccgatgtaaacgctttcaatcagcttccaaaagctccagctgccaatttaccccatgctttacgttggtacaatcacatcaaatctttctcagctgatgagcttaaacaggccggagtctcaggtaaccccttgaaatctgctcctaccaccacagcacctgccaaggatgatgacgatgatgatgttgatctat

SEQ ID NO: 1262 - DNA, 321 bp, Diabrotica virgifera
  Clone ID: pGUT3830
agtccagattctcattaaaatacatataaaaatggcttgtggagatttaaaaacagaaaagggagttaaggagctcaactccttcctaaaaaacaaaagctatgatggaggctatatcttaagccaagccgatgtaaacgctttcaatcagcttccaaaagctccagctgccaatttaccccatgctttacgttggtacaatcacatcaaatctttctcaactgatgagcttaaacaggccggagtctcaggtaaccccttgaaatctgctcctaccaccacaagaccttgccaggatgatgacgatgatgatgttgatct

SEQ ID NO: 1263 - DNA, 426 bp, Diabrotica virgifera
  Clone ID: LIB3026-010-Q1-E1-C12
aaccaattctctcaaaccattgacaaacaaacagccacccaattatttaaagtcttggaaaaatacaggcccgagacagcccttcaaaagaaaaataggttaaaggctaaggctgaagctaaggttgccaagaaagaggaggcacctgctaaaaaaccaaacacattgaaggctggtaccaatacagttactaagctgatcgaacagaaaaaagcccaattggttgttattgcacacgatgttgacccaattgagttggttctgttcctaccagccctctgcagaaaaatgggtgtcccatactgcatagttaaaggtaaagcaagacttggacttctagtaaggcgcaagacttgttcatctgtagctcttacacaagttgactctggagacaggtccaacttcaacaaacttttggaagtaatc

SEQ ID NO: 1264 - DNA, 433 bp, Diabrotica virgifera
  Clone ID: LIB150-022-Q1-E1-H12
ccacgcgtcaggcaactcgaagtgaggttgtctgtggtgtagatttaattttttaaatattataaacatcccttgaggatttaatttccaagatggtccaaaagaaacctaagaagaaggtaggaaagaaagtagctgcagctcctcttgcagtcaagaaaattgaacagaaaaaagaaattaacccactttttgaaaagaggcctagaaattttggaattggtcaggatattcaacctccccgtgatttatctcgatttgtaaaatggccaaaatacatccgtattcaaagacaaaaggctgtacttcaaaagagattgaaagttccaccaccaattaaccaattctctcaaaccattgacaaacaaacagccacccaattatttaaagtcttggaaaaatacaggcccgagacagcccttcaaaagaaaaa

SEQ ID NO: 1265 - DNA, 362 bp, Diabrotica virgifera
  Clone ID: LIB150-036-Q1-E1-G9
tcgacacaacactctacagtgagtcatattagattgaaagttcctccaccaattaaccaattctctcaaaccattgacaaacaaacagccacccaattatttaaagtcttggaaaaatacaggcccgagacagcccttcaaaagaaaaataggttaaaggctaaggctgaagctaaggttgccaagaaagaggaggcacctgctaaaaaaccaaacacattgaaggctggtaccaatacagttactaagctgatcgaacagaaaaaagcccaattggttgttattgcacacgatgttgacccaattgagttggttctgttcctaccagccctctgcagaaaaatgggtgtcccatactgcat

SEQ ID NO: 1266 - DNA, 354 bp, Diabrotica virgifera
  unsure (1)..(354): unsure at all n locations
  Clone ID: LIB149-013-Q1-E1-C4
ttaatttccaagaagggccaaaagaaacctaagaagaaaggaaggaaaaaagttaccggaactcctcctggagttcaggaaaatgtgacagaaaaaggaaattaaccaactttttgaaaagaggcctagaaatttgggaattggtcaggatattcaacctccccgtgatttatctcgatttgtaaaatggccaaaatacatccgtattcanagacaaaaggctgtacttcaaaagagattgaaagttcctccaccaattaaccaattctctcaaaccattgacaaacaaacagccacccaattatttaaagtcttggaaaaatacaggcccgagacagcccttcaaaagaaaaa

SEQ ID NO: 1267 - DNA, 318 bp, Diabrotica virgifera
  Clone ID: LIB3026-007-Q1-E1-H11
ctcaaaccattgacaaacaaacagccacccaattatttaaagtcttggaaaaatacaggcccgagacagcccttcaaaagaaaaataggttaaaggctaaggctgaagctaaggttgccaagaaagaggaggcacctgctaaaaaaccaaacacattgaaggctggtaccaatacagttactaagctgatcgaacagaaaaaagcccaattggttgttattgcacacgatgttgacccaattgagttggttctgttcctaccagccctctgcagaaaaatgggtgtcccatactgcatagttaaaggtaaagcaagac

SEQ ID NO: 1268 - DNA, 377 bp, Diabrotica virgifera
  Clone ID: LIB3026-011-Q1-E1-C3
ggatctgttcctaccagccctctgcagaaaaatgggtgtcgcatactgcatatttaaaggtaaagcaagacttggacttctagtaaggcgcaagacttgttcatctgtacctcttacacaagttgactctggagacaggtccaacttcaacaaacttttggaagtaatcaagactaacttcaacgaccgtgttgatgaaatcaggaggcactggggtggtggtttgcttggatccaaatctgctgctcgtattgctaagttagagagagccaaggctaaagaattggctcagaaacaaggttaagaggaaggttttcttgttttaataacaggactttgttataaataaatttattaagaaaaaaaaaattataaaa

SEQ ID NO: 1269 - DNA, 356 bp, Diabrotica virgifera
  unsure (1)..(356): unsure at all n locations
  Clone ID: LIB149-028-Q1-E1-G12
ttgactctatagtgagtcgtattatgctgntttgtgggtgtctcatactgcatagttagaggtaaagcaagacttggacttctagtaaggcgcatgacttgttcatctgtagctcttacacaagttgactctggagacaggtccaacttcaacaaacttttggaagtaatcaatactaacttcaacgaccgtgttgatgaaatcaggaggtactggggtggtggcttgcttggatcgaattctgctgctcgtattgctaagttgtagagagccagggttaacgaattggctcagatccaatgttaagaggaaggttttcttgttttaataacaggactttgtactaaatagattta

SEQ ID NO: 1270 - DNA, 493 bp, Diabrotica virgifera
  unsure (1)..(493): unsure at all n locations
  Clone ID: pGUT2569
ttttggccggtctacgaacatccgtaactcttgtatattcggaggtgctcccaaaggaccccaagctcgtgacctacaaaggggtattgagatctgtatcgccacacccggtcgtctcatagattttctcgaaaagggatctactaacctagagagatgtacatatttggtccttgacgaagctgacagaatgttagatatgggattcgaacctcaaattcgcaagatcctcagtcaagtcagacccgacagacaaacacttatgtggtctgctacatggcccaaagaggttaggaaattggcctccgatttcatgaagaacccagtttacatcaacataggttcaaagaacttatctgcaaataataatattgtacagttcgttgatgtctgccaggagcatgaaaaggaaaggaagttgggaagtctcttgcaagagatcaacaccaatgctgacactggctcgaaaattatcattttcgtagagaccana

SEQ ID NO: 1271 - DNA, 440 bp, Diabrotica virgifera
  Clone ID: LIB150-026-Q1-E1-H7
tgaataacctcattcaaaacttcgacgaagcaaatttccctgattacatcttgacggaagtttgcaataaggggtatgaagctccgacaccaattcaagcacaaggctggccaattgcaatgagtggtcatgatatggttggtatagcacaaacaggatctggaaaaactctagcttatatcctacctgctgcaattcatatcaacaaccaaccacctctaaataaaggggaaggaccaattgttttggtacttgctcctactagagaactggctcaacagattcaagaggtttccaatgatttttggcggtctacgaacatccgtaactcttgtatattcggaggtgctcccaaaggaccccaagctcgtgacctacaaaggggtattgagatctgtatcgccacacccggtcgtctcatagattttctcgaaaaggga

SEQ ID NO: 1272 - DNA, 442 bp, Diabrotica virgifera
  Clone ID: LIB150-014-Q1-E1-A10
gattgttgatgtctgccaggagcatgaaaaggaaaggaagttgggaagtctcttgcaagagatcaacaccaatgctgacactggctcgaaaattatcattttcgtagagaccaaaaagaaagttgaaggaataacgagatcaataagaagcattggctggtcagcattgtccatgcacggagataagagccagcaggaacgtgactatgtcctgagggaatttagaactggaaaatctagtattttggtagctactgacgtagctgccagggggttagatgttgagggtataaaatatgttgtaaattacgattatcctcactcctcagaagattacattcacagaatcggtagaactggtcgttctgacagtgccggtacgtcctatgcatttttcacaccttccaactataagcaagctagagatctgatctccgttctc

SEQ ID NO: 1273 - DNA, 385 bp, Diabrotica virgifera
  Clone ID: LIB150-032-Q1-E1-H8
aagttacgtccagtagagaaacacttctacgtgccccatccttctgtggcaagccgtactccctttgaggttgagcagtttcgcaaagcaaaagaaattacagtcgaaggggaagcacctaaccccattcagaacttcgacgaagcaaatttccctgattacatcttgacggaagtttgcaataaggggtatgaagctccgacaccaattcaagcacaaggctggccaattgcaatgagtggtcatgatatggttggtatagcacaaacaggatctggaaaaactctagcttatatcctacctgctgcaattcatatcaacaaccaaccacctctaaataaaggggaaggaccaattgttttggtacttgctcctactagagaac

SEQ ID NO: 1274 - DNA, 431 bp, Diabrotica virgifera
  unsure (1)..(431): unsure at all n locations
  Clone ID: LIB150-015-Q1-E1-A6
gacagcaggaacgtgactatgtcctgagggaatttagaactggaaaatctagtattttggtagctactgacgtagctgccagggggttagatgttgagggtataaaatatgttgtaaattacgattatcctcactcctcagaagattacattcacagaatcggtagaactggtcgttctgacagtgccggtacgtcctatgcatttttcacaccttccaactataagcaagctagagatctgatctccgttctcaatgagactaaccaggcaatagatccaaaattgactgaaattgctggaaaaacanacagctatggcaaaggtaattcacgttggggaaatggangaagtttcaatanaaggtttaaacaacaaggatgcggcagcggcngcggaggttataggaaatttggtaataactcaaataat

SEQ ID NO: 1275 - DNA, 417 bp, Diabrotica virgifera
  Clone ID: LIB150-005-Q1-E2-A3
tcccggcacgcgtccactacaaccagccccaacgacagaattagctcaccagatccagcaagtcgccagcgattttggaaattccacatacgttagaaatacctgcatattcggacagagcccccatatgactccaagcgcgtgacctagagagaggagttgagatttgtctagccactctcggtcgtttaatcgatttctttgatcaaggaatcacaaacttagagagatgtaactacgtggtacacgatgaacctgacataatgttggacatgggtttcaagcctcacatacgtaagattttggagcagatccggactgacacgcagacattgatgtggtccgcaaagtaggccaaggaggtcaagagactagctgcggatttcatgaaagatcaggtccagatcaacactgggt

SEQ ID NO: 1276 - DNA, 379 bp, Diabrotica virgifera
  Clone ID: LIB150-014-Q1-E1-A11
cccacgcgtccgcccacgcgtccgaaactacagagtctcacattaagcgacaacaatttagtttcggtaagttaatgaatgcggcaccagcaatatcatttgcgacaatatcaggaagatagttgttggagtaccaagattcataagaatgattgactggacggcattgtccaggaacggggaaaacagtaagcacgagcgtgacgatatcctgatggaatttagtactggcaaatcaagtacattggtagcgactgatgtagctgccagagggtaagatgttgtgggtttaagatatgttgtaaattacgattagcgtcagtcctcagattattacagtcacagcttcggtacaactggtccatcagacagtgctggt

SEQ ID NO: 1277 - DNA, 405 bp, Diabrotica virgifera
  Clone ID: LIB149-024-Q1-E1-A11
acggatattcaggtgatgatattaataaatttttatggatggtccgtatcgctgaaggagaacatccaaaggatatcagggaaagcgattacttcacggaacatggtgaatttagaatcgacgccgaaggttctcccacattgttgaactgtcttatgtacaaattgagctattatcgatttggagaattgaaattagactacagaagtcccgcaggatttgaccgtactagaaacgccgtcattggaaacaaagatttccagctcaattacttagaagaggcttatactaccgaacattggctcgtaagagtatacagggttaaaaaaccagatgaattcaacagacctagaatccccgttgcaaacagagtagttaaaacgagtaactacgtatcaaaaaaga

SEQ ID NO: 1278 - DNA, 433 bp, Diabrotica virgifera
  Clone ID: LIB150-016-Q1-E1-A9
ccggacaaaaatggttcaagccggtctgaaaaagtcatcaggatcaaaaataaatagcaaagctggaataagtagtttaataattttcgtagtcctacttctagcatggatcgcagggttttcttcacgtctatttgcagtaatcagattcgaaagtatcattcatgaatttgatccctggttcaattacagagccacggcgtatatggtaaaacatggattttataattttttaaattggtttgatgaaagagcatggtaccctctgggaagaattgttgggggtactgtttatccaggtttgatgttaacatcggggagtattcattacattcttcatttactccacatagatgtacatattcgtgatatatgtgtgtttttggctcctgttttcagtggccttacatcaatttccacatattacctgacg

SEQ ID NO: 1279 - DNA, 427 bp, Diabrotica virgifera
  Clone ID: LIB149-013-Q1-E1-D2
acaagtaatgcttattcgagtccaagcatcgtgttggcttcatacggaagtgatggatctagacaaattcctgatgacttcagagaagcctacttttggctttcccaaaataccggcgacgatgccaaagttaagagttggtgggactaagggtaacaaataactggtaatgccaataagactactctgggtgaaaataacacgtgggataacaatcaacatgcctttgtggggaaaagcaatgtcatccaacgaatctgctgcctacgaaaatatgacagctttagacgtcgattatgtattagttatttttggcggtgtcatcggatattcaggtgatgatattaataaatttttgtggatggttcgtatcgctgaaggagaacatccaaaggatatcagggaaagcgattacttcacggaacat

SEQ ID NO: 1280 - DNA, 356 bp, Diabrotica virgifera
  Clone ID: LIB150-049-Q1-E1-H6
agattacattcttcatttactccacataaatgtacatattcgtgatatatgtgtgtttttggctcctgttttcagtggccttacatcaatttccacatattacctgacgaaggaattgtggtcagctggagctggattgtttgcagcatgttttaatgccatagtgcctggttatataagtcgttcagtggcaggtacttatgacaatgaaggtatagccatttttgccttacagtttacatattatctctggattaaatctgtgaaaactggatcagtgttttggtctgttgcaacttcattgtcagatttccacatggtgtcagcatggggtcgttacgtttttagcatcaact

SEQ ID NO: 1281 - DNA, 418 bp, Diabrotica virgifera
  Clone ID: LIB3026-031-Q1-E1-C10
cacacgcgtccgcccacgcgtccgcccacgcgtccggatgaaacatgaacaatcgaaagagcctgacagcattggaccaaatttgagaagtattgtaactgtagtaatcctattattgttaatgttgtttgccgtccattgtacttgggttacaagtaatgcttattcgagtccaagcatcgtgttggcttcatacggaagtgatggatctagacaaattcttgatgacttcagagaggcctacttttggctttctcaaaataccgccgacgatgccagagttatgagttggtgggactatggttatcaaatagctggtatggcgaataggactactctggttgataataacacgtggaataacagtcacattgctttggtgggaaaagcgatgtcatccaacgaatctgctgcctac

SEQ ID NO: 1282 - DNA, 413 bp, Diabrotica virgifera
  Clone ID: LIB3026-031-Q1-E1-C11
aagaagcatcagcccacacatcagaaaaaaacatcaggaagaaaaataagacaatcgaaagagcctgacagcattggaccaaatttgagaagtattgtaactgtcataatcctattattgttaatgttgtttgccgtccattgtacttgggttacaagtaatgcttattcgagtccaagcatcgtgttggcttcatacggaagtgatggatctagacaaattcttgatgacttcagagaggcctacttttggctttctcaaaataccgccgacgatgccagagttatgagttggtgggactatggttatcaaatagctggtatggcgaataggactactctggttgataataacacgtggaataacagtcacattgctttggtgggaaaagcgatgtcatccatcgaatcctg

SEQ ID NO: 1283 - DNA, 421 bp, Diabrotica virgifera
  Clone ID: LIB150-037-Q1-E1-E12
actgtgtgcgtgtcatgactttgcttggtagttgatggttgtcaaaaatggttcaagccggtctgaaaaagtcatcaggatcaaaaataaatagcaaagctggaataagtagtttaataattttcgtagtcctacttctagcatggatcgcagggttttcttcacgtctatttgcagtaatcagattcgaaagtatcattcatgaatttgatccctggttcaattacagagccacggcgtatatggtaaaacatggattttataattttttaaattggtttgatgaaagagcatggtaccctctgggaagaattgttgggggtactgtttatccaggtttgatgttaacatcggggagtattcattacattcttcatttactccacataaatgtacatattcgtgatatatgtgtgttttt

SEQ ID NO: 1284 - DNA, 436 bp, Diabrotica virgifera
  unsure (1)..(436): unsure at all n locations
  Clone ID: LIB3026-004-Q1-E1-B6
aattggtattggaactcctgctcaaacctttaatgtaattttcgacactggttcatcgaatctctggattccgtctagtaaatgtggatttttggaagttgcttgcttacttcataacaaatacgatgccgataaatcttctacctatgtgaaaaacgacaccagattcgcaattgcatatggttcaggggaagttgcaggacttatttcccaagatgttgttgattttgggggtttacaagctaaggatcaattatttgctgaagctanccaagaacccggtttagctttccttgtgggaaaattcgatggaattttaggaatgggataccctgaaatttccgttaacggaattactccagtatttaattcactggttgaacaaggcgctgtgcaagaaccagtcttctccttttacttgaacagagaccctgat

SEQ ID NO: 1285 - DNA, 323 bp, Diabrotica virgifera
  Clone ID: LIB149-042-Q1-E1-H1
cccacgcgtccgcggacgcgtgggtttcaggctcaatattatggagaaattggtattggaactcctgctcaaacctttaatgtaattttcgacactggttcatcgaatctctggattccgtctagtaaatgtggatttttggaagttgcttgcttacttcataacaaatacgatgccgataaatcttctacctatgtgaaaaacgacaccagattcgcaattgcatatggttcaggggaagttgcaggacttatttcccaagatgttgttgattttgggggtttacaagctaaggatcaattatttgctgaagctacccagga

SEQ ID NO: 1286 - DNA, 403 bp, Diabrotica virgifera
  Clone ID: LIB149-009-Q1-E1-G9
gggtagcatcaaaatgttatccaaattgttaatatttgtatttgctgctgtttttgtcagtgctgaaatcaatagaattccactgaagaagtttgaaaagccgagggatgcacttaacagaaatggactaaaggaaggattattagccaaatacaatagaaatgtcaatgacgatagcgccgtcgttttaactaactatttagatgctcaatattatggagaaattggtattggaactcctgctcaaacctttaatgtaattttcgacactggttcatcgaatctctggattccgtctagtaaatgtggatttttggaagttgcttgcttacttcataacaaatacgatgccgataaatcttccacctatgtgaaaaacgacaccagattcgcaattgcatat

SEQ ID NO: 1287 - DNA, 394 bp, Diabrotica virgifera
  Clone ID: LIB149-022-Q1-E1-D1
ggtagcatcaaaatgttatccaaattgttaatatttgtatttgctgctgtttttgtcagtgctgaaatcaatagaattccactgaagaagtttgaaaagccgagggatgcacttaacagaaatggactaaaggaaggattattagccaaatacaatagaaatgtcaatgacgatagcgccgtcgttttaactaactatttagatgctcaatattatggagaaattggtattggaactcctgctcaaacctttaatgtaattttcgacactggttcatcgaatctctggattccgtctagtaaatgtggatttttggaagttgcttgcttacttcataacaaatacgatgccgataaatcttctacctatgtgaaaaacgacaccagattcgcaa

SEQ ID NO: 1288 - DNA, 411 bp, Diabrotica virgifera
  Clone ID: LIB149-028-Q1-E1-A2
aaacagggtagcatcaaaatgttatccaaattgttaatatttgtatttgctgctgtttttgtcagtgctgaaatcaatagaattccactgaagaagtttgaaaagccgagggatgcacttaacagaaatggactaaaggaaggattattagccaaatacaatagaaatgtcaatgacgatagcgccgtcgttttaactaactatttagatgctcaatattatggagaaattggtattggaactcctgctcaaacctttaatgtaattttcgacactggttcatcgaatctctggattccgtctagtatatgtggatttttggaagttgcttgcttacttcataacatatacgatgcccataaatcttctacctatgtgaaaaacgacaccagaatcgcaattgcatatggt

SEQ ID NO: 1289 - DNA, 368 bp, Diabrotica virgifera
  Clone ID: LIB149-038-Q1-E1-A11
taaccaaattgttaatatttgtatttgctgctgtttttgtcagtgctgaaatcaatataattccactgaagaagtttgaaaagccgagggatgcacttaacagaaatggactaaaggaaggattattagccaaatacaatagaaatgtcaatgacgatagcgccgtcgttttaactaactatttagatgctcaatattatggagaaattggtattggaactcctgctcaaacctttaatgtaattttcgacactggttcatcgaatctctggattccgtctagtaaatgtggatttttgggaattgcttgcttacttcataccagctacgatgccgataaatcttctacctatgtgaaaaacgacacc

SEQ ID NO: 1290 - DNA, 434 bp, Diabrotica virgifera
  Clone ID: pGUT2599
cgtttacggaattactcccgcatttaattcactgggggaacaaagcgctgtgcaagaaccagtcttcttcttttacttgaacagagaccctgatggagaaattggtggtgaattgttgcttggtggatcacaccccaactatttcaaaggtgactttacttatgtagatgtttcagctaaaggctattggcaagttgttattgacagtcttaacgttggatctttcttaaaactatagttcaatggatgtcaaattatttgtatacactggttccagcttgatcgctggacctatcgctgaagtcgaaaagtttcatttatgaataggggctttttcattccttaatggtgggtatataattgattgcagcgtaattgattatctatcccgaacatagttttgttttttgagggaaagaattcacacttttcct

SEQ ID NO: 1291 - DNA, 543 bp, Diabrotica virgifera
  Clone ID: pGUT3344
gaggtgcatttgcacgatgagttccttaaaacttcagaagaggctagcagcctctgttatgcgatgtggtaaaaagaaagtatggttggaccctaatgaaatcaacgaaattgccaacactaactcaagacagaacatccgtaagttgataaaggatggtcttattattaagaagcccgtagctgtacattcccgtgcccgtgttcgcaaaaacactgaagcccgcaggaaaggaaggcactgcggttttggtaaaaggaagggtactgctaatgcccgtaccccgcaaaaggaattatggattcaacgcatgagagttttgcgtcgtctccttaaaaaatacagggaagctaaaaaaattgacagacatctataccactcactctacatgaaggccaagggtaacgtattcaagaacaagcgtgtccttatggaatacatccacaagaagaaggcagagaaagcccgtgccaagatgttggcagaccaggccaatgccagaaggatgaaggtaaaacaggctagagaaagacgtgaggaacg

SEQ ID NO: 1292 - DNA, 439 bp, Diabrotica virgifera
  Clone ID: LIB3026-006-Q1-E1-C12
gatgagttccttaaaacttcagaagaggctagcagcctctgttatgcgatgtggtaaaaagaaagtatggttggaccctaatgaaatcaacgaaattgccaacactaactcaagacagaacatccgtaagttgataaaggatggtcttattattaagaagcccgtagctgtacattcccgtgcccgtgttcgcaaaaacactgaagcccgcaggaaaggaaggcactgcggttttggtaaaaggaagggtactgctaatgcccgtaccccacaaaaggaattatggattcaacgcatgagagttttgcgtcgtctccttaaaaaatacagggaagctaaaaaaattgacagacatctataccactcactctacatgaaggccaagggtaacgtattcaagaacaagcgtgtccttatggaatacatccacaagaagaag

SEQ ID NO: 1293 - DNA, 445 bp, Diabrotica virgifera
  unsure (1)..(445): unsure at all n locations
  Clone ID: LIB149-015-Q1-E1-F2
aaattcttttacggaagacacgttgagaggtgcatttgcacgatgagttccttaaaacttcagaagaggctagcagcctctgttatgcgatgtggtaaaaagaaagtatggttggaccctaatgaaatcaacgaaattgccaacactaactcaagacagaacatccgtaagttgatcaaggatggtcttattattaagaagcccgtagctgtacattcccgtgcccgtgttcgcaaaaacactgaagcccgcaggaaaggaaggcactgcggttttggtaaaaggaagggtactgctaatgcccgtaccccacaaaaggaattatggattcaacgcatgagagttttgcgtcgtctccttaaaaaatacagggaagctaaaaagattgacagacatctataccactcactctacatgaanggcaagggtaacgtattcaagaaca

SEQ ID NO: 1294 - DNA, 394 bp, Diabrotica virgifera
  Clone ID: LIB150-043-Q1-E1-F4
aattgagatgtgcatttgcaggatgagttccttaaaacttcagaagaggctagcagcctctgttatgcgatgtggtaaaaagaaagtatggttggaccctaatgaaatcaacgaaattgccaacactaactcaagacagaacatccgtaagttgataaaggatggtcttattattaagaagcccgtagctgtacattcccgtgcccgtgttcgcaaaaacactgaagcccgcaggaaaggaaggcactgcggttttggtaaaaggaagggtactgctaatgcccgtaccccacaaaaggaattatggattcaacgcatgagaattttgcgtcgtctccttaaaaaattcaaggaagctaaaaaaattgacagacatctataccactcactctac

SEQ ID NO: 1295 - DNA, 371 bp, Diabrotica virgifera
  Clone ID: LIB3026-015-Q1-E1-D11
aaaatcaacgaaattgccaacactaactcaagacagaacatccgtaagttgatcaaggatggtcttattattaagaagcccgtagctgtacattcccgtgcccgtgttcgcaaaaacactgaagcccgcaggaaaggaaggcactgcggttttggtaaaaggaagggtactgctaatgcccgtaccccacaaaaggaattatggattcaacgcatgagagttttgcgtcgtctccttaaaaaatacagggaagctaaaaagattgacagacatctataccactcactctacatgaaggccaagggtaacgtattcaagaacaagcgtgtccttatggaatacatccacaagaagaaagcagagaaagcccg

SEQ ID NO: 1296 - DNA, 378 bp, Diabrotica virgifera
  Clone ID: pGUT3145
tgcacgatgagttccttaaaacttcaaaagagggtggcagcctctgttatgcgaggtggtaaaaagaaagtatggttggaccctaatgaaatcaacgaaattgccaacactaactcaagacagaacatccgtaagttgataaaggatgggcttattattaagaagcccgtagctgtacattcccgtgcccgtgttcgcaaaaacactggagcccgcaagaaaagaaagcactgcggttttggtgaaaagaaaggtactggtaatgcccctaccccgcaaaaagaattatggattcaacgcatgagagatttgcgttgtctccttaaaaatacacggaagctaaaaaattgtcagacatctattccctcactctacatg

SEQ ID NO: 1297 - DNA, 340 bp, Diabrotica virgifera
  Clone ID: LIB3026-016-Q1-E1-A2
ccatcgcgtccgggtgcatttgcaggatcagttccttacaacttcagaagaggctatcagcctctgttaagctatgtggtacaaacatagtatggttggaccctaatgatttcaacaatcttgccaacactaactcaacacagaacatccgtaagttgatacaggatggtcttattattacgaagcccgtatctgtccattcccgtgcccgtgttcgcaaaaacactgaagcccgcatgaaaagaaggcactgcggttttggtaaaaggaaaggtactgctaatgcccgtaccccactcaaggaattatggattcaacgcatgatagttttgcgtcgtct

SEQ ID NO: 1298 - DNA, 414 bp, Diabrotica virgifera
  Clone ID: LIB150-050-Q1-E1-E1
atcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaatactatgtaaccatcattgatgcccctggacacagagatttcattaagaacatgatcactggtacatcacaagctgactgtgctgtactcattgttgcagctggtactggtgaatttgaagcaggtatttcaaagaatggacaaacacgtgaacat

SEQ ID NO: 1299 - DNA, 420 bp, Diabrotica virgifera
  Clone ID: LIB150-033-Q1-E1-B5
atttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaatactatgtaaccatcattgatgcccctggacacagagatttcattaagaacatgatcactggtacatcacaagctgactgtgctgtactcattgttgcagctggtactggtgaatttgaagcaggtatttcaaagaatggacaaaca

SEQ ID NO: 1300 - DNA, 453 bp, Diabrotica virgifera
  Clone ID: LIB150-019-Q1-E1-H7
ctagcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaatactatgtaaccatcattgatgcccctggacacagagatttcattaagaacatgatcactggtacatcacaagctgactgtgctgtactcattgttgcagctggtactgg

SEQ ID NO: 1301 - DNA, 379 bp, Diabrotica virgifera
  Clone ID: LIB149-027-Q1-E1-B1
cccacgcgtccgaggacgcgtgggaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaatactatgtaaccatcattgatgcccctggacacagagatttcattaagaacatgatcactggtacatcacaagctgactgtgctgtactcattgttgcagctggtactggtga

SEQ ID NO: 1302 - DNA, 346 bp, Diabrotica virgifera
  Clone ID: LIB150-001-Q1-E1-C1
gtgaggacctcgcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacag

SEQ ID NO: 1303 - DNA, 314 bp, Diabrotica virgifera
  Clone ID: LIB150-018-Q1-E1-B3
catcccaagtcgtgttcctttcactctaagtttaatttcgaacagttgcatttactttatttccaaacagtcaagatgggtaaagagagcattcatattaacatcgttgtcattgggcacgtatattctggtacatctaggactactggacatttaatttacaaatgtggtggtatcgatatacgtcccatcgagaagttcgatgacgaagcccaagaaatgggtcaaggttcagtcaaatatgcctgggtacgcgagaaacttaaggccgagcgataaggtggtagtaccattgagactgctttgggcgaatt

SEQ ID NO: 1304 - DNA, 390 bp, Diabrotica virgifera
  unsure (1)..(390): unsure at all n locations
  Clone ID: LIB150-040-Q1-E1-B1
atgcannattcgctgaaatcaaagaaaaaggttaacgtccttctgggaagaacactgaagaaaatcccaaaggcatcaaatcctggtatggcggcattgtcaactttggtaccaacaagcccaagttttaaaatcatccaagaaattccacccttggacgttttgctggtcgtgacatgaggcaaacgttgcagtaagagtcatcaagagcgtggcttcaaagatccagcggcggaaaagtcacaaaagctgcagaaaaagccaaaagaagaaatagtctatttggactccactacttaaataattttgatatgttttgtttcttttatatattaatattggagtatcaatgtatttttaataactaatggacttattacttgcattgca

SEQ ID NO: 1305 - DNA, 414 bp, Diabrotica virgifera
  Clone ID: LIB149-010-Q1-E1-A2
ggcagttccatgtgcacactaacgagaagtttttcccgtatttagtgtaatttgccaaaaataaagtgtgaaatagtagttttcgagtgcaaaataagtcaatatgaagttgaacgtatcgtacccggccacgggttgccaaaaacttttcgaagttgttgacgaacacaaaattcgtatcttttacgaaaaacgcatgggtcaagaagttgaggctgatgctcttggtgacgaatggaagggctacatcttgaaaatatctggaggtaacgacaaacaaggattccccatgaaacaaggtgttcttacaaacggtagagtaagacttttactttcaaaaggtcactcctgctacagacccagacgtaccggtgaacgtaaaaggaaatcagttcgtgggtgcattgttgatgg

SEQ ID NO: 1306 - DNA, 400 bp, Diabrotica virgifera
  Clone ID: LIB149-037-Q1-E1-H6
agttccatgtgcacactaacgagaagtttttcccgtatttagtgtaatttgccaaaaataaagtgtgaaatagtagttttcgagtgcaaaataagtcaatatgaagttgaacgtatcgtacccggccacgggttgccaaaaacttttcgaagttgttgacgaacacaaaattcgtatcttttacgaaaaacgcatgggtcaagaagttgaggctgatgctcttggtgacgaatggaagggctacatcttgaaaatatctggaggtaacgacaaacaaggattccccatgaaacaaggtgttcttacaaacggtagagtaagacttttactttcaaaaggtcactcctgctacagacccagacgtaccggtgaacgtaaaaggaaatcagttcgtgggtgc

SEQ ID NO: 1307 - DNA, 405 bp, Diabrotica virgifera
  Clone ID: LIB150-026-Q1-E1-H5
agcacacgcgtccgccaacgcgtccgggcagttccatgtgcacactaacgagaagtttttcccgtatttagtgtaatttgccaaaaataaagtgtgaaatagtagttttcgagtgcaaaataagtcaatatgaagttgaacgtatcgtacccggccacgggttgccaaaaacttttcgaagttgttgacgaacacaaaattcgtatcttttacgaaaaacgcatgggtcaagaagttgaggctgatgctcttggtgacgaatggaagggctacatcttgaaaatatctggaggtaacgacaaacaaggattccccatgaaacaaggtgttcttacaaacggtagagtaagacttttactttcaaaaggtcactcctgctacagacccagacgtaccggtgaacgt

SEQ ID NO: 1308 - DNA, 445 bp, Diabrotica virgifera
  Clone ID: LIB150-014-Q1-E1-C9
gggaacctcagcgtgttggccctagtcattgtaagaaaaggagaacaagaaattcccggacttactgacaccaccatcccacgtcgcctgggacccaagagagcatccagaatccgtaagctcttcaaccttagcaaagaagacgatgtacgtcaatatgtagtaaagagacctttggcccaaaaagaaggtaagaagttaagaaccaaggcccccaaaatccaacgtcttattacacccgttgttttgcaaagaaaacgtcatcgtcttgctttgaagaagaagaggtgccttaaacgtaaagaacaagaagatgcatatgctaaactattggctcaacgtaagaaggaatccaaggctcgtcgtgagatgttgaagaggcgtaggtctgccagtatgcgtgatagtaaatccagcacgcagagtggtcagaagtaaattgtaa

SEQ ID NO: 1309 - DNA, 392 bp, Diabrotica virgifera
  Clone ID: LIB149-040-Q1-E1-G5
cccacgcgtccgcggacgcgtggggttccatgtgcacactaacgagaagtttttcccgtatttagtgtaatttgccaaaaataaagtgtgaaatagtagttttcgagtgcaaaataagtcaatatgaagttgaacgtatcgtacccggccacgggttgccaaaaacttttcgaagttgttgacgaacacaaaattcgtatcttttacgaaaaacgcatgggtcaagaagttgaggctgatgctcttggtgacgaatggaagggctacatcttgaaaatatctggaggtaacgacaaacaaggattccccatgaaacaaggtgttcttacaaacggtagagtaagacttttactttcaaaaggtcactcctgctacagacccagacgtaccgg

SEQ ID NO: 1310 - DNA, 402 bp, Diabrotica virgifera
  Clone ID: LIB150-047-Q1-E1-D10
gcgtccgagcagatccatgtgcacactaacgagaagtttttcccgtatttagtgtaatatgccaagaataaagtgtgaaatagtaattatcgagtgcaaaataagtcaatatgaagttgaactgtagcgtatccgggctcacaggtagccaaaaacttttcgaaattgttgaagaacacacgattcgtatctatcacgaaaaacgcatgggtcaataagttgaggctgatgcacttggtgacgaagggaagggctacatctcgaaaatatctggaggtaacgacatacaaggattccccatgaaacaatgtgttcttacaaacggtagagtaagacttttacattcaaaaggtcactcctgctacagacacagacgtaccggtgaacgtaaaaggaaatcaa

SEQ ID NO: 1311 - DNA, 342 bp, Diabrotica virgifera
  unsure (1)..(342): unsure at all n locations
  Clone ID: LIB150-047-Q1-E1-D11
agtgagtcgtattaagacgancgagaagtttttcccgtattaagtgtaagatgccaagaacgaggtgtgaaatagtagtattcgagtgcaaggtaagtcaagatgaagttgaacgtagcgtatccggccacgggtagccagacacttttcgaagtagtggacgaacacaggattcggatcgttcacgacaaacgcatgggtcaagaagttgaggctgatgcgcatggtgacgaagggatgggctacatctcgaagatatctggaggtaacgactgacaacgattcaccatgacacagggtgtccttacgcacggtagagtaagacgttgactttcagaaggt

SEQ ID NO: 1312 - DNA, 633 bp, Diabrotica virgifera
  unsure (1)..(633): unsure at all n locations
  Clone ID: pGUT3270
gtgagaagtagtcgtgtatgtgtagctgctaagaaaaaaataagatgactgaaactttgcaattaaaaggcacccttttgggtcacaatggatgggtaacacaaattgccaccaacccaaaataccctgatatgattttatcttcatccagagacaaaaccttgattgtatggaaattgacacgtgaagatacccaatatggtgtaccccaaaaacgtttatatggccactctcactttatctcagatgtagtactctccagtgacggaaattatgctctttctggttcatgggacaagactcttcgtctgtgggatttggctgcaggaaaaactacaagaagatttgaagatcacactaaggatgttttgagtgtagccttctctgttgacaatagacaaattgtgtctggatcccgtgacaagaccatcaaactgtggaacaccttggccgaatgtaaatacacaattcaagatgatggacattccgattgggtatcctgtgtaagattttnccccaaccacgccaacccaatcatcgtatcagctggatgggaccgtatggtgaaggtatggaacttgaccaatngccgtctaaagatcaaccactctggtcacactggttacttaaaca

SEQ ID NO: 1313 - DNA, 424 bp, Diabrotica virgifera
  Clone ID: LIB150-032-Q1-E1-C4
gggtccacgcccgcgtccgaccacgcgtccgcccacgcgtccgagccttctctgttgacaatagacaaattgtgtctggatcccgtgacaagaccatcaaactgtggaacaccttggccgaatgtaaatacacaattcaagatgatggacattccgattgggtatcctgtgtaagattttcccccaaccacgccaacccaatcatcgtatcagctggatgggaccgtatggtgaaggtatggaacttgaccaattgccgtctaaagatcaaccactctggtcacactggttacttaaacacagttgcagtctctcctgacggtatcttatgtgctagcggaagtaaagactgcaaagccatgctgtgggatcttaatgacggcaagcacttacatatcttggagcataatgacatcatcaacgc

SEQ ID NO: 1314 - DNA, 340 bp, Diabrotica virgifera
  Clone ID: LIB149-019-Q1-E1-G2
aaataagatgactgaaactttgcaattaaaaggcacccttttgggtcacaatggatgggtaacacaaattgccaccaacccaaaataccctgatatgattttatcttcatccagagacaaaaccttgattgtatggaaattgacacgtgaagatacccaatatggtgtaccccaaaaacgtttatatggccactctcactttatctcagatgtagtactctccagtgacggaaattatgctctttctggttcatgggacaagactcttcgtctgtgggatttggctgcaggaaaaactacaagaagatttgaagatcacactaaggatgttttgagtgta

SEQ ID NO: 1315 - DNA, 395 bp, Diabrotica virgifera
  unsure (1)..(395): unsure at all n locations
  Clone ID: LIB150-034-Q1-E1-A4
accacgcgtccggttgctgtgagaagtagtcgtgtatgtgtagctgctaagaaaaaaataagatgactgaaactttgcaattaaaaggcacccttttgggtcacaatggatgggtaacacaaattgccaccaacccaaaataccctgatatgattttatcttcatccagagacaaaaccttgattgtatggaaattgacacgtgaagatacccaatatggtgtaccccaaaaacgtttatatggccactctcactttatctcagatgtagtactctccagtgacggaaattatgctctttctggttcatgggacaagactcttcgtctgtgggatttggctgcangaaaaactacaagaagatttgaagatcacactaaggatgttttgagtgta

SEQ ID NO: 1316 - DNA, 364 bp, Diabrotica virgifera
  Clone ID: LIB150-015-Q1-E1-F4
gaatgtattgattgtacccttctcggttgacaatagacaaattgtgtctggatcccgtgacaagaccatcaaactgtggaacaccttggccgaatgtaaatacacaattcaagatgatggacattccgattgggtatcctgtgtaagattttcccccaaccacgccaacccaatcatcgtatcagctggatgggaccgtatggtgaaggtatggaacttgaccaattgccgtctaaagatcaaccactctggtcacactggttacttaaacacagttgcagtctctcctgacggtagcttatgtgctaaccgaggtaaagactgcaaagcatgctgtgggattctaatgacggcaagcacttac

SEQ ID NO: 1317 - DNA, 415 bp, Diabrotica virgifera
  Clone ID: LIB3026-033-Q1-E1-E12
gggtccagccagcgtccgcacaaacgtccggcggttgctgtgagaagtagccgtgtatgtgtacctgcaaaaaaaaaaataaaataacggaaactttgcaattaaaaggcacccttttgggtcaaaatggatgggtaacacaaattgccaccaacccaaaataccctgatatgattttatcttcatccagagacaaaaccttgattgtatggaaattgacacgtgaagatacccaatatggtgtaccccaaaaacgtttatatggccactctcactttatctcagatgtagtactctccagtgacggaaattatgctctttctggttcatgggacaagactcctccgcctgtgggatttggctgcaggaaaaactacaagaagattttgagattacactaaggatgttttgagtg

SEQ ID NO: 1318 - DNA, 329 bp, Diabrotica virgifera
  Clone ID: LIB150-015-Q1-E1-G2
cggaaactttgcaattaaacggctcccttttgggtcacattggatcggtatcacaaattgccaccagcccaaaataccctgatatgattttatcttcatccacagacataaccttgattgtatggaaattgacacgtgaagatacccaatatggtgtactccaaaaacgtttatatggccactcgcactttaccacagatgtagtactcaccagtgacagaaattatgctctttctggttcatgggacaagactcttcgtctgtgggagttggctgcaagaaaaactacaagaagagttgacgatcacacgaaggatgttttgagtgta

SEQ ID NO: 1319 - DNA, 486 bp, Diabrotica virgifera
  Clone ID: LIB150-031-Q1-E1-A6
cccacgcgtccgcccacgcgtccgcggtggaggttgaaccgtaggttacgaataaaatttgtacatacatttaaaacatggctttcgtaaaggttgtgaagaacaaacagtacttcaagaggttccaggttaaattcaagaggcgtaggcaaggaaaaactgattactatgcccgtaaacgattgattgttcaagacaagaacaaatacaacactcccaagtaccgtttgatcgtacgtatctccaacaggaacattacttgtcagattgcttactcccgtattgagggagacaagattgtatgtgctgcttactcccatgaattgcccagatatggaatcaaaactggtcttaccaactatgctgctgcctatgccactggtttacttttggccagaaggctcctcaaaaaattgggacttgacaatttatacagtggcaccactgatgttactgcggacgaatacaatgttgaagctgctgaac

SEQ ID NO: 1320 - DNA, 376 bp, Diabrotica virgifera
  Clone ID: LIB150-043-Q1-E1-E12
accacgcgtccgcgcggtggaggttgaaccgtaggttacgaataaaatttgtacatacatttaaaacatggctttcgtaaaggttgtgaagaacaaacagtacttcaagaggttccaggttaaattcaagaggcgtaggcaaggaaaaactgattactatgcccgtaaacgattgattgttcaagacaagaacaaatacaacactcccaagtaccgtttgatcgtacgtatctccaacaggaacattacttgtcagattgcttactcccgtattgagggagacaagattgtatgtgctgcttactcccatgaattgcccagatatggaatcaaaactggtcttaccaactatgctgctgcctatgccactggttta

SEQ ID NO: 1321 - DNA, 420 bp, Diabrotica virgifera
  Clone ID: LIB3026-019-Q1-E1-F4
aggcggtggaggttgaaccgtaggttacgaataaaatttgtacatacatttaaaacatggctttcgtaaaggttgtgaagaacaaacagtacttcaagaggttccaggttaaattcaagaggcgtaggcaaggaaaaactgattactatgcccgtaaacgattgattgttcaagacaagaacaaatacaacactcccaagtaccgtttgatcgtacgtatctccaacaggaacattacttgtcagattgcttactcccgtattgagggagacaagattgtatgtgctgcttactcccatgaattgcccagatatggaatcaaaactggtcttaccaactatgctgctgcctatgccactggtttacttttggccagaaggctcctcacaaaattgggacttgacaatttatacagtggca

SEQ ID NO: 1322 - DNA, 384 bp, Diabrotica virgifera
  Clone ID: LIB149-046-Q1-E1-D1
acgcgtaggattgaagcgcaggttacgaataaaatttgtacatacatttaaaacatggctttcgtaaaggttgtgaagaacaaacagtacttcaagaggttccaggttaaattcaagaggcgtaggcaaggaaaaactgattactatgcccgtaaacgattgattgttcaagacaagaacaaatacaacactcccaagtaccgtttgatcgtacgtatctccaacaggaacattacttgtcagattgcttactcccgtattgagggagacaagattgtatgtgctgcttactcccatgaattgcccagatatggaatcaaaactggtcttaccaactatgctgctgcctatgccactggtttacttttggccagaaggctcctc

SEQ ID NO: 1323 - DNA, 417 bp, Diabrotica virgifera
  Clone ID: LIB150-040-Q1-E1-A9
aatccggcggtggaggttgaaccgtaggttacgaataaaatttgtacatacatttaaaacatggctttcgtaaaggttgtgaagaacaaacagtacttcaagaggttccaggttaaattcaagaggcgtaggcaaggaaaaactgattactatgcccgtaaacgattgattgttcaagacaagaacaaatacaacactcccaagtaccgtttgatcgtacgtatctccaacaggaacattacttgtcagattgcttactcccgtattgagggagacaagattgtatgtgctgcttactcccatgaattgcccagatatggaatcaaaactggtcttaccaactatgctgctgcctatgccactggtttacttttggccagaaggctcctcaaaaaattgggacttgacaaattatac

SEQ ID NO: 1324 - DNA, 421 bp, Diabrotica virgifera
  Clone ID: LIB150-016-Q1-E1-C12
cacgaatccggaaacgcggtggaagctgaaccatatgttacgaataaactttgtacatacatttataacatgagcattcgcaaaggttgtacttcaacagcagtcatcatcaggctccaagataaagtcaacaagcataagccctgaaaaactgattactagtcccgtaaactaatgattgttcaagacaagaacaaatacaacactcacaagtaccgtttgatcctaggtatctccaacaggaacattacttgtcagattgcttactctcgtattgagggaaacaagattgtatgtgctgcttactcccatgaattgcccagatatggaatcaaaactggtcttaccaactatgctgctgcctatgccactggtttacttttggccataaggctcctcaaaaaattgggacatgacaatt

SEQ ID NO: 1325 - DNA, 336 bp, Diabrotica virgifera
  Clone ID: pGUT327
ccaaatacaacactcccaattaccgggtgatcgtacgtatctccaacaagaacataacttgtctcattgctttctcccgtctcgagggagacaatatcgtgtgtgctgctcactcccatgaattgcccagatctggactcacaactggtctcacccactatgctgctgcctatgccactggtttacttctggtctccatgttgctgattatatgacctcactgcacgatgatgatccatacgcattccacatgcacttctctctatacatcactctgggaatcagtgctcaccaaattgtttatatgtacaacattgcccatactgacagtcgtgc

SEQ ID NO: 1326 - DNA, 583 bp, Diabrotica virgifera
  unsure (1)..(583): unsure at all n locations
  Clone ID: pGUT3281
agacacanctaacaaaagaatttaaaggccaaaagcaaattataagtacttatgccaacataccagctgaagctattattggagtcagaactccccaactacaacttgcaggaaacacttccattgaggcctatatagcatcagaattggcatatgatagttcatggccctctttgccatcaagaagattatttccctatacattggattatcaatcaacagaacaatgtcttttgggcgcagaatgtcctaacgaagctttcccaggttattggattctgccaataaatgatttaacttcaccaaatggtacagaatgcaattcactggctacttgtggaatagaaggtagtgttgatgaaatcgccaaatatttggatgatcaaattgaaggaattagaagtaaatctagaactcccataaatttgatgatcaactcatactggtttgaacaaactgacaccagcttcgatgggcttcgaaaattcttggaaaacacagttgcacgtgaagcaaaagataccttcttcgtctcacaaaaacaggtcctagattatataaaaaaatcccgtaaaattagcga

SEQ ID NO: 1327 - DNA, 366 bp, Diabrotica virgifera
  Clone ID: LIB150-025-Q1-E1-F8
ctcgcgggtcgatacaagcctctagaatgagtcgtcgtatctcacaaatacacaaactactcagcagtacaggacctacacagacgtggtcatgaaatcgcggtgttttcattgactcataaagaggatccaaactactggtcccagggttcttatgacgactggttggctgaaatggctggagctagattgattattgaaagatttgccaacattaccgatggatcaataattggagtgagagctccatacctcagagtaggaggaaacagacaatttgaaatgatgacagatcaattctttatttatgattcatcaattacagcctctcttggacgtgtcccaatctggccttatactttatac

SEQ ID NO: 1328 - DNA, 412 bp, Diabrotica virgifera
  Clone ID: LIB150-003-Q1-E2-G5
agaaaggattgccaggatgggtctgatgaaactacctgcgatatcgatagtgaccccaatagtgccccaccctgcgaccccgcagtatgcgttctccctgattgtttctgctcagaggacggtacaggcattcccaatgatttaccagccaaagatgtacctcaaatgataactgtcacatttgacgacgccataaataataacaacatcggtctatacaagaacattttcaacggtgaacggaaaaaccccaacggttgtcatatcaaggctacattcttcgtgtctcacaagtacaccaactactcggcagtccaagaaatgcatagaaaatgtcacgaaatcgcagtacattcaatatcgcacaatgatgacgaaaacttctggtccaacgccagtgtaaatgactggg

SEQ ID NO: 1329 - DNA, 392 bp, Diabrotica virgifera
  Clone ID: LIB149-021-Q1-E1-E7
agagtatcctcagctgattagtttaacatttgatgaagctgttacacaacacatctacgacaacagttggattacattgctcggaaatatatataatccagatgataagccaattagtggaacattctttgtaccacatgagtatacgagctatcaaagagttaatgatttgtacaactttggatttgaaattggtgtgcactcaattacgaaggattttagacaaaattactggagatatgcaactctagacacactaacaaaagaatttaaaggccaaaagcaaattataagtacttatgccaacataccagctgaagctattattggagtcagaactccccaactacaacttgcaggaaacacttccattgaggcctatatagcatcag

SEQ ID NO: 1330 - DNA, 431 bp, Diabrotica virgifera
  Clone ID: LIB150-003-Q1-E1-G5
aaaaggattgccaggatgggtctgatgaaactacctgcgatatcgatagtgaccccaatagtgccccaccctgcgaccccgcagtatgcgttctccctgattgtttctgctcagaggacggtacaggcattcccaatgatttaccagccaaagatgtacctcaaatgataactgtcacatttgacgacgccataaataataacaacatcggtctatacaagaacattttcaacggtgaacggaaaaaccccaacggttgtcatatcaaggctacattcttcgtgtctcacaagtacaccaactactcggcaatccaataaatgcatagaaaaagtcacgaaatcgcagtacattcaatatcgcacaatgatgacgaatacttctggtccaaacgccagtgttaatgactgggttaaagaaatgggaagtat

SEQ ID NO: 1331 - DNA, 407 bp, Diabrotica virgifera
  Clone ID: LIB149-004-Q1-E1-B11
tagaatttatcggccaaaagcaaattataagtacttatgccaacataccagctgaagctattattggagtcagaactccccaactacaacttgcaggaaacacttccattgagggctatatagcatcagaattggcaaaagatagttcatgggcctctttgccatcaagaagattaattccctatacattggattatcaatcaacagaacaatgtcctttgggcgcaaaatgtcctaacgaagctttcccaagttaatggattctgccaataaatgatttaacttcaccaaatggtacagaatgcaattcactggctacttgtggaatagaacgtactgttgatgaaatcgccaaatatttggatgatctaattggaggaatttgaagttaatctagaactcccata

SEQ ID NO: 1332 - DNA, 493 bp, Diabrotica virgifera
  Clone ID: pGUT3104
gattttatttctcgtagctactttagcattcgatagtgcgattgcaaatgatgtagcaaaaccgcgtgagtctgattcttgtacgatcggcaacaattgtagatgttctagtcaagtgtcacctctaggtggagatctcacagagtatcctcagctgattagtttaacattcgatgaagctgttacacaacacatctacgacaacagttggattacattgctcggaaatatatataatccagatgataagccaattagtggaacattctttgtaccacatgagtatacgagctatcaaagagttaatgatttgtacaactttggatttgaaattggtgtgcactcaattacgaaggattttagacaaaattactggagatatgcaactctagacacactaacaaaagaatttaaaggccaaaagcaaattataagtacttatgccaacataccagctgaagctattattggagtcagaactccccaactacaa

SEQ ID NO: 1333 - DNA, 439 bp, Diabrotica virgifera
  Clone ID: LIB150-018-Q1-E1-D9
gagtgagaataatatcagctgtgataaccggtaaagtcttgtacagttactttttataaatctttttacgtatttcaccttttggaaacactcatcatatcaaagatgtcttgcacagtaccagctgccccagccccaccagcactcaaagaccttcccaaagtagcaggtgacctcaagagtgaattagaaacattcaaatcaagcaatcttaaaaacgctgatacacacgaaaaagtagttctaccatcagctgaagatgtggctgctgagaaaaccgaaaaagctcttattgaaggaattgaacgttttgatactagcaagttaaaacatactttgacgcaagaaaagaatccgttgccagacaaagaagttatcgaacaggaaaagggacaaatgaaccttatctctggcattgaaaatttcgacaactccaaac

SEQ ID NO: 1334 - DNA, 452 bp, Diabrotica virgifera
  Clone ID: LIB150-022-Q1-E1-B10
aggaaagcggtaagttgaccgagtgagaataatatcagctgtgataaccggtaaagtcttgtacagttactttttataaatctttttacgtatttcaccttttggaaacactcatcatatcaaagatgtcttgcacagtaccagctgccccagccccaccagcactcaaagaccttcccaaagtagcaggtgacctcaagagtgaattagaaacattcaaatcaagcaatcttaaaaacgctgatacacacgaaaaagtagttctaccatcagctgaagatgtggctgctgagaaaaccgaaaaagctcttattgaaggaattgaacgttttgatactagcaagttgaaacatactttgacgcaagaaaagaatccgttgccagacaaagaagctgtacaacaagaaaaaacacaccagacactacttaatggcgtcgaacatttcgataag

SEQ ID NO: 1335 - DNA, 439 bp, Diabrotica virgifera
  unsure (1)..(439): unsure at all n locations
  Clone ID: LIB150-005-Q1-E2-E2
gggccgagccacgcgtccagagtaagaataatatcagctgtgataaccggtaaagtcttgtacagttactttttataaatctttttacgtatttcaccttttggaaacactcatcatatcaaagatgtcttgcacagtaccagctgccccagccccaccagcactcaaagaccttcccaaagtagcaggtgacctcaagagtgaattagaaacattcaaatcaagcaatcttaaaaacgctgatacacacgaaaaagtagttctaccatcagctgaagatgtggctgctgagaaaaccgaaaaagctcttattgaaggaattgaacgttttgatactagcaagttaaaacatactttgacgcaagaaaagaatccgttgccagacaaagaagttatcgaacaggaaaagggacanatgaaccttatctctggcattgaa

SEQ ID NO: 1336 - DNA, 425 bp, Diabrotica virgifera
  Clone ID: LIB150-003-Q1-E2-C8
agttgaccgagtgagaataatatcagctgtgataaccggtaaagtcttgtacagttactttttataaatctttttacgtatttcaccttttggaaacactcatcatatcaaagatgtcttgcacagtaccagctgccccagccccaccagcactcaaagaccttcccaaagtagcaggtgacctcaagagtgaattagaaacattcaaatcaagcaatcttaaaaacgctgatacacacgaaaaagtagttctaccatcagctgaagatgtagctcaggaacgtacccacaatgcgcttatggacggagtggaaaattttcaaacgtccaccctcaaaagaacagacaccaaagagaagatagtgttacctaatgcacaagatgtggctgctgagaaaaccgaaaaagctcttattgaaggaatt

SEQ ID NO: 1337 - DNA, 355 bp, Diabrotica virgifera
  Clone ID: LIB150-049-Q1-E1-A5
aggagagcggtaagttgaccgagtgagaataatatcagctgtgataaccggtaaagtcttgtacagttactttttataaatctttttacgtatttcaccttttggaaacactcatcatatcaaagatgtcttgcacagtaccagctgccccagccccaccagcactcaaagaccttcccaaagtagcaggtgacctcaagagtgaattagaaacattcaaatcaagcaatcttaaaaacgctgatacacacgaaaaagtagttctaccatcagctgaagatgtggctgctgagaaaaccgaaaaagctcttattgaaggaattgaacgttttgatactagcaagttgaaacatac

SEQ ID NO: 1338 - DNA, 374 bp, Diabrotica virgifera
  unsure (1)..(374): unsure at all n locations
  Clone ID: LIB150-003-Q1-E1-C8
tgataaccggtaaagtcttgtacagttacttttataaacttttacgtatttcaccttttggaaacactcatcatatcaaagatgtcttgcacagtaccagctgccccagccccaccagcactcanagaccttcccagagtagcaggtgacctcaagagtgaattagaaacattcanatcaagcaatcttaaaaacgctgatacacacganaaagtagttctaccatcagctgaagatgtaactcaggaacgtacccacaatgcgcttatggacggagtggaaaattttcaaacgtccaacctcaaaagaacagacaccagagagaagataatgttacctaaagcacaagatgtggctgctgagaaaacccaaaa

SEQ ID NO: 1339 - DNA, 554 bp, Diabrotica virgifera
  unsure (1)..(554): unsure at all n locations
  Clone ID: pGUT3574
ctcgtgccgtttttgaacaaattcggggacaaatttagttttctaaaatggcacatacatataaacttatatattttgacgtccccggaaagggtgaagcaattagaatgatcttaagctatggagaaattccatttgaggacaaacgcatccagatgggggattggccaaaacttaaaccaactacccctcttggacaacttcccttgttagaggtcgatggtaaagcaatccctcaaagtactgcaatctgcaggtacttggcatcaatagtaaaactagatggcaaagatgcaaaagaaaatcttgctctagatgttgcactagaaactctttttgatttacaaaaaatgaacggcgaaataaagtatgaacaagacgccgctaaaaaaaaggaaaaacttgaaaaattattacaacaaggattacctctgtattttggaaaactagacgaatatgctaagaaacacaatggttacatagcttttgaaaggttgtcatgggctgatattttattcngttgtgtatatgaagcattagtcaatcttgcaggt

SEQ ID NO: 1340 - DNA, 415 bp, Diabrotica virgifera
  Clone ID: LIB150-038-Q1-E1-C6
agtcatttgccagttagttctccttggcagagcaaagtaggtacttgtattgagtgttttaaattgtttttggcaaacttgccgtttatcaatttgtgaacgaaatggcacccaaatataagctcacctacttcgatattactgctttcgctgaaccaattaggttcctcctaagctatggccaacttgatttcgaagacagacgttttgctgtagacggtatcgagtggccttctattaaaccgaccactcctttcggccaagtaccacttttggaatatgatggaaaagtggctcatcagtcaattgccatcagccgttatctcgctaagcaagtaaaactggtaggaagcaacgattgggaagacttggaaatcgatgctgctgttgataccatcattgacttacgcacaaa

SEQ ID NO: 1341 - DNA, 414 bp, Diabrotica virgifera
  Clone ID: LIB149-036-Q1-E1-F10
tacacacacgtctgagatgtataaaaacactttatttatataccggtgcgcggtgtttcgtttaattcgtatcgtatcagatcagcggtagttctctctactctaagtggacaaatttagttttctaaaatggcacatacatataaacttacatattttgacttccccggaaagggtgaagcaattagaatgatcttaagctatggagaaataccattcgaggacaaacgtatccagatgggggattggccaaaaattaagccaactactcctcttggacaacttcccatattagaggtcgatggtaaagaaatcccccaaagcactgcaatcagcaggtacttggcatctaaattaaacctcgatggcaaagatctgaaggaaaatcttgcactagatgttgcagtaaaaact

SEQ ID NO: 1342 - DNA, 379 bp, Diabrotica virgifera
  Clone ID: LIB149-042-Q1-E1-B6
agcgcggtgtttcgtttaattcgtatcgtatcagcggtagttctctctactctaagtggacaaatttagttttctaaaatggcacatacataaacttacatattttgacttccccggaaaggctgaagcaattagaatgatcttaagctatggagaaataccattcgaggacaaacgtatccagatgggggattggccaaaaattaagccaactactcctcttggacaacttcccatattagaggtcgatggtaaagaaatcccccaaagcactgcaatcagcaggtacttggcatctaaattaaacctcgatggcaaagatctgaaggaaaatcttgcactagatgttgcagtagaaactctcttggatttacaaaaa

SEQ ID NO: 1343 - DNA, 390 bp, Diabrotica virgifera
  Clone ID: LIB3026-032-Q1-E1-D3
gtcaccggaaagggtgaagcaattagaatgatcttaagctatggagaaattccatttgaggacaaacgcatccagatgggggattggccaaaacttaaaccaactacccctcttggacaacttcccttgttagaggtcgatggtaaagcaatccctcaaagtactgcaatctgcaggtacttggcatcaatagtaaaactagatggcaaagatgcaaaagaaaatcttgctctagatgttgcactagaaactctttttgatttacaaaaaatgaacggcgaaataaagtatgaacaagacgccgctaaaaaaaaggaaaaacttgaaaaattattacaacaaggattacctctgtattttggaaaactagacgaatatgctaagaaacac

SEQ ID NO: 1344 - DNA, 423 bp, Diabrotica virgifera
  Clone ID: LIB3026-012-Q1-E1-D8
ccaacgcgtccggttctctctactctaagtggacaaatttagttttctaaaatggcacatacatataaacttacatattttgacttccccggaaaggctgaagcaattagaatgatcttaagctatggagaaataccattcgaggacaaacgtatccagatgggggattggccaaaaattaagccaactactcctcttggacaacttcccatattagaggtcgatggtaaagaaatcccccaaagcactgcaatcagcaggtacttggcatctaaatttaaacctcgatggcaaagatctgaagggaaaatcttgcactagatgttgcagtagaaactctcttggatttacaaaaagttggcgtcggaataaagtatgaacaggacgctgctaagagagcagagaacgttgaaaaatcgaaac

SEQ ID NO: 1345 - DNA, 271 bp, Diabrotica virgifera
  Clone ID: pGUT3283
catcgaaaagattataatacccatgttcgtccgtctaaagatctggtctactggcaaggatcgatcccaccgtaaaccgataatctcaacggaaataagggctcgtgcgacagtcgtagcgaactacgattgcctagtaaagtcacattgttttgagcctttcgactctcggaactccaagagatatcgttgccacctttgactagaaaggatacggccttagaggcgttcaggcataatcccacggatggtagcttcgcaccattacccg

SEQ ID NO: 1346 - DNA, 249 bp, Diabrotica virgifera
  Clone ID: pGUT3679
atgttcgtccgtctaaagatctggtctactggcaaggatcgatcccaccgtaaaccgataatctcaacggaaataaaggctcgtgcgacagtcgtagcgaactacgattgcctagtaaagtcacattgttttgagcctttcgactctcggaactccaagagatatcgttgccacctttgactagaaaggatacggccttagaggcgttcaggcataatcccacggatggtagcttcgcaccattacccg

SEQ ID NO: 1347 - DNA, 297 bp, Diabrotica virgifera
  Clone ID: pGUT3233
cgtctacagacaattccgagttccaacatcgaaaagattataatacccatgttcgtccgtctaaagatctggtctactggcaaggatcgatcccaccgtaaaccgataatctcaacggaaataagggctcgtgcgacagtcgtagcgaactacgattgcctagtaaagtcacattgttttgagcctttcgactctcggaactccaagagatatcgttgccacctttgactagaaaggatacggccttagaggcgttcaggcataatcccacggatggtagcttcgcaccattacccg

SEQ ID NO: 1348 - DNA, 303 bp, Diabrotica virgifera
  unsure (1)..(303): unsure at all n locations
  Clone ID: pGUT1112
ccaacatcgaaaagattataatacccatgttcgtccgtctaaagatctggtctactggcaaggatcgatcccaccgtaaaccgataatctcaacggaaataatggctcgtgcgacagtcgtancgaactacgattgcctagtanagtcacattgttttgagcctttcgactctcggaactccaagagatgtcgttgccacctttgactacaaaggatacggccttatatgcgttcaggcataatcccacggatggtatcttcgcaccattacccgctcgagtaagtgcgtcaaccanatgtcc

SEQ ID NO: 1349 - DNA, 328 bp, Diabrotica virgifera
  unsure (1)..(328): unsure at all n locations
  Clone ID: pGUT466
ccgggcgacatgagttcgaggagagacaaatacagacatcgagaaaattatagtaaccatgttcgtcagtctgagagatctggtctactggcanagatcaatcccaccgtaaaccgatgatctcaacagagatactggctcgtgcgacagtcgtatcgaactacgattgcctactaaagtcacattgttttgagcctctcgactctctgaactccaagagatatcgtcgccacctttgactagaaaggataccgacttaaaggcgttcaagcataatcccgcggatggtagcttctcaccattactcgctctagtaagtgcctcgtgc

SEQ ID NO: 1350 - DNA, 378 bp, Diabrotica virgifera
  Clone ID: pGUT2793
acctttgactagagaggatacggccttataggcgttcaggcataatcccacggatggtagcttcgcaccattacccgctcgagttataaatggtgtaactaacacaacctcgactttcttttatatatatagatgtaaaatatttaaatggctattaaaaaataacggtctgagataaaaaattgaaaatttaggattgtatgtatcttttgcttctacatctcataaaaatagtaaaaaacggtttttccaaaaattaaaaaaatatatcaggggggcaacaccccttatgacgtacgggtatgaaactccatattatcctattcccagaccgctagaatatacatgtaaaatttcataaaaatctgttcagtcgtt

SEQ ID NO: 1351 - DNA, 459 bp, Diabrotica virgifera
  Clone ID: LIB150-013-Q1-E1-H5
gtaataatttgttttatagactaaagcacattcctcgtccaaagatgcaggtatgcatcttgggagatcagcaacattgtgacgaagctaacgccaacaatgttccattcatggatgtagaagccttgaaaaaattgaacaaaaacaagaaattggttaagaaactagccaagaaatatgatgctttccttgcttctgaagccctcatcaaacagatccccaggttgttgggtccaggtttgaacaaggctggtaaattccctggtcttctctcccaccaggaatccatgacacagaaaattgatgaagtaaaagcaacaatcaaattccaaatgaagaaggtactctgcctttctgttgctgttggtcatgtaggcatgaatcaagatgaattggttcaaaatgtccatctttcaatcaacttcttggtctcactgttgaagaaacattggcagaacg

SEQ ID NO: 1352 - DNA, 453 bp, Diabrotica virgifera
  unsure (1)..(453): unsure at all n locations
  Clone ID: LIB150-022-Q1-E1-B9
ccacgcgtcaggcaattcagcggaaccgtcaaactaaagcacattcctcgtccaaagatgcaggtatgcatcttgggagatcagcaacattgtgacgaagctaacgccaacaatgttccattcatggatgtagaagccttgaaaaaattgaacaaaaacacgaaattggttaagaaactagccaagaaatatgatgctttccttgcttctgaagccctcatcaaacagatccccaggttgttgggtccaggtttgaacaaggctggtaaattccctggtcttctctcccaccaggaatccatgacacagaaaattgatgaagtaaaagcaacaatcaaattccaaatgaagaaggtactctgcctttctgttgctgttggtcatgtaggcatgaatcaagatgaattggttcaaaatgtncatctttcaatcaacttcttggtctcactgttg

SEQ ID NO: 1353 - DNA, 411 bp, Diabrotica virgifera
  Clone ID: LIB149-004-Q1-E1-F7
aggacagccgcaaaagttgtgtcttgaaaaataaaaatgacgtctaaagtatctcgtgatactctatacgagtgtgtgaatggagtcttggaaaatgccaaggagaagaaaaggaactttttggaaaccgtggaactccagatcggtcttaagaactacgatccccaaaaggataagcgtttcagcggaaccgtcaaactaaagcacattcctcgtccaaagatgcaggtatgcatcttgggagatcagcaacattgtgacgaagctaacgccaacaatgttccattcatggatgtagaagccttgaaaaaattgaacaaaaacaagaaattggttaagaaactagccaagaaatatgatgctttccttgcttctgaagccctcatcaaacagatccccaggttgttgggt

SEQ ID NO: 1354 - DNA, 407 bp, Diabrotica virgifera
  Clone ID: LIB149-023-Q1-E1-H4
tcggcgcaaaagttgtgtcttgaaaaataaaaatgacgtctaaagtatctcgtgatactctatacgagtgtgtgaatggagtcttggaaaatgccaaggagaagaaaaggaactttttggaaaccgtggaactccagatcggtcttaagaactacgatccccaaaacgataagcgtttcagcggaaccgtcaaactaaagcacattcctcgtccaaagatgcaggtatgcatcttgggagatcagcaacattgtgacgaagctaacgccaacaatgtgccattcatggatgtagaagccttgaaaaaattgaacaacaacaagaaattggttaagaaactagccaagaaatatgatgctttccttgcttctgaagccctcatcaaacagattcccaggttgttgggt

SEQ ID NO: 1355 - DNA, 358 bp, Diabrotica virgifera
  Clone ID: LIB150-003-Q1-E2-E12
cgggtcgaccacgcgtcaggcgattcaagcggaacgtcaaactaaagcacattcctcgtccaaagatgcaggtatgcatcttgggagatcagcaacattgtgacgaagctaacgccaacaatgttccattcatggatgtagaagccttgaaaaaattgaacaaaaacaagaaattggttaagaaactagccaagaaatatgatgctttccttgcttctgaagccctcatcaaacagatccccaggttgttgggtccaggtttgaacaaggctggtaaattccctggtcttctctcccaccaggaatccatgacacagaaaattgatgaagtaaaagcaacaatcaaattccaaatgaa

SEQ ID NO: 1356 - DNA, 284 bp, Diabrotica virgifera
  Clone ID: LIB150-003-Q1-E1-E12
agcgtttcagcggaaccgtcaaactaaagcacattcctcgtccaaagatgcaggtatgcatcttgggagatcagcaacattgtgacgaagctaacgccaacaatgttccattcatggatgtagaagccttgaaaaaattgaacaaaaacaagaaattggttaagaaactagccaagaaatatgatgctttccttgcctctgaagccctcatcaaacagattccaggttgttgggtccaagtttggacaaaggtgggaaaatccctggtcctcccccccaacaag

SEQ ID NO: 1357 - DNA, 353 bp, Diabrotica virgifera
  Clone ID: LIB3026-021-Q1-E1-C8
cacgcgtcagcccacgcgtccggtttttgagccgtcaacatgggtaagccccgtggattgagaaccgctaggaaacatgtgaatcaccgtcgtgaacaaagatgggctgataaagattacaaaaaggcacatttaggaactagatggaaggctaatccttttggaggtgcttctcatgctaaaggaattgtattggaaaaagtgggagttgaagcaaaacaacctaactctgctattcgcaagtgcgttagggtacagttaattaaaaatggtaaaaaaatcacagccttcgtacctagagatgggtgcttaaaccatatagaagaaaacgatgaagttctagatgcacgttt

SEQ ID NO: 1358 - DNA, 297 bp, Diabrotica virgifera
  Clone ID: pGUT1570
gtttttgagccgtcaacatgggtaagccccgtggattgagaaccgctaggaaacatgtgaatcaccgtcgtgaacaaagatgggctgataaagattacaaaaaggcacatttaggaactagatggaaggctaatccttttggaggtgcttctcatgctaaaggaattgtattggaaaaagtgggagttgaagcaaaacaacctaactctgctattcgcaagtgcgttagggtacagttaattaaaaatggtaaaaaaatcacagccttcgtacctagagatggttgcttaaaccata

SEQ ID NO: 1359 - DNA, 267 bp, Diabrotica virgifera
  Clone ID: pGUT1922
ggattgagaaccgctaggaaacatgtgaatcaccgtcgtgaacaaagatgggctgataaagattacaaaaaggcacatttaggaactagatggaaggctaatccttttggaggtgcttctcatgctaaaggaattgtattggaaaaagtgggagttgaagcaaaacaacctaactctgctattcgcaagtgcgttagggtacagttaattaaaaatggtaaaaaaatcacagccttcgtacctagagatggttgcttaaaccatata

SEQ ID NO: 1360 - DNA, 297 bp, Diabrotica virgifera
  unsure (1)..(297): unsure at all n locations
  Clone ID: pGUT1102
tttgagccgtcaacatgggtaagccccgtggattgagatccgctaggaaacatgtgaatcaccgtcgtgaacaaagatgggctgatanagattacaaaaaggcacatttaggaactacatggaatgctaatccttttggaggtgcttctcatgctaaaggatttgtattggataaagtgggagttgaagcagaacgacctaactctgctatacgcaagtgcgttagggtacagttaattaaaaatggtaaaaaaatcacagccttcgtacctaaagatggttgcttaaaccatatag

SEQ ID NO: 1361 - DNA, 333 bp, Diabrotica virgifera
  Clone ID: LIB3026-009-Q1-E1-H3
ccaggcgtccgcgacaacatgggtaagccccgtggattgagaaccgctaggaaacatgtgaatcaccgtcgtgaacaaagatgggctgataaagattacaaaaaggcacatttaggaactagatggaaggctaatccttttggaggtgcttctcatgctaaaggaattgtattggaaaaagtgggagttgaagcaaaacaacctaactctgctattcgcaagtgcgttagggtacagttaattaaaaatggtaaaaaaatcacagccttccgtacctagagaatggttgcttaaaccatatagaaaaaaacaatgaatttcaatttgcaggtt

SEQ ID NO: 1362 - DNA, 269 bp, Diabrotica virgifera
  Clone ID: pGUT482
tgagccgtcaacatgggtaagccccgtggattgagaaccgctcggaaacatgtgaatcaccgtcgtgatctaagatgggctgataacgattactgaaaggcacatttaggaactagatggaacgctaatccttttggaggtgcttctcacgctaaaggaattgtattggaaaaagtgggagttgaagcaaaacaacctaactctgctatgcgcaagtgcgttagggtacagttaattaatcatggtaaaaaaatcacagccttcgtacc

SEQ ID NO: 1363 - DNA, 428 bp, Diabrotica virgifera
  Clone ID: LIB149-014-Q1-E1-B4
tgcaaatcatcgttaaaaccttaacgggtaagaccatcacccttgaggtcgagccctcagatactatcgaaaatgtgaaagctaaaatccaggataaagaaggaattcctccagaccagcaacgtctcatcttcgctggaaaacaactcgaagatggtcgtaccttgtctgactataatattcaaaaagaatcaacccttcacttggtgttgagattgagaggaggtgctaagaaacgtaagaagaagaattactccacccccaagaaaatcaagcacaagaagaagaaggttaagttagctgtattgaaattttataaggttgacgaaaatggtaaaatccaccgattgagacgtgaatgccccgctgaacaatgtggagctggtgtcttcatggcagccatggaagacaggcattactgtggcaag

SEQ ID NO: 1364 - DNA, 442 bp, Diabrotica virgifera
  Clone ID: LIB3026-006-Q1-E1-B10
gttctttttacagcgtgttatggtggagtagtcgttgactccccaaaatgcagatcttcgttaaaaccttaacgggtaagaccatcactcttgaggtcgagccctcagatactatcgaaaatgtgaaagctaaaatccaggataaagaaggaattcccccagaccagcaacgtctcatcttcgctggaaaacaactcgaagatggtcgtaccttgtctgactataatattcaaaaagaatcaacccttcacttggtgttgagattgagaggaggtgctaagaaacgtaagaagaagaattactccacccccaagaaaatcaagcacaagaagaagaaggttaagttagctgtattgaaattttataaggttgacgaaaatggtaaaatccaccgattgagacgtgaatgccccgctgaacaatgtggagctggtgtcttcat

SEQ ID NO: 1365 - DNA, 408 bp, Diabrotica virgifera
  Clone ID: LIB3026-002-Q1-E1-E9
accacgcgtccgggagtagtcgttgactccccaaaatgcagatcttcgttaaaaccttaacgggtaagaccatcactcttgaggtcgagccctcagatactatcgaaaatgtgaaagctaaaatccaggataaagaaggaattcccccagaccagcaacgtctcatcttcgctggaaaacaactcgaagatggtcgtaccttgtctgactataatattcaaaaagaatcaacccttcacttggtgttgagattgagaggaggtgctaagaaacgtaagaagaagaattactccacccccaagaaaatcaagcacaagaagaagaaggttaagttagctgtattgaaattttataaggttgacgaaaatggtaaaatccaccgattgagacgtgaatgccccgctgaac

SEQ ID NO: 1366 - DNA, 438 bp, Diabrotica virgifera
  Clone ID: LIB3026-022-Q1-E1-H5
cacgcgtccggaaaagtagttctttttacagcgtgttatggtggagtagtcgttgactccccaaaatgcagatcttcgttaaaaccttaacgggtaagaccatcactcttgaggtcgagccctcagatactatcgaaaatgtgaaagctaaaatccaggataaagaaggaattcccccagaccagcaacgtctcatcttcgctggaaaacaactcgaagatggtcgtaccttgtctgactataatattcaaaaagaatcaacccttcacttggtgttgagattgagaggaggtgctaagaaacgtaagaagaagaattactccacccccaagaaaatcaagcacaagaagaagaaggttaagttagctgtattgaaatttcacaaggttgacgaaaatggtaaaacccaccgattgagacgtgaatgccccgctgaac

SEQ ID NO: 1367 - DNA, 406 bp, Diabrotica virgifera
  Clone ID: LIB149-047-Q1-E1-D1
agtcattgtctccccaaaatgcagatcttcgttaaaaccttaacgggtaagaccatcactcttgaggtcgagccctcagatactatcgaaaatgtgaaagctaaaatccaggataaagaaggaattcccccagaccagcaacgtctcatcttcgctggaaaacaactcgaagatggtcgtaccttgtctgactataatattcaaaaagaatcaacccttcacttggtgttgagattgagaggaggtgctaagaaacgtaagaagaagaattactccacccccaagaaaatcaagcacaagaagaagaaggttaagttagctgtattgaaattttataaggttgacgaaaatggtaaaatcccacgattgagacgtgaatgcccgctgaacaatgtggagctggtgt

SEQ ID NO: 1368 - DNA, 424 bp, Diabrotica virgifera
  Clone ID: LIB3026-019-Q1-E1-B9
agcccacgcgtccgcccacgcgtccgagatggtcgtaccttgtctgactataatattcaaaaagaatcaacccttcacttggtgttgagattgagaggaggtgctaagaaacgtaagaagaagaattactccacccccaagaaaatcaagcacaagaagaagaaggttaagttagctgtattgaaattttataaggttgacgaaaatggtaaaatccaccgattgagacgtgaatgccccgctgaacaatgtggagctggtgtcttcatggcagccatggaagacaggcattactgtggcaagtgcggttacactcttgtcttctccaaaccaggagatgagaaatagatatatgtccttggatagtgtttaagaaaaaaatttggaaaaaccttggttaatttgaataaaatattcgaggaag

SEQ ID NO: 1369 - DNA, 607 bp, Diabrotica virgifera
  Clone ID: pGUT3284
gaatagtcagtatgaaaacatacgtgatagtattttgcgttgtaagttttactgtttgcaatgtaattggacaaaagaagaatcactttgctggaggaagaaacacgatcgtacagctgtttgaatggcactgggatgctattgccaatgaatgtgagaatttcttgggaccgaaaggatttgctggagtacaggtatctccaccaaatgagaattgtgtagtaaatggcagaccgtggtgggaaagatatcaaccagtaagctatcaactcattacccgatctggagatgaaactgcatttgcgaatatggtacgacgttgtaataacgcaggagtcagaatctacgttgatgttgtcattaaccacatgtcggggattactggtaatggtaccggaggaaagtcatctgatgctggttctttatcctatccaggagtaccattcgggccgaaccactttcattctcgttgtgatattaataattatcaagaatcgcacactattagaaactgtgcacttaccggattaccagatttggatcagagtcacgaacatgttcgtaagaaaattgtcgagtacctcaaccatttagtagatctgggagt

SEQ ID NO: 1370 - DNA, 436 bp, Diabrotica virgifera
  Clone ID: LIB149-028-Q1-E1-A7
agtcagtggccaacatgaaaattgtaatattgttttgcgccttgagcgttactgtgtccagtgtaattggacaaaaagataatcacttcgctcaaggaagaaacaccattgtacacctgtttgaatggcactgggatgctattgctagtgaatgcgagaacttcttgggacctaaaggatttgctggtgttcaggtatctccaccaaatgaaaattccgtaataggagacagaccatggtgggaaagataccaaccagtaagttaccaactcactacccgatctggagatgaaagtgcatttgctaatatggtacaacgttgtaacaatgtgggagtcagaatatacgtcgatgttgtcttcaaccacatgtcagcgacatctggtggtggtactgctgggggttcatgtgacgttggatctctatcatacccatc

SEQ ID NO: 1371 - DNA, 422 bp, Diabrotica virgifera
  Clone ID: LIB150-013-Q1-E1-E9
cacacgcgtccgatttgattaaggcaggaatagtcagtatgaaaacatacgtgatagtattttgcgttttaagttttactgtttccaatgtaattggacagaagaagaatcactttgctggaggaagaaacacgatcgtacagctgtttgaatggcactgggatgctattgccaatgaatgtgagaatttcttgggaccgaaaggatttgctggagtacaggtatctccaccaaatgagaattgtgtagtaaatggcagaccgtggtgggaaagatatcaaccagtaagctatcaactcattacccgatctggagatgaaactgcatttgcgaatatggtacgacgttgtaataacgcaggagtcagaatctacgttgatgttgtcattaaccacatgtcggggattactggtaatggtacc

SEQ ID NO: 1372 - DNA, 404 bp, Diabrotica virgifera
  Clone ID: LIB150-007-Q1-E1-A10
accacgagtccgatttgattaaggcaggaatagtcagtatgaaaacatacgtgatagtattttgcgttttaagttttactgtttccaatgtaattggacagaagaagaatcactttgctggaggaagaaacacgatcgtacagctgtttgaatggcactgggatgctattgccaatgaatgtgagaatttcttgggaccgaaaggatttgctggagtacaggtatctccaccaaatgagaattgtgtagtaaatggcagaccgtggtgggaaagatatcaaccagtaagctatcaactcattacccgatctggagatgaaactgcatttgcgaatatggtacgacgttgtaataacgcaggagtcagaatctacgttgatgttgtcattaaccacatgtccggg

SEQ ID NO: 1373 - DNA, 399 bp, Diabrotica virgifera
  Clone ID: LIB149-030-Q1-E1-A12
agatttgattaaggcaggaatagtcagtatgaaaacatacgtgatagtattttgcgttttaagttttactgtttccaatgtaattggacagaagaagaatcactttgctggaggaagaaacacgatcgtacagctgtttgaatggcactgggatgctattgccaatgaatgtgagaatttcttgggaccgaaaggatttgctggagtacaggtatctccaccaaatgagaattgtgtagtaaatggcagaccgtggtgggaaagatatcaaccagtaagctatcaactcattacccgatctggagatgaaactgcatttgcgaatatggtacgacgttgtaataacgcaggagtcagaatctacgttgatgttgtcattaaacacatgtcggggaatac

SEQ ID NO: 1374 - DNA, 310 bp, Diabrotica virgifera
  Clone ID: pGUT1963
ggcaggaatagtcattatgaaaacatacgtgatactatgtcgcgttttaagttttactgtttccaatgtaattggacagaagatgattcactttgctggaggatgatacacgatcgtacagctgtctgattggcactgggatgctattgccaatgagtgtgagagtttcttgggaccgatccgattagctggagttcaggtatctcctccaactgacaattgtgtactaaatggtagaccgcggtgggaaagatatcaaccagtaagctagcgggtcattacccgatctggacatgaaactgcctttgcc

SEQ ID NO: 1375 - DNA, 393 bp, Diabrotica virgifera
  Clone ID: LIB149-049-Q1-E1-G10
agttctacagtcggtgtctccagttgtttattatcaaacaaaaatgtctctgacaatgattggtggtgtgaaaatccccatagtggggctaggaacatggcaggctaccaatgaagaagaattggaagctgccgttgaggcagctctggaaactggataccgccacatcgatactgcatctgcataccaaaacgagcatgtcatcggcaaagttctcaacaaatggttgacgtctggcaaacttaagagagaagatattttcattactaccaagcttccaatgacacacatccatcccgatctcgtcgaaacagctcttaaagaatccttacagaagcttcagctggactatgttgatttgtacttggtgcattctcccatatacatgaaatt

SEQ ID NO: 1376 - DNA, 392 bp, Diabrotica virgifera
  Clone ID: LIB150-037-Q1-E1-C12
cccacgcgtccggtcagtgtctccagttgtttattatcaaacaaaaatgtctctgacaatgattggtggtgtaaagatccccatagtggggctaggaacatggcaggctaccaatgaagaagaattggaaggtgccgttgaggcagctctggaaactggataccgccacatagatactgcatctgcataccaaaacgagcatgtcatcggcaaagttctaaataaatggttggcgtctggcaaacttaagagagaagatattttcattactaccaagcttccaatgacacacatccatcccgatctcgtcgaaacagctcttaaagaatccttacagaagcttcagctggactatgttgatttgtacttggtgcattctcccatatacatga

SEQ ID NO: 1377 - DNA, 438 bp, Diabrotica virgifera
  unsure (1)..(438): unsure at all n locations
  Clone ID: LIB149-010-Q1-E1-D11
acgcccacgcgtccgcccacgcgtccgcgtttatcaaagcgaagctcttatagggaaagttttaaagaaatgggttcccaatagaataaaaagggaagatatttttattaccagcaagtttcaaccaagagatgaattggatccagaagatacacttaaaaaaaccttagaggatcttcagctggattatgttgacttatatctaattcataatccatctgatgataatgaaaagaacctaaaaatatggaggagactagaagaacaggttgatgcacgaagggtcaaatatataggtctgtccaacttttctatcgaacaaatagaatatattttgcagaacggcagagtaaagcctgtcaatttacaagtgcaagtacatttgtatggtcagcgtanagaatttgtagagtattgcaaaaagaacaatatcacagt

SEQ ID NO: 1378 - DNA, 414 bp, Diabrotica virgifera
  unsure (1)..(414): unsure at all n locations
  Clone ID: LIB150-035-Q1-E1-H8
acacacacgtctgagaagatgctctgaacgctgcattagatgctggataccgccactttgacaccgctaccgtatatggaaatgaagccatcatcggtaaagttctaaataaatggttttcttctggaaaaattaagcgagaggacctattcattacaaccaaattgcccttatgtggaggacaccccgatagagtagaaatgtttattaaacagtcacttgaagatttaaaactggattatttggacttatatttgatccattttccagttactagtaattatatcggcgttcctgttacaccaccagattaatttaaattggaacctgtggatcatctttcactttggcagaaaatggaagaacaagtcgacgcaggcagaacanagtccatangagtctcaaactttactc

SEQ ID NO: 1379 - DNA, 276 bp, Diabrotica virgifera
  Clone ID: LIB149-015-Q1-E1-B12
cagcaaagttctaaataaatggttggcgtctggcaaacttaagagagaagatattttcattactaccaagcttccaatgacacacatccatcccgatctcgtcgaaacagctcttaaagaatccttacagaagcttcagctggactatgttgatttgtacttggtgcattctcccatatacatggaattttggtgaaccgggaaagcaatgggaactccaactaacggacaaccgggcggttgggaaaaaattggaaaaccagttgaatgcaaaag

SEQ ID NO: 1380 - DNA, 402 bp, Diabrotica virgifera
  Clone ID: LIB149-005-Q1-E1-F10
accgatgacgtgttcgtttccgtatgcggcagctgtgtcgatgtggcggtagcctagttctaaagcagcgtctagtgctgtctctatctcgctgtcgtctctagcttcccatgtgcccaatccaaccgtgggcatactcaatccaccacaagaaattgttttagccatattttatttataaatgatctccacaataaaaaaatcttgccggtattcgatatttgttcaccggaactgtcttgaaaaagtggttcgattctggcaaactgaccagagacgatctctttattgtcaccaaactcccagctccaggtatacatcccgatagggttgaaaaatatctgacaaaatcgttggctgatctgcagttggattacctggatctttatcctatacactttc

SEQ ID NO: 1381 - DNA, 451 bp, Diabrotica virgifera
  Clone ID: LIB150-019-Q1-E1-F12
gttagttaaagtttgtatgatagcttccgttaatatacactcgaagatgtttagtacgttattaagagcacccatgaggttttttgacaccaatgcaagtgggaggattctgaatagattctccaaagatatgggatccatagatgaaatattacccagagtactactagaatcagtgcagatttttttggttctgattggtatattggtgaatgtatcgatttcaagtccatacgccattatagctatgttacttttgggaatttgcttcctaaaattaagatcttgttacctatccatagcgatgtcgttgaaacatatagaaggaaaagtcaaatcgccgatgttttctcacgtcaactcttcattgcatggaatggcaaccattagagcttcaaatacagaagatatacttattaaggagtttgacgagcaccaaaatgttcacacg

SEQ ID NO: 1382 - DNA, 387 bp, Diabrotica virgifera
  Clone ID: LIB150-020-Q1-E1-C12
agttcgttaaagtttgtatgatagcttccgttaatatacactcgaagatgtttagtacgttattaagagcacccatgaggttttttgacaccaatgcaagtgggaggattctgaatagattctccaaagatatgggatccatagatgaaatattacccagagtactactagaatcagtgcagatttttttggttctgattggtatattggtgaatgtatcgatttcaagtccatacgccattatagctatgttacttttgggaatttgcttcctaaaattaagatcttgttacctatccatagcgatgtcgttgaaacatatagaaggaaaagtcaaatcgccgatgttttctcacgtcaactcttcattgcatggaatggcaacca

SEQ ID NO: 1383 - DNA, 380 bp, Diabrotica virgifera
  Clone ID: LIB150-003-Q1-E2-B3
acccacgagtccggcagttcgaagtccaatgcttggccatttaaactcatctctcgatggactttcaactattagagcatttaaagccgaagataccattagcacagaatttgatagacatcaagatttatatacatctgcaaactatgcttcagaatgctgccagagggcttttgggtactacttggatgtttgttgtactagatttataggtgctattattgcagcgttcatcattgttggaaaagaaactgctgttggggatgttggtttagcaataacacaagcgtttatgttgaatggcattgcccactacgccattacgctttgggcagatattgagaatatcatgacatcggtagaatggattttggaatacg

SEQ ID NO: 1384 - DNA, 400 bp, Diabrotica virgifera
  Clone ID: LIB149-003-Q1-E1-D10
aaggcgagctcgtccacgatcgaagcactgtgccaagtgggtcaaattgaccacattctactggctgagggagttggtacgcgcaagatcaatccacagacgcacaagtcagccagatccagatcagcgcaatacccagttctgtgttcaggaacgctcataaagatctcggatccatttgtcgacaacagcgatcaggtccattggaaagctttggtacaagtctgtctaaaacatgcagttaaagactaacctgcaccattaaacagtaatttggcagtgtgaagttcaaacttcactgtcggtcaacgacaaatggtgtgtcgagcaatagctgtagtaagatccaacatgatcacatgtaagatgaagctacagcaaatctgtatccgcacactga

SEQ ID NO: 1385 - DNA, 307 bp, Diabrotica virgifera
  Clone ID: pGUT3337
tgatcatacaggattcgcagactggtggctaaccccattgtttataagcgaaaacactgtaatatactttagcgctctgaacattcttatggtcgttataatgaacattagatcgtcttcattctacgcatggtctataactgcctcaacaaaaatgcacaataccatgttcgagaacatagtttatagtcccatgaggtttttcactataaatccttctgggagaatacttaataggttttccaaagatatcggtgccttagatgaagttttaccaatgactttcatggatactgttcaaattggt

SEQ ID NO: 1386 - DNA, 408 bp, Diabrotica virgifera
  Clone ID: LIB149-004-Q1-E1-B3
agcagacgcgtgggttcaaaatgctgccacagggcttttgggtactacttggatgtttgttgtactacatttataggtgctattaatgcatcgttcatcattgttggcaaagaaactggtgttggggatgttggtttagcaataacacaagcgtttatgttgaatggcattgcccaatacgccattaagctttgggcagatattgagaataaaatgacatcggtacaacggattttggaatacgttggtataaacacagaagacaatgaccttagggacatatttaaagattggtcttcaaacaatataatccaatacaaatatgtacattttcgttacgattatagtcaacagtatattttaaaagacattactattacaattaatgaacgagaaaaagttggaata

SEQ ID NO: 1387 - DNA, 643 bp, Diabrotica virgifera
  unsure (1)..(643): unsure at all n locations
  Clone ID: pGUT2301
ctagtatcgaacgagagtgggtgaagtgaaagtaatagtaattaataattaatatataattacacagattaaaaatgaagttttctgtataccttgcgctgctcatggtactagcggtagtagtctcgacttcagctaaacaccaccacaagaagaaaaactggcaggttcaaccagacgttggtcgtgacggagctggaaacgtcaatgcaggagtagaagtgaaaaactctggaaagaaccatgatttcgaagctggctggagcaaagtagtacgaggacccaatagagccaagcccacatggcacgtaggtggtacgtggaggttcaaaagatcgccggatccacaatgggaagtcaatcctggtgcaaaccgagatgaaaatggtaacgttaacgctggtgttgagcttaagaggaaaggaganaaacacgactttgatgcangatggaataaagtagtcagtgggcccaatagagctaaaccaacatggcatgtcggtggtacctttagattcaagagatcacctgtacctgattggcagtcaaccctgggggtaatcgagatgaagacggtaacgtaaatgctggtggttgaataaagaacataggcaaagatcatgattttaatgcttgatggaac

SEQ ID NO: 1388 - DNA, 421 bp, Diabrotica virgifera
  unsure (1)..(421): unsure at all n locations
  Clone ID: LIB149-015-Q1-E1-H8
gatgaagtgaaagcatcagcaaacagcatataaccataatacagatcaaaaatgaagttctgtgcataccttccactgctcatggtactggcggtggtagtctcgacttcagccaagcaccacaagaagagaaagaactggcaggttcaaccaggcgttggtcgtgacggagctggaaacgtcaatgcaggagtagaagtgaaaaattctgggaagaaccatgatttcgaagctggctggagcaaagtagtacgaggacccaatagagccaagcccacatggcacgtaggcggtacttggaggttcaaaagatcgccggattcacaatgggaagtcaatcctggtgcaaaccgagatgaaaatggtaacgtcaacgccggtgttgagcttaaaaggaaaggagaanaacacgactttgatg

SEQ ID NO: 1389 - DNA, 547 bp, Diabrotica virgifera
  unsure (1)..(547): unsure at all n locations
  Clone ID: pGUT3369
agctaaccaacattgcatgtaggtggtacatggagattcaagagatcgccaaaaccagattgggaagtgaatccaagagctaacggtgatggaaatggtaacactaatgctggagtagaaataagaaataaggacaaagatcatgacttccaggctggatggaacaaagttgtccatggacccaacagagctaaaccaacatggcatgtaggtggtacctggagattcaagagatcacctaaaccagattgggaagtgaatccaggagctaaccgtgatgatgatggtaacactaatgctggcgttcaagtgaaaaatcatggaaatgaccacgattttgaagcaggatggagcaaagtagttagcggacccgatagggctaaaccaacatggcatgtangtggtacttggagattctagaatcctatagcaataggaatattaggaaatacaaatattctcgtattttgtactatttatttaatttattgggtgataaaaattaaatagaaaaaaaaaaaaaaaaaaaaaaacctgaggggggggc

SEQ ID NO: 1390 - DNA, 344 bp, Diabrotica virgifera
  unsure (1)..(344): unsure at all n locations
  Clone ID: pGUT1248
ggaaatggtaacactaatgctggagtagaaataagaaataaggacaaagatcatgacttccaggctggatggaacaaagttgtccatggacccaacagagctaaaccaacatggcatgtaggtggtacctgaagattcaagagatcacctaaaccagattgggaagtgaatccaggagctaaccgtgatgatgatggtaacactaatgctggcgttcaagtgaaaaatcatggaaatgaccacgattttgaagcaggatggagcanagtagttagcggaaccgatagggctaaaccaacatggcatgtaagtggtacttggagattctaaaatcctatagcaat

SEQ ID NO: 1391 - DNA, 307 bp, Diabrotica virgifera
  unsure (1)..(307): unsure at all n locations
  Clone ID: pGUT1245
ggaaatggtaacactaatgctggagtagaaataagaaataaggacaaagatcatgacttccaggctggatggaacaaagttgtccatggacccaacagagctaaaccaacatggcatgtaggtggtacctgaagattcaagagatcacctanaccagattgggaagtgaatccaggagctaaccgtgatgatgatggtaacactaatgctggcgttcaagtgataaatcatggaaatgaacacgattttgaagcaggatggagcanagtatttagcggaaccgatagggctaaaccaacatggcatg

SEQ ID NO: 1392 - DNA, 418 bp, Diabrotica virgifera
  Clone ID: LIB149-031-Q1-E1-G2
cgggccgacccacgcgtcaagctaaaccaacatggcatgtacgtggcagcttcagattcaagagatcaccaaaaccagattgggaagtacaacctggagcaaacggtgatggtaatggtaacactaacgctggtgtagaagtaagaaataagggcaaagatcatgactttcaggctggatggaacaaagttgtccatggacccaatagagctaaaccgacatggcatgtatgtggtagcttcagattcaagagatcaccaaaaccagattgggaagtacaacctggagcaaacggtgatggaaatggtaacactaatgccggtgtagaagtaagaaataagggcaaagatcatgacttccaggctggatggaacaaagttgtccatggacccaacagagctaaaccaacatggcatgt

SEQ ID NO: 1393 - DNA, 399 bp, Diabrotica virgifera
  unsure (1)..(399): unsure at all n locations
  Clone ID: LIB149-023-Q1-E1-D9
acccacgcgtccgcaagacagtggaaacaacacaaacccaactccagctcctaattcatgtcaaaaagaaggtgtcgtttgcccggcagtagatggacccgattcggtttatttccctctcagggattgtactaaattctgccaatgttccaacggtgtgccatatgagcatgcctgtcctgctggncttcacttcaacccaaaactgaatgtttgcgattggccacagaatgcaggatgcggaggctcagacccagtgacaacagaacaaactattacaccaacacaagacagtggaaacaacacaaactcaactccagctcctaattcatgtcaaaaagaaggtgtcgtttgcccggcagtagatggacccgattcggtttatttccctctcagcga

SEQ ID NO: 1394 - DNA, 648 bp, Diabrotica virgifera
  unsure (1)..(648): unsure at all n locations
  Clone ID: pGUT3297
atcataaacaactgcgattggcccgataatgttgattgctcttacgttgttaccacaagtgcaaaacctacatctgctgccccagatacttccacctcagctacgcaaagcactccttcacaagttcccacggaatcaactgctgcccctggaccatacacaacaccagatctcatatgtacagatgaaaataattattttccttacatttatgattgctcaaaatactacgaatgttccaacggagtaccagttttaatggattgtccaaaaggagaattttggaatattaaactgaataactgcgattggcctcaaaatgttgattgttcatacgttgtaaccacatctggagcatctactgtatctactgaagcacctactaaagcacctacagaagcacctactgatgtacctaccgatgcacctacggaaggacctggaccatactacacgacaccagaaattatatgtaaagaagataatacttatttcccatatatttttgactgctccaaatattacgaatgctcaaacggacagccaattctaatgacatgtcctgctggacagttatggagtaatttactaaaaacatgtgattggcccgcanacgtcgattgctcatacgtcgtaaaccactctggt

SEQ ID NO: 1395 - DNA, 637 bp, Diabrotica virgifera
  unsure (1)..(637): unsure at all n locations
  Clone ID: pGUT3432
caactcctgaaatgatctgtactgatgacaacacctatgtcccttacatttttgattgctgaaagtactacgaatgttccaacggaataccagttctaatggattgcccagcaggcgagttatggaatattatcataaacaactgcgattggcccgataatgttgattgctcttacgttgttaccacaagtgcaaaacctacatctgctgccccagatacttccacctcagctacgcaaagcactccttcacaagttcccacggaatcaactgctgcccctggaccatacacaacaccagatctcatatgtacagatgaaaataattattttccttacatttatgattgctcaaaatactacgaatgttccaacggagtaccagttttaatggattgtccaaaaggagaattttggaatattaaactgaataactgcgattggcctcaaaatgttgattgttcatacgttgtaaccacatctggagcatctactgtatctactgaagcacctactanagcacctacagaagcacctactgatgtacctaccgatgcacctacgggaggacctgtaccatactacacgacacccgaaattatatgtaaagaagataatacttatttcccatatatttt

SEQ ID NO: 1396 - DNA, 636 bp, Diabrotica virgifera
  unsure (1)..(636): unsure at all n locations
  Clone ID: pGUT2347
gattgctcaaagtactacgaatgttccaacggaataccagttctaatggattgcccagcaggcgagttatggaatattatcataaacaactgcgattggcccgataatgttgattgctcttacgttgttaccacaagtgcaaaacctacatctgctgccccagatacttccacctcagctacgcaaagcactccttcacaagttcccacggaatcaactgctgcccctggaccatacacaacaccagatctcatatgtacagatgaaaataattattttccttacatttatgattgctcanaatactacgaatgttccaacggagtaccagttttaatggattgtccaaaaggagaattttggaatattaaactgaataactgcgattggcctcaaaatgttgattgttcatacgtngtaaccacatctggagcatctactggatctactgaagcacctactanagcacctacagaagcacctactgatgtacctaccgatgcacctacngaaggacctgaccatactacacgacaccagaaatatatngtaagaagataatacttatttcccatatattnttgactgctncaaatattacgaatgctcaaacggacagccaattctaatgacatg

SEQ ID NO: 1397 - DNA, 229 bp, Diabrotica virgifera
  unsure (1)..(229): unsure at all n locations
  Clone ID: pGUT597
gtttgtgtgacagtctgttctgttgtcactgggtcggagcctccgcaacctgcattctgtggccaatcgcaaaccttcagttttgggttgaagtgaagaccagcaggataagcatgttcatatggcacaccgttggaacattggcagaatttagtacaatccctgagaggcaaataaactgaatcgggtccatctactgctgggcaaacgaacacttctntttgacatg

SEQ ID NO: 1398 - DNA, 338 bp, Diabrotica virgifera
  unsure (1)..(338): unsure at all n locations
  Clone ID: LIB149-033-Q1-E1-F12
aacccacgcgtccggacagcggaaacaacacaaactcaactccagctcctaattcatgtcaaaaagaaggtttcgtttgcccggcagtagatggacccgattcggtttattttccctctcagggattgtactaaattctgccaatgttccaacggtgtgccatatgaacatgcttgtcctgctggtcttcacttcaacccanaactgaatgtttgcgattggccacagaatgcaggatgcggaagctcagacccagttgacacagaacagactgttacaccaacacaagacagtggaaacaacacaaactcaactcgagctcctaattcatgtcaaaa

SEQ ID NO: 1399 - DNA, 433 bp, Diabrotica virgifera
  Clone ID: LIB150-014-Q1-E1-B9
attgaagcttccgacggtatcatggtagctcgtggagatcttggtatcgaaatcccaaccgaaaaagtattcatcgctcaaaaggccatgattgcccgatgcaacaaggccggcaaacccgtcatctgcgccacccagatgttggaatctatgaccaaaaaaccaagacctactcgtgccgagagctcagacgttgctaatgccgttatcgacggtgctgactgtgtgatgttgtcaggagagaccgccaaaggagactatcctttggactgtgtccgaaccatggctaatatctgcaaggaagctgaagctgctatctggagcggcgaattcttcggtgacttgacctcaatgattcctgttccattagatatggcacaagctatcgctatttccgctgtcgaatctgccaataaaacaatgggagctgcca

SEQ ID NO: 1400 - DNA, 471 bp, Diabrotica virgifera
  Clone ID: LIB150-029-Q1-E1-C5
agaatttttgcagaatttgtgccggctctcacgtgtaaaagtaactgatttccatcgttttcctttctaagattcttcaagtgtatcagtaataatctcctaagatggctcaaaatgttttgccattccaactccaagctttggagaagaaaaaccacttggaccatttgtgtgcccttgatatcaattccagagcctcgtttatccgtctttctggaataatatgtaccattggacccgcttcaagggacccagagatcttggtccaaatgatggaatctggtatgaactgtgcccgtttgaacttctctcacggttctcacgaatatcacgctgagaccatcgccaacatcagaaaggccgtcgaaatgtacagcaagaaaatcggcatgccctacccattggccattgccctagacaccaaaggtcctgaaattcgtactggacttttagaagggggtggctctgctg

SEQ ID NO: 1401 - DNA, 456 bp, Diabrotica virgifera
  Clone ID: LIB150-030-Q1-E1-B6
cataattaagaatttttgcagaatttgtgccggctctcacgtgtaaaagtaactgatttccatcgttttcctttctaagattcttcaagtgtatcagtaataatctcctaagatggctcaaaatgttttgccattccaactccaagctttggagaagaaaaaccacttggaccatttgtgtgcccttgatatcaattccagagcctcgtttatccgtctttctggaataatatgtaccattggacccgcttcaagggacccagagatcttggtccaaatgatggaatctggtatgaactgtgcccgtttgaacttctctcacggttctcacgaatatcacgctgagaccatcgccaacatcagaaaggccgtcgaaatgtacagcaagaaaatcggcatgccctacccattggccattgccctagacaccaaaggtcctgaaattcgtactggact

SEQ ID NO: 1402 - DNA, 436 bp, Diabrotica virgifera
  unsure (1)..(436): unsure at all n locations
  Clone ID: LIB150-033-Q1-E1-H7
attcagttcagtgggtaaggttctaggaaagaaaattcaaacatgaaggctattgtcaggaccggaaggatggctcaaaatgttttgccattccaactccaagctttggagaaaaagaaccacttggaccatttgtgtgcccttgatatcaattccagagcctcgtttatccgtctttctggaataatatgtaccattggacccgcttcaagggacccagagatcttggtccaaatgatggaatctggtatgaactgtgcccgtttgaacttctctcacggttctcacgaatatcacgctgagaccatcgctaacatcagaaaggccgtcgaaatgtacagcaagaaaatcggcatgccctacccattggccattgccctagattacaaaggtcctgaaattcgtactggacttttaaanggggtggctctgctga

SEQ ID NO: 1403 - DNA, 394 bp, Diabrotica virgifera
  Clone ID: LIB149-025-Q1-E1-D3
aacggcaatgggaaattatcctttggacggtgtccgaacaacggctaatatctgcaaggaagctgaagctgctatctggagcggcgaattcttcggtgacttgacctcaatgattcctgttccattagatatggcacaagctatcgctatttccgctgtcgaatctgccaataaaacaatggcagctgccatagttgtaataactacatcatgaaaatcagctcatctgatagccatattcaagcccagatgctctatcatcgctgttacgcgtattccacaaactgcacgtcaatgccaaatgtacagagccatcctacctttgatctacgaagctgaacgtaaagaagactggctccatgacgtatacgctagattacactatggtatcaca

SEQ ID NO: 1404 - DNA, 411 bp, Diabrotica virgifera
  Clone ID: LIB150-018-Q1-E1-C4
caggtggtacataatttagaattttgcagaatttgtgccggctctcacgtgttaaaattactgatttccatcgttttcctttctaagattcttcaagtgtaccagtaataatctcctaagatggctcaaaatgttttgccattccaactccaagctttggagaagaaaaaccacttggaccatttgtgtgcccttgatatcaattccagagcctcgtttatccgtctttctggaataatatgtaccattggacccgcttcaagggacccagagatcttggtccaaatgatggaatctggtatgaactgtgcccgtttgaacttctctcacggttctcacgaatatcaagctgagaccatcgccaacatcagaaatgccgtcgaaatgtacagcaagaaaatcggcatgccc

SEQ ID NO: 1405 - DNA, 613 bp, Diabrotica virgifera
  unsure (1)..(613): unsure at all n locations
  Clone ID: pGUT3403
gaagtgtgtaccctttgagtcgaaggttctaaatctcaggatcctaagaaaagccaccatggttgacgctgcagttttggacaaacttgaaagtggattcgccaagattaaagattccaactccaaatccctcttaaagaaacaccttacccaagaaatcttcgacaacctcaaaaccaagaaaacccccactttcggttgcacacttctagatgtcatccaatctggcttagaaaatcacgactccggcgtaggtatctacgccccagatgctgaatcctacaccgtcttcgctgacatcttcgatcccatcattgaagactaccatggtggattcaagaagaccgacaagcacccccccaagaactggggtgacgttagcgtattcggcgacttagaccccaccggtgagtttgttgtgtccacccgtgtcagatgcggacgttccatggaaggatacccattcaacccatgcttgaccgaagaacaatataaagaaatggaacaaaaagtttccagcactctctctggccttgaggtgaacttaaaggaacattctacccattgactggtatgagcaaagacgtccaacanaagttgatcgacgaccatt

SEQ ID NO: 1406 - DNA, 448 bp, Diabrotica virgifera
  unsure (1)..(448): unsure at all n locations
  Clone ID: LIB149-029-Q1-E1-H7
acggacgcgtgggcttcgatcccatcattgaagactaccatggtggattcaagaagaccgacaagcacccccccaagaactggggtgacgttagcgtattcggcgacttagaccccaccggtgagtttgttgtgtccacccgtgtcagatgcggacgttccatggaaggatacccattcaacccatgcttgaccgaagaacaatataaagaaatggaacaaaaagtttccagcactctctctggccttgaaggtgaacttaaaggaacattctacccattgactggtatgagcaaagacgtccaacaaaagttgatcgacgnacatttcctgttcnaggaaagagaccgattcttgcaagctgccaacgcctgcagattctggccctctggtcgtggaatctaccacaacgagaacaaaaccttcttagtatggtgcaacgaagaaga

SEQ ID NO: 1407 - DNA, 420 bp, Diabrotica virgifera
  Clone ID: LIB149-003-Q1-E1-E5
acttttgtgaagtgtgtaccctttgagtcgaaggttctaaatctcaggatcctaagaaaagccaccatggttgacgctgcagttttggacaaacttgaaagtggattcgccaagattaaagattccaactccaaatccctcttaaagaaacaccttacccaagaaatcttcgacaacctcaaaaccaagaaaacccccactttcggttgcacacttctagatgtcatccaatctggcttagaaaatcacgactccggcgtaggtatctacgccccagatgctgaatcctacaccgtcttcgctgacatcttcgatcccatcattgaagactaccatggtggattcaagaagaccgacaagcacccccccaagaactggggtgacgttagcgtattcggcgacttagaccccaccggtgag

SEQ ID NO: 1408 - DNA, 382 bp, Diabrotica virgifera
  Clone ID: LIB149-047-Q1-E1-D3
gaccaagcctctagtaagagtcgtatcaaatgttctaaatctcaggatcctaagaaaagccaccatggttgacgctgcagttttggacaaacttgaaagtggattcgccaagattaaagattcgaactccaaatccctcttaaagaaacaccttacccaagaaatcttcgacaacctcaaaaccaagaaaacccccactttcggttgcacacttctagatgtcatccaatctggcttagaaaatcacgactccggcgtaggtatctacgccccagatgctgaatcctacaccgtcttcgctgacatcttcgatcccatcattgaagactaccatggtggattcaagaagaccgacaagcacccccccaagaactggggtgac

SEQ ID NO: 1409 - DNA, 390 bp, Diabrotica virgifera
  Clone ID: LIB150-045-Q1-E1-D11
ccacgcgtccgcggacgcgtgggcttttgtgaagtgtgtaccctttgagtcgaaggttctaaatctcaggatcctaagaaaagccaccatggttgacgctgcagttttggacaaacttgaaagtggattcgccaagattaaagattccaactccaaatccctcttaaagaaacaccttacccaagaaatcttcgacaacctcaaaaccaagaaaacccccactttcggttgcacacttctagatgtcatccaatctggcttagaaaatcacgactccggcgtaagtatctacgccccagatgctgaatcctacaccgtcttcgctgacatcttcgattccatcattgaagactaccatggtggattcaagaagaccgacaagcacccccc

SEQ ID NO: 1410 - DNA, 269 bp, Diabrotica virgifera
  Clone ID: LIB150-039-Q1-E1-H7
acttttgtgaagtgtgtaccctttggttcgaggggtcaaattctcaagatccgaataaaagccaccagggttgacgcagcaattttggacaaacttgaaagtggactcgcgaatattaaagattcgacatcgatctggcacatacagtaacagcttacgcaaaaaatctacgacaaccactaaatgaacaaaacccccactttcggttgcacaattcaagatgtcaacaacactggcttagaacatcacgactccggcgtacgtatcta

SEQ ID NO: 1411 - DNA, 433 bp, Diabrotica virgifera
  Clone ID: LIB150-012-Q1-E1-A10
ccgtagctaagccaaaagatggaaaagagaaaagagaagttaaagacaaaacaaaaaatagtatgcgagagttacacattcgcaaactctgccttaacatttgtgtaggagaatctggtgacaggcttactagagctgctaaggtattggaacaacttacaggacaacaacctgtattctcaaaagccagatacactgtcaggtcttttggtatccgtcgtaatgaaaaaattgctgtacactgcacagtaaggggagccaaagctgaagaaattttagaaagaggcttaaaagttagagaatatgaattgagacgtgataacttctctgcatctggaaactttggatttggtattcaggaacacatcgatcttggtatcaaatatgatccaagtataggtatttacggtcttgacttttacgtagtattagg

SEQ ID NO: 1412 - DNA, 399 bp, Diabrotica virgifera
  Clone ID: LIB150-010-Q1-E2-F1
ggcgcccgtagctaagccaaaagatggaaaagagaaaagagaagttaaagacaaaacaaaaaatagtatgcgagagttacacattcgcaaactctgccttaacatttgtgtaggagaatctggtgacaggcttactagagctgctaaggtattggaacaacttacaggacaacaacctgtattctcaaaagccagatacactgtcaggtcttttggtatccgtcgtaatgaaaaaattgctgtacactgcacagtaaggggagccaaagctgaagaaattttagaaagaggcttaaaagttagagaatatgaattgagacgtgataacttctctgcatctggaaactttggatttggtattcaggaacacatcgatcttggtatcaaatatgatccaag

SEQ ID NO: 1413 - DNA, 395 bp, Diabrotica virgifera
  Clone ID: LIB149-028-Q1-E1-F9
caatggcgcccgtagctaagccaaaagatggaaaagagaaaagagaagttaaagacaaaacaaaaaatagtatgcgagagttacacatccgcaaactctgccttaacatttgtgtaggagaatctggtgacaggcttactagagctgctaaggtattggaacaacttacaggacaacaacctgtattctcaaaagccagatacactgtcaggtcttttggtatccgtcgtaatgaaaaaattgctgtacactgcacagtaaggggagccaaagctgaagaaattttagaaagaggcttaaaagttagagaatatgaattgagacgtgataacttctctgcatctggaaactttggatttggtattcaggaacacatcgatcttggtatcaaatat

SEQ ID NO: 1414 - DNA, 425 bp, Diabrotica virgifera
  Clone ID: LIB150-024-Q1-E1-G7
ttacaataccctaaagtgagtcgtattacaatggcgcccgtagctaagccaaaagatggaaaagagaaaagagaagttaaagacaaaacaaaaaatagtatgcgagagttacacatccgcaaactctgccttaacatttgtgtaggagaatctggtgacaggcttactagagctgctaaggtattggaacaacttacaggacaacaacctgtattctcaaaagccagatacactgtcaggtcttttggtatccgtcgtaatgaaaaaattgctgtacactgcacagtaaggggagccaaagctgaagaaattttagaaagaggcttaaaagttagagaatatgaattgagacgtgataacttctctgcatctggaaactttggatttggtattcaggaacacatcgatcttggtatcaaatatga

SEQ ID NO: 1415 - DNA, 422 bp, Diabrotica virgifera
  unsure (1)..(422): unsure at all n locations
  Clone ID: LIB150-013-Q1-E1-D3
ggcgcccattactaaaccaaaagatgggaaagagaaaagagaagtttaagacaaaacaaaaaatagtatgccagagttacacattcgcaaactctgccttaacatttgtgtaagagaatctggtgacaagcttactaaagctgctaaggtattggaacaacttacaagacaacaacctgtattctcaaaagccagatacactgtcaagtcctttggtaaccgtcctaatgaaaaaattgctgtacactgcacaataaggggagccaaagctgaagaaattttagaaagaaggcttaaaaattaaaaaatatgaattgagacgtgataacttctctgcatctggaaactttggatttggtattcaggaacacatcgatcttggtatcaaatatgatccaagtatangtatttacggtcttgac

SEQ ID NO: 1416 - DNA, 409 bp, Diabrotica virgifera
  Clone ID: LIB150-038-Q1-E1-C1
caggcctccgaaacaatggagcccgttaccaagccaaaagattggaaagagaaaagagaagtttaagaccaaaccaaaaataatatgccaaaattacacaatcccaaactccggcctaacaattggggtagaaaaaccggtgaacaggctaacaaaacctgcaaaggaattggaacaccttaaaggacaccaaccggtattcccaaaagcaagatacactgtcaggtcttttggtatccgtcgtaatgaaaaaattgctgtacactgcacagtaaggggagccaaagctgaagaaattttagaaagaggcttaaaagttagagaatatgaattgagacgtgataacttctctgcatctggaaactttggatttggtattcaagaacacatcgatcttggtatcaaatat

SEQ ID NO: 1417 - DNA, 431 bp, Diabrotica virgifera
  Clone ID: LIB3026-020-Q1-E1-D12
acgcgtccgaccacaagtccgaaggatttatgcacagtgaagatattcaagttccagattctttcgatgcaagggaaaactggaaagactgttcagatgttatcagcactattgtagaccaatctgcttgtggatcttgctgggcaatgtctgcagcatctgcaatgagtgacagacgatgcatagtcacccagggaaagcttaaagtgcctgtttctgctgaaaatttattgtcttgttgcgatgactgtggatttggatgcgccggaggatatatagatgatgcatggtcgttttggcaagagaatggaattactacaggaggtctttacggcagcaaccagggttgtcaatcatattcgcttcaaccttgtgaacatcatacaaatggtactaaagtgcaatgcagtactttgaactacggcacacct

SEQ ID NO: 1418 - DNA, 426 bp, Diabrotica virgifera
  Clone ID: LIB149-008-Q1-E1-E1
tacagattcacgaaaatgaatgctgcttttattattacactactactacctattgtattaagttacaaaggtaacccaaatcctctttcaaatgactttataaactacatcaatagcaaacaaagtacatgggttgctggaaaaaactttgatgagaacctttcaatccaagagattaaaaatttggtaggaacaaaaaatagtaaattaagggtggctaaagaatttacacacaatgaagatattcaagttcccaattccttccaagcaagagaaaactggaaagaatgttcagatgttatcagcaccgttgtagatcaatccgattgatgatcttgctgggccgtcgctgcagcttctgcaatgagtgacagacgatgcatagcatcccagggaaagcttaaagtacctgtttcggctgaaaat

SEQ ID NO: 1419 - DNA, 217 bp, Diabrotica virgifera
  unsure (1)..(217): unsure at all n locations
  Clone ID: pGUT1886
tcgggttttaggttggggagaagagagtggagtcccttattggttggttgctaattcatggaatgaagattggggagacaagggattgtttaaaatacgtcgcggaaataatgaatcaggcttcgaggactctattgttgctgcacctgctcaagtctaattttaaacgaaatattagtgttacgtttaatatgttttattttanataanaaaatta

SEQ ID NO: 1420 - DNA, 420 bp, Diabrotica virgifera
  Clone ID: LIB149-011-Q1-E1-C3
gattgaccaaaatgaaagcggcttgtattattacactattactacctgttgtattaagttacaaagctaacttaaatcctctttcaaatgagtttataaactatatcaatagcaagcaaaacacatgggttgctggaaagaactttgatgagaaactttcaatccaagaaataaaaaatttattaggagcgagaaaaaggagtttaggagatgtaaaaggatttatgcacagtgaagatattcaagttccagattctttcgatgcaagggaaaactggaaagactgttcagatgttatcagcactattgtagaccaatctgcttgtggatcttgctgggcaatgtctgcagcatctgcaatgagtgacagacgatgcatagtcacccagggaaaagcttaagtgcctgtttctgctgaaa

SEQ ID NO: 1421 - DNA, 412 bp, Diabrotica virgifera
  Clone ID: LIB3026-002-Q1-E1-F12
agattgaccaaaatgaaagcggcttgtattattacactattactacctgttgtattaagttacaaagctaacttaaatcctctttcaaatgagtttataaactatatcaatagcaagcaaaacacatgggttgctggaaagaactttgatgagaaactttcaatccaagaaataaaaaatttattaggagcgagaaaaaggagtttaggagatgtaaaaggatttatgcacagtgaagatattcaagttccagattctttcgatgcaagggaaaactggaaagactgttcagatgttatcagcactattgtagaccaatctgcttgtggatcttgctgggcaatgtctgcagcatctgcaatgagtgacagacgatgcatagtcacccagggaaagcttaaagtgcctgttt

SEQ ID NO: 1422 - DNA, 401 bp, Diabrotica virgifera
  Clone ID: LIB3026-032-Q1-E1-A5
cgcgtaagccaacgcgtccgtagagattgaccaaaatgaaagcggcttgtattattacactattactacctgttgtattaagttacaaagctaacttaaatcctctttcaaatgagtttataaactatatcaatagcaagcaaaacacatgggttgctggaaagaactttgatgagaaactttcaatccaagaaataaaaaatttattaggagcgagaaaaaggagtttaggagatgtaaaaggatttatgcacagtgaagatattcaagttccagattctttcgatgcaagggaaaactggaaagactgttcagatgttatcagcactattgtagaccaatctgcttgtggatcttgctgggcaatgtctgcagcatctgcaatgagtgacagacgatgc

SEQ ID NO: 1423 - DNA, 435 bp, Diabrotica virgifera
  Clone ID: LIB149-009-Q1-E1-D7
atcagcagacacagtaagagatcccagaggtttcgcaatcaaattctacaccgaggaaggcatctgggatttggcgggaaacaacactcccatcttctttattagagaccccatcttcttcgccagctttatccgcactcagaagagaaatccacagacccaccttaaagaccccgatatgttctgggacttcatgtctttgaggcctgagactatgcaccaattattattcttgttctcagacagaggtattcctgatggatacagacatatgaacggatatggatcccacaccttcaagtttgtcaacaaagaaggccaggtacatttttgtaaattccatcacaaaactgaccaaggaatacaaaatctcgatgtcaataaagctgatgacttgtctgcatccgatcctgattacagcatcagagacctgtt

SEQ ID NO: 1424 - DNA, 634 bp, Diabrotica virgifera
  Clone ID: LIB150-021-Q1-E1-F12
cccacgcgtcagcggacgcgtgggcggttgacggtttaaagcagtcgtcagtcgttcagtttttggtttatttagtttaaaagaacgagtaacatggcaaacagagactcagctactaaccaattacttaactacaagaaaaagactcaagggggagagtctgtaacaactggatatggcaaccccgtccggcaattcgcttccttgagcctccggcccaaaggccccattctattccaagatcaaatcctagtcgatgaactttcccactttaacaaggaaaggattcctgaaagagtattccacgctaaaggagctggtgctttcggatattttgaatgtactaatgatatcacaaaatactcagcagcaaaattattttcttccatcggcaaaaagaccccaatcgctattcgtttctcgaccgtcggcggtgagtctggatcagcagacacagtaagagatcccagaggtttcgcaatcaaattctacaccgaggaatgcatctgggatttggcgggaaacaacactcccatcttctttattagagaccctatcttcttcgccagctttatccgcactcagaagagaaatcacagacccaccttaaagacccgacatgttctgggacttc

SEQ ID NO: 1425 - DNA, 407 bp, Diabrotica virgifera
  Clone ID: LIB149-036-Q1-E1-A6
gacggtttaaagcagtcgtcagtcgttcagtttttggtttatttagtttaaaagaacgagtaacatggcaaacagagactcagctactaaccaattacttaactacaagaaaaagactcaagggggagagtctgtaacaactggatatggcaaccccgtcggacaattcgcttctttgagcgtcgggcccagaggccccattctattccaagatcaaatcctagtcgatgaactttcccactttaacagggaaaggattcctgaaagagtagtccacgctaaaggagctggtgctttcggatattttgaatgtactaatgatatcacaaaatactcagcagcaaaattattttcttccatcggcaaaaagaccccaatcgctattcgtttctcgaccgtcgggggtg

SEQ ID NO: 1426 - DNA, 360 bp, Diabrotica virgifera
  Clone ID: LIB149-033-Q1-E1-E9
cccacgcgtccgatccaaccggttgacggtttaaagcagtcgtcagtcgttcagtttttggtttatttagtttaaaagaacgagtaacatggcaaacagagactcagctactaaccaattacttaactacaagaaaaagactcaagggggagagtctgtaacaactggatatggcaaccccgtcggacaattcgcttctttgagcgtcgggcccagaggccccatactattccaagatcaaatcctagtcgatgaactttcccactttaacagggaaaggattcctgaaagagtagtccacgctaaaggagctggtgctttcggatattttgaatgtactaatgatatcacaaaatactc

SEQ ID NO: 1427 - DNA, 334 bp, Diabrotica virgifera
  Clone ID: LIB150-010-Q1-E2-F6
aacggttgacggtttaaagcagtggtcagtcgttcagtttttggtttatttagtttaaaagaacgagtaacatggcaaacagagactcagctactaaccaattacttaactacaagaaaaagactcaagggggagagtctgtaacaactggatatggcaaccccgtcggacaattcgcttctttgagcgtcgggcccagaggccccattctattccaagatcaaatcctagtcgatgaactttcccactttaacagggaaaggattcctgaaagagtagtccacgctaaaggagctggtgctttcggatattttgaatgtactaatgatatcac

SEQ ID NO: 1428 - DNA, 429 bp, Diabrotica virgifera
  Clone ID: LIB3026-027-Q1-E1-E6
cacacgcgtccgcccacgcgtccgggtgcccccaactatttccctaacagctttaacggtccagtatgtgacaaagtcgctcaacatctcgaaccagcatttactgtttctggagaagcttacagatacgacactggagattctgacaactttagccaggctcgtagatttgtgcagaaggttctaaacagagagcaacaagacagattggtctccaacatagtcggacatctttccggagctctggactttatccaggaaagacaagtcaatcacttcaaacaagtggatcaatcatttggagagagaatcgcagctggacttcaaaacgtcaaacacactaagggcaaaatataaatttttaagattttttacttttttgttatgtacttgatttttgttgttaatcaacgtgtgtgtcaacgttta

SEQ ID NO: 1429 - DNA, 414 bp, Diabrotica virgifera
  Clone ID: LIB149-039-Q1-E1-G6
tacaatgcatcgccacaatgggtaaaataatgaaatcaggaaaagtcgtattggtcctcgggggccgatacgccggcagaaaagccgtagtcgtcaaaacctacgatgaaggtacatcagataaacaatacggacatgccttagtagctggaattgataggtacccaaggaaaatccacaaacgcatgggcaaaggcaaaatgcacaagaggtccaagatcaagccttttatcaaagtattgaactacaaccatctcatgcccactagatactctgtagatttggcatcagacttgaaagttgtacccaaggacctcaaagatgccatgaagaggaagaaggctagattccagacccgtgtcaaatttgaggaaaggtataagcaaggaaagaacaaatggttcttccaaaaat

SEQ ID NO: 1430 - DNA, 431 bp, Diabrotica virgifera
  Clone ID: LIB3026-020-Q1-E1-G10
gcgtccacccacgcgtccgtgtcaaagcactgccacaatgggtaaaataatgaaatcaggaaaagtcgtattggtcctcgggggccgatacgccggcagaaaagccgtagtcgtcaaaacctacgatgaaggtacatcagataaacaatacggacatgccttagtagctggaattgataggtacccaaggaaaatccacaaacgcatgggcaaaggcaaaatgcacaagaggtccaagatcaagccttttatcaaagtattgaactacaaccatctcatgcccactagatactctgtagatttggcatcagacttgaaagttgtacccaaggacctcaaagatgccatgaagaggaagaaggctagattccagacccgtgtcaaatttgaggaaaggtataagcaaggaaagaacaaatggttcttccaaa

SEQ ID NO: 1431 - DNA, 418 bp, Diabrotica virgifera
  Clone ID: LIB150-043-Q1-E1-C8
acagttgtcaaagcactgccacaatgggtaaaataatgaaatcaggaaaagtcgtattggtcctcgggggccgatacgccggcagaaaagccgtagtcgtcaaaacctacgatgaaggtacatcagataaacaatacggacatgccttagtagctggaattgataggtacccaaggaaaatccacaaacgcatgggcaaaggcaaaatgcacaagaggtccaagatcaagccttttatcaaagtattgaactacaaccatctcatgcccactagatactctgtagatttggcatcagacttgaaagttgtacccaaggacctcaaagatgccatgaagaggaagaaggctagattccagacccgtgtcaaatttgaggaaaggtataagcaaggaaagaacaaatggttcttccaaaa

SEQ ID NO: 1432 - DNA, 419 bp, Diabrotica virgifera
  Clone ID: LIB3026-032-Q1-E1-F11
ttcgcggggccccccacgcgtacgaaacactgccacaatgggtaaaataatgaaatcaggaaaagtcgtattggtcctcgggggccgatacgccggcagaaaagccgtagtcgtcaaaacctacgatgaaggtacatcagataaacaatacggacatgccttagtagctggaattgataggtacccaaggaaaatccacaaacgcatgggcaaaggcaaaatgcacaagaggtccaagatcaagccttttatcaaagtattgaactacaaccatctcatgcccactagatactctgtagatttggcatcagacttgaaagttgtacccaaggacctcaaagatgccatgaagaggaagaaggctagattccagacccgtgtcaaatttgaggaaaggtataagcaaggaaagaacaaat

SEQ ID NO: 1433 - DNA, 416 bp, Diabrotica virgifera
  Clone ID: LIB150-017-Q1-E1-A9
ccgggtgcacccacgcgtccgcagacgcgtgggtcgcccacgcgtccgtgtcaaagcactgccacaatgggtaaaataatgaaatcaggaaaagtcgtattggtcctcgggggccgatacgccggcagaaaagccgtagtcgtcaaaacctacgatgaaggtacatcagataaacaatacggacatgccttagtagctggaattgataggtacccaaggaaaatccacaaacgcatgggcaaaggcaaaatgcacaagaggtccaagatcaagccttttatcaaagtattgaactacaaccatctcatgcccactagatactctgtagatttggcatcagacttgaaagttgtacccaaggacctcaaagatgccatgaagaggaagaaggctagatttcagacccgtgtcaaatt

SEQ ID NO: 1434 - DNA, 385 bp, Diabrotica virgifera
  Clone ID: LIB150-043-Q1-E1-C9
tacaacaaactgacatgagtcgtattactgccacaatgggtaaaataatgaaatcaggaaaagtcgtattggtcctcgggggccgatacgccggcagaaaagccgtagtcgtcaaaacctacgatgaatgtacatcagataaacaatacggacatgccttagtagctggaattgataggtacccaaggaaaatccacaaacgcatgggcaaaggcaaaatgcacaagaggtccaagatcaagccttttatcaaagtattgaactacaaccatctcatgcccactagatactctgtagatttggcatcagacttgaaagttgtacccaaggacctcaaagatgccatgaagaggaagaaggctagattccagacccgtgtcaaatt

SEQ ID NO: 1435 - DNA, 308 bp, Diabrotica virgifera
  Clone ID: LIB3026-028-Q1-E1-G5
aaataattattttcctcgatattcgtcgcgcctagatatttagatagtccaagaaataatcatgccacgtgaattgacagaaattaaggaattcctcctcaccgcaagaaggaaggacgccaaatctgtcaagataaagaagaacacagaaaacaccaaattcaaagtacgttgctccaggtttctgtatactttggtgattacggataaggagaaggcagaaaagctaaagcaatcacttcctccaggtctccaagttaaggaagttaagtaaatgactaatgtagaaataaaaattttttgttaat

SEQ ID NO: 1436 - DNA, 399 bp, Diabrotica virgifera
  Clone ID: LIB3026-022-Q1-E1-B1
gcctccgcacgaaagaaacttgtgtttctgaatttatttcagaaatctgaaatcatcttattattccgtgaagggaataataaatcgaggaaataattattttcctcgatattcgtcgcgcctagatatttagatagtccaagaaataatcatgccacgtgaattgacagaaattaaggaattcctcctcaccgcaagaaggaaggacgccaaatctgtcaagataaagaagaacacagaaaacaccaaattcaaagtacgttgctccaggtttctgtatactttggtgattacggataaggagaaggcagaaaagctaaagcaatcacttcctccaggtctccaagttaaggaagttaagtaaatgactaatgtagaaataaaaattttttgtttaat

SEQ ID NO: 1437 - DNA, 393 bp, Diabrotica virgifera
  Clone ID: LIB149-011-Q1-E1-A11
attctcgaaagtgacttgtgtttctgaatttatttcagaaatctgaaatcatctgattattccgtgaagggaataataaattgaggaaattattattttcctcgatattcgtcgcgcctaaaaatttagttagtccaagaaataaccatgccacgtgaattgacagaaattaaggaattcctcctcacagcaagaaggaaggacgccaaatctgttaagataaagaagaacacagaaaacaccaaattcaaagtacgttgctccaggtttctgtatactttggtgattacagataaggagaaggcagaaaaactaaaacaatcacttcctccaggtctccaagttaaggaagttaagtaaatgactataatgtagaaataaaaattttttgtt

SEQ ID NO: 1438 - DNA, 240 bp, Diabrotica virgifera
  Clone ID: LIB3026-026-Q1-E1-A10
agcccacgcgtccggaaattaaggaattcctcctcaccgcaagaaggaaggacgccaaatctgtcaagataaagaagaacacagaaaacaccaaattcaaagtacgttgctccaggtttctgtatactttggtgattacggataaggagaaggcagaaaagctaaagcaatcacttcctccaggtctccaagttaaggaagttaagtaaatgactaatgtagaaataaaatttttttgtt

SEQ ID NO: 1439 - DNA, 418 bp, Diabrotica virgifera
  Clone ID: LIB150-006-Q1-E1-G10
agcttcattcttgctgtgaggaggaaggacgccaaatctgttaagataaagaagaacacagaaaacaccaaattcaaagtacgttgctccaggtttctgtatactttggtgattacagataaggagaaggcagaaaaactaaaacaatcacttcctccaggtctccaagttaaggaagttaagtaaatgactataatgtagaaataaaaattttttgttaaaaaaaaaggtaagaaaggggatttgcaccaaaaatccacaaaaaaaaaaaagggacacaaactcaacaaaggtgctaatcgcagatgctggatacaaagggaatgattgaaaatggtaaggatgttgctgcaatctgaattccacaaaggaaggcaaatacgaggtacacttcaaagtgactcaactccgaccaaag

SEQ ID NO: 1440 - DNA, 643 bp, Diabrotica virgifera
  unsure (1)..(643): unsure at all n locations
  Clone ID: pGUT3471
aatatggtgggacttaaggtttttgttttatttgcgctattagcaacaacctatggatttcatcaaataaaatttagaaatactcgcaatggcttaggtttggatggtgctacagaggctacagatggacaattcccttgggtagtttcacttcaatccagttatgagcgcattaatacacatgtttgtggaggtgtcatcttaactgaaaattgggttcttacatctgccgaatgtgaaggtgctgttaaggtagtggccggtgctgttaaaccgcgtttagccgatcctaataaacagactgttgatgttgaaagatgggtggttcatccagactataactcacaaatagttgggcccaacgatatcgctttagttaaactaaagcaaccattgaaatttaccgatgccgttaaagctgctaatttgcccgagcaaggagctgcagttactggattagctgatgttgttggatacggcaacagcgcaagacctgatttcaacaatntgacctacatatcggacttgccccttataagctacgacgattgcaatcaagctcttgaagatgtattgcaagaaaagagttcttttggacgaaaagagcaacatttgcgcangtgtattggcaaatggagctaat

SEQ ID NO: 1441 - DNA, 606 bp, Diabrotica virgifera
  Clone ID: pGUT2457
ctagtctcgagtttttgttttatttgcgctattagcaacaacctatggatttcatcaaataaaatttagaaatactcgcaatggcttaggtttggatggtgctacagaggctacagatggacaattcccttgggtagtttcacttcaatccagttatgagcgcattaatacacatgtttgtggaggtgtcatcttaactgaaaattgggttcttacatctgccgaatgtgaaggtgctgttaaggtagtggccggtgctgttaaaccgcgtttagccgatcctaataaacagactgttgatgttgaaagatgggtggttcatccagactataactcacaaatagttgggcccaacgatatcgctttagttaaactaaagcaaccattgaaatttaccgatgccgttaaagctgctaatttgcccgagcaaggagctgcagttactggattagctgatgttgttggatacggcaacagcgcaagacctgatttcaacaatttgacctacatatcggacttgccccttataagctacgacgattgcaatcaagctcttgaagatgtattgcaagaaaagagttctttggacgaaaagagcaacatttg

SEQ ID NO: 1442 - DNA, 538 bp, Diabrotica virgifera
  unsure (1)..(538): unsure at all n locations
  Clone ID: pGUT2314
ctcttttcttgtattaaatcttcaagagcttgattgcaatcgtcgtagcttataaggggcaagtctgatatgtagctcaaagtgttgaaatcaggcaagaagctgttgccgtatccaacaacatcagctaatccagtaactgcagctccttgctcgggcaaattagcggctttaatggcatcgttaaatttcaatggttgctttagtttaactaaagcgatatcgtttggcccaactacttgtgagttatagtctggatgaaccacccatctttcaatatcaacagtctgtttattaggatcggctccttgcagtttaacagcaccggccactactttgttagcagcaccttcacattcggcagatgtaagaaccccattntcatttaagatgacacctncacaaacatgtgtattaacanacaaaanatttgattgaagtgaaactacccaagggaatngtccatctgtagcctctgtaccaccatccaaatctaagccattgcgggtatttctagaatttaattgattaaatccat

SEQ ID NO: 1443 - DNA, 459 bp, Diabrotica virgifera
  Clone ID: LIB149-012-Q1-E1-C1
cacgcgtccggaaacttaaggtatttgttttatttgcgctattagcaacaacctatggatttcatcaaataaaatttagaaatactcgcaatggcttaggtttggatggtgctacagaggctacagatggacaattcccttgggtagtttcacttcaatccagttatgagcgcattaatacacatgtttgtggaggtgtcatcttaactgaaaattgggttcttacatctgccgaatgtgaaggtgctgttaaggtagtggccggtgctgttaaaccgcgtttagccgatcctaataaacagactgttgatgttgaaagatgggtggttcatccagactataactcacaaatagttgggcccaacgatatcgctttagttaaactaaagcaaccattgaaatttaccgatgccgttaaagctgctaatttgcccgagcaaggagctgcagttactggat

SEQ ID NO: 1444 - DNA, 407 bp, Diabrotica virgifera
  Clone ID: LIB149-037-Q1-E1-D2
gggacttaaagtttttgttttatttgggctattggcaacaacctatggatttaatcaaataaaatctagaaatacccgcaatggcttagatttggatggtggtacagaggctacagatggacaattcccttgggtagtttcacttcaatcaaattttttgtttgttaatacacatgtttgtggaggtgtcatcttaaatgaaaattgggttcttacatctgccgaatgtgaaggtgctgctaacaaagtagtggccggtgctgttaaactgcaaggagccgatcctaataaacagactgttgatattgaaagatgggtggttcatccagactataactcacaagtagttgggccaaacgatatcgctttagttaaactaaagcaaccattgaaatttaacgatgcca

SEQ ID NO: 1445 - DNA, 420 bp, Diabrotica virgifera
  unsure (1)..(420): unsure at all n locations
  Clone ID: LIB3026-005-Q1-E1-F9
gttaacgccatctcttttccattttctagctcgaagagggcaaaatggtccaacgattagtctttagaagacggttgtcttacaacacaaaatccaacaggaggcgaattgtccgcactcctggtggtaaactcgtatatcaatacctgaaaaaacccaagaagattcccaaatgcggtcaatgcaaagacaaacttagaggtattctccctgccaggccccaagaaaggtcacgattgtgcagaaggaagaagactgttaagagggcatacggtggtgtcctatgccacaagtgtgttaaagaaaagattgttcgagctttcttgattgaagaacagaagatcgtagtgaaagttcttaaagcccaacaagctgtagttaaaccatctaaganatagagcttaataaatgtttattttt

SEQ ID NO: 1446 - DNA, 378 bp, Diabrotica virgifera
  Clone ID: LIB3026-013-Q1-E1-B3
cccacgcgtccgcaaaatggtccaacgattagtctttagaagacggttgtcttacaacacaaaatccaacaggaggcgaattgtccgcactcctggtggtaaactcgtatatcaatacctgaaaaaacccaagaagatccccagatgcggtcaatgcaaagacaaacttagaggtattctccctgccaggccccaagaaaggtcaagattgtgcagaaggaagaagactgttaagagggcgtacggtggtgtcctatgccacaagtgtgttaaagaaaagattgttcgagctttcttgattgaagaacagaagatcgtagtgaaagttcttaaagcccaacaagctgtagttaaaccatctaagaaatagagcttaat

SEQ ID NO: 1447 - DNA, 418 bp, Diabrotica virgifera
  Clone ID: LIB3026-006-Q1-E1-C7
aaatggtccaacgattagtctttagaagacggttgtcttacaacacaaaatccaacaggaggcgaattgtccgcactcctggtggtaaactcgtatatcaatacctgaaaaaacccaagaagatccccagatgcggtcaatgcaaagacaaacttagaggtattctccctgccaggccccaagaaaggtcaagattgtgcagaaggaagaagactgttaagagggcgtacggtggtgtcctatgccacaagtgtgttaaagaaaagattgttcgagctttcttgattgaagaacagaagatcgtagtgaaagttcttaaagcccaacaagctgtagttaaaccatctaagaaatagagcttaataaatgtttaatttttaaaaaaaaagaaaaaaaaaaaaaaaaaaaagggcggccg

SEQ ID NO: 1448 - DNA, 311 bp, Diabrotica virgifera
  Clone ID: LIB3026-031-Q1-E1-G11
gaccgcactcctggtggtaaactcgtatatcaatacctgaaaaaacccaagaagatccccagatgcggtcaatgcaaagacaaacttagaggtattctccctgccaggccccaagaaaggtcaagattgtgcagaaggaagaagactgttaagagggcgtacggtggtgtcctatgccacaagtgtgttaaagaaaagattgttcgagctttcttgattgaagaacagaagatcgtagtgaaagttcttaaagcccaacaagctgtagttaaaccatctaagaaatagagcttaataaatgtttaattttt

SEQ ID NO: 1449 - DNA, 321 bp, Diabrotica virgifera
  Clone ID: LIB3026-032-Q1-E1-A3
ccacgcataagtcagcactcctggtggtaaactcgtatatcaatacctgaaaaaacccaagaagatccccagatgcggtcaatgcaaagacaaacttagaggtattctccctgccaggccccaagaaaggtcaagattgtgcagaaggaagaagactgttaagagggcgtacggtggtgtcctatgccacaagtgtgttaaagaaaagattgttcgagctttcttgattgaagaacagaagatcgtagtgaaagttcttaaagcccaacaagctgtagttaaaccatctaagaaatagagcttaataaatgtttaattttt

SEQ ID NO: 1450 - DNA, 444 bp, Diabrotica virgifera
  Clone ID: LIB3026-021-Q1-E1-E2
gacccaggcgtcagccagtcaacaactgtgtagtagttttaaatcaagtgaatttgtgtccttgtgaattaaaccttcaagaaaaatgtcaaaagcacaaaataaaggttttacaaaagaggaagaacttctccttcaagatttcagccgtaatgtatcaacaaaatcatcagccctgttctatggaaatgccctgattgtgtctgcagttccaatatggttattctggagaatacacatgattgatatttattcctccttgatcttgttcgcagtcatcacagctatttctacctatttattggctatggcatacagaaacacaaaattcaccctaaaacataagattgctgtaaagagagaagaagctgttaccaaagactttaagccaaaaactaccaaggacaggaaattgagcatgaaagaaaaagacgagagaattct

SEQ ID NO: 1451 - DNA, 430 bp, Diabrotica virgifera
  unsure (1)..(430): unsure at all n locations
  Clone ID: LIB150-036-Q1-E1-A12
caagcgtctacataaactgctgtagaagttttaaatcaagtgaatttgtgttcttgtgaattaaatcttcaagaaaaatgtcgaaagcacaaaataaaggttttacaaaagaggaagaacttctccttcaagatttcagccgtaatgtatcaacaaaatcatcagccctgttctatggaaatgccctgattgtgtctgcagttccaatatggttattctggagaatacacatgattgatatttattcctccttgatcttgttcgcagtcatcacagctatttctacctatttattggctatggcatacagaaacacagaattcaccctaaaacataagattgctgtaaagagagaagaagctgttaccagagacttgagcanaatactagcagaagacaagaaaatgagcaggaaagataaagacgagag

SEQ ID NO: 1452 - DNA, 446 bp, Diabrotica virgifera
  unsure (1)..(446): unsure at all n locations
  Clone ID: LIB149-015-Q1-E1-E5
gtgcccagtcatcaactgtgtagtagttttaaatcaagtgaatttgtgttcttgtgaattaaatcttcaagaaaaatgtcgaaagcacaaaataaaggttttacaaaagaggaagaacttctccttcaagatttcagccgtaatgtatcaacaaaatcatcagccctgttctatggaaatgccctgattgtgtctgcagttccaatatggttattctggagaatacacatgattgatatttattcctccttgatcttgttcgcagtcatcacagctatttctacctatttattggctatggcatacagaaacacaaaattcaccctaaaacataagattgctgtaaagagagaagaagctgttaccagagacttgagcanaaaactagcagaagacaagaaaatgagcaagaaagaanaagacgagagaattctatggaagaagaa

SEQ ID NO: 1453 - DNA, 341 bp, Diabrotica virgifera
  Clone ID: LIB150-012-Q1-E1-C8
gtaaatttgtgttcttgtgaattaaatcttcaagaaaaatgtcgaaagcacaaaataaaggttttacaaaagaggaagaacttctccttcaagatttcagccgtaatgtatcaacaaaatcatcagccctgttctatggaaatgccctgattgtgtctgcagttccaatatggttattctggagaatacacatgattgatatttattcctccttgatcttgttcgcagtcatcacagctatttctacctatttattggctatggcatacagaaacacaaaattcaccctaagacataagattgctgtacagagagaagaggctgtgaccagagacttgagc

SEQ ID NO: 1454 - DNA, 275 bp, Diabrotica virgifera
  unsure (1)..(275): unsure at all n locations
  Clone ID: pGUT509
tgctgacttcgaagctactactttctccatattctacaacaatgccctatttttagccattgttattcttgctagcttctatttgcttccagcattcacaccagcagtcaactacaccctttccattggctccacatctgcgtgattagccttattgtacgactggatcacattaagaattgtttattgaatctgtggtattgtctaatagtaccatgttgttcaagtgtaaataagaagatgacatnaacatcaacgatatctaaatatcctgt

SEQ ID NO: 1455 - DNA, 407 bp, Diabrotica virgifera
  Clone ID: LIB3026-009-Q1-E1-C12
accacgcgtccggccatgaaagccaaaggagagttgaaggagtatgaagttatcgggcgtaaattgcctaccgagaaggagaagaccactcctttgtataaaatgagaatcttctctccagacaaaatcgtagcgaagtcccgcttttggtatttcttgaggcaacttaggaagttcaagaaaactactggagaaatcgtgtcagttagacaaattccagaaagatctcccgttaaaattaagaactttggtatttggttgaggtatgactcccgttctggtacacacaacatgtacagggaataccgtgaccttagtgtatcaggtgcagtaacagcctgttacagggatatgggggcccgccacagagctagagctcattctattcaggttattaaagttgaaga

SEQ ID NO: 1456 - DNA, 397 bp, Diabrotica virgifera
  Clone ID: LIB150-033-Q1-E1-F8
gcagccatgaaagccaaaggagagttgaaggagtatgaagttatcgggcgtaaattgcctaccgagaaggagaagaccactcctttgtataaaatgagaatcttctctccagacaaaatcgtagcgaagtcccgcttttggtatttcttgaggcaacttaggaagttcaagaaaactactggagaaatcgtgtcagttagacaaattccagaaagatctcccgttaaaattaagaactttggtatttggttgaggtatgactcccgttctggtacacacaacatgtacagggaataccgtgaccttagtgtatcaggtgcagtaacagcctgttacagggatatgggggcccgccacagagctagagctcattctattcaggttattaaagttgaag

SEQ ID NO: 1457 - DNA, 402 bp, Diabrotica virgifera
  Clone ID: LIB3026-005-Q1-E1-E2
gaaggagtatgaagttatcgggcgtaaattgcctaccgagaaggagaagaccactcctttgtataaaatgagaatcttctctccagacaaaatcgtagcgaagtcccgcttttggtatttcttgaggcaacttaggaagttcaagaaaactactggagaaatcgtgtcagttagacaaattccagaaagatctcccgttaaaattaagaactttggtatttggttgaggtatgactcccgttctggtacacacaacatgtacagggaataccgtgaccttagtgtatcaagggcaattacagcctgttacagggatatgggggcccgccacagagctagagctcattctattcaggttattaaagttgaagaagtaaaggctagcaacacaagaaggcccca

SEQ ID NO: 1458 - DNA, 363 bp, Diabrotica virgifera
  unsure (1)..(363): unsure at all n locations
  Clone ID: pGUT3601
aaggagagttgaaggagtatgaagttatcgggcgtaaattgcctaccgagaaggagaagaccactcctttgtataaaatgagaatcttctctccagacaaaatcgtagcgaagtcccgcttttggtatttcttgaggcaacttaggaagttcaagaaaactactggagaaatcgtgtcagttagacaaattccagaaagatctcccgttaaaattaagaactttggtatttggttgaggtatgactcccgttctggtacacacaacatgtacagggaataccgtgaccttagtgtatcangtgcagtaacagcctgttacagggatatgggggctcgccacagagctagagctcattctattc

SEQ ID NO: 1459 - DNA, 337 bp, Diabrotica virgifera
  Clone ID: LIB3026-018-Q1-E1-F12
atgcctaacgagaaggagaagaccactcctttgtataaaatgagaatcttctctccagacaaaatcgtagcgaagtcccgcttttggtatttcttgaggcaacttaggaagttcaagaaaactactggagaaatcgtgtcagttagacaaattccagaaagatctcccgttaaaattaagaactttggtatttggttgaggtatgactcccgttctggtacacacaacatgtacagggaataccgtgaccttagtgtatcaggtgcagtaacagcctgttacagggatatgggggcccgccacagagctagagctcattctattcaggttattaaag

SEQ ID NO: 1460 - DNA, 382 bp, Diabrotica virgifera
  Clone ID: LIB149-039-Q1-E1-G7
aatcggtatacacgtatcgtgtctcaagacttaaaaatgcgttacgtggctgcttacttattggccgttttgggcggcaaagcctctcccaatgctgcagatcttgaaaaaatcttgggatctgtaggtgttgaagctgaaggagaaagagtaaagaaagtcatcagcgagctcagtggcaagtctgttgaagaactcattgctcaaggtcgtgaaaagttgagctccatgccagttggtggtggtgccccagctgctgccggaggtgccgctgctgctgctccagctgctgaagaaaagaaagaggccaagaaggaagaaaagaaggttgaatctgaatcagaagacgacgacatgggctttgctctattcgactagactc

SEQ ID NO: 1461 - DNA, 427 bp, Diabrotica virgifera
  Clone ID: LIB3026-032-Q1-E1-G9
cacgcgtacgcacacgcgtccgttccttcttgacattttgatattttgtcggtatacacgtttcgtgtctcaagacttaaaaatgcgttacgtggctgcttacttattggccgttttgggcggcaaagcctctcccaatgctgcagatcttgaaaaaatcttgggatctgtaggtgttgaagctgaaggagaaagagtaaagaaagtcatcagcgagctcagtggcaagtctgttgaagaactcattgctcaaggtcgtgaaaagttgagctccatgccagttggtggtggtgccccagctgctgccggaggtgccgctgctgctgctccagctgctgaagaaaagaaagaggccaagaaggaagaaaagaaggttgaatctgaatcagaagacgacgacatgggctttgctctattcgactagact

SEQ ID NO: 1462 - DNA, 448 bp, Diabrotica virgifera
  Clone ID: LIB3026-030-Q1-E1-G1
cacgcgtccgatattgacggtatacacgtttcgtgtctcaagacttaaaaatgcgttacgtggctgcttacttattggccgttttgggcggcaaagcctctcccaatgctgcagatcttgaaaaaatcttgggatctgtaggtgttgaagctgaaggagaaagagtaaagaaagtcatcagcgagctcagtggcaagtctgttgaagaactcattgctcaaggtcgtgaaaagttgagctccatgccagttggtggtggtgccccagctgctgccggaggtgccgctgctgctgctccagctgctgaagaaaagaaagaggccaagaaggaagaaaagaaggttgaatctgaatcagaagacgacgacatgggctttgctctattcgactagactcattagttgtaaaatcaaccttgttttgtaccttaatatatattttttaagtt

SEQ ID NO: 1463 - DNA, 449 bp, Diabrotica virgifera
  Clone ID: LIB149-043-Q1-E1-F12
ggtcgacccacgcaaccaaatttgtcggtatacacgtttcgtgtctctagacttaaaaatgcgttacgtggctgcttacttattggccgttttgggcggcaaagcctctcccaatgctgcagatcttgaaaaaatcttgggatctgtaggtgttgaagctgaaggagaaagagtaaagaaagtcatcagcgagctcagtggcaagtctgttgaagaactcattgctcaaggtcgtgaaaagttgagctccatgccagttggtggtggtgccccagctgctgccggaggtgccgctgctgctgctccagctgctgaagaaaagaaagaggccaagaaggaagaaaagaaggttgaatctgaatcagaagacgacgacatgggctttgctctattcgactagactcgttagttgtaagatcaaacttgttttgtaccttaatatatatttt

SEQ ID NO: 1464 - DNA, 378 bp, Diabrotica virgifera
  Clone ID: LIB3026-031-Q1-E1-B4
cttattggccgttttgggcggcaaagcctctcccaatgctgcagatcttgaaaaaatcttgggatctgtaggtgttgaagctgaaggagaaagagtaaagaaagtcatcagcgagctcagtggcaagtctgttgaagaactcattgctcaaggtcgtgaaaagttgagctccatgccagttggtggtggtgccccagctgctgccggaggtgccgctgctgctgctccagctgctgaagaaaagaaagaggccaagaaggaagaaaagaaggttgaatctgaatcagaagacgacgacatgggctttgctctattcgactagactcattagttgtaagatcaaccttgttttgtaccttaatatatattttttaagtt

SEQ ID NO: 1465 - DNA, 545 bp, Diabrotica virgifera
  Clone ID: pGUT2648
agtcaagggactggctttttattttcgcaatttttggaataattctaaaaattgagaactctcagccaaatttaagtgctagaattgaataaaacaaaatgccgaagaataaaggaaaaggaggtaaaaatcgtaggaggggaaagaatgaaaatgaaacagaaaaacgtgaattggtattcaaagaagatggacaagaatatgcacaagtcacaaaaatgttgggtaacggtaggctagaggctatgtgttttgatggtgtcaagaggttatgtcatattagagggaaacttagaaagaaggtttggataaatcaaggtgacattattctcataggtctcagagagtaccaagatgccaaagcagatgtgattctaaaatacacccctgatgaagctcgtaatctaaaaacatatggtgaattcccagaatctgttagaattaatgaaaccgttacattcgtcgaagaagttttgatgaagatattgaatttggtgatgacatcagttcagcagacgaagctgaccctgttgatggcatctgat

SEQ ID NO: 1466 - DNA, 432 bp, Diabrotica virgifera
  unsure (1)..(432): unsure at all n locations
  Clone ID: LIB149-026-Q1-E1-D9
ataaatatgcacaagtcacaaaaatgttgggtaacggtaggctagaggctatgtgttttgatggtgtcaagaggttatgtcatattagagggaaacttagaaagaaggtttggataaatcaaggtgacattattctcataggtctcagagagtaccaagatgccaaagcagatgtgattctaaaatacacccctgatgaagctcgtaatctaaaaacatatggtgaattcccagaatctgttagaattaatgaaaccgttacattcgtcgaagaaggttttgatgaagatattgaatttggtgatgacatcagttcagcagacgaagctgaccctgttgatggcatctgatgacatgaagacgatgatagtaggtcaggccaatanagatcttgaatgggttatctcagaaacggatttcatcatgtaccag

SEQ ID NO: 1467 - DNA, 408 bp, Diabrotica virgifera
  Clone ID: LIB150-046-Q1-E1-A7
acccacgcgtccgattttcgcaatttttggaataattctaaaaattgagaactctcagccaaatttaagtgctagaattgaataaaacaaaatgccgaagaataaaggaaaaggaggtaaaaatcgtacgaggggaaagaatgaaaatgaaacagaaaaacgtgaattggtattcaaagaagatggacaagaatatgcacaagtcacaaaaatgttgggtaacggtaggctagaggctatgtgttttgatggtgtcaagaggttatgtcatattagagggaaacttagaaagaaggtttggataaatcaaggtgacattattctcataggtctcagagagtaccaagatgccaaagcagatgtgattctaaaatacacccctgatgaagctcgtaatctaaaaacata

SEQ ID NO: 1468 - DNA, 397 bp, Diabrotica virgifera
  Clone ID: LIB150-014-Q1-E1-C4
tttcgcaatttttggacaattctaaaaattgagaactctcagccaaatttaagtgctagaattgaataaaacaaaatgccgaagaataaatgaaaaggaggtaaaaatcgtatgaggggaaagaatgaaaatgaaacagaaaaacgtgaattggtattcaaagaagatggacaagaatatgcacaagtcacaaaaatgttgggtaacggtaggctagacgctatgtgttttgatggtgtcaagaggttatgtcatattagagggaaacttagaaagaaggtttggataaatcaaggtgacattagtctcataagtctcagagagtaccaagatgccaaagcacatgtgagtctaaaatacacccctgatgaagctcgtaatctaaaaacatatggtg

SEQ ID NO: 1469 - DNA, 411 bp, Diabrotica virgifera
  Clone ID: LIB150-002-Q1-E1-F5
gtcaagggactggctttttattttcgcaatttttggaataattctaaaaattgagaactctcagccaaatttaagtgctagaattgaataaaacaaaatgccgaagaataaaggaaaaggaggtaaaaatcgtaggaggggaaagaatgaaaatgaaacagaaaaacgtgaattggtattcaaagaagatggacaagaatatgcacaagtcacaaaaatgttgggtaacggtaggctagaggctatgtgttttgatggtgtcaagaggttatgtcatattagagggaaacttagaaagaaggtttggataaatcaaggtgacattattctcataggtctcagagagtaacaagatgccaaagcagatgtgattctaaaatacacccctgatgaagctcgtaatctaaaaac

SEQ ID NO: 1470 - DNA, 421 bp, Diabrotica virgifera
  unsure (1)..(421): unsure at all n locations
  Clone ID: pGUT1333
gttttatccatatttattattggaaataaaatataaaatgagaaataaatttaacggttggatttggctacacgttcaagttcatccttctttttgatagcatatgaatttgatgatcccttggcagcattgattaattcatcagccaaacattcagcaatagttttaatattacggaatgctgcttccctagcacctgtgcagagcaaccaaattgcttggttaacccttctcaagggtgacacatcaacagcttgtcttcttacagtaccagctctaccaatacgagtagaatcttctctaggtcctgaattgataatagcagaaaactaaatctgtaatggattttctccaattagtanatggataatttcaaaagcatgtttaacaattctgacagccatcaattttttaccattgt

SEQ ID NO: 1471 - DNA, 368 bp, Diabrotica virgifera
  unsure (1)..(368): unsure at all n locations
  Clone ID: pGUT1369
gttttatccatatttattattggaaataaaatataaaatgagaaataaatttaacggttggatttggctacacgttcaagttcatccttctttttgatagcatatgaatttgatgatcccttggcagcattgattaattcatcagccaaacattcagcaatagttttaatattacggaatgctgcttccctagcacctgtgcagagcaaccaaattgcttggttaacccttctcaagggtgacacatcaacagcttgtcttcttacagtaccagctctaccaatacgagtagaatcttctctaggtcctngattgataatagcagaaactaaaatctgtaatggattttctccagttagtaaatggat

SEQ ID NO: 1472 - DNA, 345 bp, Diabrotica virgifera
  Clone ID: pGUT1322
gttttatccatatttattattggaaataaaatataaaatgagaaataaatttaacggttggatttggctacacgttcaagttcatccttctttttgatagcatatgaatttgatgatcccttggcagcattgattaattcatcagccaaacattcagcaatagttttaatattacggaatgctgcttccctagcacctgtgcagagcaaccaaattgcttggttaacccttctcaagggtgacacatcaacagcttgtcttcttacagtaccagctctaccaatacgagtataatcttctctaggtcctgaattgataatagcagaaactaaaatctgtaatgga

SEQ ID NO: 1473 - DNA, 350 bp, Diabrotica virgifera
  unsure (1)..(350): unsure at all n locations
  Clone ID: pGUT1373
gttttatccatatttattattggaaataaaatataaaatgagaaataaatttaacggttggatttggctacacgttcaagttcatccttctttttgatagcatatgaatttgatgatcccttggcagcattgattaattcatcagccaaacattcagcaatagttttaatattacggaatgctgcttccctagcacctgtgcagagcaaccaaattgcttggttaacccttctcaagggtgacacatcaacagcttgtcttcttacagtaccagctctaccaatacgagtagaatcttctctaggtgctgaanttgatatagcagaaactaaaatctgtaatggattttc

SEQ ID NO: 1474 - DNA, 261 bp, Diabrotica virgifera
  Clone ID: pGUT1383
agttttatccatatttattattggaaataaaatattacatgagaattaaatctaccggttggatttggatatacgttcaagtacatccttctttgtgatagcatatgaatgatgatgatcccttggcagcatcgattaattcatcagcctaccattcgtcaagagtttaaatattacagaatgctgcttcgctaccacctgtgcagagcaaccaaattgcttggttaacccttctcaaggagtgaccatcgtcagcttgtc

SEQ ID NO: 1475 - DNA, 447 bp, Diabrotica virgifera
  Clone ID: LIB150-016-Q1-E1-E7
gtaggttctttcatctgtctcagtttttgttaccgggctgttaaatagagcttagcaggagtatattcaacatttattactaaagtagctgaataatttgaagataaaagtatttagaattagagaaaaatgtctgctcctgataaagatgaattagttcaaagggccaagcttgctgagcaagcagaacgctatgatgatatggcctcagcaatgaaatcagttacagagacaggagtggaactcagtaacgaagaaaggaatctcctatcagtcgcatataagaatgtggttggtgccagacgatcatcatggagagtaatttcttcaattgaacaaaagactgaaggatcagagaggaaacaacagatggctcgagaatatagagaaaaagttgaaaaagagttacgagaaatctgcgatgacgtcttaggacttcttgacaaa

SEQ ID NO: 1476 - DNA, 436 bp, Diabrotica virgifera
  Clone ID: LIB150-045-Q1-E1-G6
accacgcgtccgctcgtgatcgctgatctagtctattcattgttgaaagtagtgtgtatagcgtcggctgctataaaatcttactatttattgaataaaaccatttagaattagagaaaaatgtctgctcctgataaagatgaattagttcaaagggccaagcttgctgagcaagcagaacgctatgatgatatggcctcagcaatgaaatcagttacagagacaggagtggaactcagtaacgaagaaaggaatctcctatcagtcgcatataagaatgtggttggtgccagacgatcatcatggagagtaatttcttcaattgaacaaaagactgaaggatcagagaggaaacaacagatggctcgagaatatagagaaaaagttgaaaaagagttacgagaaatctgcgatgacgtcttaggacttcttgaca

SEQ ID NO: 1477 - DNA, 414 bp, Diabrotica virgifera
  Clone ID: LIB150-007-Q1-E1-G12
accacgcatccgggttctttcatctgtctcagtttttgttaccgggctgttaaatagagcttagcaggagtatattcaacatttattactaaagtagctgaataatttgaagataaaagtatttagaattagagaaaaatgtctgctcctgataaagatgaattagttcaaagggccaagcttgctgagcaagcagaacgctatgatgatatggcctcagcaatgaaatcagttacagagacaggagtggaactcagtaacgaagaaaggaatctcctatcagtcgcatataagaatgtggttggtgccagacgatcatcatggagagtaatttcttcaattgaacaaaagactgaaggatcagagaggaaacaacagatggctcgagaatatagagaaaaagttgaaaaagag

SEQ ID NO: 1478 - DNA, 421 bp, Diabrotica virgifera
  Clone ID: LIB150-038-Q1-E1-C8
aatgagatattaaattcaccagacaaagcttgccagttagctaaacaggcctttgacgatgcaatagccgagttggacacacttaacgaagactcatataaggacagtacccttattatgcagcttctccgagataacctcacactttggacgagtgacacgcagggcgaagctgatgagcctcaagaggctggtgataattaaaagtgtggagcgtcattttttaaacaattattcgttaataatgaaatttcatgtaagttgacgtattcgtggaacttggttgtgaagtttcattgacagttttaagtttcatcctgctgaaacttcgatatttaaaatgttttaggagatatgtaaatcgttaaatttatatttcacattatcacacaaccgtcatacttttcgcaacaagtaattt

SEQ ID NO: 1479 - DNA, 282 bp, Diabrotica virgifera
  Clone ID: LIB150-038-Q1-E1-D2
taggtcaagaggcctttgacgatgcagtagccgagttggacacacttaacgaggactcatatagggacagtgggcttattatgcagcttcgccgagataacgtcacactttggacgagtgacacgcagggcgaagctgatgagcctcaagaggctggtgataattaaaagtgtggagcgtcattttttaaacagttattcgttaatactgagatttcatgtaagttgacgtattcgtggaacttggttgtgaagtttcaatgacagttttaagtttcatcct

SEQ ID NO: 1480 - DNA, 449 bp, Diabrotica virgifera
  Clone ID: LIB150-025-Q1-E1-B8
cacacaagcctcaaaaggaactcgagatattccaatatctaggagcgacattcactacgagaccaaatatagaagaagaaatccaagcgagaattatggctggtaatcgttgtatctttgctctaaacaacttattgagaaataagaacatatctagaggggctaagataagaatatacaagacagtgataagacctatagtcttgtatgccagtgaaacatggacgatgaacaaatccgagcaagtcatgcttaaagtatgggaaagaaaagtcctaagaaaaatatttggcggaaagatatggaatggaatgtggataagaagaccaaatgtggaattggagaggatgtatggtgaaccaaacatagtatggatcgtaaaatcacaaagactgagatggttgggacatatccaaagggtgccaaaaacgagacttttcaaaaaaata

SEQ ID NO: 1481 - DNA, 371 bp, Diabrotica virgifera
  Clone ID: LIB149-034-Q1-E1-G3
acgcgtccaccaagctccgagaacaccaccttgttttacacctgtccttgtgtagaattctagagatgagcaattgttcgttcttacattattacgtgtacatttatatatactcttttttgcttggattaacttcggtttcacatatctacgatttaatatttcccagatcttgttacgtggcgcccgatcaaatgctttttcgaagtccacaaaacagagaaacaacttactgttatgctctatggcttcttctgataactgtctcaccgtgaatatgagatcggttgtacctcgtcctggcctaaagccgcattggctgtcatccagtgtggcctcgatattttctcgcagctttttctcgagtatta

SEQ ID NO: 1482 - DNA, 440 bp, Diabrotica virgifera
  Clone ID: LIB150-025-Q1-E1-B4
cacaaccctatagagggtctcaatatattccaatatctaggagcgacattcactaggagaccaaatataaaagaagaaatccaagcgagaattatggctggtaatcgttgtatctttgctctaaacaacttattgagaaataagaacatatctagaggggctaagataagaatatacaagacagtgataagacctatagtcttgtatgccagtgaaacatggacgatgaacaaatccgagcaagtcatgcttaaagtatgggaaagaaaagtcctaagaaaaatatttggcggaaagatatggaatggaatgtggataagaagaccaaatgtggaattggagaagatgtatggtgaaccaaacatagtagggatcgtaaaatcacaaagactgagatgggtgggagatatctcaaggggagccaaaaccggagttttcgc

SEQ ID NO: 1483 - DNA, 438 bp, Diabrotica virgifera
  unsure (1)..(438): unsure at all n locations
  Clone ID: LIB150-009-Q1-E1-D7
cccacgcgtccgtagaaattgatggtatcagtattgaacaagtaatggaagtaaaataccttggaattacattgtcaagttacggagacctggacaaagaagtgagaaatcaagtacaaaaagcaaatagactggcaggactcaatcacactatatggcgaaaccgacatattaacactgagatgaagtcaagaatttataaaaccagtgtaagacaaataatagcatatgcatcagaaacaagacccgatacagccacaacacaaagactactgaaaacggcagagatgagactactgagaagaattacaggaaatacgttgagagatcganaggggagtgaagacattagaagacaatgtaacgtacagtgtaaaaacgaatggacactaaatagaaaaaaaaaagaatggagcaacccacataccagaatggtgg

SEQ ID NO: 1484 - DNA, 393 bp, Diabrotica virgifera
  Clone ID: LIB149-005-Q1-E1-A3
agggaccaccaaatgtagcgattttagacgaatcagtttgatgagtcacaccctcaagatacgtttacgtattatacaaaaccgagtattccttctatgcgaaactagaatggataataagcaatttggatttagaaatggtgaaggaactagagaagcactattttgtatgcgcgttctcttacaaaaaagttgtgaattccgaaagaacgtttatgtttgtttcatcaacttcgagaaggcattcgactgagtacaacacgatacatttttcgattgcctgcagacagcaggacttgaccgctacgatataagactgctggaatacttatattacaaccaagtagcctctatccaaattggagacagtcgtactgaaaaactaacgattaa

SEQ ID NO: 1485 - DNA, 511 bp, Diabrotica virgifera
  Clone ID: pGUT2653
gttcactgttgtagaatattagttgtagtttaagtgacaggtttactcagtagtttatttaaaatgggaagtgcacaatcagctttaaattttggtgccgggcccgccaagttacctagagaggtgctagaagaggtccaaaaagaattcctttcctaccaagattcaggaatgagcttgattgaaatgagccacagaggcaaggaatataccaaaatcaataaagattcacaagcggttatcagggagcttcttaatgttccggacaactacaagattctgcttatgcaaggcggtggatgtggagcttttgccgcagttgccatgaatctcttgaatagaaccggaaccgctgattacgccgtgactggtacatggtccgacaaagcagctaaagaggcatccaaatatggaaacgtcaatctagtattcccaaaagccagcaaaccaggcagtgttcctcctcaaaacacgtggaagatgaatccaaatgcttcctacgtattctact

SEQ ID NO: 1486 - DNA, 447 bp, Diabrotica virgifera
  Clone ID: LIB150-017-Q1-E1-E5
ccacgcgtccgcaaaattcggctgcatcattgctggtgcccaaaagaatattggacctgcgggagtagtagtggttattgtccgtgaagatcttctaggaaatcccatgaaatgctgtccatctgtaatggacttcactcacatagccaaagaaaactctgtacataacactccagcaacattctctgtctacgtcatggaaaaggtacttcagtggattaaaaagaacggaggtctcgaagccatggaaaaccaagccatagaaaagagcagtttattgtacaacgccatggttgaatctaaaggtttctacacttgcccaattgatgaagacgtcagaagtagaatgaacgtaccattcagagtgggtggaggcaacgaaaaactcgaagaacttttcttagtagaagcagagaaagttaagatgtatcaactaaaagggcacag

SEQ ID NO: 1487 - DNA, 412 bp, Diabrotica virgifera
  Clone ID: LIB150-033-Q1-E1-E5
accacgcgtccggtgacttagttcactgttgtagaatattagttgtagtttaagtgacaggtttactcagtagtttatttaaaatgggaagtgcacagtcagctttaaattttggtgccgggcccgccaagttacctagagaggtgctagaagaggtccaaaaagaattcctttcctaccaagattcaggaatgagcttgattgaaatgagccacagaggcaaggaatataccaaaatcaataaagattcacaagcggttatcagggagcttcttaatgttccggacaactacaagattctgcttatgcaaggcggtggatgtggagcttttgccgcagttgccatgaatctcttgaatagaaccggaaccgctgattacgccgtgactggtacatggtccgacaaagcagc

SEQ ID NO: 1488 - DNA, 460 bp, Diabrotica virgifera
  unsure (1)..(460): unsure at all n locations
  Clone ID: LIB150-030-Q1-E1-G1
tgcacatgcgtctgctcacgcgtccgggtgtagaatattacttgtagtttaagtgacaaggttactcagtaatttaattaaaatgggaaatgcacagtcagctttaaattttggtgccgggcccgccaagttacctaaagaagttgcaaaagaaggccaaaaagaattcctttcccaacaaagattcaaggaatgagcttgattgaaatgagccacaaaggcaaggaatatnacaaaatcaataaagattcacaggcggttatcagggagctccttaaggttccggacaactacaagattctgcttatgcaaggcggtggatgtggagcttatgccgcagttgccatgaatctcttgaatagaaccggaaccgctgattacgccgtgactggtacatggtccgacaaagcagctaaagaggcatccaaatatggaaacgtcaatctagtattcccaaaag

SEQ ID NO: 1489 - DNA, 337 bp, Diabrotica virgifera
  Clone ID: LIB150-033-Q1-E1-E6
accacgcgtccggtgacttagttcactgttgtagaatattagttgtacattaagtgacaggtttactcagtagtttatttaaaatgggaagtgcacagtcagctttaaattttggtgccgggcccgccaagttacctagagaggtgctagaatacgtccagaaagaattcctttcctaccaagattcaagaatgagcttgattgaaatgagccacagaggcaatgaatatatcaggctcaatagagattcacaagcggttatcagggagcttcttaatgttccggacaactacaagattctgcttaggcaaggcagtggatgtggagcttttgccgc

SEQ ID NO: 1490 - DNA, 411 bp, Diabrotica virgifera
  Clone ID: LIB150-006-Q1-E1-B8
aattctggtgatggtgtatcccacactgtcccaatctatgaaggttatgcacttccccatgcaatccttcgtttggacttggctggcagagatttaactgattacctcatgaaaatcttgactgaacgtggctactctttcaccaccacagcagaaagagaaattgttagggatattaaagaaaaactctgctatgtagctttggacttcgaacaagaaatggcaacggctgctagttccagttcccttgaaaagagttacgaacttcctgatggacaagtcatcaccattggtaatgaaagattccgttgtccagaagccctcttccaaccatcctttttgggaatggaagccaatggtatacatgagactacctacaattccatcatgaagtgtgatgttgatatccgt

SEQ ID NO: 1491 - DNA, 411 bp, Diabrotica virgifera
  unsure (1)..(411): unsure at all n locations
  Clone ID: LIB3026-023-Q1-E1-D12
ccacgcgtccgccaacgcgtcaggtcatcaccattggtaatgnagatccgttgtccaaaccctctttcaacatcctttttgggaatggaagccaatggtatacatgagactacctacaattccatcatgaagtgtgatgttgatatccgtaaagacttatatgccaatactgtactctctggaggtaccaccatgtaccctggtattgctgacagaatgcagaaagaaataacctccttggcacccagcacaatgaaaatcaaaattattgctccaccagaaaggaaatactctgtttggattggtggttcaattttagcttctctttctactttccaacagatgtggattttcaaacaggaatatgatgaatctggaacatccattgttcacaggaagtgcttttaattt

SEQ ID NO: 1492 - DNA, 339 bp, Diabrotica virgifera
  Clone ID: LIB149-037-Q1-E1-G6
atatagaaatcaaatactaaccaatcaacatgtgtgaagaagaagttgccgctttagtcgtagacaatggatccggtatgtgcaaagctggttttgctggggatgatgcacctcgtgctgtattcccttcaattgttggacgcccaagacatcagggtgtgatggtaggaatgggacaaaaagattcctatgtaggtgatgaagctcaaagtaaaagaggtatccttaccttaaaataccccatcgagcacggaatagtcacaaactgggatgatatggagaaaatttggcatcatacattctacaatgaactcagagtagccccagaagaacaccctg

SEQ ID NO: 1493 - DNA, 421 bp, Diabrotica virgifera
  Clone ID: LIB150-045-Q1-E1-H1
tggtaacctaatgggttccgggtaagggggtacccaaaatggcccaatccaagaaaggtaagcactttcccaaggaatccctccgttggactttggtgggaagagatttaaactgaatacctcatgaaaatcttgactgaacgtggctactctttcaccaccacagcagaaagagaaattgttagggatattaaagaaaaactctgctatgtagctttggacttcgaacaagaaatggcaacggctgctagttccagttcccttgaaaagagttacgaacttcctgatggacaagtcatcaccattggtaatgaaagattccgttgtccagaagccctcttccaaccatcctttttgggaatggaagccaatggtatacatgagactacctacaattccatcatgaagtgtgatgttgata

SEQ ID NO: 1494 - DNA, 364 bp, Diabrotica virgifera
  Clone ID: LIB149-011-Q1-E1-F6
aattagtgcttacttggtacagcagtttcagtgctgtgctttagaataatttattttttaacatttatatagaaatcaaatactaaccaatcaacatgtgtgaagaagaagttgccgctttagtcgtagacaatggatccggtatgtgcaaagctggttttgctggggatgatgcacctcgtgctgtattcccttcaattgttggacgcccaagacatcagggtgtgatggtaggaatgggacaaaaagattcctatgtatgtgatgaagctcaaagtaaaagaggtatccttaccttaaaataccccatcgagcacggaatagtcacaaactgggatgatatggagaaaatttggcatcatac

SEQ ID NO: 1495 - DNA, 443 bp, Diabrotica virgifera
  unsure (1)..(443): unsure at all n locations
  Clone ID: LIB150-046-Q1-E1-G10
gactcgtaggtcgatacaacactctaaagtgagtcgtattagggtagggaggacaaggctacttggaagtcaaaatacttcaccaaacttatccaattgctagaagactacccaaagtgtttcattgtgggcgctgacaatgtcggctcaaaacaaatgcagcaaattcgtatttcattgcgaggaaatgctgtcgttcttatgggaaaaaataccatgatgcgtaaagctatcaagggccatattgaacacaaccctgctctggaaaagatcttgccccacatcaagggtaatgttggttttgttttcacccgaggtgacttggttgaaatcagagacaaactattggaaaacaaagtcaaagcccctgctagagctggtgccattgctccattatctgtcatcattcctgcncaaaacactggattgttccctgagaagac

SEQ ID NO: 1496 - DNA, 441 bp, Diabrotica virgifera
  Clone ID: LIB149-008-Q1-E1-C4
ctgagttcttaaattcgaaaatacgagtccctaaccacttcaaagatgggtagggaggacaaggctacttggaagtcaaaatacttcaccaaacttatccaattgctagaagactacccaaagtgtttcattgtgggcgctgacaatgtcggctcaaaacaaatgcagcaaattcgtatttcattgcgaggaaatgctgtcgttcttatgggaaaaaataccatgatgcgtaaagctatcaagggccatattgaacacaaccctgctctggaaaagatcttgccccacatcaagggtaatgttggttttgttttcacccgaggtgacttggttgaaatcagagacaaactattggaaaacaaagtcaaagcccctgctagagctggtgccattgctccattatctgtcatcattcctgcccaaaacactggattgttccct

SEQ ID NO: 1497 - DNA, 424 bp, Diabrotica virgifera
  Clone ID: LIB150-047-Q1-E1-H3
atgagttcttaaatttgaaaatacgagtccctaaccacttcaaagatgggtagggaggacaaggctacttggaagtcaaaatacttcaccaaacttatccaattgctagaagactacccaaagtgtttcattgtgggcgctgacaatgtcggctcaaaacaaatgcagcaaattcgtatttcattgcgaggaaatgctgtcgttcttatgggaaaaaataccatgatgcgtaaagctatcaagggccatattgaacacaaccctgctctggaaaagatcttgccccacatcaagggtaatgttggttttgttttcacccgaggtgacttggttgaaatcagagacaaactattggaaaacaaagtcaaagcccctgctaaagctggtgccattgctccattatctgtcatcattcctgcccaaa

SEQ ID NO: 1498 - DNA, 436 bp, Diabrotica virgifera
  Clone ID: LIB150-020-Q1-E1-E4
gcgtccatgtttattgctgagttcttaaattcgaaaatacgagtccctaaccacttcaaagatgggtagggaggacaaggctacttggaagtcaaaatacttcaccaaacttatccaattgctagaagactacccaaagtgtttcattgtgggcgctgacaatgtcggctcaaaacaaatgcagcaaattcgtatttcattgcgaggaaatgctgtcgttcttatgggaaaaaataccatgatgcgtaaagctatcaagggccatattgaacacaaccctgctctggaaaagatcttgccccacatcaagggtaatgttggttttgttttcacccgaggtgacttggttgaaatcagagacaaactattggaaaacaaagtcaaagcccctgctagagctggtgccattgctccattatctgtcatcattcctgcc

SEQ ID NO: 1499 - DNA, 420 bp, Diabrotica virgifera
  Clone ID: LIB150-009-Q1-E1-E8
acgaaattcgaaaatacgagtccctaaccacttcaaagatgggtacggaggacaaggctacttggaagtcaaaatacttcaccaaacttatccaattgctagaagactacccaaagtgtttcattgtgggcgctgacaatgtcggctcaaaacaaatgcagcaaattcgtatttcattgcgaggaaatgctgtcgttcttatgggaaaaaataccatgatgcgtaaagctatcaagggccatattgaacacaaccctgctctggaaaagatcttgccccacatcaagggtaatgttggttttgttttcacccgaggtgacttggttgaaatcagagacaaactattggaaaacaaagtcaaagcccctgctaaagctggtgccattgctccattatctgtcatcattcctgccaaaacac

SEQ ID NO: 1500 - DNA, 441 bp, Diabrotica virgifera
  Clone ID: LIB149-014-Q1-E1-C8
gcaaccccccaagaactggggtgacgttagcgtattcggcgacttagaccccaccggtgagtttgttgtgtccacccgtgtcagatgcggacgttccatggaaggatacccattcaacccatgcttgaccgaagaacaatataaagaaatggaacaaaaagtttccagcactctctctggccttgaaggtgaacttaaaggaacattctacccattgactggtatgagcaaagacgtccaacaaaagttgatcgacgaccatttcttgttcaaggaaggagaccgattcttgcaagctgccaacgcctgcagattctggccctctggtcgtggaatctaccacaacgagaacaaaaccttcttagtatggtgcaacgaagaagatcatcttcgtctcatctctatgcaaatgggtggtaacttgggagaagtttacagacg

SEQ ID NO: 1501 - DNA, 400 bp, Diabrotica virgifera
  Clone ID: LIB149-039-Q1-E1-C9
acggacgcgtgggcgacttagaccccaccggtgagtttgttgtgtccacccgtgtcagatgcggacgttccatggaaggatacccattcaacccatgcttgaccgaagaacaatataaagaaatggaacaaaaagtttccagcactctctctggccttgaaggtgaacttaaaggaacattctacccattgactggtatgagcaaagacgtccaacaaaagttgatcgacgaccatttcttgttcaaggaaggagaccgattcttgcaagctgccaacgcctgcagattctggccctctggtcgtggaatctaccacaacgagaacaaaaccttcttagtatggtgcaacgaagaagatcatcttcgtctcatctctatgcaaatgggtggtaacttggg

SEQ ID NO: 1502 - DNA, 435 bp, Diabrotica virgifera
  Clone ID: LIB149-032-Q1-E1-B11
ctcacgggccaacacacgcctctacaatgactcctataaaagaattccattctctcacaatgacaggcttggtttccttactttctgcccaactaacttgggtaccactgttcgtgcttctgttcacattaaggttcctaaattggctgccaacatggctaaattggaagagattgctggaaaatacaatctccaagtccgtggtactcgtggcgagcacacagaagctgaaggaggagtctatgatatttccaacaagagacgtatgggtttgaccgaatatgacgccgttaaagaaatgtacgatggtatccaagaactcatcaagatcgagaaagagttataaatcgtctatcagtatgctttatcagttaaaagtatttataagcagtgatgtaaacatattttatttttcacttctatttcagatgccaa

SEQ ID NO: 1503 - DNA, 280 bp, Diabrotica virgifera
  Clone ID: LIB150-005-Q1-E1-A5
cgggttcgtgcttcggttcaaattaaggttcctaaattggctgccaacatggctaaatttggaagagattgctggaaaatacaatctccaagtccgtggtactcgtggcgagcacacagaagctgaaggaggagtctatgatatttccaacaagagacgtatgggtttgaccgaatatgacgccgttaaagaaatgtacgatggtatccaagaactcatcaagatcgagaaagagttataaatcgtctatcagtatgctttatcagttaaaagtatttat

SEQ ID NO: 1504 - DNA, 320 bp, Diabrotica virgifera
  Clone ID: LIB150-005-Q1-E1-C1
gccaacatggctaaattggaagagattgctggaaaatacaatctccaagtccgtggtactcgtggcgagcacacagaagctgaaggaggagtctatgatatttccaacaagagacgtatgggtttgaccgaatatgacgccgttaaagaaatgtacgatggtatccaagaactcatcaagatcgagaaagagttataaatcgtctatcagtatgctttatcagttaaaagtatttataagcagtgatgtaaacatattttattttctacttccatttcaaatgccaaaggtattagcaaagtttacataagatgttttat

SEQ ID NO: 1505 - DNA, 442 bp, Diabrotica virgifera
  Clone ID: LIB3026-006-Q1-E1-G9
gtttattgccgagttcttaaattcgaaaatacgagtccctaaccacttcaaagatgggtagggaggacaaggctacttggaagtcaaaatacttcaccaaacttatccaattgctagaagactacccaaagtgtttcattgtgggcgctgacaatgtcggctcaaaacaaatgcagcaaattcgtatttcattgcgaggaaatgctgtcgttcttatgggaaaaaataccatgatgcgtaaagctatcaagggccatattgaacacaaccctgctctggaaaagatcttgccccacatcaagggtaatgttggttttgttttcacccgaggtgacttggttgaaatcagagacaaactattggaaaacaaagtcaaagcccctgctagagctggtgccattgctccattatctgtcatcattcctgcccaaaacactggatt

SEQ ID NO: 1506 - DNA, 448 bp, Diabrotica virgifera
  Clone ID: LIB150-017-Q1-E1-C3
gatgtttaatgctgagttcttaaattcgaaaatacgagtccctaaccacttcaaagatgggtagggaggacaaggctacttggaagtcaaaatacttcaccaaacttatccaattgctagaagactacccaaagtgtttcattgtgggcgctgacaatgtcggctcaaaacaaatgcagcaaattcgtatttcattgcgaggaaatgctgtcgttcttatgggaaaaaataccatgatgcgtaaagctatcaagggccatattgaacacaaccctgctctggaaaagatcttgccccacatcaagggtaatgttggttttgttttcacccgaggtgacttggttgaaatcagagacaaactattggaaaacaaagtcaaagcccctgctatagctggtgccattgctccattatctgtcatcattcctgcccaaaacactggattgtt

SEQ ID NO: 1507 - DNA, 407 bp, Diabrotica virgifera
  Clone ID: LIB149-030-Q1-E1-G5
agcttaaattcgaaaatacgagtccctaaccacttcaaagatgggtagggaggacaaggctacttggaagtcaaaatacttcaccaaacttatccaattgctagaagactacccaaagtgtttcattgtgggcgctgacaatgtcggctcaaaacaaatgcagcaaattcgtatttcattgcgaggaaatgctgtcgttcttatgggaaaaaataccatgatgcgtaaagctatcaagggccatattgaacacaaccctgctctggaaaagatcttgccccacatcaagggtaatgttggttttgttttcacccgaggtgacttggttgaaatcagagacaaactattggaaaacaaagtcaaagcccctgctagagctggtgccattgccccattatctgtcatca

SEQ ID NO: 1508 - DNA, 419 bp, Diabrotica virgifera
  Clone ID: LIB150-035-Q1-E1-G8
ttattgctgagttcttaaattcgaaaatacgagtccctaaccacttcaaagatgggtagggaggacaaggctacttggaagtcaaaatacttcaccaaacttatccaattgctagaagactacccaaagtgtttcattgtgggcgctgacaatgtcggctcaaaacaaatgcagcaaattcgtatttcattgcgaggaaatgctgtcgttcttatgggaaaaaataccatgatgcgtaaagctatcaagggccatattgaacacaaccctgctctggaaaagatcttgccccacatcaagggtaatgttggttttgttttcacccgaggtgacttggttgaaatcagagacaaactattggaaaacaaagtcaaagcccctgctagagctggtgccattgctccattatctgtcatcat

SEQ ID NO: 1509 - DNA, 414 bp, Diabrotica virgifera
  Clone ID: LIB149-028-Q1-E1-H12
acccacgcgtccgcccacgcgtccgcttaaattcgaaaatacgagtccctaaccacttcaaagatgggtaaggaggacaaggctacttggaagtcaaaatacttcaccaaacttatccaattgctagaagactacccaaagtgtttcattgtgggcgctgacaatgtcggctcaaaacaaatgcagcaaattcgtatttcattgcgaggaaatgctgtcgttcttatgggaaaaaataccatgatgcgtacagctatcaagggccatattgaacacaaccctgctctggaaaagatcttgccccacatcaagggtaatgttggttttgttttcacccgaggtgacttggttgaaatcagagacaaactattggaaaacaaagtcaaagcccctgccagagctggtgccattgct

SEQ ID NO: 1510 - DNA, 530 bp, Diabrotica virgifera
  Clone ID: pGUT2598
ttaaagtacctgtttcggctgaaaatctattgtcttgctgcgattcctgtggatatggatgcgaaggaggatatccaaccatggcatggagttattggatagatacaggaattactacaggaggcctttatggcagcaaacagggttgtcaaccttattcgcttcaaccatgtgaacatcatacagagggtaataaagtacaatgcagcactttggactatgacacaccttcttgtaaacataaatgtgacgattccgcactcaattataagtccgagttaacttttggttcaggttctgtgcgtaacttctattcagttgcaaatattcaaaaggaaatattgacgaatggtccggtagaagcagcttttgatgtgtacagcgacttcgtgaattataaaagtggtgtctatcaacatgttgctggagaatatttaggaggacatgccgtcagaattttaggttggggagaagagagtggagtcccttattggttgggtgctaattcatggaatgaagattggggagac

SEQ ID NO: 1511 - DNA, 420 bp, Diabrotica virgifera
  Clone ID: LIB150-033-Q1-E1-D12
accacgcgtccgcaatggactatatcattaaattgatgggggtattacctgaccataagaactatatgcctcctgtattgacacataaactagaagctctagaaattccagccgatttcgatgctcgtcagcaatggccacattgcccaacaattcgggagataagagatcagggatcatgcgggtcatgttgggcttttggagcagtggaagctatgtcagacagagtgtgcattcattctaacggtgaatctaacttccatttctcatcagatgatttggtttcttgctgttggacatgtggaatgggatgtaatggtggatatcctggtgcagcttggcattattgggtcagaaaaggtcttgtctctggtggtcaatatggtacaaaacaaggttgccggccatacgaaattcctc

SEQ ID NO: 1512 - DNA, 443 bp, Diabrotica virgifera
  Clone ID: LIB3026-017-Q1-E1-F6
aatccgaaagggttgtcaatcatattcgcttcaaccttgtgaacatcatacaaatggtactaaagtgcaatgcagtactttgaactacggcacaccttcttgcagaagcgatcaatgtgacgataccgcactaaattataagtccgagttaacttatgcctcaggtccagtgaattactatactacagttcccaatatgcaaaaggaaatattgacaaatggtccgatacaaactcgttttgatgtgtacagcgatttcttcagttacaaaagtggtgtttatcaacatgtcgctggagattatgtaggaggacatgccgtcagagttttaggttggggagtagagaatggagtcgcttattggttggctgctaattcatggaatgaacattggggagacaatggattgtttaaaataattcgcggaacaaatgaatgcagtt

SEQ ID NO: 1513 - DNA, 450 bp, Diabrotica virgifera
  Clone ID: LIB3026-012-Q1-E1-E3
ccacgcctccgagtggcttgaagccgtaatagtcttggatgcaaaataggatatatggaagatggatggtggtattggctaaaaaatggaattcctacaggaggtctttatggcagcaaacagggttgtcaaccatattcgcttcaatcttgtgaacatcatacaaatggtactaaagtggattgcagtactttgaaattggatacacctacttgcagaactcaatgtaacgatcccgcacttaattataagtccgagttaacttatgctgcaggtccaccagattggtacactagagttgccgatatgcaaagggaaataatgacaaatggtccagtagaaacaactttccgcttgtacactgatttctggaattataaaagtggtgtttatcataatgtcggtggagattatgctggataccattgcgtcagagttttaggctggggt

SEQ ID NO: 1514 - DNA, 346 bp, Diabrotica virgifera
  Clone ID: LIB3026-009-Q1-E1-B4
caggaagatggatggtggttatgggaggcgaatggaattcctacaggaggcctttatggcagcaaccagggttgccaaccttattctcttccaccatgtgaacataatacaactggtactaaagtgcaatgcagtactttgaagttagatacacctacttgcagaactcaatgtaacgatcccgcacttaattataagtccgagttaacttttgcttcaggtccatcgtattcgttcactacagtagccaatatgcaaaaggaaatattgacaaatggtccggtagaaacgactttccacttgtacagtgatttctggagttataaaagtggtgtttatcaacatg

SEQ ID NO: 1515 - DNA, 403 bp, Diabrotica virgifera
  Clone ID: LIB149-007-Q1-E1-H5
caacaacctcttttcatcttcgacccgtttgccggcgttagcttgtaaaacatttctgttaaaatcacgaaccatccgttaaaagaaatggcagatgaatatttttttgctttaaccctcaaaggtaaaaacagtgaaatctgggatccagaagcgaagggagcagaggattaccaagggggacacaaattgatcattaaacaagctttgttgggacccgaagcccaagaaggtgaagtaaatgttgtacaagtagaagctatgacgtggaaagactcggttaaaatcccaattgccacactaaaagccggaggcccaaataaccaagtattgttagatctgtcattcccagacccaccagtcacattttcacttatacaaggtaatggaccagttcacattg

SEQ ID NO: 1516 - DNA, 413 bp, Diabrotica virgifera
  unsure (1)..(413): unsure at all n locations
  Clone ID: LIB150-037-Q1-E1-D12
aaaaacagtgaaatctgggatccagaagcgaagggagcagaggattaccaagggggacacaaattgatcattaaacaagctttgttgggacccgaagcccaagaaggtgaagtaaatgttgtacaagtagaagctatgacgtggaaagactcagttaaaatcccaattgccacactaaaagccggaggcccaaataaccaagtattgttagatctgtcattcccagacccaccagtcacattttcacttatacaaggtaatggaccagttcacattgtaggccatcatttaattggtagtccgatggaagaattcgatgaaatggatgaattagaagaggaaatgttggatgatgaagaacgggaagaaggagccgangaagatgaggatgaagatgaacccaaaagcaaaaa

SEQ ID NO: 1517 - DNA, 669 bp, Diabrotica virgifera
  Clone ID: LIB150-021-Q1-E1-E10
cccacgcgtcagacaatttctcttaaatataagtataatatcttatgacgtcaagaaacataaaatattatacttatatttaagagaaattgttacggttgatctgttaatggatgtataacaactcccgagatacattaaaaaactaacttaacattacaaaggaggtggtttggggattagatgaacttgtttatttctttgcagcctttgaattgttttttacgggagttttgcccttggcgttagtccctgattttgcctttttggctttgggttcaacctcatcctcaacttcctcgggtccttcctccccttcctcatcatccaacatttcctcttccaattcatccatttcatcgaattcttccatcggactaccaattaaatgatggcctacaatgtgaactggtccattaccttgtataagtgaaaatgtgactggtgggtctgggaatgacagatctaacaatacttggttatttgggcctccggcttttagtgtggcaattgggattttaaccgagtctttccacgtcataacttctacttgtacaacatttacttcaccttcatgggcttcgggtcacaacaaagcttgtttaatgaataatttgtgtcccccttggtaatcctctgctcccttcgcttcgggatccagatttcact

SEQ ID NO: 1518 - DNA, 386 bp, Diabrotica virgifera
  unsure (1)..(386): unsure at all n locations
  Clone ID: LIB3026-033-Q1-E1-G4
cacgcgtccgccaacgcgtccgcccacgcgtccgcgacgcgtttgccggcgttagcttgtaaaacatttctgttaaaatcacgaaccatccgttaaaagaaatggcagatgaatatttttttgctttaaccctcaaaggtaaaaacagtgaaatctgggatccagaagcgaagggagcanaggattaccaagggggacacaaattgatcattaaacaagctttgttgggacccgaagcccaagaaggtgaagtaaatgttgtacaggtagaagctatgacgtggaaagactcggttaaaatcccaattgccacactaaaagccggaggcccaaataaccaagtattgttagatctgtcattcccagacccaccagtcacattttca

SEQ ID NO: 1519 - DNA, 373 bp, Diabrotica virgifera
  Clone ID: LIB150-040-Q1-E1-B8
acggacgcgtggggaagccggcatttgcgcgccattgtagttagtactaggaaaacgggagttatttttgcatttaacaatggttgtttctcttcattttgcagctttaaccctcaaaggtaaaaacagtgaaatctgggatccagaagcgaagggagcagaggattaccaagggggacacaaattgatcattaaacaagctttgttgggacccgaagcccaagaaggtgaagtaaatgttgtacaagtagaagctatgacgtggaaagactcggttaaaatcccaattgccacactaaaagccggaggcccaaataaccaagtattgttagatctgtcattcccagacccaccagtcacattttcacttata

SEQ ID NO: 1520 - DNA, 425 bp, Diabrotica virgifera
  Clone ID: LIB150-024-Q1-E1-F1
gaccagaagcgcttacttttgacgtaaatgatcccctgcacttggattatgttattgctgcagctaatttgaaggctgaagtttatggtataccaactagtagaaatagagaacaaatcgcagaagtggttatgcaagtcaatgttccagaattcatccctaaatctggcgtaaagatagcagttacggattctcaaatggctatgaatggtaataatgtggatttggatcgtgtttcccaaattaaagaagaattaccttcagtagcagaactaggtggactacgtcttactcctttagaatttgaaaaggacgatgacaccaatttccacatggactttatagttgctgcttcaaatcttcgtgcagctaattacaaaataccgcctgctgatagacataaatcataacttattgctggtaag

SEQ ID NO: 1521 - DNA, 446 bp, Diabrotica virgifera
  Clone ID: LIB150-011-Q1-E1-A1
catcattctgattcattttcagcttaatttttccatgtagtgccggttaattgaagtgatatatgatttatttatgtgattacatctaacagcagactcataaaattgtgtctttttgtgtccgatgtctagtggtagtttagcagacaactccatcgatcctccagccaaaaagcggaagcttgaatcaaagattgctaccctcgaaatggcgaacaatgaagcttcaggatcctccaccagtgatatcgatgagggactttactcgagacaactgtacgttttggggcacgaagctatgcgccgcatggcaaatagtgatgttctaatatcaggtttaagtggtttgggtgtagaagtagctaaaaatgtaattcttggtggtgttaaatctgttacccttcacgatgaggctctttgtactattaaggacctgtcatcccaat

SEQ ID NO: 1522 - DNA, 420 bp, Diabrotica virgifera
  Clone ID: LIB150-014-Q1-E1-D8
cggacgcgtgggttttcagcttaatttttccatgtagtgccggttaattgaagtgatatatgatttatttatgtgattacatctaacagcagactcataaaattgtgtctttttgtgtccgatgtctagtggtagtttagcagacaactccatcgatcctccagccaaaaagcggaagcttgaatcaaagattgctaccctcgaaatggcgaacaatgaagcttcaggatcctccaccagtgatatcgatgagggactttactcgagacaactgtacgttttggggcacgaagctatgcgccgcatggcaaatagtgatgttctaatatcaggtttaggtggtttgggtgtagaagtagctaaaaatgtaattcttggtggtgttaaatctgttacccttcacgatgaggctctttgtac

SEQ ID NO: 1523 - DNA, 410 bp, Diabrotica virgifera
  Clone ID: LIB150-005-Q1-E2-A2
catcaatctgattcattttcagcttaatttttccatgtagtgccggttaattgaagtgatatatgatttatttatgtgattacatctaacagcagactcataaaattgtgtctttttgtgtccgatgtctagtggtagtttagcagacaactccatcgatcctccagccaaaaagcggaagcttgaatcacagattgctaccctcgaaatggcgaacaatgaagcttcaggatcctccaccagtgatatcgatgagggactttactcgagacaactgtacgttttggggcacgaagctatgcgccgcatggcaaatagtgatgttctaatatcaggtttaagtggtttgggtgtagaagtagctaaaaatgtaattcttggtggtgttaaatctgttacccttcacgatg

SEQ ID NO: 1524 - DNA, 417 bp, Diabrotica virgifera
  Clone ID: LIB3026-035-Q1-E1-F8
cccacgcgtccgaagctaaagctcaagaacgtttcggtctttcgatgtcagaagtcgtcagacgggtgtcaaagaagaaaatcgaacctcacgtaaaagcattggtattcgaactgtgttgcaacgattccactggtgaagacgtggaagttccatatgttaaatacaatttatgttgagccgactcagttcacaactcagcttagaagacttaagagttttgttaggtcagtttctggattaagagtacgggaaaactagccacgttttactatttacacattgtgagattgctgaccaatagttggaatacatattagcagcaagagcttgtgtcttttattagttattatttatcagctgttttttaatatttgcagacctttaaatattttttatcttttaaatgtccttttt

SEQ ID NO: 1525 - DNA, 431 bp, Diabrotica virgifera
  Clone ID: LIB3026-006-Q1-E1-D8
cccacgcgtccgcccacgcgtccgcggacgcgtgggagcaaattgtaacaaaccaaacggtaaaaattcctgagggaattacagtaaccactaagtcaagggtagtaactgtaaaaggaccccgaggtaatctgaagagatccttcaaacatcttaccctggacattcgaatgatcaaccccaggttactgaaagtagagaaatggttcggtaccaagaaggaattagctgctgtcagaacagtatgctctcatgttgaaaacatgttaaagggtgttacaaaaggataccaatacaagatgagagcagcatatgctcactttcccattaactgtgtcaccactgaaggaaacacagttatcgaaattagaaatttcttgggagaaaaatacatcagaagagtaaagatggccccaggtgttacagtagta

SEQ ID NO: 1526 - DNA, 424 bp, Diabrotica virgifera
  Clone ID: LIB3026-010-Q1-E1-E6
accacgcgtccgcccacgcgtccgcggacgcgtgggagcaaattgtaacaaaccaaacggtaaaaattcctgagggaattacagtaaccactaagtcaagggtagtaactgtaaaaggaccccgaggtaatctgaagagatccttcaaacatcttaccctggacattcgaatgatcaaccccaggttactgaaagtagagaaatggttcggtaccaagaaggaattagctgctgtcagaacagtatgctctcatgttgaaaacatgttaaagggtgttacaaaaggataccaatacaagatgagagcagcatatgctcactttcccattaactgtgtcaccactgaaggaaacacagttatcgaaattagaaatttcttgcgagaaaaatacatcagaagagtaaagatggccccaagtgttac

SEQ ID NO: 1527 - DNA, 327 bp, Diabrotica virgifera
  Clone ID: LIB149-016-Q1-E1-A2
aagaaacacagttatcgaaattagaaatttcttgggagatacatacatcagaagagtaaagatggccccaagtgttacagtagtaaactccaccagacagaaggatgaacttatcattgaaggaaactcattggaggatgtttcaaagtcagctgcccttattcaacaatctacaacagttaaaaataaagatatccgtaaattcttagatgggctttatgtatctgaaaaaacaactgttgtacaagaagaataacttgtatttttgaaataaatttaagtttatatttaagattggacgtcaaaggaaaaggaacttgaaaaaga

SEQ ID NO: 1528 - DNA, 310 bp, Diabrotica virgifera
  Clone ID: LIB3026-004-Q1-E1-B2
cggacgcgtgggattttatgtcacaagtagggctaaaatgaagcaaattgtaacaaaccaaacggtaaaaattcctgagggaattacagtaaccactaagtcaagggtagtaactgttaaaggaccccgaagtaatctgaagagatccttcaaacatcttaccctggacattccaatgattaaccccaggttactgaaagtagaaaaatggttcggtaccaagaaggaattaactgctgtcagaacagtatgctctcatgttgaaaacatgttaaagggtgttacaaaaggataccaatacaagatgaga

SEQ ID NO: 1529 - DNA, 387 bp, Diabrotica virgifera
  Clone ID: LIB150-042-Q1-E1-E1
ccaacccttcgagtaaggctaaaatgaaccaaattgtaacaaacaaaacggtaaaaatccttaaggaaattcaattaccaacaaattcaaggttataaccggtaaaaggaccccaaggtatcctaaaaaattcctccaaaaatctaaccctgaaaatccaaatgatcaacccaagttactgaaatagaaaatggtccgtacaagaaagaattagctgctgtcagaacagtatgctctcatgttgaaaacatgtttaaagggtgttacaaaaggattacaatacaagatgagagcagcatatgcccacttttccattaactgtgtcaccactgaaggaaacacagttatcgaaattagaaatttcttgggagaaaaatacatcagaag

SEQ ID NO: 1530 - DNA, 429 bp, Diabrotica virgifera
  Clone ID: LIB3026-026-Q1-E1-C9
gacccaagacgtcagatatattttgacgtccccggaaagggtgaagcaattagaatgatcttaagctatggagaaattccatttgaggacaaacgcatccagatgggggattggccaaaacttaaaccaactacccctcttggacaacttcccttgttagaggtagatggtaaagcaatccctcaaagtactgcaatctgcaggtacttggcatcaatagtaaaactcgatggcaaagatgcaagagaaaatcttgcactagatgttgcactagaaactctttttgatttacaaaaaatgaacggcgaaataaagtatgaacaagacgccgctaaaaaaaaggaaaaacttgaaaaattattaaaacaaggattacctctgtattttggaaaactagacgaatatgctaaaaaacacaatggttacata

SEQ ID NO: 1531 - DNA, 411 bp, Diabrotica virgifera
  unsure (1)..(411): unsure at all n locations
  Clone ID: LIB3026-034-Q1-E1-B4
gcggtagttttttgaacaaattcggggacaaatttagttttctaaaatggcacatacatataaacttatatattttgacgtccccggaaagggtgaagcaattagaatgatcttaagctatggagaaattccatttgaggacaaacgcatccagatgggggattggccaaaacttaaaccaactacccctcttggacaacttcccttgttagaggtcgatggtaaagcaatccctcaaagtactgcaatctgcaggtacttggcatcaatagtaaaactagatggcaaagatgcanaagaaaatcttgctctagatgttgcactagaaactctttttgatttacaaaaaatgaacggcgaaataaagtatgaacaagacgccgctaaaaaaaaggaaaaacttgaaaaatt

SEQ ID NO: 1532 - DNA, 391 bp, Diabrotica virgifera
  Clone ID: LIB149-037-Q1-E1-C11
aagcgagtggttttttgaacaaatttactattctaaaatggcacatacatataaacttatatattttgacggccccggaaaggctgaagcaattagaatgatcttaagctatggagaaattccatttgaggacaaacgtatccagattggggattggccaaaacttaaaccaactacccctcttggacaacttcccttgttagaggtcgatggtaaagcaatccctcaaagtactgcaatctgcaggtacttggcatcaatagtaaaactcgatggcaaagatgcaaaagaaagtcttgcactagatgttgcagtagaaactctttttgatgtacaaaaactgagctccgaagtaagttatgaacaggacgccgctaagaaaaaagaaaaa

SEQ ID NO: 1533 - DNA, 401 bp, Diabrotica virgifera
  Clone ID: LIB3026-028-Q1-E1-G2
acggacgcgtggggctgcggtagttttttgaacaaattcggggacaaatttagttttctaaaatggcacatacatataaacttatatattttgacgtccccggaaagggtgaagcaattagaatgatcttaagctatggagaaattccatttgaggacaaacgcatccagatgggggattggccaaaacttaaaccaactacccctcttggacaacttcccttgttagaggtcgatggtaaagcaatccctcaaagtactgcaatctgcaggtacttggcatcaatagtaaaactagatggcaaagatgcaaaagaaaatcttgctctagatgttgcactagaaactctttttgatttacaaaaaatgaacggcgaaataaagtatgaacaagacgccgct

SEQ ID NO: 1534 - DNA, 417 bp, Diabrotica virgifera
  Clone ID: LIB149-033-Q1-E1-G8
aacaaattcggggacaaatttagttttctaaaatggcacatacatataaacttatatattttgacgtccccggaaagggtgaagcaattagaatgatcttaagctatggagaaattccatttgaggacaaacgcatccagatgggggattggccaaaacttaaaccaactacccctcttggacaacttcccttgttagaggtcgatggtaaagcaatccctcaaagtactgcaatctgcaggtacttggcatcaatagtaaaactagatggcaaagatgcaaaagaaaatcttgctctagatgttgcactagaaactctttttgatttacaaaaaatgaacggcgaaataaagtatgaacaagacgccgctaaaaaaaaggaaaaacttgaaaaattattacaacaaggattacctc

SEQ ID NO: 1535 - DNA, 426 bp, Diabrotica virgifera
  unsure (1)..(426): unsure at all n locations
  Clone ID: LIB149-006-Q1-E1-F3
acttatttattagatgtcaaaaaaaataaaacaaggtaagatattaatttatatgatgccaatcttgttggcaacatctagagcatcataatctctagctaaccttacatatgccttctttttgccatcgggcctaattaaggtgttgaccttggctacattgatatcatacaatttcttaactgcagctttaatgtggtgcttgtttgccctagtgtgtactaaaaataccaacgtgttgttatcttcaatcttcttcatggctgcttcggtggtcaatgggaatttgatgatattgtaagcatccatgcgggatctgtggggaacactcctcttggggtatttgggactcctgngtggtctgagggtcttangacgacggnagtggactgagttaccgattttccctgagtgtgttccaatggg

SEQ ID NO: 1536 - DNA, 426 bp, Diabrotica virgifera
  Clone ID: LIB3026-004-Q1-E1-F1
gtcgtcctaagaccctcagaccacccaggagtcccaaataccccaagaggagtgttccccacagatcccgcatggatgcttacaatatcatcaaattcccattgaccaccgaagcagccatgaagaagattgaagataacaacacgttggtatttttagtacacactagggcaaacaagcaccacattaaagctgcagttaagaaattgtatgatatcaatgtagccaaggtcaacaccttaattaggcccgatggcaaaaagaaggcatatgtaaggttagctagagattatgatgctccagatgttgccaacaggattggaatctcttaaattaatatcttaccttgttttattttttttgacatctaatacataagttgagaataaagttttttagtttgagtttaaaaaaacaccccaaaca

SEQ ID NO: 1537 - DNA, 379 bp, Diabrotica virgifera
  Clone ID: LIB3026-001-Q1-E1-H7
aggacgcgtggggctgccagtgcagtgcaagtagcgagagcacttaaaatccagaagaaagtaattaaaggccccaatggaacacactcaaggaaaatccgtaactcagtccacttccgtcgtcctaagaccctcagaccacccaggagtcccaaataccccaagaggagtgttccccacagttcccgcatggatgcttacaatatcatcaaattcccattgaccaccgaagcagccatgaggaaaattgaggataccaccacgttggaatttttattacacactagggcaaacaagcaccacattaaacctgcagttaaaaaattgtatgaaatcaatgtacccaaggtcaacaccttatttaggcccgatggcaaaa

SEQ ID NO: 1538 - DNA, 424 bp, Diabrotica virgifera
  Clone ID: LIB3026-035-Q1-E1-D10
cccacgcgtccgcaaggctcctgcaactcttattgctaagcccaagaagaatgttcccgttaaacaacaacagaaaggtgttggtaaaaagccagctgccagtgcagtgcaagtagcgagagcacttaaaatccaaaagaaagtaattaaaggccccaatggaacacactcaaggaaaatccgtaactcagtccacttccgtcgtcctaagaccctcagaccacccaggagtcccaaataccccaagaggagtgttccccacagatcccgcatggatgcttacaatatcatcaaattcccattgaccaccgaagcagccatgaagaagattgaagataacaacacattggtatttttagtacacactagggcaaacaagcaccacattaaagctgcagttaagaaattgtatgatatcaatgta

SEQ ID NO: 1539 - DNA, 428 bp, Diabrotica virgifera
  Clone ID: LIB150-024-Q1-E1-C8
aacgctgctgctaaagctggaaaggctgcaggcaaaggtgctgccaaacccgcagccaaggctgcaggaaagaaaccagctgctgctggaaaggccaaggctcccgcaactcttattgctaagcccaagaagaatgttcctgttaaacaacaacagaaaggtgttggcaaaaagccagctgccagtgcagtgcaagtagcgagagcacttaaaatccaaaagaaagtaattaaaggccccaatggaacacactcaaggaaaatccgtaactcagtccacttccgtcgtcctaagaccctcagaccacccaggagtcccaaataccccaagaggagtgttccccacagatcccgcatggatgcttacaatatcatcaaattcccattgaccaccgaagcagccatgaagaagattgaagataacaacac

SEQ ID NO: 1540 - DNA, 400 bp, Diabrotica virgifera
  unsure (1)..(400): unsure at all n locations
  Clone ID: LIB149-037-Q1-E1-H11
acccacgcgtccgcccacgcgtccgcccacgcgtccgttttatagtaaagccagcatggcaccaaggtacgagatcgcagtcggcctccaaaggggtcacaaaaccaccaaaatctcagacaaatccaaactgaataaagttcgtcccgctaggttgaaggggatccaaaccaaacacaccaaatttgtcagagacatcatccgtgaagtcgtaggacatgctccatatgaaaagagagccatggaattgttaaaggtgtcaaaggataagagggccctgaaattcctgaagcgtcgtcttggcacacacatcagagccaagaggaagcgtgaagaactatccaacatccttacccanatgcgtaaacaacaagctacacatanatagattgtattttgt

SEQ ID NO: 1541 - DNA, 376 bp, Diabrotica virgifera
  Clone ID: LIB3026-029-Q1-E1-B8
acatggcaacacgagaatcacgttgtgaatttttatagtaaagccagcatggcaccaaggtacgagatcgcagtcggcctccaaaggggtcacaaaaccaccaaaatctcagacaaatccaaactgaataaagttcgtcccgctaggttgaaggggatccaaaccaaacacaccaaatttgtcagagacatcatccgtgaagtcgtaggacatgctccatatgaaaagagagccatggaattgttaaaggtgtcaaaggataacacggccctgaaattcctgaagcgtcgtcttggcacacacatcacagccacgaggaagcgtgaacaactatccaacatccttacccaaatgcgtaaacaacaagctacacatc

SEQ ID NO: 1542 - DNA, 386 bp, Diabrotica virgifera
  Clone ID: LIB150-042-Q1-E1-A5
gtccgcccacgcgtccgcccacgcgtccgcccacgcgtccggtgaattcttggcaacacgagaatcacgttgtgaatttttatagtaaagccagcatggcaccaaggtacgagatcgcagtcggcctccaaaggggtcacaaaaccaccaaaatctcagacaaatccaaactgaataaagttcgtcccgctacgttgaaggggatccaagccaaacacaccaaatttgtcagagacatcatccgtgaagtcgtaggacatgctccatatgaaaagagagccatggaattgttaaaggtgtcaaaggataagagggccctgaaattcctgaagcgtcgtcttggcacacacatcagagccaagaggaagcgtgaagaactatcccac

SEQ ID NO: 1543 - DNA, 217 bp, Diabrotica virgifera
  Clone ID: pGUT2091
gtgaagtcgtaggacatgctccatatgaaaagagagccatggaattgttgaaggtgtcaaaggataagagggccctgaaattcctgaagcgtcgtcttggcacacacatcagagccaagaggaagcgtgaagaactatccaacatccttacccaaatgcgtaaacaacaagctacacataaatagattgtattttggttaattaataggaaactagt

SEQ ID NO: 1544 - DNA, 199 bp, Diabrotica virgifera
  unsure (1)..(199): unsure at all n locations
  Clone ID: pGUT916
aatttttatagtaaagccagcatggcaccaaagtacgagatcgcagtcggcctccaaaggggtcacaaaaccaccaaaatctcagacaaatccaaactgaataaagttcgtcccgctaggttgaaagggatccaaaccaaacacaccaaatttgtcagagacatcatccgtgaagtcgtangacatgctccatatgaaa

SEQ ID NO: 1545 - DNA, 409 bp, Diabrotica virgifera
  Clone ID: LIB3026-034-Q1-E1-E8
cccacgcgtccgaactgctctaattgcaccaattttattagtgagtagaaccgtgtgtgcagtgattttttaaatttacaacaatatgagctggcaggattacgtagacaaacagctcttggcttcaaaatgcgttacgaaagcggcaatcgctggccacgacggaaacgtttgggctaaatcagaaaatttcgatgtatcaaaagaagaactagcaaaattagttcagggcttcgaaaaacaagacattctcacatcctcaggcgtaacattagccggtaacagatacatatacctctctggcacagaccgtgtaattagggcgaaattgggcaaagttggtgtacattgcatgaaaacgacacaagctgttgtagtatccctttatgaagatcaatccaacctcaac

SEQ ID NO: 1546 - DNA, 439 bp, Diabrotica virgifera
  Clone ID: LIB150-010-Q1-E1-E10
aagtattcggcttcagttcgtcgtgcggcaactgctctaattgcaccaattttattagtgagtagaaccgtgtgtgcagtgattttttaaatttacaacaatatgagctggcaggattacgtagacaaacagctcttggcttcaaaatgcgttacgaaagcggcaatcgctggccacgacggaaacgtttgggctaaatcagaaaatttcgatgtatcaaaagaagaactagcaaaattagttcagggcttcgaaaaacaagacattctcacatcctcaggcgtaacattagccggtaacagatacatatacctctctggcacagaccgtgtaattagggcgaaattgggcaaagttggtgtacattgcatgaaaacgacacaagccggtggtagaacccctttatgaggatccaatcgaacctcagcaagcagcgtca

SEQ ID NO: 1547 - DNA, 462 bp, Diabrotica virgifera
  Clone ID: LIB150-010-Q1-E2-E10
aaatattcggcttcagttcgtctgcgggaactgctccaattgcaccaattttaataatgagtagaaccgtgtgtgcagtgattttttaaatttacaacaatatgagctggcaggattacgtagacaaacagctcttggcttcaaaatgcgttacgaaagcggcaatcgctggccacgacggaaacgtttgggctaaatcagaaaatttcgatgtatcaaaaggaagaactagcaaaattagttcagggcttcgaaaaacaagacattctcacatcctcaggcgtaacattagccggtaacagatacatatacctctctggcacagaccgtgtaattagggcgaaattgggcaaagttggtgtacattgcatgaaaacgacacaagctgttgtagtatccctttatgaagatccaatccaacctcagcaagcagcgtcagtggtagaaaagctaggtgattac

SEQ ID NO: 1548 - DNA, 336 bp, Diabrotica virgifera
  unsure (1)..(336): unsure at all n locations
  Clone ID: LIB150-014-Q1-E1-G6
cacacgcgtccgaaaagtattcggcttcagttcgtcgtgcggcaactgctctaattgcaccaattttattagtgagtagaaccgtgtgtgcagtgattttttaaatttacaacaatatgagctggcaggattacgtagacaaacagctcttggcttcaaaatgcgttacgaaagcggcaatcgctggccacgacggaaacgtttgggctaaatcagaaaatttcgatgtatcaaaagaagaactagcanaattagttcaggggctccaaaaacaagaacatcctcaaatcttcaggcgtaacattacccggtaacagatacatatacctcccggga

SEQ ID NO: 1549 - DNA, 397 bp, Diabrotica virgifera
  Clone ID: LIB150-032-Q1-E1-G1
gacaaagttggtgtacattgcatgaaaacgacacaagctgttgtagtatccctttatgaagatccaatccaacctcagcaagcagcgtcagtggtagaaaagctaggtgattacttaattacctgcggttactatagatagtgtgtgccgctgtaagcagccatgccgtgcggcgaaaaattaattattattaaatttgtatttttttcaacataacagcgaaccggcaatgcgtataccgagtgcatcatcattaataaatacatggaaaaaagtcatataatcggacaatagtgtactttccatttttatcaaacaaacaacataggatatatattatatatcggtcaaaatcattaattttttcatcgttgtccatcgtgtggttccagttatg

SEQ ID NO: 1550 - DNA, 417 bp, Diabrotica virgifera
  Clone ID: LIB149-049-Q1-E1-A12
aaccacgagtccgcccacgcgtccggattcaaataaaaatcataaatcattcagttttttgtgaagacatttgggaagaagttcagtacagtttaacagtcctttagaaataatttaccatggctaaacaatcatacaaagttgccgacatgagcttggccgaatggggccgcaaagaaatcactttggccgaaaatgaaatgcccggcctgatgagtctacgagcgaaatacaaggacaacaaaattttgaagggggccaaaatagctggatgtcttcacatgactgtacaaacagcagtattaattgaaaccctcgcagatcttggggctgaggtacaatggtccagttgcaacatcttcagtactcaagatcacgccgctgcagcaattgccaaaaggggaattccagtatatg

SEQ ID NO: 1551 - DNA, 396 bp, Diabrotica virgifera
  Clone ID: LIB150-009-Q1-E1-E1
cggatacccggtagagacggtgacggtagagcgaggattcaaataaaaatcataaatcattcagttttttgtgaagacatttgggaagaagttcagtacagtttaacagtcctttagaaataatttaccatggctaaacaatcatacaaagttgccgacatgagcttggccgaatggggccgcaaagaaatcactttggccgaaaatgaaatgcccggcctgatgagtctacgagcgaaatacaaggacaacaaaattttgaagggggccaaaatagctggatgtcttcacatgactgtacaaacagcagtattaattgaaaccctcgcagatcttggggctgaggtacaatggtccagttgcaacatcttcagtactcaagatcacgccgctgca

SEQ ID NO: 1552 - DNA, 388 bp, Diabrotica virgifera
  Clone ID: LIB150-025-Q1-E1-G3
gagtcgtattatacccggtagagacggtgacggtagagcgaggattcaaataaaaatcataaatcattcagttttttgtgaagacatttgggaagaagttcagtacagtttaacagtcctttagaaataatttaccatggctaaacaatcatacaaagttgccgacatgagcttggccgaatggggccgcaaagaaatcactttggccgaaaatgaaatgcccggcctgatgagtctacgagcgaaatacaaggacaacaaaattttgaagggggccaaaatagctggatgtcttcacatgactgtacaaacagcagtattaattgaaaccctcgcagatcttggggctgacgtacaatggtccaattgcaacatcttcaatactcaa

SEQ ID NO: 1553 - DNA, 248 bp, Diabrotica virgifera
  Clone ID: pGUT1592
gacatgtccaccccgtatgatctccttacatccagttgtagtaacttttatttgggcttctttggatgcttcttccatcttggtagattcataaccttccatatctgcgttgctaccatcgatatggtctctttctgtgatcaatactcgtccaccacatgctcttggtgattgtgcataatctttgcccacatctccgtatctctctacgatactgaccttaccatcgagcattacatctgtcgctc

SEQ ID NO: 1554 - DNA, 332 bp, Diabrotica virgifera
  unsure (1)..(332): unsure at all n locations
  Clone ID: LIB150-021-Q1-E1-A3
tgacggtaaaccgaggattcaaataaaaatcataaaccattcattttttggtaaaaacatttggaaagaaatttcattacaagttaaaaagtccctttaganataatttacaagggctaaacaatcatacaaagttgccgacatgagcttggccgaatggggccgcaaagaaatcactttggccganaatgaaatgcccggcctgatgagtctacgagcganatacaaggacaacanaattttgaacggggccaaaatagctggatgtcttcacatgactgtacanacagcagtattaattggaaacctcgcagatcttggggctgaggtac

SEQ ID NO: 1555 - DNA, 425 bp, Diabrotica virgifera
  Clone ID: LIB3026-012-Q1-E1-G5
gttttagtgaaaaagccatcctaatcgatggcagaggccatttattgggccgtttagcggctatcgtgtccaaagcactcctagaaggtaacaaagtcacagtagtaagatgtgaacagttaaatatctccggaaatttttacagaaataaattgaagtttatgtcattcctccgaaagaggtgtaatgttaacccagctaggggaccattccacttcagagctccctcaaggatcttctggaaaactgtaagaggaatgttaccacacaaatcagaaaggggaaagcaagctcttcgtagactaaaggcatataagggtatccctcccccatatgatcgcaggaagcgtgttgttgtgcctggtgcacttagagtaatttgccttaaaccaggccgtaaattctgtcaggtaggccgtctttca

SEQ ID NO: 1556 - DNA, 418 bp, Diabrotica virgifera
  Clone ID: LIB3026-006-Q1-E1-H7
agcatgacaggttttagtgaaaaagccatcctaatcgatggcagaggccatttattgggccgtttagcggctatcgtgtccaaagcactcctagaaggtaacaaagtcacagtagtaagatgtgaacagttaaatatctccggaaatttttacagaaataaattgaagtttatgtcattcctccgaaagaggtgtaatgttaacccagctaggggaccattccacttcagagctccctcaaggatcttctggaaaactgtaagaggaatgttaccacacaaatcagaaaggggaaagcaagctcttcgtagactaaaggcatatgaaggtatccctcccccatatgatcgcaggaagcgtgttgttgtgcctggtgcacttagagtaatttgccttaaaccaggccgtaaattctgtc

SEQ ID NO: 1557 - DNA, 419 bp, Diabrotica virgifera
  Clone ID: LIB3026-026-Q1-E1-C7
actttttcggtttcagtggaagcatgacaggttttagtgaaaaagccatcctaatcgatggcagaggccatttattgggccgtttagcggctatcgtgtccaaagcactcctagaaggtaacaaagtcacagtagtaagatgtgaacagttaaatatctccggaaatttttacagaaataaattgaagtttatgtcattcctccgaaagaggtgtaatgttaacccagctaggggaccattccacttcagagctccctcaaggatcttctggaaaactgtaagaggaatgttgccacacaaatcataaaggggaaagcaagctcttcgtagactaaaggcatacgaaggtatccctcccccatatgatcgcaggaagcgtgttgttgtgcctggtgcacttagagtaatttgccttaaa

SEQ ID NO: 1558 - DNA, 399 bp, Diabrotica virgifera
  Clone ID: LIB3026-010-Q1-E1-F4
ggaagcatgacaggttttagtgaaaaagccatcctaatcgatggcagaggccatttattgggccgtttagcggctatcgtgtccaaagcactcctagaaggtaacaaagtcacagtagtaagatgtgaacagttaaatatctccggaaatttttacagaaataaattgaagtttatgtcattcctccgaaagaggtgtaatgttaacccagctaggggaccattccacttcagagctccctcaaggatcttctggaaaactgtaagaggaatgttaccacacaaatcagaaaggggaaagcaagctcttcgtagactaaaggcatatgaaggtatccctcccccatatgatcgcaggaagcgtgttgttgtgcctggtgcacttagagtaaattgcctt

SEQ ID NO: 1559 - DNA, 363 bp, Diabrotica virgifera
  Clone ID: LIB3026-030-Q1-E1-B7
gacaggttttagtgaaaaagccatcctaatcgatggcagaggccatttattgggccgtttagcggctatcgtgtccaaagcactcctagaaggtaacaaagtcacagtagtaagatgtgaacagttaaatatctccggaaatttttacagaaataaattgaagtttatgtcattcctccgaaagaggtgtaatgttaacccagctaggggaccattccacttcagagctccctcaaggatcttctggaaaactgtaagaggaatgttaccacacaaatcagaaaggggaaagcaagctcttcgtagactaaaggcatatgaaggtatccctcccccatatgatcgcaggaagcgtgttgttgt

SEQ ID NO: 1560 - DNA, 411 bp, Diabrotica virgifera
  Clone ID: LIB150-028-Q1-E1-H7
gtcgctgagcgtcgagtccatacacttactcagagtcgctgtaccaccaaaccaaaaaaccataaatcatgtgtgacgacgatgtagcggctcttgtcgtcgacaatggctccggaatgtgcaaagccggtttcgccggtgatgacgcacctcgtgctgtctttccatccatcgtaggtcgtcccagacaccaaggtgtcatggtgggtatgggtcaaaaagactcctacgtaggagacgaagcccaaagcaaaagaggtatcctcaccttaaaataccccattgaacacggaattatcactaactgggacgatatggaaaagatctggcatcacaccttctacaatgaacttagagtagcccccgaagaacatcccattcttttgactgaagctccaatttaaccaaaag

SEQ ID NO: 1561 - DNA, 364 bp, Diabrotica virgifera
  Clone ID: LIB3026-023-Q1-E1-E6
ttgtccgtaacaaaaaagaaaaactctgctatgtcgccctcgacttcgaacaggaaatggccaccgctgctgcttccacctccctcgaaaagagctacgaattgcctgatggacaagtcatcaccattggtaacgaaagattccgttgcccagaagccctcttccaaccttccttcttgggtatggaatcttgcggtatccacgaaaccgtatacaactccatcatgaagtgcgacgttgatatccgtaaggacttgtacgccaacactgttctctccggaggtaccaccatgtacccaggtattgccgacagaatgcaacaggaaatcaccgcccttgctccatccaccatcaagatcaagat

SEQ ID NO: 1562 - DNA, 371 bp, Diabrotica virgifera
  Clone ID: LIB150-003-Q1-E1-E9
gtcgctgagcgtcgagtccatacacttactcagagtcgctgtaccaccaaaccaaaaaaccataaatcatgtgtgacgacgatgtagcggctcttgtcgtcgacaatggctccggaatgtgcaaagccggtttcgccggtgatgacgcacctcgtgctgtctttccatccatcgtaggtcgtcccagacaccaaggtgtcatggtgggtatgggtcaaaaagactcctacgtaggagacgaagcccaaagcaaaagaggtatcctcaccttaaaataccccattgaacacggaattatcactaactgggacgatatggaaaagatctggcatcacaccttctacaatgaacttagagtagcccccgaagaa

SEQ ID NO: 1563 - DNA, 410 bp, Diabrotica virgifera
  Clone ID: LIB150-024-Q1-E1-A11
ctgctaatgacgatcgtatgcaaaaggaaatcactgccttggctccatcaaccatcaaaatcaagatcatcgctcccccagaaagaaagtactccgtttggatcggtggctccatcttggcctccctctccaccttccaacagatgtggatctccaaacaagaatacgacgaatccggccctggaattgttcaccgcaaatgcttctaaactactttatatttatcgtatacatattaagtacaatactgagagttggagcatgaatgtatgtttttatttatggttatatatatgatgacttgttgatattgtaacaataaattcattttgtattactctggtaatattttatttatgagaacaaccagattgaagtcgtaaagagccaataacaacctgaagatatca

SEQ ID NO: 1564 - DNA, 149 bp, Diabrotica virgifera
  Clone ID: LIB150-001-Q1-E1-H3
tttactgtctagtgagcagtgatcaaccacaaaagacaacatgtgtgacgacgatgttgcggctcttgtcgttgacaatggatccggtatgtgcaaacctggattcgccggaaatgacgcaccccttgccgtcttcccctcaaccgtcg

SEQ ID NO: 1565 - DNA, 422 bp, Diabrotica virgifera
  Clone ID: LIB3026-010-Q1-E1-B11
ctcgttaacagagttttcattgctaatcttgaatacaatgttgacgagaaaaagttgcgagatgcctttaaattggcaggtagaatagtaaatattgatcttcctcttgacaaagatggtcgtattaaaggttttgctgtcattgagtatgatcaccctgtcgaggctgtacaggccatttcgatgttcaatcatcaatctttctttgatcgtacattggcagtgagaatggatagggcaaatgataatatcaagttgcccgagggtttaaggtcgatcggaatgggtctaaggcccaatggagagcctttgaagtgtgtcgctcataatcttaataatcagtctaattcgtcaactaatggacttttgggagcagttccgaatagtactttgcaacaattgagtaatttgacaggtttgag

SEQ ID NO: 1566 - DNA, 454 bp, Diabrotica virgifera
  unsure (1)..(454): unsure at all n locations
  Clone ID: LIB150-030-Q1-E1-D4
tccggccaagcgtccgcccaagcgtccgtgttagtaaccaacgaagtggtgaaagaagagagtacaatcgtttcaatgataacatgaacagcatgaataatgaattgggcaataccttgaatcctgggaaataaaaattggggcacaacttagggatgaatccaaaatttccttgatccttggaaaaccattccccccctaaataataaggtgtttgtggccaattttggatacaacattgatangacaaaaataaaagatgtctttaaactancaggtanagtcatcaatgttgacatgcctctagataaggatggcaaagttcgaggtttcgccgttgttgagtatgatcaccctgtagaagcagttcaagctatctctatgttgcaaggccaagttttgaatgatagaacattggccgtacgtatggatagagtcaacgataactccaaat

SEQ ID NO: 1567 - DNA, 373 bp, Diabrotica virgifera
  Clone ID: LIB150-046-Q1-E1-C12
acaacactctatagtgagtcgtattaaatgagtccatagtttcttgattctttgaaaatctatccccctcttaataataaggtgtttgtggccattttggattacaacattgataagaaaaaaataaaagatgtctttaaactaccatgtatagtcagcaatgttgacatgcctctagataatgatggcaaacttcgaggtttcgccgttgttgagtatgatcaccctgtataagcagttcaggcaatctctatgttgcacggccaagttttgactgatataacattggccgtacgtatggatagagtcatcgataactctaaattaccagtacgattaagatctgtggtcaagggtcagagacctaatgggg

SEQ ID NO: 1568 - DNA, 424 bp, Diabrotica virgifera
  Clone ID: LIB150-045-Q1-E1-H3
ggtccacacaagcctctaaaatgcgtccgcaccacgcgtccggttgagtatgatcaccctgtagaagcagttcaggctatctctatgttgcaaggccaagttttgaatgatagaacattggccgtacgtatggatagagtcaacgataactccaaattaccagaaggattaagatctgtgggcatgggtctgggacctaatggggaagcgttgaaaaacgtggctcacaatttaccttcgttgggtagcggctcacaaggtgggacaactggttctgggcttttgggggctgtacctaatagttctttacagttggccaatgctctctcaggccttggcaatgttggtaacttaacaggtttgaaccaaaatttttccgggctagccagcactttgttgggaaacggattgggggctactgaac

SEQ ID NO: 1569 - DNA, 413 bp, Diabrotica virgifera
  Clone ID: LIB150-044-Q1-E1-E1
accaagcgtccggtttccttcgtggagctattttacgatgaatcaaacaaatccaaaggaaccggtatcgttgaattcgctgataaaggttctgttgacaaatgtatggagaagatgcagcgatatgaagttaatggtagaaagttagttgttagggatgactcaggcgttactaaggacagaactggagctatactatctggaacttccagaagacctccagcagagaggaacttcggtggtggcggaggcggaaatagcttcaacaacagcatctccttcagcagtaataatgatggaaactggggcaacacctatggtttgagtcctcagttcttggaatcgttgaaaattgaccctccactcgttaacagagttttcattgctaatcttgaatacaatgttgacgagaa

SEQ ID NO: 1570 - DNA, 390 bp, Diabrotica virgifera
  Clone ID: LIB150-024-Q1-E1-A5
ctaaagactgaccagtagcaatggctgccggtttcaagatatttttgctcgtgctcttctcgtacgtctgttatacacatgccaatcctaaggtggtttgctactatgacgaaaaaggcaactcccggcaagggcaatgcaagttcgatgttgcctttttggaaccagctttacaattctgcacacacttaatttatgggtacgcaggtattgacccaaatacttacaaaataaagctgatgaatgaacagctagaccttaaccaacacaacttcagacaagttactgatcttaagaggaaattccctggtcttagggttttcctttcggtcggtggtgacatagatgttagtggagaagatactgaaaagaatatggtttacaggaatg

SEQ ID NO: 1571 - DNA, 415 bp, Diabrotica virgifera
  Clone ID: LIB150-003-Q1-E2-G9
atgacaagtagcaatggctgccggtttcaagatatttttgcttgtgctcttctcgtacgtctgttatacacaggcgaatcctaaggtggtttgctactatgacgaaaaaggcaactcccggcaagggcaaggcaagttcgatgttgcctttttggaaccagctttacaattctgcacacacttaatttatgggtacgcaggtattgacccaaatacttacaatataaagctaatgaatgaacagctagaccttaaccaacacaacttcagacaagttactgatcttaagaggaaattccctggtcctaaggttttcctttcgggtggtggtgacagacatcttaatgtggaagattctggaacaaatatggattacatgaatgtgttagaagcagtagaccgtagattaactttc

SEQ ID NO: 1572 - DNA, 379 bp, Diabrotica virgifera
  unsure (1)..(379): unsure at all n locations
  Clone ID: LIB150-005-Q1-E2-D1
aagtagcaatggctgccggtttcaagatatttttgcttgtgctcttctcgtacgtctgttatacacaggcgaatccaaggtggtttgctactatgacgaaaaaggcaactcccggcaaaggcaaggcaagttcgatgttgcctttttggaaccagctttacaattctgcacacacttaatttatgggtacgcacgtattgacccaaatacttacaanataaagctaatgaatgaacagctagaccttaaccaacacaacttcagacaagttactgatcttaagaggaaattccctggtcttaaggttttcctttcggttggtggtgacagagatgttagtggagaagatactganaagaatatggtttacaggaatgtg

SEQ ID NO: 1573 - DNA, 320 bp, Diabrotica virgifera
  Clone ID: LIB150-003-Q1-E1-G9
atgaccagtagcaatggctgccggtttcaagatatttttgcttgtgctcttctcgtacgtctgttatacacaggcgaatcctaaggtggtttgctactatgacgaaaaaggcaactcccggcaagggcaaggcaagttcgatgttgcctttttggaaccagctttacaattctgcacacacttaatttatgggtacgcaggtattgacccaaatacttacaaaataaagctaatgaatgaacagctagaccttaaccaacacaacttcagacaagttactgatcttaagaggaaattccctggtcttagggttttccttt

SEQ ID NO: 1574 - DNA, 301 bp, Diabrotica virgifera
  Clone ID: LIB150-012-Q1-E1-H1
cccacgcgtccgaagaacttagaggcgatgggttcgttaactttatcagtgatctttttatcgttagcggctttttcggtcgctgaaaatattgttgtgtgtaactacgagtcaaaagcccatttaagagatggagaaggaaaattcgatgtttctaatttaaacgaagctttgcgctattgcacccatttattatatggctacgctgcaattgacgacaacacatacaagttagttccaatgaatgaacaatatgatgtgattaaagaaaattataaacatataaccgatttgaagaaga

SEQ ID NO: 1575 - DNA, 442 bp, Diabrotica virgifera
  unsure (1)..(442): unsure at all n locations
  Clone ID: LIB3026-020-Q1-E1-F9
gcacgcgtccaatttttgagccgtcaacatgggtaagccccgtggattgagaaccgctaggaaacatgtgaatcaccgtcgtgaacaaagatgggctgataaagattacaaaaaggcacatttaggaactagatggaaggctaatccttttggaggtgcttctcatgctaaaggaattgtattggaaaaagtgggagttgaagcaaaacaacctaactctgctattcgcaagtgcgttagggtacagttaattaaaaatggtaaaaaaatcacagccttcgtacctagagatggttgcttaaaccatatagaagaaaacgatgaagttctagttgcaggttttggacgtaaaggtcatgctgtangagatattcccggagttagatttaaggttgttaaggtcgctaatgtgtccctattagctttatacaaagaaaagaag

SEQ ID NO: 1576 - DNA, 420 bp, Diabrotica virgifera
  unsure (1)..(420): unsure at all n locations
  Clone ID: LIB150-014-Q1-E1-D12
gattttgagccgtcaacatgggtaagccccgtggattgagaaccgctaggaaacatgtgaatcaccgtcgtgaacaaagatgggctgataaagattacaaaaaggcacatttaggaactagatggaaggctaatccttttggaggtgcttctcatgctaaaggaattgtattggaaaaagtgggagttgaagcaaaacaacctaactctgctattcgcaagtgcgttagggtacagttaattaaaaatggtaaaaaaatcacaaccttcctaactagaaaatgttgcttaaaccatatagaagaaaacgatgaagttctagttgcaggttttggacgtaaaggtcatgctgtangagatattctccggagttagatttaaggttgttaaggtcgctaatgtgtccctattagctttatac

SEQ ID NO: 1577 - DNA, 400 bp, Diabrotica virgifera
  Clone ID: LIB3026-032-Q1-E1-A9
gaaggctaatccttttggaggtgcttctcatgctaaaggaattgtattggaaaaagtgggagttgaagcaaaacaacctaactctgctattcgcaagtgcgttagggtacagttaattaaaaatggtaaaaaaatcacagccttcgtacctagagatggttgcttaaaccatatacaagaaaacgatgaagttctagttgcatgttttggacgtaaaggtcatgctgtaggagatattcccggagttagatttaaggttgttaaggtcgctaatgtgtccctattagctttatacagagaaaagaaggaaaggccaagatcagaattaaactgttatttttcttatttatctgcttcggacttttaagttttaaataaagtgttaggcatattcgtttgt

SEQ ID NO: 1578 - DNA, 207 bp, Diabrotica virgifera
  Clone ID: pGUT3411
ggagatattcccggagttagatttaaggttgttaaggtcgctaatgtgtccctattagctttatacaaagaaaagaaggaaaggccaagatcataattaaaatgttattttttttatttatttgcttggcacttttaatttttaaataaagtgttaagcatataattttgtacagtgttttatttcaataaacaattttatacctgt

SEQ ID NO: 1579 - DNA, 144 bp, Diabrotica virgifera
  Clone ID: pGUT1762
ctagatggaaggctaatccttttggaggtgcttctcatgctaaaggaattgtattggaaaagtgggagttgaagcaaaacaacctaactctgctattcgcaagtgcgttagggtacagttaattaaaaatggtaaaaaaatcac

SEQ ID NO: 1580 - DNA, 416 bp, Diabrotica virgifera
  Clone ID: LIB149-023-Q1-E1-D4
acgttaatcaatttgccgattggtccaacgctgaatttaaagctatgttagactctcaaatggctcagaggccaaaactattggttgctgaaacattcgaagccgattctaatttacaagttccaacagaggttgattggaggaataaaaaggctgatttgggagttaggaaccagggaagctgtggatcctgctgggctttcagtgccgtcggagccatcgaaggtcaacttgctattcacaaaaagcaacacgttcaactaagtgaacaagaattggtagattgtgacacagtaaacgagggatgcaatggaggtttaatgacagatgcctttaactacgttaagcgccatggtctagcaccagaaagtaaatataaatacacaggtaaacgtggcagttgcaagaaggtacac

SEQ ID NO: 1581 - DNA, 379 bp, Diabrotica virgifera
  unsure (1)..(379): unsure at all n locations
  Clone ID: LIB149-010-Q1-E1-E7
atagactctcaaatggctcagaggccaaaactattggttgctgaaacattcgaagccgattctaatttacaagttccaacagaggttgattggaggaataaaaaggctgatttgggagttaggaaccagggaagctgtggatcctgctgggctttcagtgccgtcggagccatcgaaggtcaacttgctattcacaaaaagcaacacgttcaactaagtgaacaagaattggtagattgtgacacagtaaacgagggatgcaatggaggtttaatgacagatgcctttaactacgttaagcgccatggtctagcaccagaaagtaaatataaatacacaggtaaacgtggcagttgcaagaaggtacacanacaagtct

SEQ ID NO: 1582 - DNA, 267 bp, Diabrotica virgifera
  Clone ID: LIB3026-029-Q1-E1-A1
gttgattggagagatagtgccgttttgggagtcaaagatcaaggacagtgtggatcatgctgggctttcagtaccaccggatccctcgaaggtcaactcgccatccacaaaaatcaacgtgttcctctcagtgaacaagaattggtagactgtgacacatcaagaaatgctggttgtaacggaggtttgatgacagatgcctttaactatgttaaacgccatggtctctcttccgaatctcaatatgcatacaccggcagagatgat

SEQ ID NO: 1583 - DNA, 414 bp, Diabrotica virgifera
  Clone ID: LIB149-030-Q1-E1-B4
acgcgtccgcccaagcgtccggccgatcccaatgtccaagctgtagaaaaagttgattggagaaatagtgccgttttgggagtcaaagatcaaggacagtgtggatcatgctgggctttcagtaccacgagatccctcgaaggtcaactcgccatccacagaaaccaacgtgttcctctcagtgaacaagaattggtagactgtgacacatcaagaaatcctggttgtaacggacgtttgatgacagatgcctgtaactatgttataaaccatggtccctcttccgaatctcaataggcatacaccggcagagatgatcgctgcaagaatgttgagaacaaaccactcttccattagtggctacctagaacttgaaacaactgaacatgcactcgcgtccgctcttgctaacgt

SEQ ID NO: 1584 - DNA, 415 bp, Diabrotica virgifera
  Clone ID: LIB150-041-Q1-E1-D11
acctgaaaataatcactttttaagattagcaatgccagcagctgacgaaataaagtccagctgggctgacgaggtagagttagaaggaggtgccttaccaccacccagtgaagtcttcgaaaatggtttcaagattgtaactgaatataaatacaatgaagacgacaagaaagttaagattgtcaggacgtacaaaattgagaaacgtgttgtgtccaagtcaattgctctccgtaaaacatggaaaaagtttggtgatgttgccaatgataaacctggcccgaatcccgcgactaccatagtagctgaagacgtttatatgcagtacatcactagtaaggaagaagataataagcaggatgatgactctttggacaaactgaaaggaatgggtgataagaaattctttaaatgt

SEQ ID NO: 1585 - DNA, 443 bp, Diabrotica virgifera
  unsure (1)..(443): unsure at all n locations
  Clone ID: LIB150-043-Q1-E1-B1
accacacgtccgttcttgtagttattgcctggaaataatcactttttaagattagcaatgccagcagctgacgaaataaagtccagctgggctgacgaggtanagttagaaggaggtgccttaccaccacccagtgaagtcttcgaaaatggtttcaagattgtaactgaatataaatacaatgaagacgacaagaaagttaagattgtcaggacgtacaaaattgagaaacgtgttgtgtccaagtcaattgctctccgtaaaacatggaaaaagtttggtgatgttgccaatgataaacctggcccgaatcccgcgactaccatagtagctgaagacgtttatatgcagtacatcactagtaaggaagaagataataagcaagatgatgactcttttggcaaactgaaaggaatgggtgataagaaattccttaaatgtcc

SEQ ID NO: 1586 - DNA, 402 bp, Diabrotica virgifera
  Clone ID: LIB150-005-Q1-E2-G12
agaaagtacgtgacattttcactttattttccatacagtttaaacaatattgtattcttgtagttattgcctgaaaataatcactttttaagattagcaatgccagcagctgacgaaataaagtccagctgggctgacgaggtagagttagaaggaggtgccttaccaccacccagtgaagtcttcgaaaatggtttcaagattgtaactgaatataaatacaatgaagacgacaagaaagttaagattgtcaggacgtacaaaattgagaaacgtgttgtgtccaagtcaattgctctccgtaaaacatggaaaaagtttggtgatgttgccaatgataaacctggcccgaatcccgcgactaccatagtagctgaagacgtttatatgcagtacatcact

SEQ ID NO: 1587 - DNA, 357 bp, Diabrotica virgifera
  unsure (1)..(357): unsure at all n locations
  Clone ID: pGUT013
gctaaacgagatgatagttcctgtgctatcagaattgccaatttgagtgaatccacaactgaaactgatttggaagatctggttaaacaatttggaccaattcaaaaactgtatttggctaaagacaagataactggtggatgtacaggatttgctcatatacatttcaaattccgttctgatgcatctaaggcaatcgcaatgcttcatggacatagttatgatcatcttattcttaatgttgattggtccaagccatcaccaaattctaaccaataattgtatcaccagatttntgaataataaacataatttctacatttnnctgccaaacattgcatttggttgtctttttta

SEQ ID NO: 1588 - DNA, 425 bp, Diabrotica virgifera
  Clone ID: LIB3026-026-Q1-E1-E8
agctagatgttccaaaccagccatcgatctaattgcctcctgtttaccagaggaatccaaagaccttcctgtattggcccagaaaatcattgttgccgtagtaaaacaagcatgcagttccactgttgaagaaattttggaattgttgaacccatgtgcccttgaaaaggacttcgcttctttcccagcttgcagagaaatcaaaaccgttatcgacgaacacagaaacaaacttccatcgaaatcactcatctgctcaactctccccaagatcaggaactgcgccaaagctcacattgaagcttcctgccaaaacacagtcaccagacaagctgccttgaaattccacgatgctatcgatgctgcccttaaagacgactgtgatgcccttaacaaagcctaaatcatttatgacaaaatgctcc

SEQ ID NO: 1589 - DNA, 394 bp, Diabrotica virgifera
  Clone ID: LIB150-005-Q1-E2-A12
accacgcgtccgcttaaagaatccgattatcaagtaataaaagaccttactcgtgaattcgacagacacaaggacaaatgcgcagatattgaaaagaaaatgaatgctaccatcgaggacctcgccaactgcattgaagatattaccattggatcaagtaccgtgtgcgctactgcccaacgtacaattgaaaaatgcgccaagccagtcattgaattagttagcggttgtttgccagaagaatccaaagaacttcccgccttagctgagggaattgttcttgctgttttgaaacaagcttgtgcttctacagtagaagaagtattagaattatttaatccatgccaatggaaagctttcggaagcattgaaaaagtagattcctgcaaagccg

SEQ ID NO: 1590 - DNA, 442 bp, Diabrotica virgifera
  Clone ID: LIB150-031-Q1-E1-F11
aaatggcccagaaaatcattgttgccgtagtaaaacaagcatgcagttccactgttgaagaaattttggaattgttgaacccatgtgcccttgaaaaggacttcgcttctttcccagcttgcagagaaatcaaaaccgttatcgacgaacacagaaacaaacttccatccaaatcactcatctgctcaactctccccaagatcaggaactgcgccaaagctcacattgaagcttcctgccaaaacacagtcaccaggcaagctgccttgaaattccacgatgctatcgatgctgcccttaaagacgactgtgatgcccttaacaaagcctaaatgatttatgacaaaatgctccaaaaaattaataaaatatttttatagttaaaaaccaagaacaatgagatcgaacgacgcgagaggcggggtgtaaaaaaaaagggggg

SEQ ID NO: 1591 - DNA, 409 bp, Diabrotica virgifera
  Clone ID: LIB150-003-Q1-E2-C5
acgctgtcctcgttcagggcaaaaaagaagactccagcagctcatctgaagaaaatgtcagagaagtagcagaattattgaacaagaaattcaacaccacccttcttcttgatgttatcaaaatggccgaaaaagctaaagcaaaatgtccagacttggaagaaaaacttgacgatatttccggaaaaattgaaaaatgcgttgacgaaatcgaacttggatcagaaactttctgctctctcgtcaagaacaacttggctagatgttccaaaccagccatcgatctaattgcctcctgtttaccagaggaatccaaagaccttcctgtattggcccagaaaatcattgttgccgtagtaaaacaagcatgcagttccactgttgaagaaattttggaattgttgaaccc

SEQ ID NO: 1592 - DNA, 485 bp, Diabrotica virgifera
  Clone ID: pGUT2722
agaaaatgccgtctgtaaccttaaaagacgttgatcaacataaatttgtgaaggctttctcctccttcttgaaaaaaactggaaaactacgtgttccagaatgggttgatctcgtcaaaacatccagagctaaggaattagctccctacgatcccgactggtactatgtcagatgtgctgctattgctaggcacatttacatcaggtctcctgtaggtgtaggatcagtcacaaaaatcttcggttcccgcaaacgcaatggaacgaaaccctcccatttctgcagatcagcaggaagcattgcccgtaaagctctccaaagtttagaaacagttaagttgattgaaaaatctgctgatggtggtaggaaaatcacccaacaaggtaggagagatcttgatcgtattgctgcacaggttaaagctaaggaacgtaaagctcttaaggcttccggtgtgcttactttgtaaatgattaagttttaa

SEQ ID NO: 1593 - DNA, 431 bp, Diabrotica virgifera
  unsure (1)..(431): unsure at all n locations
  Clone ID: LIB150-018-Q1-E1-F3
cagacgcatgggcggacgcgtgggcggacgcgtgggcgacgtgtgacagctacagaaaatgccgtctgtaaccttaaaagacgttgatcaacataaatttgtgaaggctttctcctccttcttgaaaaaaactggaaaactacgtgttccagaatgggttgatctcgtcaaaacatccagagctaaggaattagctccctacgatcccgactggtactatgtcagatgtgctgctattgctaggcacatttacatcaaggctcctgtaagtgtaagatcagtcacaaaaatcttcggttcccgcaaacgcaatggaacgaaaccctcccatttctgcagatcagcaggaagcattgcccgtaaagctctccaaagtttagaaacagttaagttgattgaaaaatctgctgatggtggtangaaaatcaccc

SEQ ID NO: 1594 - DNA, 370 bp, Diabrotica virgifera
  unsure (1)..(370): unsure at all n locations
  Clone ID: pGUT2126
aaggaattagctccctacgatcccgactggtactatgtcagatgtgctgctattgctaggcacatttacatcaggtctcctgtaggtgtaggatcagtcacaaaaatcttcggttcccgcaaacgcaatggaacgaaaccctcccatttctgcagatcagcaggaagcattgcccgtaaagctctccaaagtttagaaacagttaagttgattgaaaaatctgctgatggtggtaggaaaatcacccaacaaggtangagagatcttgatcgtattgctgcacangttanagcttaggaacgtanagctcttanggctttcggtgtgctactttgtaaatgattaagttttaataaaataaatatttgat

SEQ ID NO: 1595 - DNA, 350 bp, Diabrotica virgifera
  unsure (1)..(350): unsure at all n locations
  Clone ID: LIB3026-008-Q1-E1-F11
cccacgcgtccggacagctacaggttagctaaagtgtttattcttaaattttattataaaatttatctaactacagaaaatgccgtctgtaaccttaaaagacgttgatcaacataaatttgtgaaggctttctcctccttcttgaaaaaaactggaaaactacgtgttccagaatgggttgatctcgtcaaaacatccagagctaaggaattagctccctacgatcccgactggtactatgtcagatgtgctgctattgctaggcacatttacatcaggtctcctgtangtgtaggatcagtcacaaaaatcttcggttcccgcaaacgcaatggaacgaaaccctccc

SEQ ID NO: 1596 - DNA, 370 bp, Diabrotica virgifera
  Clone ID: LIB150-047-Q1-E1-A1
aactgacaactagcaatggctgccggtttcaagatatttttgcttgtgctcttctcgtacgtctgttatacacaggcgaatcctaaggtggtttgctactatgacgaaaaaggcaactcccggcaagggcaaggcaagttcgatgttgcctttttggaaccagctttacaattctgcacacacttaatttatgggtacgcaggtattgacccaaatacttacaaaataaagctaatgaatgaacagctagaccttaaccaacacaacttcagacaagttactgatcttaagaggaaattccctggtcttagggttttcctttcggttggtggtgacagagatgttagtggagaagatactgaaaagaata

SEQ ID NO: 1597 - DNA, 388 bp, Diabrotica virgifera
  Clone ID: LIB150-028-Q1-E1-D11
aaagatatttttgcttgtgctcttctcgtacgtctgttatacacaggcgaatcctaaggtggtttgctactatgacgaaaaaggcaactcccggcaagggcaaggcaagttcgatgttgcctttttggaaccagctttacaattctgcacacacttaatttatgggtacgcaggtattgacccaaatacttacaaaataaagctaatgaatgaacagctagaccttaaccaacacaacttcagacaagttactgatcttaagaggaaattccctggtcttatggttttcctttcggttgggggtgacagagatgttagtggagaagatactgaaaagaatatggtttacaggaatgtgttagaagcagtagaccgtatattaactttc

SEQ ID NO: 1598 - DNA, 405 bp, Diabrotica virgifera
  Clone ID: LIB150-048-Q1-E1-E8
gcagccgcctagactcacgcgtccgaaagactaaagactgaccagtagcaatggctgccggtttcaagatatttttgcttgtgctcttctcgtacgtctgttatacacaggccaatcctaaggtggtttgctactatgacgaaaaaggcaactcccggcaagggcaaggcaagttcgatgttgcctttttggaaccagctttacaattctgcacacacttaatttatgggtacgcaggtattgacccaaatacttacaaaataaagctgatgaatgaacagctagaccttaaccaacacaacttcagacaagttactgatcttaagaggaaattccctggtcttagggttttcctttcggtcggtggttacagagatgttagtggagaagatactgaaaagaata

SEQ ID NO: 1599 - DNA, 418 bp, Diabrotica virgifera
  Clone ID: LIB150-001-Q1-E1-G11
gggactcgcatttcaacacaacactctatagtgagtcgtattagcaatggctgccggtttcaagatatttttgcttgtgctcttctcgtacgtctgttatacacaggcgaatcctaaggtggtttgctactatgacgaaaaatgcaactcccggcaagggcaaggcaagttcgatgttgcctttttggaaccagctttacaattctgcacacacttaatttatcggtacgcaggtattgacccatatacttacaacataaagctaatgaatgaacagctagaccttaaccaacacaacttcacacatgttactgatcttaagaggaaattcgctggtcataaggttttcctttcggttggtggtgacaaagatgttactggagaatatattgaaaagaatatggtttacaagaatgtg

SEQ ID NO: 1600 - DNA, 364 bp, Diabrotica virgifera
  Clone ID: LIB150-006-Q1-E1-C1
aggacgtggtggttccgcgggagcgaagtttacgatctcccttgctcttcctgtatgagcagtaattaattgtgcagataatacaggagcatagaacttatatgttatcgctgtacaaggtattggtggacgacttaaccgtctgccagctgcaggatctggtgacatgattgtagccacagtcaaaaagggtaaaccagaactcaggaaaaaagtcatgcctgcagtagttatcaggcagcggaaaccatttagaacgaaggatggtgtcttcatttactttgaagataatgctggggttatagtcaataacacaggtgaaatgaaaggatcagccatcactggtccagttgcaaaagaatgt

SEQ ID NO: 1601 - DNA, 388 bp, Diabrotica virgifera
  unsure (1)..(388): unsure at all n locations
  Clone ID: LIB3026-026-Q1-E1-E4
aaaatagtcaagagaggacgtggtggttccgcgggagcgaagtttaggatctcccttgctcttcctgtaggagcagtaattaattgtgcagataatacaggagcagagaccttatatgttatcgctgtacaaggtattggtggacgacttaaccgtctgccagctgcaggatctggtgacatgattgtagccacagtcaaaaagggtaaaccagaactcaggaaaaaagtcatgcctgcagtaattatcaggcagcggaaatcatttagaaggaatgatggtgtcntcatttactttgaagataatgcctgggttatagtcaatagcaaaggttaaatgataggattagccatcactggtccactttcaaaagaatgtgcataattat

SEQ ID NO: 1602 - DNA, 363 bp, Diabrotica virgifera
  Clone ID: LIB3026-025-Q1-E1-A6
ccacgcatccggagaggacgtggtggttccgcgggagcgaagtttaggatctcccttgctcttcctgtaggagcagtaattaattgtgcagataatacaggagcaaagaacttatatgttatcgctgtacaaggtattggtggacgacttaaccgtctgccagctgcaggatctggtgacatgattgtagccacagtcaaaaagggtaaaccagaactcaggaaaaaagtcatgcctgcagtagttatcaggcagcggaaaccatttagaacgaaggatggctgtctcattgactttgaagataatgctggggtcatagtcaataacagaggtgaaatgaacggatcagccatcactggtcca

SEQ ID NO: 1603 - DNA, 314 bp, Diabrotica virgifera
  unsure (1)..(314): unsure at all n locations
  Clone ID: pGUT737
gctcttcctgtaggagcagtaattaattgtgcagataatacaggagcaaagaacttatatgttatcgctgtacaaggtattggtggacgacttaaccgtctgccagctgcaggatctggtgacatgattgtagccacagtcaaaaagggtaaaccagaactcaggaaaaaagtcatgcctgcagtagttatcaggcagcggaaaccatttataaggaaagatggtgtcttcatttactttgaaaataatgctggggttatagtcaataacaaaggtganatganaggatcagccatcactggtccagttgcaaa

SEQ ID NO: 1604 - DNA, 404 bp, Diabrotica virgifera
  unsure (1)..(404): unsure at all n locations
  Clone ID: LIB149-031-Q1-E1-D8
agtcactcacaagagcgatggttgggactcagaaccttttgagttgacagaaagagatgggaaactgtacggaagaggggcttcagatgataaaggacccgttttgtcttggttgcatgctattgaaggattccaggcaattggcgaagaagtacccgtcaacttaaaaatggtattcgaaggaatggaagaaagcggaagtgaaggtttggacgagttgttacatgccgagaaaaataaatttctggctggaacggattatgtatgtatttcagacaattactggctgggaaccaccaaaccttgcattacctatggtctccgaggaatctcttatttcttcttagaggttgaatgtgctgataaagatttgcatagtggagtttacngcggtacagtccatg

SEQ ID NO: 1605 - DNA, 436 bp, Diabrotica virgifera
  Clone ID: LIB149-016-Q1-E1-F11
cccacgcgtccgctagtgtacttgaaatatggctcttccaggacccttggataaattattcaaatatctcgatgaaaacaaagcaaaatatatagaaaacttaagacaagtcgttgctatccagtcagtatcagcatggccagaaaaaagaggtgaaataaccaagcaaatgaaatgggcgctggaacgtttacaagctttgggagcgtcagcagaattaagagatcttggaacccaaactctacctaacggacaaactatacctttacctcctgtcttattcggttcattgggcaacgatccaaaaaagaagactgttttaatttatgggcatttagatgttcaaccagctcacaagagcgatggttgggactcagaaccttttgagttgacagaaaaagatgggaaactgtacggaagaggggcttcagatgat

SEQ ID NO: 1606 - DNA, 349 bp, Diabrotica virgifera
  Clone ID: pGUT2150
aaaaatggtatttgaaggaatggaagaaagcggaagtgaaggtttggacgagttgctacatgcggagaaaaataaatttttggctggaacagattatgtatgtatttcagacaattactggctgggaaccaccaaaccttgtattacctatggtcttcggggaatctcttatttcttcctagaggtcgaatgtgctgataaagatttgcatagtggagtttacggcggtacagtccatgaggcgatgtcagacctggtgtacctaatgaaccaacttgttgataaagacggaaaaatcttagtcgacggtatatacgacgatgtagcttcagttaccgataacgaacat

SEQ ID NO: 1607 - DNA, 279 bp, Diabrotica virgifera
  Clone ID: LIB150-014-Q1-E1-H2
gaaaaaagaggtgaaataaccaagcaaatgaaatgggcgctagaacgtttacaagctttgggagcgtccgcagaactaagagatcttggaacccaaactctacctaacggacaaactatacctttacctcctgtcttattcggttcattgggcaacgatccaaaaaagaagactgtgttaatttatgggcatttagatgttcaaccagctcacaagaccaattgttgggactcagaaccttttggtttgccagaaaaagatgggaaactgtacggaaaa

SEQ ID NO: 1608 - DNA, 410 bp, Diabrotica virgifera
  Clone ID: LIB150-009-Q1-E1-G4
tgttgtgcggtggtactcgctagggcccagattccaagtctgggtttctgtcccgattatttgcccatgtcggaatttgacatcgagagttttttgggaaagtggtatgaggctgagcgttattttcaattcacggaagtcacatcgaggtgtgttgtgacagattatgctaaaggacctagtgggaaaatttatgtttccaacgaagttacaagccgattgactggcataaaacgagtcatagatggccagctagaattgtcaggaagatctggtgaaggaaaatttaacattagatattcaacacctttatcttctcaagcacaactcacggtacttgacacagactatgataactatgctgttatatggagttgcagtggctttggaccaattcatacacaaagtgt

SEQ ID NO: 1609 - DNA, 414 bp, Diabrotica virgifera
  Clone ID: LIB150-009-Q1-E1-G8
agttgtgttgtgctgtggtactcgctagggcccagattccaagtctgggtttctgtcccgattatttgcccatgtcggaatttgacatcgagagttttttgggaaagtggtatgaggctgagcgttattttcaattcacggaagtcacatcgaggtgtgttgtgacagattatgctaaaggacctagtgggaaaatttatgtttccaacgaagttacaagccgattgactggaataaaacgagtcatagatggccagctagaattgtcaggaagatctggtgaaggaaaatttaacattagatattcaacacctttatcttctcaagcacaactcacggtacttgacacagactatgataactatgctgttatatggagttgcagtggctttggaccaattcatacacaaagtg

SEQ ID NO: 1610 - DNA, 434 bp, Diabrotica virgifera
  Clone ID: LIB3026-030-Q1-E1-D3
acgcgtccgatagaagtgcatatttgggtgactggtacgaacaagccagatacccaactttactggaagatcacggaagatgtgttgttaccaatattgcagtaggtgacgatagaactataaggagtcgtacccaatatatcaattcagagacaaatgagagacacgttctagaaggagaaacgcaaggttcaacaactggggaaggcaaatttatagtacatttcttaaatccagacgtaactgtacctttctgggttcttggtacagactatgaaagttattctgtaggtttgtcctgttttgaacgagatggtgctcctctagcgagccttttcatttcaacaagaactccatttccaccaaaagatctggtggattcgattctccaagttcttgacgacaacaaatttgctataaaggcactaatcttc

SEQ ID NO: 1611 - DNA, 387 bp, Diabrotica virgifera
  Clone ID: LIB3026-019-Q1-E1-B10
cccacgcgtccgattcctgttgaaagttgtccagatgtagaagtagttacaaatttcaatggaagtgcatatttgggtgactggtacgaacaagccagatacccaactttactggaagatcacggaagatgtgttgttaccaatattgcagtaggtgacgatagaactataaggagtcgtacccaatatatcaattcagagacaaatgagagacacgttctagaaggagaaacacaaggttcaacaactggggaaggcaaatttatagtacatttcttaaatccagacgtaactgtacctttctgggttcttggtacagactatgaaagttattctgtaggtttgtcctgttttgaacgagatggtgctcctctagcgagccttttc

SEQ ID NO: 1612 - DNA, 408 bp, Diabrotica virgifera
  Clone ID: LIB149-028-Q1-E1-E10
taaaatgtttttaaaggtaatattagttttagcagcttctttgtgcatttcgtgcagtgcgcaggattcagatttaaatgtgactctgttttacgaaggattatgtccatattgccataattttatagtggatcaattataccctggatatcaaaaattaggagacagctttaaattggatgtagtaccgtatggatgggagacttataaaaaactagccgatggaacaatacaatatacttgtcaacatggagaaaacgaatgcaccgttaatagaatacacgcttgtgtcattgaccaaaatccaactcaatcagatcttataagctttatgcaatgccatttatctcaagctaacgcatataacatttatgatgagttgatggatatggcaaaagattgctctgg

SEQ ID NO: 1613 - DNA, 454 bp, Diabrotica virgifera
  Clone ID: LIB149-010-Q1-E1-G10
aggtcaaaggtaatattagttttagcagcttctttgtgcatttcgtgcagtgcgcaggattcagatttaaatgtgactctgttttacgaaggattgtgtccatattgccacaattttatagtggatcaattataccctggatatcaaaaattaggagacagctttaaattggatgtagtaccgtatggatgggagacttataaaaaactagccgatggaacaatacaatatacttgtcaacatggagaaaacgaatgcaccgttaatagaatacacgcttgtgtcattgaccaaaatccaactcaatcagatcttataagctttatgcaatgccatttatctcaagctagcgcatataacagttatgaggagttgatggatatggcaaaagattgctctggaggtactatttcttttgatcgtgttcaaaattgtgtaaaaggatctcatgcag

SEQ ID NO: 1614 - DNA, 388 bp, Diabrotica virgifera
  Clone ID: LIB149-028-Q1-E1-C3
gcgaccacgcgtccgcacacgcgtccgcccacgcgtccgcccacgcgtccgcccacgcgtccgcccacgcgtccgtgtttttaaaggtaatattagttttagcagcttctttgtgcatttcgtgcagtgcgcaggattcagatttaaatgtgactctgttttacgaaggattatgtccatattgccataattttatagtggatcaattataccctggatatcaaaaattaggagacagctttaaattggatgtagtaccgtatggatgggagacttataaaaaactagccgatggaacaatacaatatacttgtcaacatggagaaaacgaatgcaccgttaatagaatacacgcttgtgtcattgaccaaaatccaactcaatcaga

SEQ ID NO: 1615 - DNA, 401 bp, Diabrotica virgifera
  Clone ID: LIB149-034-Q1-E1-B8
agtcaaaggtaatattagttttagcagcttctttgtgcatttcgtgcagtgcgcatgattcagatttaaatgtgactctgttttacgaaggattgtgtcgatattgccacaattttatagtggatcaattataccctggatatcaaaaattaggagacagctttaaattggatgtagtaccgtatggatgggagacttacaagaaactagccgatggaacaatacaatatacttgtcaacatggagaaaacgaatgcaccgttaatagaatacacgcttgtgtcattgaccatgatccaactcaatcagatcttataagctttatgcaatgccatttatctcaagctagcgcatataacagttatcatgagtttatggatatggcaaaaaattgctctgga

SEQ ID NO: 1616 - DNA, 410 bp, Diabrotica virgifera
  unsure (1)..(410): unsure at all n locations
  Clone ID: LIB150-002-Q1-E1-E3
atcacaatagacgtaggaaccaacaacgagactcatctgaaagatcctttgtatataggtttgagacaaaagagagtcacaggacaagagtacgatgaactcctcgatgaattcatggaagccgtagtacgccgatggggtcagaacactttgatccaattcgaagactttggtaactcaaacgcattcagattgttggagaagtacagaaatgaatattgtactttcaacgacgacattcagggtaccgctagtgtagccgtagctggtctattggcttcattgaggatcacaaaaactagacgttccgatcatgtgatagtattccaaggagcaggagaagcgaatttgggtatcgctcaattgtgcaccatggcaatggtaaaggaaggtactantgagagtgacgc

SEQ ID NO: 1617 - DNA, 355 bp, Diabrotica virgifera
  Clone ID: LIB149-020-Q1-E1-D3
acccacgcgtccggaaatacgtaacagatattatgcccttagtatatacaccagtcgtaggattagcttgtcaaaactttggattggtttacagaagaccccggggcatgtacgttacaatatacgacaaaggaaacgtatatgaaattatgaaaaattggcctgaaacagatgtccgtgcaatagtagtcaccgacggtgaacgtatcttaggtttaggagaccaaggagcctgtggtatgggaatccccgtcggcaaactgtctttatacacagctttggctggaatcaagccgcatcaatgcctcccaatcacaatagacgtaggaaccaacaacgagactcatctgaaaga

SEQ ID NO: 1618 - DNA, 392 bp, Diabrotica virgifera
  Clone ID: LIB3026-029-Q1-E1-A4
cccacgcgtccgcccacgcgtccgcccacgcgtccgcccacgcgtccgcccacgcgtccgaaaagagagtcacaggacaagagtatgatgaactcctcgatgaattcatggaagccgtactacgccgatggggtcagaacactttgatccaattcgaacactttggtaactcaaacgcattcagattgttggagaagtacagaaatgaatattgtactttcaacgacgacattcaaggtaccgctagtgtacccgtaactggtcgattggcttcattgaggattacaaatactagactttccgatcatgtgatagtattccaaggagcaggagaaacgaatttgggtatcgctcaattgtgcagcatggcaatggtaaaggaaggtactagt

SEQ ID NO: 1619 - DNA, 410 bp, Diabrotica virgifera
  Clone ID: LIB150-044-Q1-E1-C7
cccacgcgtccgataaatcagtacggtcttctttttgttgcagtactagtccactcccaataaacaaatcaaatctaaccatggaaagagatcgggttggaaattggggaaatggagagcacctcgttcctggaggagtatccggtctggagaggttgacaacccccgctttaaataagggtctggcattcaccttcgaagagagacaacagcttggaatccatgggttgttacctcccgtagtaaaatcacaggaacaacaaatcgaacattgtaaaaaatgtttggacagattagatgataatttaaacaaatacatgtacctgataggtcttttggaccgcaatgaaaaattattctacagtttcgtcaggaaatacgtaacagatattatgcccttagtatataca

SEQ ID NO: 1620 - DNA, 487 bp, Diabrotica virgifera
  Clone ID: LIB150-029-Q1-E1-H12
cccgggtggccacacgaatccggtgatagccatggcagttctaatggagaacggtgaagatttttcaaaagatgtctcagcagagcatcaaaatggatcaggtgatgctccagccgatagtggaagtgcagaaacgcccggccgtgacgatgatagaaaattatttgttggtggcatgtcttgggaaaccactgatagggagttacgagaacattttggccaatatggcgaaatcgaaagtataaatgtaaagacagatcccaacactggtagattaaggggatttgcattcatagtatttaccacaacagaagctattgacaaagttgtagctgcaggtgaccatgtcattaatggcaaaaaagttgaccccaaaaaagccaaagcgaggcatggaaaaatatttgtaggtggtctcacctctgaattgagtgatgatgacatcaagaactatttctcacaatttggatcgatcattgatattgaa

SEQ ID NO: 1621 - DNA, 506 bp, Diabrotica virgifera
  Clone ID: pGUT2694
cagatcccaacactggtagatcaaggggatttgcattcatagtatttaccacaacagaagctattgacaaagttgtagctgcaggtgaccatgtcattaatggcaaaaaagttgaccccaaaaaagccaaagcaaggcatggaaaaatatttgtaggtggtctcacctctgaattgagtgatgatgacatcaagaactatttctcacaatttggatcgatcattgatattgaaatgccatttgacaagcaaaagaaccaaaggaaaggattctgcttcatcacatttgaatctgaacaagtagtgaatgagttactcaagcaacccaaacaaaccattaaagacaaagaggtcgatgtaaagaaagccacacccaaaccagaccaaatgggcggccccatgatgggcatgcgcggtatgcgaggcggaggcagaggcggtccaatgaggggaggtcgcggtggccgatgcggctacggaaaccaaggaaactggaaccaagcctat

SEQ ID NO: 1622 - DNA, 411 bp, Diabrotica virgifera
  unsure (1)..(411): unsure at all n locations
  Clone ID: LIB150-020-Q1-E1-C1
aggtaggacgtgttangtgttagtagctcttaggctaagtataatattagttttttaatttatcggcacacaggcagttctaatggagaacggtgaagatttttcaaaagatgtctcagcagagcatcaaaatggatcaggtgatgctccagccgatagtggaagtgcagaaacgcccggccgtgacgatgatagaaaattatttgttggtggcatgtcttgggaaaccactgatagggagttacgagaacattttggccaatatggcgaaatcgaaagtataaatgtaaagacagatcccaacactggtagatcaangggatttgcattcatagtatttaccacaacagaagctattgacaaagttgtagctgcaggtgaccatgtcattaatggcaaaaaagttgaccc

SEQ ID NO: 1623 - DNA, 453 bp, Diabrotica virgifera
  Clone ID: LIB3026-011-Q1-E1-C7
atcaagaactatttctcacaatttggatcgatcattgatattgaaatgccatttgacaagcaaaagaaccaaaggaaaggattctgcttcatcacatttgaatctgaacaagtagtgaatgagttactcaagcaacccaaacaaaccattaaagacaaagaggtcgatgtaaagaaagccacacccaaaccagaccaaatgggcggccccatgatgggcatgcgcggtatgcgaggcggaggcagaggcggtccaatgaggggaggtcgcggtggccgaggcggctacggaaaccaaggaaactggaaccaagcctatggtggctatggttatggccaaggatacggctatgatggctacagccaaggttatgactactacggcagtggctatgggggttatggaggttatgattactcaaactatggcggcggtaactacggtaaatacacc

SEQ ID NO: 1624 - DNA, 443 bp, Diabrotica virgifera
  Clone ID: LIB150-015-Q1-E1-C12
gcgtccggaatactaaaatcaaagcaaatcttaaacagatatttagtagaaactaaagatattgaagttaaatacaccatcttcaatgtaggaacttcagcagctgttaatgtccaacttgtagataatggtttccatcatgaagcctttgaagttgttggaggtcacttgcagtccaaattcgaaagaattccacctcaatccaatgttacccatgttgttgttgtcaggcctttgaggtatggatatttcaacttcaccagtgcagaagtatcctacaatgcatctgatgatgcatctgtcaaaatcaaacgttctttgagcagtgaaccaggtgaaggaggaatcattgccttcagggaatacaacaagaaattctcatctcactattgggactggttggccttcgccctcatgacaacaccatcattggttattcccct

SEQ ID NO: 1625 - DNA, 423 bp, Diabrotica virgifera
  Clone ID: LIB149-044-Q1-E1-C2
agtgatatttagtagttgtgataaattaaaccaacaaaatgaaatctggattgttattcttagttcttgctctattttcctttgcccattgcgaatcagaagatgatacaggtccaagactactagtatcaaagcaaatcttaaacagatatttagtagaaactaaagatattgaagttaaatacaccatcttcaatgtaggaacttcagcagctgttaatgtccaacttgtagataatggtttccatcatgaagcctttgaagttgttggaggtcacttgcagtccaaattcgaaagaattccacctcaatccaatgttacccatgttgttgttgtcaggcctttgaggtatggatatttcaactttcacagtgcagaagtatcctacaaggcatctgatgatgcatctgtcaaaatcaaac

SEQ ID NO: 1626 - DNA, 376 bp, Diabrotica virgifera
  Clone ID: LIB150-048-Q1-E1-H3
atgatctaacagaaggaaacctactgttagtggaaataagtgatatttagtagttgtgataaattaaaccaacaaaatgaaatctggattgttattcttagttcttgctctattttcctttgcccattgcgaatcagaagatgatacaggtccaagactactagtatcaaagcaaatcttaaacagatatttagtagaaactaaagatattgaagttaaatacaccatcttcaatgtaggaacttcagcagctgttaatgtccaacttgtagataatggtttccatcatgaagcctttgaagttgttggaggtcacttgcagtccaaattcgaaagaattccacctcaatccaatgttacccatgttgttgttgtc

SEQ ID NO: 1627 - DNA, 423 bp, Diabrotica virgifera
  Clone ID: LIB150-039-Q1-E1-E3
agccacagacgagatacttgggatctttcactcaatttccggttccggttaggtttggaagatctaacagaaaggaaactactgttagtggaaataagtgataattagtaattgtgaaaaattaaaccaacaaaatgaaatccggattgttattcttagttcttgctctattttcctttgcccattgcgaatcagaagatgatacaggtccaagactactagtatcaaagcaaatcttaaacagatatttagtagaaactaaagatattgaagttaaatacaccatcttcaatgtaggaacttcagcaactgttaaatgtccaacttgtagataatggtttccatcatgaaccctttgaagttgttggaggtcacttgcagtccaaattcgaaagaattccacctcaatccaatgttacccat

SEQ ID NO: 1628 - DNA, 454 bp, Diabrotica virgifera
  unsure (1)..(454): unsure at all n locations
  Clone ID: LIB3026-012-Q1-E1-D11
caaacgcgtccggaactttagacgatggagtccaattcagattagggacacttccacctcagcgttttgtaatgacaatgaatcccgtcaaaagagtttacgatccaaactcactccccagagatttcgactccaattcagtctggcgtggtttaatcactggcattcaagatcagggatggtgtggatcgtcttgggctatctcaacagctgctgttgcatctgacaggtatggtatcgtgtctaaaggaaaagaagcagttacgctcagtgctcaaaacttagtctcctgtgatactcaaggacaacaaagctgcactggtggtcatcttgatagagcgtggtcatttactaaagcttacggtcttgtacatgaagactgtttcncctacgtggtcagaaacgaaagatgcacaatcaaacgaagaggaactctagaggcggctggctgccg

SEQ ID NO: 1629 - DNA, 413 bp, Diabrotica virgifera
  Clone ID: LIB149-023-Q1-E1-F6
acccacgcgtccgatctggtccagttcaagctacaatgaaagtttatcacgatctgtttacatacagcggaggaatatacaaacactcagatttggctgtcaaccacaaacaaggttaccattctgtaaggattgttggatggggtgaagaatataactacagaggagttcaaaagtactggaaagtagccaacagttggggtgccaactggggagaagacggatatttcagaatcgtaagaggaaccaacgaatgtgaaattgagtcgtttgttatcgcttcctggccacacgtatctagaaagattttattgtcaaacgaattgggaacaaactcagtatattaagcaaaaatatgttgtagaccgttttaatatctcatgacgaatatcatcacaacgatgtttgcattc

SEQ ID NO: 1630 - DNA, 406 bp, Diabrotica virgifera
  unsure (1)..(406): unsure at all n locations
  Clone ID: LIB150-039-Q1-E1-H2
acgcgtccacaaaacttagtctcctgtgatactcaaggacaacanagctgcactggtggtcatcttgatagagcgtggtcatttactaaagcttacggtcttgtagatgaagactgtttcccctacgtggccagaaacgaaagatgcacaatcaaacgaagaggaactctagaggcggctggctgccggcaacaacgatttgctgaaagaagaggaagatacaccgtaggacctgcctacagattaggaaacgagactgatatcatgtatgaaattactagatctggtccagttcaagctacaatgaaagtttatcacgatctgtttacatacagcggaggaatatacaaacactcagatttggctgtaaaccatttacaaggttaccattctgtaaggattgttg

SEQ ID NO: 1631 - DNA, 387 bp, Diabrotica virgifera
  Clone ID: LIB3026-019-Q1-E1-G6
agcccacgcgtccgggaaagtagccaacagttggggtgccaactggggagaagacggatatttcagaatcgtaagaggaaccaacgaatgtgaaattgagtcgtttgttatcgcttcctggccacacgtatctagaaagattttattgtcaaacgaattgggaacaaactcagtatattaagcaaaaatatgttgtagaccgttttaatatctcatgacgaatatcatcacaacgatgtttgcattcatgtttttattgtacaccaaaaatctttgtaaattccgtgagattcataaactgatctacttttattcaagctttactgttatttgtgaaaatttatacttaccaaatatttttagtgttactaaaatgccataacaaac

SEQ ID NO: 1632 - DNA, 380 bp, Diabrotica virgifera
  Clone ID: LIB149-037-Q1-E1-A12
aggttgctatccttcccccatctcgtccatctgagaaacccctccgtcttcaactccaggatgtctacagaattggtggtattggaacagtacctgtaggtcgtgttgaaactggtgtattgaaacctgctatggttgtagtattcgctccagccaatttgacgactgaagtaaaatccgttgaaatgcatcacgaagccctccaggaagcagtacctggtgacaatgttggtttcaacgtcaagaatgtctctggtaaagaattgcgtcgtggttacgtagctggagacaccaagaagaacccacccagaggagcttcagacttcactggcccaagtcaatgttctcaaccatcctggtcaaatctcaaacggatatac

SEQ ID NO: 1633 - DNA, 337 bp, Diabrotica virgifera
  Clone ID: LIB150-025-Q1-E1-A10
cctatagtgagtcgtattacctagtacgtcgtgttgaaacggtgtgttgtgacctgtcatggttgttgtaatcgctccagccaatttgacgactgaagtataaaccgttgaaatgcatcacgaaacgctccacgaagcagtacgtggtgacaatgttggtttcaacgtcaagaatgtctctgttatagaattgcgtcggggctacgtagctggggacaccattaacagcccacgcagaggagcttcagacttcattgcccaagtcattgttctcaaccaccctggtcaaatctcaacgcgatatacccctgtactcgactgtcacacaactcacatt

SEQ ID NO: 1634 - DNA, 183 bp, Diabrotica virgifera
  Clone ID: LIB3026-003-Q1-E1-C4
gaaacctggtatggttgtagtattcgctccagccaatttgacgactgaagtaaaatccgttgaaatgcatcacgaagccctccaggaagcagtacctggtgacaatgttggtttcaacgtcaagaatgtctctgttaaagaattgcgtcgtggttacgtagctggggacaccaagaacaaccc

SEQ ID NO: 1635 - DNA, 222 bp, Diabrotica virgifera
  Clone ID: LIB150-038-Q1-E1-E3
acagccaaattgacgactgaagtaaaatccgttgaaatgcatcacgaagccctccaggaagcagtacctggtgacaatgttggtttcaacgtcaagaatgtctctgttaaagaattgcgtcgtggcaatgtgagctctgtatcaagtatctaataggttacatcattgagcgagctgactgtttagacattttattgtacaatagatattttcaatggatat

SEQ ID NO: 1636 - DNA, 407 bp, Diabrotica virgifera
  Clone ID: LIB149-047-Q1-E1-A2
acggacgcgtggggtacttgatataattccttacaacagaaaattaatttcctggtcaaaaggtcggattaattaaccgtttcggaatttgaaaaacatgctttggaagtttggcctaaaaatattcgagattactacagaagtggtgcaggacgacaggagacattggctgataacagaaaagcattcttcaggtataaagtaagaccaagatatttaagaaatgtagaaaatatagatttatctacagtagttcttggagagaagatttccatgccaattggaattgctccgtctggtatgcaaaaaatggctcatccaatgggcgaactggctgttgttaaagctgcccaagaaatgggtgtagtttacactcttagcaacatgtcaacatacagcattgaaga

SEQ ID NO: 1637 - DNA, 416 bp, Diabrotica virgifera
  Clone ID: LIB149-013-Q1-E1-E6
aagaagtgttcggtacaagtttctcagtttttcctacacaattcaaaaatatagaataacaatgtctaactctgcatcaaatctagtgtgtgtcaacgattatgaagaatatgccaaggaggaattaaaaaatgggagctttgagttttataatggtggagctggacagcaaagaacgttggaatggaataaaactgattttaacaagtatcgcattagaccaaaatatatgcgcaatgtaagcaacagaaacttatcaacaaatatcttgggtaaacctgtggcagttcccataggaatatctccctctgcttatcagaaaatagcacacccggatggagaatgtgctactgcaaaagctgcccaagaatcagacaccatcttgatattaagttcacactctaattgtacctttg

SEQ ID NO: 1638 - DNA, 395 bp, Diabrotica virgifera
  Clone ID: LIB149-043-Q1-E1-C9
ggtatataagaagtgttcggtacaagtttctcagtttttcctacacaattcaaaaatatagaataacaatgtctaactctgcatcaaatctagtgtgtgtcaacgattatgaagaatatgccaaggaggaattaaaaaatgggagctttgagttttataatggtggagctggacagcaaagaacgttggaatggaataaaactgattttaacaagtatcgcattagaccaaaatatatgcgcaatgtaagcaacagatacttatcaacaaatatcttgggtaaacctgtggcagttcccataggaatatctccctctgcttatcagaaaatagcacacccggatggagaatgtgctactgcaaaagctgcccaagaatcagacaacatcttgata

SEQ ID NO: 1639 - DNA, 408 bp, Diabrotica virgifera
  unsure (1)..(408): unsure at all n locations
  Clone ID: pGUT3592
aagtgttcggtacaagtttctcantttttcctacggcgttcaaaaatatagagtgggaatgtctaactctgcatcaaatctagtgtgtgtcaacgattatgaagaatatgccaaggaggaattaaaaaatgggagctttgagttttataatggtggagctggacagcaaagaacgttggaatggaataaaactgattttaacaagtatcgcattagaccaaaatatatgcgcaatgtaagcaacagaaacttatcaacaaatatcttgggtaaacctgtggcagttcccataggaatatctccctctgcttatcagaaaatagcacacccggatggagaatgtgctactgcaaaagctgccaggatcagacaccatcttgatattaagtcacactctaattgtacctt

SEQ ID NO: 1640 - DNA, 418 bp, Diabrotica virgifera
  Clone ID: LIB149-014-Q1-E1-H9
cggacgcgtgggttggtcagccagttgtctctgtacgatcttgtacacactcctggagtagctgctgatttgtctcacattgagaccgcagctaaagtaaagggattcaatggtcctgaatgtcttaaggatgctttgaaaggcgccgacgtaattattattccagctggtgtacccaggaaacctgctatgaccagagacgatctgttcaacacaaacgccggaattgtaaaagcgttggccgaatgcgcagctgaagtagcgccatgtgcgcttattggtatcattacgaagcctgtcaactccgctgtcactattgcctgtgaagtactcaaaaaggctggtaaacttgaccccaaacgtgtgtttggtatctccaacttggacatcgtccgttgcaacaccttcatcgcagaag

SEQ ID NO: 1641 - DNA, 458 bp, Diabrotica virgifera
  Clone ID: LIB149-008-Q1-E1-D12
ccgggtagacccacgcggcccctcagtctgctttaggtcgacctctactgggaaaggtcaaagtttttccaaatttgaagaggttaaaagttaaactataaattcaaaaatgttttccagaattgtaagaccaactgtagtagcaactagaagcttcagcacatcaaaacagaacaacttcaaagtagcagtatgtggagcctctggcggtattggtcaacccctttctttgctcttgaagatcaaccctttggtcagccagttgtctctgtacgatcttgtacacactcctggagtagctgctgatttgtctcacattgagaccgcagctaaagtaaagggattcaatggtcctgaatgtcttaaggatgctttgaaaggcgccgacgtaattattattccagctggtgtacccaggaaacctggtatgaccagagacgatctgttcaacacaaacg

SEQ ID NO: 1642 - DNA, 405 bp, Diabrotica virgifera
  Clone ID: LIB149-020-Q1-E1-F11
acggacgcgtgggtctctgtctgcttttggtcgacctctactgggaaaggtcaaagtttttccaaatttgaagaggttaaaagttaaactataaattcaaaaatgttttccagaattgtaagaccaactgtagtagcaactagaagcttcagcacatcaaaacagaacaacttcaaagtagcagtatgtggagcctctggcggtattggtcaacccctttctttgctcttgaagatcaaccctttggtcagccagttgtctctgtacgatcttgtacacactcctggagtagctgctgatttgtctcacattgagaccgcagctaaagtaaagggattcaatggtcctgaatgtcttaaggatgctttgaaaggcgccgacgtaattattattccagctggtgta

SEQ ID NO: 1643 - DNA, 345 bp, Diabrotica virgifera
  Clone ID: LIB149-029-Q1-E1-A12
gggtcgatgcacgcgtctagactaactgttgtaacaactagaagcttcagcacatcagaacagaacaacttcaaagtagcagtatgtggagcctctggcggtattggtcaacccctttctttgctcttgaagatcaaccctttggtcagccagttgtctctgtacgatcttgtacacactcctggagtagctgctgatttgtctcacattgagaccgcagctaaagtaaagggattcaatggtcctgaatgtcttaaggatgccttaaatgcgccgacgtaattattaatccaactggtggtaccaggaaacctggtatgaccagagacgatctgttcaacacaa

SEQ ID NO: 1644 - DNA, 406 bp, Diabrotica virgifera
  Clone ID: LIB149-010-Q1-E1-D3
gtagaaacaacgataatacaacaaccggcaatatggcgaacggcagtggtcctggttacgctactccacttgatgccatgaaaaatggcccaaaagaaaagcttatgtacgtagtttgcattaatccaaatgaaggggaagataaaaccgatcttttggcgacggtagacgttgatccggagtcaccgacatattgccagattatccatcgtttaagaactggtcacaagaacgatgagcttcaccactctggttggaatgtctgttccagctgtcacagttccacaggctgttgtaatggtcttgtcagggacaaacttattctaccggctttgggatctgacaggatttacgtagtggatgttggaaagaatctaaaggcaccagaatttcacaaaattataga

SEQ ID NO: 1645 - DNA, 449 bp, Diabrotica virgifera
  unsure (1)..(449): unsure at all n locations
  Clone ID: LIB150-017-Q1-E1-G1
caactacaagcaccagccgatcagtgtagccgtgacctccaagtagaaacaacgataatacaacaaccggcaatatggcgaacggcagtggtcctggttacgctactccacttgatgccatgaaaaatggcccaaaagaaaagcttatgtacgtagtttgcattaatccaaatgaaggggaagataaaaccgatcttttggcgacggtagacgttgatccggagtcaccgacatattgccagattatccatcgtttaagaactggtcacaagaacgatgagcttcaccactctggttggaatgtctgttccagctgtcacagttccacaggctgttgtaatggtcttgtcagggacaaacttattctaccggctttgggatctgacangatttacgtagtggatgttggaaagaatccaaaggcactagaatttcacaaaattatagaa

SEQ ID NO: 1646 - DNA, 414 bp, Diabrotica virgifera
  Clone ID: pGUT2948
gtgacctccaagtataaacaacgataatacaacaaccgggggtatggcgaacggcagtggtcctggttacactactccacttgatgccatgaaaaatggcccaaaagaaaagcttatgtacgtagtttgcattaatccaaatgaaggggaagataaaaccgatcttttggcgacggtagacgttgatccggagtcaccgacatattgccagattatccatcgtttaagaactggtcacaagaacgatgagcttcaccactctggttggaatgtctgttccagctgtcacagttccacaggctggtgtaatggtcttgtcagggacaaacttattctaccggctttgggatctgacaggatttaacgtagtggatgttggaaagaatccaaaggcaccagaatttcacaaaatta

SEQ ID NO: 1647 - DNA, 406 bp, Diabrotica virgifera
  unsure (1)..(406): unsure at all n locations
  Clone ID: LIB150-021-Q1-E1-D9
caactaccgacaccagccgatcagtgtagccgtgacctccaagtagaaacaacgataatacaacaaccggcaatatggcgaacggcagtggtcctggttacgctactccacttgatgccatgaaaaatggcccaaaagaaaagcttatgtacgtagtttgcattaatccaaatgaaggggaagataaaaccgatcttttggcgacggtagacgttgatccggagtcaccgacatattgccagattatccatcgtttaagaactggtcacaagaacgatgagcttcaccactctggttggaatgtctgttccagctgtcacagttccacaggctgttgtaatggtcttgtcagggacaaacttattctaccggctttgggatctgacangatttacgtantggatgt

SEQ ID NO: 1648 - DNA, 548 bp, Diabrotica virgifera
  Clone ID: pGUT3412
gaagatcttcggatctgttaagaactttttcgtggggctcaaaaggaaaataggtggttcctcagttgtggacgataaagcagatgaacatagagaacagtttactgccttcatcagagaatttaaaaatgctcttcgtcatgatggattctgggtgactctttctgttctcccgaacgttaacagcacagtttattacgatcctcgtgcattggctccacatttggatttcgttacacttcaaaactttgatttttacactcccgaacgtaaccccaaagaagcagattactcatctccattatacaaaatttttgacagaaaagatgatgaaaacggtgacttccaagttatgtactggctgaacaacggtatgccagccaataaaatcctttacggtatccgtaccttcggtcgcagctggaaaatgactgaagcttctggttaactggagtaccgccactaactatcgaagaggctcccggtgaaagctgtccttacactcaagaaccaggcctacttagctataacgaagtctgcaccaaaat

SEQ ID NO: 1649 - DNA, 404 bp, Diabrotica virgifera
  Clone ID: LIB150-010-Q1-E2-B1
cacacgcgtccgcccacgcgtccgcgtagattaactttcatcaactctgccaaagatctaatcaaaaattatggattcgatggaattgatctcgcatgggaaatgccaagaaccaaaccaaagaagatattcggaactgttaagaactttttggtcggaatcaaaaggagaatagttggttcctcagttgtggacgataaagcagatgaacatagagaacagtttactgccttcatcagagaatttaaaaatgctcttcgtcatgatggattctggttgactctttctgttctccctaacgttaacagcacagtttattacgatcctcgtgcattagctccacatttggatttcgttactcttcaaaactttgatttttacactcccgagcgtaaccccaaaga

SEQ ID NO: 1650 - DNA, 413 bp, Diabrotica virgifera
  Clone ID: LIB149-003-Q1-E1-H10
gaccaaacgtccaacagctagaccttaaccaacacaacttcagacaagttactgatcttaagaggaaattccctggtcttagggttttcctttcggttggtggtgacagagatgttagtggagaagatactgaaaagaatatggtttacaagaatgtgttagaagcagtagaccgtagattaactttcatcaactctgccaaagatctaatcaaaaattatggattcgatggaattgatctcgcatgggaaatgccaagaaccaaaccaaagaagatattcggaactgttaagaactttttggtcggaatcaaaaggagaatagttggttcctcagttgtggacgataaagcagatgaacatagagaacagtttactgccttcatcagagaatttaaaaatgctcttcgtcat

SEQ ID NO: 1651 - DNA, 422 bp, Diabrotica virgifera
  Clone ID: LIB149-016-Q1-E1-F2
tcgcgggtcgatacaagcctctaaaatgactcatccaaacttaaggtgttactttctgtgggaggaaacgaagatgtcagtggctcaggtgacgagaaaaatgaaaaatatagaaaaattttggaatctaccgctcaccggttaagctttgtcaactctgcatacactttattaaaagcttatggttttgatggacttgatttggcttgggaattccccgaaaccaaacccaaaaagataaaatctggattgaaaaaactgtggagttccatcaaaacaacagttgccggtgaacatgttgttgacgagaatgctcagcagcatagagaacaattcgtagcattagttaaagaacttaaaaatgctcttaaagcagacaacatgcaactgtctctgacagttttgcccaacattaacagcac

SEQ ID NO: 1652 - DNA, 425 bp, Diabrotica virgifera
  Clone ID: LIB150-020-Q1-E1-D7
agtagtgtcaacgggtaactcgtactttctttgagttctttcgttttgtccgtaagcgcgaaaacaacacccatccaccatggacgcgatcaagaagaaaatgcaagcgatgaagcttgaaaaagacaacgcattagaccgcgcagcacacaatgaacaactcgccaaagatgccaacctccgcgctgaaaaggctgaagaagaagctcgctccctacaaaagaagatccaagccattgaaaacgatcttgaccaaactcaggaacaactcacacaagtcaatggcaaacttgaagaaaaagaaaaggccctccaaaacgctgaatccgaagttgccgccctcaaccgtcgtatccaattgttagaagaagacttgggacgttcagaagaacgtttagccactgccaccgccaaattggctgaag

SEQ ID NO: 1653 - DNA, 384 bp, Diabrotica virgifera
  Clone ID: LIB150-027-Q1-E1-C4
gggtaactcgtactttctttgagttctttcgttttgtccgtaagcgcgaaaacaacacccatccaccatggacgcgatcaagaagaaaatgcaagcgatgaagcttgaaaaagacaacgcattagaccgcgcagcacacaatgaacaactcgccaaagatgccaacctccgcgctgaaaaggctgaagaagaagctcgctccctacaaaagaagatccaagccattgaaaacgatcttgaccaaactcaggaacaactcacacaagtcaatggcaaacttgaagaaaaagaaaaggccctccaaaacgctgaatccgaagttgccgccctcaaccgtcgtatccaattgttagaagaagacttgggacgttcagaagaacgttt

SEQ ID NO: 1654 - DNA, 426 bp, Diabrotica virgifera
  Clone ID: LIB150-013-Q1-E1-D9
acctccgtggttcgtaagtcgtaacgttcaactttagtcgctccgagaccgtgtgtagtgtcaacgggtaactcgtactttctttgagttctttcgttttgtccgtaagcgcgaaaacaacacccatccaccatggacgcgatcaagaagaaaatgcaagcgatgaagcttgaaaaagacaacgcattagaccgcgcagcacacaatgaacaactcgccaaagatgccaacctccgcgctgaaaaggctgaagaagaagctcgctccctacaaaagaagatccaagccattgaaaacgatcttgaccaaactcaggaacaactcacacaagtcaatggcaaacttgaagaaaaagaaaaggccctccaaaacgctgaatccgaagttgccgccctcaaccgtcgtatccaattgttagaagaagac

SEQ ID NO: 1655 - DNA, 399 bp, Diabrotica virgifera
  Clone ID: LIB150-025-Q1-E1-F2
tcgcgggtccccacacgcgtctaaacggaggcatagtaaacgggtaactcgtactttctttgagttctttcgatttgtccgtaagcgcgaaaacaacacccatccaccatggacgcgatcaagaagaaaatgcaagcgatgaagcttgaaaaagacaacgcattagaccgcgcagcacacaatgaacaactcgccaaagatgccaacctccgcgctgaaaaggctgaagaagaagctcgctccctacaaaagaagatccaagccattgaaaacgatcttgaccaaactcaggaacaactcacacaagtcaatggcaaacttgaagaaaaagaaaaggccctccaaaacgctgaatccgaagttgccgccctcaaccgtcgtatccaattgttagaagaa

SEQ ID NO: 1656 - DNA, 425 bp, Diabrotica virgifera
  unsure (1)..(425): unsure at all n locations
  Clone ID: LIB150-042-Q1-E1-F6
accaatttctctcttttcttgccgaaacacagaaaaattgctggacaacttattaacatttacataggcatgcgcaacgttgatgatcttctctcggttgctgtatataccagagaccgtgttaatccttacttgttcaactatgctctttcggttgcattgttgcatagaactgatacccaggacgtcgacttgccatccttcattaggtcgttccccgacaaatatgtcgacagtaaagtattcgccaaggctanggaagaagccaacattgtgcctaccaattcaaggacaccaattgaaataccaagagatttcactgcctccaacctggaaccagaacatcgtttagcttacttcagagaagatttgggaattaatcttcaccattggcattggcatttggtttatccattcgaagctgc

SEQ ID NO: 1657 - DNA, 401 bp, Diabrotica virgifera
  Clone ID: LIB150-034-Q1-E1-G7
aaaaattatcaaatcttaaaagagaacaagtccagatcacgatggatatcgatgatttggaaagatggcgagacagaatttttgaagctattcagtctggtcgagtacaaggtagaaatggcgaaaccattttgctaactgaaaatgaaggaatagatgtcttgggcaacatgatcgaatccagtgttctctcacccaacagagatatatatggagatctacataacatgggtcacgtatttctttcatatatacacgatcccgaccatagacatctcgaatcttttggagtgatgggtgattcagcaactgctatgcgcgatcctgtattttatagatggcatgcctatattgattacatgtttcaaacctataaatcagccttgcctagatataccgtt

SEQ ID NO: 1658 - DNA, 426 bp, Diabrotica virgifera
  Clone ID: LIB150-026-Q1-E1-H2
gtgtgtcgttccaagcccctagattgagtcatggtagaaaatttctctttatttattcctaaacacagaagacttgctggaaaactaattaatatattcatgggaatgaaagatcctgatgacctaatggctgtggcaatatacgctcgagagcgtgtcaatcctgttcttttcaactatgcattttcagtggctttgatgcatcggcatgatactagagatttagaattaccatctgtactgttttctttccccgacagatatatggatagtaaagtgttttcaagaatgagagaagttgctaacgttgttccagagcctcaaaggactccggttttgatacccagggattatacagcatccgatttggaagacgagcatcgcttagcatacttcagagaagatatcggaataaatcttcatcac

SEQ ID NO: 1659 - DNA, 408 bp, Diabrotica virgifera
  Clone ID: LIB150-033-Q1-E1-E7
tcgcgggtcgatacaagcctctaaattgagtcatactattattggactaaagaagtacaggcaccattgttgtttaacatgtcgaccagtgctaagaggaatgttgtcaagctctttgacagaccaaaagagctggtcatcatgcccaaaggagatgacaaaactgtatttgacgttcctaaagaatatatcacagatcaatacaaaaatgttggaaatcagattgtgtctcgatttggagaagaagctgaaggaggtaagattcctgtgaacactatttccattcctccattgggtgagattttggagttaagaagagacgagaatttctctcttttcttgccgaaacacataaaaattgctggacaacttactaacagttacatacgcatgcgcaacgttgatgat

SEQ ID NO: 1660 - DNA, 423 bp, Diabrotica virgifera
  Clone ID: LIB149-035-Q1-E1-E2
atgaacagtcaccctgatggagaagttggtggtgaattgttgcttggtggatcagacccaaactattacaaaggtgactttacttatgtagatgtttcagctaaaggctattggcaagttgttatggacagtcttaacgttggatcttccttaaaactatgttcaaatggatgtcaaattatcgtagacactggtaccagtttgatcgctggacctagcgctgaagtcgaaaagttacataaagaaataggcgctttttcattccttaatggtgaatatataattgattgcagcaaaattgatcaactacccgaaattagttttgtttttggaggaaaagaattcacactttccggaaattgatatgttttaaagcaatctaacggcggtattgacatatgtatttctggattcatgggatta

SEQ ID NO: 1661 - DNA, 441 bp, Diabrotica virgifera
  Clone ID: LIB149-029-Q1-E1-D5
acccacgcgtccgcccacgcgtccgcccacgcgtccgcccacgcgtccgctaaggatcaattatttgctgaagctacccaggaacccggtttagctttccttgtgggaaaattcgatggaattttaggaatgggataccctgaaatttccgttaacggaattactccagtatttaattcactggttgaacaaggcgctgtgcaagaaccagtcttctccttttacttgaacagagaccctgatggagaagttggtggtgaattgttgcttggtggatcagacccaaactattacaaaggtgactttacttatgtagatgtttcagctaaaggctattggcaagttgttatggacagtcttaacgttggatcttccttaaaactatgttcagatggatgtcaaattatcgtagacactggtaccagtttgatcgcgggacca

SEQ ID NO: 1662 - DNA, 403 bp, Diabrotica virgifera
  Clone ID: LIB3026-017-Q1-E1-C10
aaaggcactgtgcaagaaccagtcttctccttttacttgaacagagaccctgatggagaagttggtggtgaattgttgcttggtggatcagacccaaactattacaaaggtgactttacttatgtagatgtttcagctaaaggctattggcaagttgttatggacagtcttaacgttggatcttccttaaaactatgttcaaatggatgtcaaattatcgtagacactggtaccagtttgatcgctggacctagcgctgaagtcgaaaagttacataaagaaataggcgctttttcattccttaatggtgaatatataattgattgcagcaaaattgatcaactacccgaaattagttttgtttttggaggaaaagaattcacactttccggaaatgattatg

SEQ ID NO: 1663 - DNA, 392 bp, Diabrotica virgifera
  Clone ID: LIB149-032-Q1-E1-B4
agataccctgaaatttccgttaacggaattactccagtatttaattcactggttgaacaaggcgctgtgcaagaaccagtcttctccttttacttgaacagagaccctgatggagaagttggtggtgaattgttgcttggtggatcagacccaaactattacaagggtgactttacttatgtagatgtttcagctaaaggctattggcaagttgttatggacagtcttaacgttggatcttccttaaaactatgttcaaatggatgtcaaattatcgtagacactggtaccagtttgatcgctggacctagcgctgaagtcgaaaagttacataaagaaataggcgctttttcattccttaatggtgaatatataattgattgcagcaaaat

SEQ ID NO: 1664 - DNA, 404 bp, Diabrotica virgifera
  Clone ID: LIB150-002-Q1-E1-D9
cccacgcgtccgcccacgcgtccgccacgcgtccgcccacgcgtccgatccatatttttcagtgaggtattacgagaatatctgctgaaatggctgctagaagaatcacgaaaagtgctgttaactgggctgccttaagcgaaaaggtccctgaacatcagcgtgcccagtttttagcgttcaaaactaagtccgacagctatcttaggcgtgtcttagcaaatcctgaacaagccccagccattgattgggcttactataaatccaaagtaccagttgctggaatggtagatgatttccaaaagcaatatggagctttatctattgcattccctgcagacactgtcaaacctcaactggatgctttagaaaaagaaatcaaaagtgatatcgaaaaattcaaa

SEQ ID NO: 1665 - DNA, 439 bp, Diabrotica virgifera
  Clone ID: LIB3026-032-Q1-E1-D6
ccacgcgtcagcaactggatgctttagaaaaagaaatcaaaagtgatatcgaaaaattcaaaactgaatccaatgctcgtattgctgagtacagaaagcaattggcccacatcgccagtctaattccatatgatcagatgacattggaagattaccgtgatgcttacccagaagacgctatcgaccccatcaacaagcctacattctggccacacactcccgaggaacaacacgactatgttgacaaagatgcccagcccagccaccattaatactgtaaaggtggtgatgctttcaaatacagtgatttgaataacactttcaataatgataagtttatgaaactatagtgttttttcctgcatttgaaagtatttgtacttgtcatatactaagttctatagttgtgtctactacatttttaattagaatttttttt

SEQ ID NO: 1666 - DNA, 391 bp, Diabrotica virgifera
  Clone ID: LIB149-032-Q1-E1-F6
aacccacgcgtccggaaatcaaaagtgatatcgaaaaattcaaaactgaatccaatgctcgtattgctgagtacagaaagcaattggcccacatcgccagtctaattccatatgatcagatgacattggaagattaccgtgatgcttacccagaagacgctatcgaccccatcaacaagcctacattctggccacacactcccgaggaacaacacgactatgttgacaaagatgcccagcccagccaccattaatactgtaaaggtggtgatgctttcaaatacagtgatttgaataacactttcaataatgataagtttatgaaactatagtgttttttcctgcatttgaaagtatttgtacttgtcatatactaagttctataattgtg

SEQ ID NO: 1667 - DNA, 244 bp, Diabrotica virgifera
  unsure (1)..(244): unsure at all n locations
  Clone ID: pGUT1571
gatcatccatatttttcagtgaggtattacgagaatatctgctgaaatggctgctaaaagaatcacgaaaagtgctgttaactgggctgccttaagcgaaaaggtccctgatcatcancgtgcccagtttttagcgttcaaaactaagtccgacagctatcttacgcgtgtcttatcagatcctgaacgagccccagccattgattgggcttactatatatccaaattaccagtggctggattg

SEQ ID NO: 1668 - DNA, 435 bp, Diabrotica virgifera
  Clone ID: LIB150-018-Q1-E1-E9
caagttctagccccaacgagagaattagctcaacagatccaacaagtcgccagcgattttggaaattccacatacgttagaaatacctgcatattcggaggagcccccaaaggaccccaagcgcgtgacttagaaagaggagttgaaatttgtatagccactcccggtcgtttaatcgatttccttgaaaaaggaaccacaaacttagagagatgtacctacttggtactcgatgaagctgacagaatgttggacatgggtttcgagcctcaaatacgtaagattttggagcagatccggcctgacaggcagactttgatgtggtctgcaacgtggcccaaggaggtcaagaaactagctgcggatttcctgaaagattacgtccagatcaacattgggtccttacagctctctgccaatcacaatattcttcag

SEQ ID NO: 1669 - DNA, 408 bp, Diabrotica virgifera
  Clone ID: LIB150-032-Q1-E1-G7
gcggattagatttagtcggaattgcacaaactggttctggtaaaactcttgcttatatccttccagctatagtacatattaataaccaaccagctatagctaacggagatggacctatagcgctagttctagccccaacgagagaattagctcaacagattcaacaagtcgccagcgattttggaaattccacatacgttagaaatacctgcatattcggaggagcccccaaaggaccccaagcgcgtgacttagaaagaggagttgaaatttgtatagccactcccggtcgtttaatcgatttccttgaaaaaggaaccacaaacttagagagatgtacctacttggtactcgatgaagctgacagaatgttggacatgggtttcgagcctcaaatacgtaagattt

SEQ ID NO: 1670 - DNA, 412 bp, Diabrotica virgifera
  Clone ID: LIB149-048-Q1-E1-H7
gatcaacattgggtctctacagctctctgccaatcacaatattcttcagatcatagacgtttgccaggagtatgagaaggaatttaaactgaaccaacttctccaagaaatagccaataacagtgaccccgactccaaaattctaattttcgtcgaaaccaaaaagaaagctgaagctgtatctagaacggtaagaagaaccggtttgcaagctgtgtgcatgcacggagacaagagccagcaagagagagactttgtactcaatgagttcagaaacggaaaatccacaattttagtcgctacagacgttgcagcaagaggattagatgtggaaggaataaaatatgtagtcaactatgattatcccaattcgtctgaagattacatccacagaataggaagaactggacga

SEQ ID NO: 1671 - DNA, 318 bp, Diabrotica virgifera
  unsure (1)..(318): unsure at all n locations
  Clone ID: LIB150-008-Q1-E1-A3
cccaacgagagaattagctcaccagatccaacaagtcgccagcgattttggaaattccacatacgttagaaatacctgcatattcggacgagcccccaaaggaccccaagcgcgtgacttagaaagaggagttgaaatttgtatagccactcccggtcgtttaatcgatttccttgaaaaaggaaccacaaacttagagagatgtacctacttggtactcgatgaagctgacagaatgttggacatgggtttcgagcctcaaatacgtaagattttggagcagattcggcctgacangcagactttgatgtggtctgc

SEQ ID NO: 1672 - DNA, 454 bp, Diabrotica virgifera
  Clone ID: LIB149-012-Q1-E1-D6
gtccgcccacgcgtccgatggacacagaactcctacggaattttacacaaatgaccaatattctgatttatcaaaatattggggtggcgttgacttaggacagctaacaaatctgggaaaacaacagcactatgagctaggacaatttactaggaaaagatatagtaaatggctcccaaagagatatgacaaagctgatttctacgcccagactacagatgtagatcgaacacatatgtcaggacaaacaaatctatactcactatatccagccaaagaagatcaagtatggagaaggcaaactgattggcagcccattccactacatccagccgattccaatatctgggaaacattccccagctgtgctgcttatacaacagaattagccaaagttcttgtgtctgatttgtttaaagctatagataaacaatatgcagaggtatattcatat

SEQ ID NO: 1673 - DNA, 426 bp, Diabrotica virgifera
  Clone ID: LIB149-026-Q1-E1-G7
agtcagcttcagctcttagcccttttattttcagccgcgtttgctgcatcagatctatctgatttggatcaagctgcatccgatcagttggtggctgtcgttcagttatttagacatggacacagaactcctacggaattttacacaaatgaccaatattctgatttatcaaaatattggggtggcgttgacttatgacagctaacacatctgggaaaacaacagcactatgagctaggacaatttactaggaaaagatatagtaaatggctgccaaagagatatgacaaagctgatttctacgcccagactacagatgtagatcgaacacatatgtcaggacaaacaaatctatactcactatatccagccaaagaagatcaagtatggagaaggcaaactgattggcagcccattccactacat

SEQ ID NO: 1674 - DNA, 360 bp, Diabrotica virgifera
  Clone ID: LIB149-033-Q1-E1-E4
cggaatttttcacaaatgacaaatattctgatttatcaaaatattggggtggcgttgacttaggacagctaacaaatctgggaaaacaacagcactatgagctaggacattttactaggaaaagatatagtaaatggctgccaaagagatatgacaaagctgatttctacgcccagactacagatgtagatcgaacacatatgtcaggacaaacaaatctatactcactatatccagccaaagaagatcaagtatggagaaggcaaactgattggcagcccattccactacatccagccgattccaatatctgggaaacattccccagctgtgctgcttatacaacagaattagccaaag

SEQ ID NO: 1675 - DNA, 330 bp, Diabrotica virgifera
  Clone ID: pGUT4242
attgaaaataacatagatatatacgaactatattttattacatttaacttgcttgttccagcacacattctttagtatagtcggtgggcaacatatcacttaacagcgatttgaacttttgtaatgggcatgaaagctcgcattgagatatatgatactctttcggtgtatccttccagaagtttctatacgttattttaatacttgaatttgcataaagttcaaatataagggtagctccaaaaccaggtttcaaagtctctattaagttaagacttcttaaaatatgaactatcgttaagtcatgggctgcatataaatacaatttcg

SEQ ID NO: 1676 - DNA, 450 bp, Diabrotica virgifera
  Clone ID: LIB3026-012-Q1-E1-E10
gaggatggcacattttatgaatttggagaggacattccagagatgccggaaagaaagatgacagaccaaatcaacaagcctatcatgctctgtagattccctgccaacatcaaatctttctacatgagcaaatgtccagaggatgccagattgacggaaagtgttgatgttttgttgccaaatgtaggtgaaattgtgggaggatcaatgaggatatgggatctagaagagctattagcgggatacaaacgtgaggaaatagatccagctccatatttctggtacacagaccaacgtaaatatggtacatgtccacatggaggttatggtttgggtttggagagatttgtatgttggctgctcaacagatatcatattagagaagtctgtttgtacccgcggtatctgcatcattgtaaaccttaaggtgattcagctaaatatacagac

SEQ ID NO: 1677 - DNA, 391 bp, Diabrotica virgifera
  unsure (1)..(391): unsure at all n locations
  Clone ID: LIB150-036-Q1-E1-A11
atttaaaactaataaaatatttaaatattaattttatacttagtgaaaagactgtttttatttaaataatagaaaaatcaaacatgtcaggagagaataaagaaccgatatacacttctgatagccaagggagtgacgaaaatggggacggcagcgaacaaaagccctttaagactattctacaagcaatgcggaaagctggagctgaaccttttccagttatttatgtagatggaaaagaagagggagtcaagtatgaaccagctgccaagtcacaattgaagaaaatacagaaaatttgggtaagggagagctataaacaggctgacanatccaaaaaagaagaggaagatgcagaaaagaggtccaaaaacttggaggatgccaaaaa

SEQ ID NO: 1678 - DNA, 409 bp, Diabrotica virgifera
  Clone ID: LIB149-048-Q1-E1-E10
caataaagttgcatcatttaaaattaataaaatatttaaatattaattttatacgtagtgaaaagactgtttttatttaaataatagaaaaatcaaacatgtcaggagagaataaagaaccgatatacacttctgatagccaagggagtgacgaaaatggggacggcagcgaacaaaagccctttaagactattctacaagcaatgcggaaagctggagctgaaccttttccagttatttatgtagatggaaaagaagagggagtcaagtatgaaccagctgccaagtcacaattgaagaaaatacagaaaatttgggtaagggagagctataaacaggctgacaaatccaaaaaagaagaggaagatgcagaaaagaggtccaaaaacttggaggatgccaaaaagat

SEQ ID NO: 1679 - DNA, 401 bp, Diabrotica virgifera
  Clone ID: LIB150-048-Q1-E1-G10
gcaaatatcaatttccaataaagttgcatcatttaaaattaataaaatatttaaatattaattttatacgtagtgaaaagactgtttttatttaaataatagaaaaatcaaacatgtcaggagagaataaagaaccgatatacacttctgatagccaagggagtgacgaaaatggggacggcagcgaacaaaagccctttaagactattctacaagcaatgcggaaagctggagctgaaccttttccagttatttatgtagatggaaaagaagagggagtcaagtatgaaccagctgccaagtcacaattgaagaaaatacagaaaatttgggtaagggagagctataaacaggctgacaaatccaaaaaagaagaggaagatgcagaaaagaagtccaaa

SEQ ID NO: 1680 - DNA, 461 bp, Diabrotica virgifera
  Clone ID: LIB3026-032-Q1-E1-D9
ttcgccgggccacccacgcgtacgaaaaaattacgtatgatttcgttcctggtaattgctcagaatattacgaatgtgaccacggactcagatatcttgaaacttgtcctcacaatagattatggaatcatatcaaaaactattgtgattttcctgaagaagttgactgcagtcgtgctccagttacaactaccacatctggaccttctactaccccaaattcaatttgcgatggccaaaaagacggaacctttttcgcagatgaagatgattgtgctaaatattacgaatgtgtacgaggacaggctattgaatttacatgcccacctggtactttgtgggacgaagaagaacttacttgcgactttcctgatagagttgattgtaaagtaacaccaaagagtttttaaatttgtatttactgtttttagcaaaactcagcaacttttgtcgaaaattta

SEQ ID NO: 1681 - DNA, 426 bp, Diabrotica virgifera
  Clone ID: LIB149-035-Q1-E1-B9
gattaccgtgcatacccatatgactgtcacaaatatatagcgtgtgaagataattctctggtagtcctggactgtcccaacattttcatttggaatgaagatcgcaaagcttgtgactttgctgcaaacaccgaatgccaccaaattccatttccagaacccgactgctcggatggcaaaaattcttactggagatatccctttgattgtgccctattctgggagtgtatgaataaccaattgtatcttttgccatgccctgatgattatttctgggatgacgccattaaaaaatgtgatattaatgaagctgttgattgctctggcatcattcctaatccaaatagcacaactactcaagctccagtcaccacaactagtgaaccttttccatatacaactcctgaaatgatctgtactgatgac

SEQ ID NO: 1682 - DNA, 448 bp, Diabrotica virgifera
  Clone ID: LIB149-012-Q1-E1-E5
aatctttgtaccctactagtggtattatgttcagctcattattgtacagcatattacaatgcctcccacgaatcatataaacttccatgtaaccaggaggaattagattaccgtgcatatccatatgactgtcacaaatatatagcatgtgaagataattctctggtagtcctggactgtcccaacattttcatttggaatgaagatcgcaaagcttgcgactttgctgcaaacaccgaatgccaccaaattccatttccagaacccgactgctcggatggcaaaaattcttactggagatatccctttgattgtgccctattctgggagtgtatgaataaccaattgtatcttttgccatgccctgatgattatttctgggatgacgccattaaaaaatgtgatattaatgaagctgttgattgctctggcatcattcctaatccaa

SEQ ID NO: 1683 - DNA, 436 bp, Diabrotica virgifera
  unsure (1)..(436): unsure at all n locations
  Clone ID: LIB149-015-Q1-E1-D8
caattgtatcttttgccatgccctgatgattatttctgggatgacgccattaaaaaatgtgatattaatgaagctgttgattgctctggcatcattcctaatccaaatagcacaactactcaagctccagtcaccacaactagtgaaccttttccatatacaactcctgaaatgatctgtactgatgacaacacctatttcccttacatttttgattgctcaaagtactacgaatgttccaacggaataccagttctaatggattgcccagcaggcgagttatggaatattatcataaacaactgcgattgggccgataatgttgattgctcttacgttgtttacacaagttgcaaacctacatctgctgccccagatacttccacctcagctacgcanagcactccttcacaagtcccacgggatcaactgctgc

SEQ ID NO: 1684 - DNA, 348 bp, Diabrotica virgifera
  unsure (1)..(348): unsure at all n locations
  Clone ID: LIB149-005-Q1-E1-G1
acccacgcgtccgtgaagcttctatctatactggtattactctttctgaatacttccgtgatatgggttacaacgtatctatgatggctgactcgacatcacgttgggccgaagctttgagagaaatttcaggtcgtttggctgaaatgcctgccgattccggttatccggcttacttaggtgcccgtttggcttccttctacgaacgtgctggtcgcgttaaatgtttaggtaatccagacagagaaggatccgtttcaattgtangagccgtatcacctcctggtggtgatttctcagatcctggttacactgctactcttggtattgtacaagtgttctggggtt

SEQ ID NO: 1685 - DNA, 377 bp, Diabrotica virgifera
  Clone ID: LIB150-049-Q1-E1-F10
ccgggccgacccacaactcaatgatgaattattataggaaactgaatttgatggtgatcgtaccaaatatactatgttgcaagtatggcctgtacgtcaagcaaggccagtcagtgaaaaatgacctgccaaccatcctctgcttacaggacagcgtgtacttgatgctcttttcccatgtgtacagggtggtactactgccattcccggagctttcggttgtggaaaaactgtaatttcacaatctctttccaaatattccaactctgatgtcattatctacgtcggttgcggagaaagaggtaacgagatgtctgaagtattgagagatttccctgaattgactgttgaaattgacgggcacactgaatctatta

SEQ ID NO: 1686 - DNA, 400 bp, Diabrotica virgifera
  Clone ID: LIB149-026-Q1-E1-C12
agatttcttgcaacaaaactcatactcttcttatgacagattctgtccattctataaaactgtcggtatgttgagaaacatgatcggtttgtacgacatggcgagacacgctgtagaatcaaccgcacaatcagaaaataagatcacttggaacgtaataagagattcaatgagtggaattttatatcaacttagcagtatgaaatttaaggatcccgtaaaagatggtgaacctaaaatcaaggcacattttgatcaattatatgaagatattcagcaagccttcagaaacttagaagattaaatctttttaaggaaattttcctattttgttcatcaatgtaagtttaaaaatatatcgatatttatcaaactgaataataaggcctctagccctcac

SEQ ID NO: 1687 - DNA, 402 bp, Diabrotica virgifera
  Clone ID: LIB149-030-Q1-E1-D11
gacccaagcgtcagatctcttattacgttccaagtgattcaatgagtggaattttagatcaacttagcagtatgaaatttaaggatcccgtaaaagatggtgaagctaaaatcaaggcagattttgatcaattatatgaacatattcagcaggccttcagaaacttagaagattaaatcttgttaaggaaattttcctattttgttcatcagtgtaagttcaaaaatagagcgatattcatcaaagagaatatcaaggcctcaagccctcacttcagtgaatattaatatggccgtactaatcagaataactaacgataggttttctctattttgatattatcccgtacataacaggttatgtaaattgttgactatgtgtagagtgcttttgggtcagggt

SEQ ID NO: 1688 - DNA, 477 bp, Diabrotica virgifera
  unsure (1)..(477): unsure at all n locations
  Clone ID: LIB3026-009-Q1-E1-E4
ccacgcgtccggcaaaacaaccaaaatgtctgataacgaagttgatgatgcacccccagccccacaagtacaatctggtgggcccatggacgtaaatcaagcactccaagaggtcttgaaaacagcccttattcacgatggagtcgttcatggtttgcatgaggctgctaaagctttggataaaagacaagccgtactttgtgtgctcgctgaaaactgtgacgagcctatgtataagaaactagtctcagctttatgctcagaacatcaaattcctcttattaaggtagacaataacaaaaaattaggcgagtggtcagggttatgcaaaattgataacactggtaaagcacgaaaggtcgttggctgttcctgtgtagtcattanggactatggagaagaatccccagccctagatgttcttanggattatcttaagaatgccaagtaatgtaacacattttttattcaataaaa

SEQ ID NO: 1689 - DNA, 422 bp, Diabrotica virgifera
  unsure (1)..(422): unsure at all n locations
  Clone ID: LIB3026-022-Q1-E1-G12
tccacccgcccgtccggaacaatctggtgggcccatggacgtaaatcaagcactccaagaggtcttgaaaacagcccttattcacgatggagtcgttcatggtttgcatgaggctgctaaagctttggataaaagacaagccgtactttgtgtgctcgctgaaaactgtgacgagcctatgtataagaaactagtctcagctttatgctcagaacatcaaattcctcttattaaggtagacaataacaaaaaattaggcgagtggtcagggttatgcaaaattgataacactggtaaagcacgaaaggtcgttggctgttcctgtgtagtcattanggactatggagaagaatccccacccctagatgttcttanggaatatcttaagaatgctaagtaatgtcacacattttttatttaat

SEQ ID NO: 1690 - DNA, 403 bp, Diabrotica virgifera
  Clone ID: LIB149-023-Q1-E1-G1
gataacgaagttgatgatgcacccccagccccacaagtacaatctggtgggcccatggacgtatatcaagcactccaagaggtcttgaaaacagcccttattcacgatggagtcgttcatggtttgcatgaggctgctaaagctttggataaaagacaagccgtactttgtgtgctcgctgaaaactgtgacgagcctatgtataagaaactagtctcagctttatgctcagaacatcaaattcctcttattaaggtagacaataacaaaaaattatgcgagtggtcagggttatgcaaaattgataacactggtaaagcacgaaaggtcgttggctgttcctgtgtagtcattaaggactatggagaagaatccccagccctagatgttcttagggattatc

SEQ ID NO: 1691 - DNA, 320 bp, Diabrotica virgifera
  Clone ID: LIB3026-018-Q1-E1-F7
agcccacgcgtccgtgcacccccagccccacaagtacaatctggtgggcccatggacgtaaatcaagcactccaagaggtcttgaaaacagcccttattcacgatggagtcgttcatggtttgcatgaggctgctaaagctttggataaaagacaagccgtactttgtgtgctcgctgaaaactgtgacgagcctatgtataagaaactagtctcagctttatgctcagaacatcaaattcctcttattaaggtagacaataacaaaaaattaggcgagtggtcagggttatgcaaaattgataacactggtaaagcacg

SEQ ID NO: 1692 - DNA, 441 bp, Diabrotica virgifera
  Clone ID: LIB150-016-Q1-E1-D5
cagacgcgtgggcgctaaaattgcttgttggtcgcagacacttatggatcgttctgaccttcatttttacttgacctggttaaaagaccaactaaaaactcagaacaacgaatacatccaatcggttgcaagatgccttcaaatgatgctccgaattgacgactaccgttttgccttcgtgtccgtcgatggaatatccactctgttgtcggtactctctggaagagtaaatttccaagttcagtatcagctgatattctgcttgtgggtactcactttcaacccgttgttagccgaaaagatgaacaaattcaacgttattcctatattggcagatattttgagcgattcggtaaaggagaaagtaaccagaattattttagctgttttcaggaatttgatcgaaaaacccgaagatcaacaagtttcaaaagaacattg

SEQ ID NO: 1693 - DNA, 447 bp, Diabrotica virgifera
  Clone ID: LIB3026-006-Q1-E1-D11
atggtgcaatgcaaagtattgaaacaattggccattttagaacagcgcaagttcgatgatgaagatgtgacagctgatgtcgaatttctaactgaaaaactacagagttctgttcaggatctgagttccttcgatgaatattcaactgaagtcaaatctggacgtttggaatggtctccagtacacaagagcaagttctggcgggaaaatgcgcagcgcctcaacgagaaaaactacgaattactccgtattctcattcatttgttagaaaccagcaaggaccccttggtattgagcgtagctagtttcgatattggagagtatgttcgccattatcctcgcggcaaacacataatcgagcagttgggaggaaagcaattagttatgcaactcttagcccacgaagatcccaatgtacgatatgaagctctgttgggagtccaaaaa

SEQ ID NO: 1694 - DNA, 341 bp, Diabrotica virgifera
  Clone ID: LIB149-020-Q1-E1-B7
agggatttattaccaacatgacttctaggatcatcgctaaaattgcttgttggtcgcagacacttatggatcgttctgaccttcatttttacttgacctggttaaaagaccaactaaaaactcagaacaacgaatacatccaatcggttgcaagatgccttcaaatgatgctccgaattgacgactaccgttttgccttcgtgtccgtcgatggaatatccactctgttgtcggtactctctggaagagtaaatttccaagttcagtaccagctgatattctgcatgtgggtactcactttcaacccgttgttagccgaaaagatgaacaaattcaacgtt

SEQ ID NO: 1695 - DNA, 399 bp, Diabrotica virgifera
  Clone ID: LIB149-032-Q1-E1-C1
agggagttgggtcagagttaattttttaggtcttctattaaaagggttgtaattttaatttaaaaaaatggcatccaatttagttgcgggagcaaatcctaaaatacaggatataatgtcgtctttggacgatgacaaaacagatatgttggctgctacaagtgtattgcagcaaagagctacagatataagaaatcaacatgtaaactggcaatcctatttccagtcacaaatgatttcgcaggaagactacaacttcatagtagcttttgatgtgactgatagtgcaaaaagagaagctctcctgaaaagcgacagaaaccaatgtgctcaaacattgttgaaccttttggggcatgtatccaaggaccaaactctgcagtacattttagttttggg

SEQ ID NO: 1696 - DNA, 396 bp, Diabrotica virgifera
  Clone ID: LIB150-043-Q1-E1-G10
aggttggtggaaaattggaagacacaacattagttaaaggtgtagttattgacaaaacaatgtcccatccacaaatgcccaaagaactaaaagatgtaaaattggctattctcacctgcccgttcgaaccaccaaaaccaaagaccaaacataagttggatgtcagcagtgtggaagattataaggaactaagacagtatgaacaagaaaagttcaaagaaatcgttggtttggtaaagaaagctggagctacattagcaatttgtcaatggggcttcgatgatgaagccaatcacttattgttacaacaagaattaccagctgtaagatgggttggaggtccagaaattgaacttatagcaatagctactgggggtaagatagttccccgttttg

SEQ ID NO: 1697 - DNA, 425 bp, Diabrotica virgifera
  unsure (1)..(425): unsure at all n locations
  Clone ID: LIB150-035-Q1-E1-E7
aaaaataaaattttaattaatctggaacatctcccaattttttagaaaacttacattttcaatatgagtgctataccaggaagtattgcatttgatgaatatggacgacccttcataattcttagagaccaagataagcaaaagaggttgaccgggatagatgcacttaagtcacatattttggcagcgagacaaatcgctcaaactataagcacttctttgggtcccaaaggtttagacaagatgatggtgtcacctgacggtgaagtaacagtcactaatgatggtgctactattttgaaaatgatggatgttgaacatgaagtagctaaattgctagtacagctatcacagtcncaagatgatgaaattggtgatggtaccacaggtgttgtagttttggctggtgccctgttagagcaagc

SEQ ID NO: 1698 - DNA, 429 bp, Diabrotica virgifera
  Clone ID: LIB149-007-Q1-E1-G2
cccacgcgtccggtcactttcatgggagtagccagttcgaaacaaaaataaaattttaattaatctggaacatctcccaattttttagaaaacttacattttcaatatgagtgctataccaggaagtattgcatttgatgaatatggacgacccttcataattcttagagaccaagataagcaaaagaggttgaccgggatagatgcacttaagtcacatattttggcagcgagacaaatcgctcaaactataagcacttctttgggtcccaaaggtttagacaagatgatggtgtcacctgacggtgaagtaacagtcactaatgatggtgctactattttgaaaatgatggatgttgaacatgaagtagctaaattgctagtacagctatcacagtcccaagatgatgaaattggtgatggtaccac

SEQ ID NO: 1699 - DNA, 399 bp, Diabrotica virgifera
  unsure (1)..(399): unsure at all n locations
  Clone ID: LIB150-003-Q1-E2-H2
ggtctagggttccgggcccgtcagttcgaaacanaaataaaattttaattaatctggaacatctcccaattttttagaaaacttacattttcaatatgagtgctataccaggaagtattgcatttgatgaatatggacgacccttcataattcttagagaccaagataagcaaaagaggttgaccgggatagatgcacttaagtcacatattttggcagcgagacaaatcgctcaaactataagcacttctttgggtcccaaaggtttagacaagatgatggtgtcacctgacggtgaagtaacagtcactaatgatggtgctactatattgagaatgatggatgttgaacatgaagtcgctacattgcgagtacagctatcacagtcgcaagatgatg

SEQ ID NO: 1700 - DNA, 403 bp, Diabrotica virgifera
  Clone ID: LIB149-006-Q1-E1-E8
gttgtattccttaaacaactgtactctggtctacttttggtaactggaccttttggaattaatgcctgtccattgagacgtattagccaacgttatgtaattgctacatctaccaaaattgacgttagtggagtacagctgccagaaaacctaaatgatgaatattttgcaagaaagaggcagaagagatcaaagaaagaagaaggtgatattttccaatccaaaaaagaaggttacaaagtaagcgaagataggaaagctgaccaaaagaaagtagatacacaagttctggctgcaatcaagaagcactcagaccgcaaagtacttttagcttatttgtcagccatgtggggactcagatcatcacagtacccacacagattgaagttttagataggatacc

SEQ ID NO: 1701 - DNA, 424 bp, Diabrotica virgifera
  Clone ID: LIB149-006-Q1-E1-G2
agttgaattccttaaacaactgtactctggtctacttttggtaactggaccttttgggattaatgcctgtccattgagacgtattagccaacgttatgtaattgctacatctaccaaaattgacgttagtggagtacagctgccagaaaacctaaatgatgaatattttgcaagaaagaggcagaagagatcaaagaaagaagaacgtgatattttccaatccaaaacagaaggttacaaagtaagcgaagataggaaagctgaccaaaagaaagtagatacacaagttctggctgcaatcaagaagcactcagaccgcacagtacttttagcttatttgtcagccatgtggggactcagatcatcacagtacccacacagattgaagttttagataggataccataagttgtttatcttttga

SEQ ID NO: 1702 - DNA, 358 bp, Diabrotica virgifera
  unsure (1)..(358): unsure at all n locations
  Clone ID: pGUT1250
agctggttctcacaaaggaaagagggttgtattccttaaacaactgtactctggtctacttttggtaactggaccttttggaatcaatgcttgcccattgaggcgcattanccaacgatatgtaattgctacatctaccaaaattgacgttagtggagtacagctgccagaaaaccttaatgatgaatattttgcaagaaagaagcagaagagatccangaaagaaaaaagtgatatnttccaatccaaaaaagaaagttacaaagtaagtgaaaatangaaagctgaccaaaaaaaagtaaatacacnagttctggctgcaatcaaaaaacactcagaacgcanagtacttttagct

SEQ ID NO: 1703 - DNA, 357 bp, Diabrotica virgifera
  Clone ID: LIB3026-003-Q1-E1-B2
cgttagtggagtacagctgccagaaaacctaaatgatgaatattttgcaagaaagaggcagaagagatcaaagaaagaagaaggtgatattttccaatccaaaaaagaaggttacaaagtaagcgaagataggaaagctgaccaaaagaaagtagatacacaagttctggctgcaatcaagaagcaaggagaccgcaaggtacttttaggggaggtgtcagcgatgtggggactcagatcatcggagcgcccacacagattgaagttttagataagagataccataaattgtttatcttttgacttgtatagagaggaaagtgataaataaattatggatttataaatgaggttttt

SEQ ID NO: 1704 - DNA, 437 bp, Diabrotica virgifera
  Clone ID: LIB3026-005-Q1-E1-D12
caaaaatccgtattttcgatttgggtaagaagaaggcttccgtagaagactttcctctatgtgtacatttagtttctgacgaatatgaacagctaagttctgaagcattagaagcaggacgtatctgttgtaacaaatatttggtaaagaactgtggtaaagatcaattccacattcgtatgagactccatcctttccatgttatcagaatcaacaagatgttgtcatgtgctggagctgatagactccagactggaatgagaggagcttttggcaagccccaaggtacagttgctcgtgtgcgcattggtcaacctattatgagtgtacgctctagtgatcgtttcaaggctgcagttattgaggctctccgtcgtgccaagttcaagttcccaggtcgtcaaaagatctatgtatcaaagaaatggggattcacc

SEQ ID NO: 1705 - DNA, 387 bp, Diabrotica virgifera
  Clone ID: LIB149-036-Q1-E1-C7
agaaagaactgtggtaaagatcaattccacattcgtatgagactccatcctttccatgttatcagaatcaacaagatgttgtcatgtgctggagctgatagactccagactggaatgagaggagctttcggcaagccccaaggtacagttgctcgtgtccgcattggtcaacctattatgagtgtacgctctagtgatcgtttcaaggctgcagttattgaggctctccgtcgtgccaagttcaagttcccaggtcgtcaaaagatctatgtatcaaagaaatggggattcaccaagtatgaacgtgaacaatatgaaaacttaaaacaacaaggtagattagctcctgatggttgcaatgttcaatacaggccagagcacggacct

SEQ ID NO: 1706 - DNA, 393 bp, Diabrotica virgifera
  Clone ID: LIB3026-003-Q1-E1-B1
cgacctgcgaggtgctaccgttattgtaaaaacaaaccctaccccaaaagtcgtttctgcagaggtgtcccagatccaaaaatccgtattttcgatttgggtaagaagaaggcttccgtagaagactttcctctatgtgtacatttagtttctgacgaatatgaacagctaagttctgaagcataggcagcacggcgtatctgttgtggcaggggggtggggaagaactgtggtaaggattagttgaagattcgtatgagactccatcctttccatgttatcagaatcaacaggatgttgtcatgtgctggagctgatagactccagactgggatgagaggagctttcggaaggcccaaggtacagttgctcgtgtccgcattggtcaaccta

SEQ ID NO: 1707 - DNA, 421 bp, Diabrotica virgifera
  Clone ID: LIB149-033-Q1-E1-E1
acccacgcgtccgcccacgcgtccgcccacgcgtccggttgtagtgatatatttttataaactaaatactgaatacgtaataacgtatatgtgttagttttttaatctacatatttattttctattttcaggccaaaatgggtagacgacctgcgaggtgctaccgttattgtaaaaacaaaccctaccccaaaagtcgtttctgcagaggtgtcccagatccaaaaatccgtattttcgatttgggtaagaagaaggcttcagtagaagactttcctctatgtgtacatttagtttctgacgaatatgaacagctaagttctgaagcattagaagcaggacgtatctgttgtaacaaatatttggtaaagaactgtggtaaagatcaattccacattcgtatgagactccatcctttcca

SEQ ID NO: 1708 - DNA, 426 bp, Diabrotica virgifera
  Clone ID: LIB149-035-Q1-E1-B8
cttcttcaaaaaaagtatacacaattttttgtatgagtcagaaggtagaaaaaccagttctatccggtcaacgcatcaagaccagaaaaagagatgaaaaagagaggtatgatccaactgggtttagggatgcaataatctctggactcgataaatgttctaacgattttgaagctatatctcgatatttggacagtgctggtaacaaattagattatcgtcgctatggcgaatgtctcttcgatgtactcatcgctgggggcatcctggttccaggaggtacactatcacaggaaggtgatggtccgtacagaacggaggcatgtatttttaacacaccggacgaaatcaatatggacataatgaagaactgggaacaggtgttcatcaaactgatgcgtcgctataagtatttggaaaaacttt

SEQ ID NO: 1709 - DNA, 428 bp, Diabrotica virgifera
  Clone ID: LIB149-014-Q1-E1-C7
gtgcttcttcaaaaaaagtatacacaattttttgtatgagtcataaggtagaattaccagttctatccggtcaacgcatcaagaccagaaaaagagatgaaatagagaggtatgatccaactgggtttagggatgcaataatcactggactcgataaatgttctaacgattttgaagctatatctcgatatttggacagttctggtaacaaattagattatcgtcgctatggcgaatgtctcttcgatgtactcatcgctgggggcatcctggttccaggatgtacactatcacaggaaggtgatggtccgtacagaacggaggcatgtatttttaacacaccggacgaaatcaatatggacataatgacgaactgggaacaggtgttcatcaaactgatgcgtcgctataagtatttggaaaaactt

SEQ ID NO: 1710 - DNA, 419 bp, Diabrotica virgifera
  Clone ID: LIB149-007-Q1-E1-A1
catattctgttgtgaagtgtgcttcttcaaaaaaagtatacacaattttttgtatgagtcagaaggtagaaaaaccagttctatccggtcaacgcatcaagaccagaaaaagagatgaaaaagagaggtatgatccaactgggtttagggatgcaataatctctggactcgataaatgttctaacgattttgaagctatatctcgatatttggacagtgctggtaacaaattagattatcgtcgctatggcgaatgtctcttcgatgtactcatcgctgggggcatcctggttccaggaggtacactatcacaggaaggtgatggtccgtacagaacggaggcatgtatttttaacacaccggacgacatcaatatggacataatgaaaaactgggaaaacgtgttcatcaaactgaag

SEQ ID NO: 1711 - DNA, 408 bp, Diabrotica virgifera
  Clone ID: LIB150-028-Q1-E1-G10
cccacgcgtccgcccacgcgtccgcccacgcgtccgttctgttgtgaagtgtgcttcttcaaaaaaagtatacacaattttttgtatgagtcagaaggtagaaaaaccagttctatccggtcaacgcatcaagaccagaaaaagagatgaaaaagagaggtatgatccaactgggtttagggatgcaataatctctggactcgataaatgttctaacgattttgaagctatatctcgatatttggacagtgctggtaacaaattagattatcgtcgctatggcgaatgtctcttcgatgtactcatcgctgggggcatcctggttccaggaggtacactatcacaggaaggtgatggtccgtacagaacggaggcatgtatttttaacacaccggacgaaatcaatat

SEQ ID NO: 1712 - DNA, 420 bp, Diabrotica virgifera
  Clone ID: LIB149-048-Q1-E1-A7
acaagatcaccatcaccaatgataaaggtcgtctcagcaaagaagacattgaaagaatggtcaacgatgcagaaaaataccgtaacgaagatgataagcaaaaggctaccatctctgccaagaacgtcctcgaatcatactgtttcaacatcaagagcaccatggaagatgacaaaatcaaggacaagatcagcgaaagtgacaaaactaccgtcatggagaaatgcaacgaggttattgcttggttggatgctaaccaattagccgacaaggaagaatatgaacacaaacaaaaggagctcgaaaacatctgcaaccccatcatcaccaagttgtaccaaggtgccggtggagctccaggtggcatgcccggtggtttcccaggtggagcagctccaagagctgcaagggccgctggaa

SEQ ID NO: 1713 - DNA, 370 bp, Diabrotica virgifera
  Clone ID: LIB150-038-Q1-E1-F7
aaccacgcgtccgaaataagacattgaaagaatggtcaacgatgcataaaaataccgtaacgaagatgataagcaaaatgctaccatctctgccaagaacgtcctcgaatcatactgtttcaacatcaagagcaccatggaagatgacaaaatcaaggacaagatcagcgaaagtgacaaaactaccgtcatggagaaatgcaacgaggttattgcttggttggatgctaaccaattagccgacaaggaagaatatgaacacaaacaaaaggagctcgaaaacatctgcaaccccatcatcaccaagttgtaccaaggtgccggtggagctccatgtggcatgcccggtggtttcccaggtggagcatct

SEQ ID NO: 1714 - DNA, 426 bp, Diabrotica virgifera
  Clone ID: LIB3026-034-Q1-E1-H11
tgtttcaacatcaagagcaccatggaagatgacaaaatcaaggacaagatcagcgaaagtgacaaaactaccgtcatggagaaatgcaacgaggttattgcttggttggatgctaaccaattagccgacaaggaagaatatgaacacaaacaaaaggagctcgaaaacatctgcaaccccatcatcaccaagttgtaccaaggtgccggtggagctccaggtggcatgcccggtggtttcccaggtggagcagctccaggagctgcaggcgccgctggaggtgctggaccaaccattgaagaagtcgattaaactattcattccattttttaaacttttgttaaccgttgtgcagtattacttgcagacaaagctttttaaaattactttttttacacaatttttcaattgttagacaacgttttt

SEQ ID NO: 1715 - DNA, 393 bp, Diabrotica virgifera
  Clone ID: LIB3026-028-Q1-E1-H4
acgtcgggtcaaacgtccgggttattgcttggttggatgctaaccaattagccgacaaggaagaatatgaacacaaacaaaaggagctcgaaaacatctgcaaccccatcatcaccaagttgtaccaaggtgccggtggagctccaggtggcatgcccggtggtttcccaggtggagcagctccaggagctgcaggcgccgctggaggtgctggaccaaccattgaagaagtcgattaaactattcattccattttttaaacttttgttaaccgttgtgcagtattacttgcagacaaagctttttaaaattactttttttacacaatttttcaattgttagacaacgtttttggtaacagttcaaaaattactgcaataagtacgttcgttc

SEQ ID NO: 1716 - DNA, 368 bp, Diabrotica virgifera
  Clone ID: LIB149-040-Q1-E1-E7
acccacgcgtccgcccacgcgtccgacgagtccctctgcgatcttaaatatatgggtcaatgcatcgatgaaacattaaggaaatatccaccaattccttttctcaccagagaatgttctcaagattaccagatacctgagacaaacatagtagttgaaaaaggcacaagagtcgtcatacctaccataggtattcactatgatgaagaatattatgataatccagatgtattcgatccagaacgattttcagaagagaacagaaagaacattattccatacacatatgttccttttggagaaggccctaggttatgtttaggtatgaggtttggcatcattcaagtaaaagtaggtatcatgacagt

SEQ ID NO: 1717 - DNA, 434 bp, Diabrotica virgifera
  Clone ID: LIB149-007-Q1-E1-F1
ctctaccaaaaatggaaatactcctattggaggaccagaaatgtcttccacttagaacccaaatttccttacggcagtgcccaatcagagctcaaacttaatggtgccatgaccacaatcgtcgaagacctttatcataaagtcaaatcccgcggattaaaatatggaggatactttgagttccttacgcccatgttcgttcctgtcgacttggagctaatacgatgcattatgatgaaagactttccccattttacgaaccatgggacttacgtgaatgaggaagttgatcctttgactggacatctgtttaacttggaagacgagaagtggaaaataatcagggctaaattgacgcctacttttacatcaggtaaaatgaaaatgatgtttcagactatggtaaaatgcaccgaaggtcctcaagaactcct

SEQ ID NO: 1718 - DNA, 413 bp, Diabrotica virgifera
  Clone ID: LIB149-013-Q1-E1-C5
aagggacttacgtaaatgatgaagttgatcctttgactggacatctgtttaacttggaagacgagaaatggaaaatcattagggctaaattgacgcccacttttacatcaggtaaaatgaaaatgatgttccaaactatggtagaatgcaccgaatgtcttcaagaactcttaaaaaaatctgcagcaagcaaagaacccgtagacataaaaagcaatctctcctgtttcaccactgacgtcatcggttctgttgcattcggtgtggatataaacagcatgaagattcccgactcggattttcgaaagttcggtaacagaatattcgtgcatacaactttggtgagactaaaattcatcatcttgtctatctggccacaatggatgattatgaaaagtggtattaaactattt

SEQ ID NO: 1719 - DNA, 391 bp, Diabrotica virgifera
  Clone ID: LIB149-005-Q1-E1-H5
atcaggagtgatcaagattacatgttggatgcatttatggacgtggttaatgaaagaaaaaaagttaaagcacaggatggaaaagcttttgattatattgatattattttggagacgcaagaatctactaacaatgataataaaattggaatgacggaagtgatgtccaatactctgcagtttttcatagcgggaacggaaacaatgagttctgtacaatccttttgcttgtatgaattagctattcatccagaaattcaagacaaagcacgtaaggaagttaatgtagttgtgaagagacatggtgctttaacttatgaggctatacatgacatggagtatgtacatttttgtgtactagaaaccttgcgcaaatatgtgtccctacaaa

SEQ ID NO: 1720 - DNA, 422 bp, Diabrotica virgifera
  unsure (1)..(422): unsure at all n locations
  Clone ID: LIB149-042-Q1-E1-A10
agtttttctgaaccaagtttttcgcttttgaaaacatgggtcgcgtacgtaccaagactgtgaagaaagcctccaaagtcatcattgaaaagtactacacacgtttaactttagatttccacacaaacaagcgtatctgcgaagaaatcgcaattattccaacaaaacctctacgcaacaaaattgccggatttgtcacacatttgatgaaacgtctcaggcactcacaagtgcgtggaatctccatcaaattgcaagaagaagaacgtgaaagacgtgataactacgtaccagaagtctctgctcttgaacatgatatcattgaggttgatccagagaccanagaaatgttgaaaatgcttgatttcaacaacatcagtggattgcagttaacgcaaccagctacaaacacattcaacaga

SEQ ID NO: 1721 - DNA, 426 bp, Diabrotica virgifera
  Clone ID: LIB3026-010-Q1-E1-D11
attttgcttctttgaccacgtttttctgaaccaagtttttcgcttttgaaaacatgggtcgcgtacgtaccaagactgtgaagaaagcctccaaagtcatcattgaaaagtactacacacgtttaactttagatttccacacaaacaagcgtatctgcgaagaaatcgcaattattccaacaaaacctctacgcaacaaaattgccggatttgtcacacatttgatgaaacgtctcaggcactcacaagtgcgtggaatctccatcaaattgcaagaagaagaacgtgaaagacgtgataactacgtaccagaagtctctgctcttgaacatgatatcattgaggttgatccagagaccaaagaaatgttgaaaatgcttgatttcaacaacatcagtggattgcagttaacgcaaccagctacaa

SEQ ID NO: 1722 - DNA, 321 bp, Diabrotica virgifera
  Clone ID: LIB150-025-Q1-E1-A9
ggtcgacccaagagtgcaccttgaccacgtttatctgaaccaagtttttcgcttttgaaaacatgggtcgcgtacgtaccaagactgtgaagaaagcctccaaagtcatcattgaaaagtactacacacgtttaacttttagattccacacagacaagcgtatctgcgaaaaaacgcaaattattcaaaaaaacctccacgcaacaaaattgccggatttgtcacacatttgatgaaacgtctcaagcactcacaagtgcgtggaatctccatcaaattgcaagaagaagaacctggaagacgttataactacgttccaaa

SEQ ID NO: 1723 - DNA, 219 bp, Diabrotica virgifera
  Clone ID: pGUT3276
agaacgtgaaagacgtgataactacgtaccagaagtctctgctcttgaacatgatatcattgaggttgatccagagaccaaagaaatgttgaaaatgcttgatttcaacaacatcagtggattgcagttaacgcaaccagctacaaacacattcaacagacgttcttaattttttttataatgtaattgacatttaaaataaatacaaagtatttgtac

SEQ ID NO: 1724 - DNA, 460 bp, Diabrotica virgifera
  Clone ID: LIB150-010-Q1-E2-F11
ccaacgcgtccgctcatttttgggtgtttctttgattgaacaaaaattacaagcgttttaaattcactaaatttgctttgaaatatacaaatagttaattttaggaaaatatataacctacatacagaatcatgtcttcccgcaaaaccgtaagccgccgtggtaccacaaagaaacgtgcccaaagagccacatccaatgtattcgcaatgtttgatcaggctcagattgctgagttcaaagaagccttcaatatgatcgaccagaaccatgatggttttgtagataaagaagatctgcatgatatgcttgcttcgttaggtaaaaacccaaccgatgactatctagatggcatgatgaacgaggctcctggccctataaacttcaccatgttcctaactctctttggagaacgtctccaaggcacagaccccgaagatgtaatcaaaaatgcctttgg

SEQ ID NO: 1725 - DNA, 406 bp, Diabrotica virgifera
  Clone ID: LIB150-035-Q1-E1-A6
catttttgggtgtttctttgattgaacaaaaattacaagcgttttaaattcactaaatttgctttgaaatatacaaatagttaattctaggaaaatatataacctacatacagaatcatgtcttcccgcaaaaccgtaagccgccgtggtaccacaaagaaacgtgcccaaagagccacatccaatgtattcgcaatgtttgatcaggctcagattgctgagttcaaagaagccttcaatatgatcgaccagaaccatgatggttttgtagataaagaagatctgcatgatatgcttgcttccttaggtaaaaacccaactgatgactatctagatggcatgatgaatgaagctcctggtcccataaacttcaccatgttcttaactctctttggagaacgtctac

SEQ ID NO: 1726 - DNA, 363 bp, Diabrotica virgifera
  Clone ID: LIB150-010-Q1-E1-F11
accacgcgtccgctcatttttgggtgtttctttgattgaacaaaaattacaagcgttttaaattcactaaatttgctttgaaatatacaaatagttaattttaggaaaatatataacctacatacagaatcatgtcttcccgcaaaaccgtaagccgccgtggtaccacaaagaaacgtgcccaaagagccacatccaatgtattcgcaatgtttgatcaggctcagattgctgagttcaaagaagccttcaatatgatcgaccagaaccatgatggttttgtagataaagaagatctgcatgatatgcttgcttcgttaggtaaaaacccaaccgatgactatctagatggcatgatgaacg

SEQ ID NO: 1727 - DNA, 400 bp, Diabrotica virgifera
  unsure (1)..(400): unsure at all n locations
  Clone ID: LIB150-010-Q1-E2-F4
tacggctccgtcagatccaggtcgccccacgcgtccgcaaacgcgtccgctcatttttgggtgtttctttgattgaacaaaaattacaagcgttttaaattcactaaatttgctttgaaatatacaaatagttaattttaggaaaatatataacctacatacagaatcatgtcttcccgcaaaaccgtaagccgccgtggtaccacaaagaaacgtgcccaaagagccacatccaatgtattcgcaatgtttgatcaggctcagattgctgagttcaaagaagccttcaatatgatcgnacagaaccatgatggttttgtagataaagaagatctgcatgatatgcttgcttcgttaggtaaaaacccaaccgatgactatctagatggcatgatgaacg

SEQ ID NO: 1728 - DNA, 386 bp, Diabrotica virgifera
  Clone ID: LIB3026-018-Q1-E1-E8
acgaaaatgggcgatgaaaagaaggccagcgatagcgaacacattaatctcaaagtacttggtcaggataatgcagtggtacaattcaaaatcaaaaaacacaccccattaaaaaaattgatgaccgcctattgtgaacgtgctggtataagcacacaagtagtcagatttagatttgatggcaaccccataaacgacacagatactcctaattctttagagatggatgaaggagacacaattgaagtatatcaacaacagacaggtggtttcttctatcggtttctattcatttaaataatcacactgtattgttcttgtattttcttatttgctaaattaaactagttttaaataagttagttaattttaataaaatttttaat

SEQ ID NO: 1729 - DNA, 379 bp, Diabrotica virgifera
  Clone ID: LIB150-010-Q1-E2-H5
aacggcgaaagattcggcgttgctttgtaaaattgttgtgaatctaccggcatcaaaagcctaaaaagcgtgtagcttttacgtagttatttaactgtagctactttacaaatttcatcaaaatgggcgatgaaaagaaggccagcgatagcgaacacattaatctcaaagtacttggtcaggataatgcagtggtacaattcaaaatcaaaaaacacaccccattaaaaaaattgatgaccgcctattgtgaacgtgctggtataagcacacaagtagtcagatttagatttgatggcaaccccataaacgacacagatactcctaattctttagagatggatgaaggagacacaattgaagtatatcaacaacagac

SEQ ID NO: 1730 - DNA, 369 bp, Diabrotica virgifera
  Clone ID: LIB150-004-Q1-E1-F7
acccacgcgtccgcccacgcgtccgcgactgccggccattatttgtaagcggcgaaagattcggcgttgctttgtaaaattgttgtgaatctaccggcatcaaaagcctaaaaagcgtgtagcttttacgtagttatttaactgtagctactttacaaatttcatcaaaatgggcgatgaaaagaaggccagcgatagcgaacacattaatctcaaagtacttggtcaggataatgcagtggtacaattcaaaatcaaaaaacacaccccattaaaaaaattgatgaccgcctattgtgaacgtgctggtataagcacacaagtagtcagatttagatttgatggcaaccccataaacgacacagatac

SEQ ID NO: 1731 - DNA, 289 bp, Diabrotica virgifera
  Clone ID: LIB3026-027-Q1-E1-C6
caaaagtagtcagatttagatttgatggcaaccccataaacgacacagatactcctaattctttagagatggatgaaggagacacaattgaagtatatcaacaacagacaggtggtttcttctatcggtttctattcatttaaataatcacactgtattgttcttgtattttcttagttgctaaattaaactagttttaaataagtaagttaattttaatatagtttttatttcatgtcaactgaagttacaagagttctgtaagaattcgactagttgtgtttttgga

SEQ ID NO: 1732 - DNA, 394 bp, Diabrotica virgifera
  Clone ID: LIB149-011-Q1-E1-A8
aggacgcgtgggtcagtaacgaagaaaggaatctcctatcagtcgcatataagaatgtggttggtgccagacgatcatcatggagagtaatttcttcaattgaacaaaagactgaaggatcagagaggaaacaacagatggctcgagaatatagagaaaaagttgaaaaagagttacgagaaatctgcgatgacgtcttaggacttcttgacaaataccttatccctaaagcaagcaatgcagagtccaaagtattctacctcaagatgaaaggagataactataggtacctcgcagaagtagccacggcgacactaggaacatcgtcgatttatcacaaaaagcttatcaggatgcattcgaaatctctaaagcgaaaatgacacccacacat

SEQ ID NO: 1733 - DNA, 375 bp, Diabrotica virgifera
  Clone ID: LIB149-042-Q1-E1-C8
agcccacgcgtccggaaaaatgtctgctcctgataaagatgaattagttcaaagggccaagcttgctgagcaagcagaacgctatgatgatatggcctcagcaatgaaatcagttacagagacaggagtggaactcagtaaggaagaaaggaatctcctatcagtcgcatataagaatgtggttggtgccagacgatcatcatggagagtaatttcttcaattgaacataagactgaaggatcagagaggaaacaacagatggctcgagaatatagagaaaaagttgaaaaagagttacgagaaatctgcgatgacgtcttaggacatcttgacaaataccttatccctaaagcaagcaatgcagagtccaaagt

SEQ ID NO: 1734 - DNA, 390 bp, Diabrotica virgifera
  Clone ID: LIB150-048-Q1-E1-D4
cttcgtggggtaggttctttcatctgtctcagtttttgttaccgggctgttaaatagagcttagcaggagtatattcaacatttattactaaagtagctgaataatttgaagataaaagtatttagaattagagaaaaatgtctgctcctgataaagatgaattagttcaaagggccaagcttgctgagcaagcagaacgctatgatgatatggcctcagcaatgaaatcagttacagagacaggagtggaactcagtaacgaagaaaggaatctcctatcagtcgcatataagaatgtggttggtgccagacgatcatcatggagagtaatttcttcaattgaacaaaagactgaaggatcagagaggaaacaacagatggctcgagaa

SEQ ID NO: 1735 - DNA, 339 bp, Diabrotica virgifera
  Clone ID: LIB149-034-Q1-E1-E8
ggacagtacccttattatgcagcttctccgagataacctcacactttggacgagtgacacgcagggcgaagctgatgagcctcaagaggctggtgataattaaaagtgtggagcgtcattttttaaacaattattcgttaataatgaaatttcatgtaagttgacgtattcgtggaacttggttgtgaagtttcattgacagttttaagtttcatcctgctgaaacttcgatatttaaaatgttttaggagatatgtaaatcgttaaatttatatttcacattatcacacaaccgtcatacttttcgcaacaagtaatttaagccataaaaaccagatg

SEQ ID NO: 1736 - DNA, 414 bp, Diabrotica virgifera
  unsure (1)..(414): unsure at all n locations
  Clone ID: LIB149-003-Q1-E1-B8
acggacgcgtgggggcgaggaaaatgcctacctctacagaacttggttgtacttatcagcttcagccactgctgaattctttgctgatattgccttatcacctatggaagctgctaaagtcaaaatccaaaccacacctggattcgccaacaccctccgtgaagcatggcctagaatatacagggaagaaggtcttaatggtttctacaaatcacttgttcctttgtggatgagacaaataccatacaccatgatgaaattcgcatgctttgagcgtacagttgaacttctctacaaatatgtagtacctaaaccacgtgctgactgcactaaaggcgaacaattgattgttacatttgctgctggttacattgcangtgtattctgtgctattgtatcacatcctgctgatac

SEQ ID NO: 1737 - DNA, 420 bp, Diabrotica virgifera
  Clone ID: LIB150-020-Q1-E1-H4
ccgggccgcgtccagtcggaaataactatcgaaggaccgaatttccaaaaccaaaaatgttttccgccttcttcaacaaggcctcttgcaaggctttacctgaaaaccaaactttaccacaaccagttgacgactcaccaagggcattagtaaaatcattggtagctggaagacagattgcagcagctgctgctgctgaaggtgacagttgtgaatttggatcagcacactactttgctctttgtggtctaagaggtatcctctcatgtggtatcactcacacagctgtagtaccacttgatttagtaaaatgccgtatccaagtagattctgctaaatacaagagtgtatttaatggttttaaagtaacccttgctgaagatggtacaagaggtttagctaaaggttgggccccaaact

SEQ ID NO: 1738 - DNA, 366 bp, Diabrotica virgifera
  Clone ID: LIB149-041-Q1-E1-D3
aactatcgaaggaccgaatttccaagaccaaaaatgttttccgccttcttcaacaaggcctcttgccaggctttacctgaaaaccaaactttaccacaaccagttgacgactcaccaagggcattagtaaaatcattggtagctggaagacagattgcagcagctgctgctgctgaaggtgacagttgtgaatttggatcagcacactactttgctctttgtggtctaagaggtatcctctcatgtggtatcactcacacagctgtagtaccacttgatttagtaaaatgccgtatccaagtagatcctgctaaatacaagagtgtatttaatggttttaaagtaacccttgctgaagatggtaca

SEQ ID NO: 1739 - DNA, 286 bp, Diabrotica virgifera
  unsure (1)..(286): unsure at all n locations
  Clone ID: pGUT4313
gctgacaattgtctggttaaaaaaaatgcaccaaatntggggatgcttttagaaaggaattaatacttccccttttattaaaaataaggtatttgcatattggtgttttatgaatatttaaaaataatgtatggtgatatgatatgtgaggaaaatgcctatctctacagaacttggttgtacttatcagcttcaaccactgctgaattctttgctgatattgncttatcacctatggaagctgctaaaggcaaaattcaaaccatacctggatttgtcaacaacc

SEQ ID NO: 1740 - DNA, 338 bp, Diabrotica virgifera
  Clone ID: LIB3026-031-Q1-E1-B11
cccacgcgaccggacaaaatgaccaaaggtacctcaagttttggtaaacgtcgcaataagacccacaccctatgcaggaggtgcggtagatcttcataccacatccaaaagtcacaatgcgctcagtgtggctacccatctgcaaaactacgttcctacaactggtccatcaaagccaagaggaggaagaccaccggaactggccgtctccgtcatcttaaaattgtacgcaggcgtttccgtaatggattccgtgaaggtactaaaccagttaagaaatcaacgtagatttattaatttttttttgtataagaacaaataaaaaaactgtttagttt

SEQ ID NO: 1741 - DNA, 397 bp, Diabrotica virgifera
  Clone ID: LIB3026-011-Q1-E1-B8
cggacgcgtgggcacgtttgcataggtaggtcaaaatgaccaaaggtacctcaagttttggtaaacgtcgcaataagacccacaccctatgcaggaggtgcggtagatcttcataccacatccaaaagtcacagtgcgctcagtgtggctacccatctgcaaaactacgttcctacaactggtccatcaaagccaagaggaggaagaccaccggaactggccgtctccgtcatcttaaaattgtacgcaggcgtttccgtaatggattccgtgaaggtactaaaccagttaagaaatcaacgtagatttattaatttttttttgtataagaacaaataaaaaactgtttagttaaaaaaaaaaaatactaccagttcttaaaaaaaaaaagcgaaaa

SEQ ID NO: 1742 - DNA, 346 bp, Diabrotica virgifera
  Clone ID: LIB3026-001-Q1-E1-D5
atcaaaatgaccaaaggtacctcaagttttggtaaacgtcgcaataagacccacaccctatgcaggaggtgcggtagatcttcataccacatccaaaagtcacaatgcgctcagtgtggctacccatctgcaaaactacgttcctacaactggtccatcaaagccaagaggaggaagaccaccggaactggccgtctccgtcatcttaaaattgtacgcaggcgtttccgtaatggattccgtgaaggtactaaaccagttaagaaatcaacgtagatttattaatttttttttgtataagaacaaataaaaaaactgtttagtttaaaacatcacttcctttctc

SEQ ID NO: 1743 - DNA, 431 bp, Diabrotica virgifera
  Clone ID: LIB149-027-Q1-E1-C9
cccacgcctccgaaaaaaatgagtttcgcacaaattaaaatatatattaaaaaaacagtaaaataataaaaaaaaaaacaaaataaaaaaaaagctacacaatgtaccaatgtatctataaaaataatattgtagaatgtacttatgttaataagaaatttatgactatgaatctacaatcaatcacaaacaagtctggctaattggcttaaaactagagagagagacttgaattgaatagtaacgcaaccgtctctatttattttgcttcacgttcttatttgacaaatagagtaggtcaaaatgaccaaaggtacctcaagttttggtaaacgtcgcaataagacccacaccctatgcaagaggtgcggtagatcttcataccacatccaaaagtcacaatgcgctcagtgtggctacccatctgcaaa

SEQ ID NO: 1744 - DNA, 398 bp, Diabrotica virgifera
  Clone ID: LIB3026-019-Q1-E1-D7
cgaacacaaaattcgtatcttttacgaaaaacgcatgggtcaagaagttgaggctgatgctcttggtgacgaatggaagggctacatcttgaaaatatctggaggtaacgacaaacaaggattccccatgaaacaaggtgttcttacaaacggtagagtaagacttttactttcaaaaggtcactcctgctacagacccagacgtaccggtgaacgtaaaaggaaatcagttcgtgggtgcattgttgatgggaacctcagcgtgttggccctagtcattgtaagaaaaggagaacaagaaattcccggacttactgacaccaccatcccacgtcgcctgggacccaagagagcatccagaatccgtaagctcttcaaccttagcaaagaagacgatg

SEQ ID NO: 1745 - DNA, 332 bp, Diabrotica virgifera
  Clone ID: LIB3026-021-Q1-E1-D10
attgacgaacacaaaattcgtatcttttacgaaaaacgcatgggtcaagaagttgaggctgatgctcttggtgacgaatggaagggctacatcttgaaaatatctggaggtaacgacaaacaaggattccccatgaaacaaggtgttcttacaaacggtagagtaagacttttactttcaaaaggtcactcctgctacagacccagacgtaccggtgaacgtaaaaggaaatcagttcgtgggtgcattgttgatgggaacctcagcgtattggccctagtcattgtaagaaaaggagaacaagaaattcccggacttactgacaccaccat

SEQ ID NO: 1746 - DNA, 421 bp, Diabrotica virgifera
  Clone ID: LIB150-035-Q1-E1-F4
ggcagttccatgtgcacactaacgagaagtttttcccgtatttagtgtaatttgccaaaaataaagtgtgaaatagtagttttcgagtgcaaaataagtcaatatgaagttgaacgtatcgtacccggccacgggttgccaaaaacttttcgaagttgttgacgaacacaaaattcgtatcttttacgaaaaacgcatgggtcaagaagttgaggctgatgctcttggtgacgaatggaagggctacatcttgaaaatatctggaggtaacgacaaacaaggattccccatgaaacaaggtgttcttacaaacggtagagtaagacttttactttcaaaaggtcactcctgctacagacccagacgtaccggtgaacgtaaaaggaaatcagttcgtgggtgcattgttgatgggaacctc

SEQ ID NO: 1747 - DNA, 429 bp, Diabrotica virgifera
  Clone ID: LIB149-013-Q1-E1-C8
aggacgcgtgggcggacgcgtgggtttctgaaatatcctttttgaaacatggcagttccatgtgcacactaacgagaagtttttcccgtatttagtgtaatttgccaaaaataaagtgtgaaatagtagttttcgagtgcaaaataagtcaatatgaagttgaacgtatcgtacccggccacgggttgccaaaaacttttcgaagttgttgacgaacacaaaattcgtatcttttacgaaaaacgcatgggtcaagaagttgaggctgatgctcttggtgacgaatggaagggctacatcttgaaaatatctggaggtaacgacaaacaaggattccccatgaaacaaggtgttcttacaaacggtagagtaagacttttactttcaaaaggtcactcctgctacagacccagacgttacggtgaacgt

SEQ ID NO: 1748 - DNA, 382 bp, Diabrotica virgifera
  Clone ID: LIB150-028-Q1-E1-B8
gacaaatagactttttaaacctattgtgaagaaaaactattaaaaaaacaaaaaaaattgtaaaatagtgtaaaaaagtaaaaaatatccaacgaagatgaatccggctgccccaaattatcctatggcgtctttatacgtcggcgatttacattctgatattactgaggccatgctttttgagaaattttcaaccgcgggtcctgtgctttcgattcgcgtgtgtagagacttgattacacgtcgatccttgggttatgcatatgtgaacttccaacaacctgcagatgctgagcgtgctttggataccatgaattttgacttgataaaaggtaggcctatccgcatcatgtggtctcaacgtgattcatcattgagaaaa

SEQ ID NO: 1749 - DNA, 415 bp, Diabrotica virgifera
  Clone ID: LIB150-037-Q1-E1-F11
cccacgcgtccgggcaaattactggacaacaaccacataatgcaattgtacctgctgctgttaacagaacagccaacttcaaatacacttcaaacatgagaaatccaccacaacctttgggaggtttaccaggtgctgctgctccagtacagcaggctgtacacattcaaggtcaggaaccattgacagcaaccatgttggctgctgctccaccacaggagcaaaaacagatgttgggtgaaagattgtttccacttatccaacgcatgtatccagacatggcaggtaaaatcactggtatgttattggagattgacaacactgagctgctacacatgttggaacaacaggagtcccttaagaacaaagtggaagaagcagttgctgttttacaagcccatcaagccaatcaaac

SEQ ID NO: 1750 - DNA, 371 bp, Diabrotica virgifera
  Clone ID: LIB150-024-Q1-E1-G12
gtgagtcgtattaagcgagagtggtgatgtgtagcatcagagcccacttatacttgtgaattaattgacttaaaaatacaagaatatatcagtaacgctaaggagaatgtcacatagaaatcgcatgatagtgtaaaaaagtaaaataacaaacgtaatgaatccaggcgccccaaattaccccagggcgtcattgtacgttggggattcacactcggatattactgaggccatgctttttgtcaaattttcaactgcgggccctgttctttcgattcgcgtttgcagagacttgattacacgtacatccttgggttatgcgtacgtagatttcaagcagcctgctgacgcagaccgtgcgctggatacag

SEQ ID NO: 1751 - DNA, 377 bp, Diabrotica virgifera
  Clone ID: LIB149-027-Q1-E1-D2
ctgattccaggaaagcagccacaagatgcaattgtacctgctgctgttaacagaacagccaacttcaaatacacttcagacatgagaaatccaccacaacctttgggaggtttaccaggtgctgctgctccagtacagcaggctgtacacattcaaggtcaggaaccattgacagcaaccatgttggctgctgctccaccacaggagcaaaaacagatgtggggtgaaagattgtttccacttatccaacgcatgtatccagacatggcaggtaaaatcactggtatgttattggagattgacaacactgagctgctacacatgttggaacaacaggagtcccttaagaacaaagtggaagaagcaattgctgtttt

SEQ ID NO: 1752 - DNA, 435 bp, Diabrotica virgifera
  Clone ID: LIB149-026-Q1-E1-G9
agcgtgtcacaatggcgaaaaagaaaccagaggataaaaataatcaaagcgatgatgatacaaaaaacgagagtgattactcgtcgaacgaagaagaaccaaacttcagtgatcctgaagactacgaagacgatgtatctgatgaagaactcttaggtgatgttttaaaagaaaagcctaaggaaactgatggagtagaaagtgttatagtagtagatggagttcctcaagtaggtcctaatcgtattgaaaagttgaagtcagttattgtcaaaatatttgtgaagtttggaacaatagtaaatgaattttaccctgtcaatagtgaaggccacaccaaaggttacatctttatagaatattcctcaccatccgaagctgctgaggctgttaaactcactaacaattttaaattggataagcaccatacctttc

SEQ ID NO: 1753 - DNA, 449 bp, Diabrotica virgifera
  Clone ID: LIB150-022-Q1-E1-G8
gggccacccacgagtccgcagacgcgtgggcggacgcgtgggcgcgtgtcaaaatggcgaaaaagaaaccagaggataaaaataatcaaagcgatgatgatacaaaaaacgagagtgattactcgtcgaacgaagaagaaccaaacttcagtgatcctgaagactacgaagacgatgtctctgatgaagaactcttaggtgatgttttaaaagaaaagcctaaggaaactgatggagtagaaagtgttatagtagtagatggagttcctcaagtaggtcctaatcgtattgaaaagttgaagtcagtcattgtcaaaatatttgtgaagtttggaacaatagtaaatgaattctaccctgtcaatagtgagggccacaccaaaggttatatctttatagaatattcctcaccatctgaagctgctgaggctgttaagctcactaacaat

SEQ ID NO: 1754 - DNA, 373 bp, Diabrotica virgifera
  Clone ID: LIB150-037-Q1-E1-C5
aaatgtccactgtattgatatcgcgccttgtgaaaagtactcactgacttaatcgccacaatgagacccacataatccagatcagaactggatcatcatttgggatattaggacaggtcttgaatagcgttcattcaatccagatcgtccaacagcatggccaatcttcaggtggtctcatgacgacggatattttgctcgtagtggtcatgacaatggatcccttcaagtatacgaaacaccatcatttggtctactagataagaaatcaatcattattcacggcagtagatatttcaattggtcacccacagataatgttgtagcttattgggtaacctaagacaacgatgtgcctgccagtgtaactctg

SEQ ID NO: 1755 - DNA, 290 bp, Diabrotica virgifera
  unsure (1)..(290): unsure at all n locations
  Clone ID: pGUT269
ctctgatccatggcgaatcccccatcatccgtgccaatttctacgaagttaagatacgagtggctcctatccttctcaaaaaattagagtcaagagcttgctaccatctgttttggtctcctagtgggcagttcataatattagcatgcttgggttccaacggaggtggatctctggaatttgttgatactcaccaatttttaatcatcaacactacagaccatttccaattgtcagatgtaaagtgggatccanctggaagatatgtaattactggagtctcattttgg

SEQ ID NO: 1756 - DNA, 455 bp, Diabrotica virgifera
  Clone ID: LIB149-049-Q1-E1-B7
cgcgggtcgatacaagactctaaagtgtgacgtattatatttgcactgtttattgttgaaggatattcagcagctttgaacagaacaaagagtgctcttagaatagttggaggacaagatgctctaattcaggattatccgtaccaagtttcaattctcttttacggaaaacatggatgcggtggttcaataatcaatcgatactatattttgacagcagcacattgtacttatgatgtcacgaaatcagtgctgaccgtacgtgtaaactcttccttcagagacgagcaaggcacagtctacgaggtagatcaaatctttgtacatgatggttttgacgacagcacatacgacaacgatataagcatccttcgtcttgcaacacctttaacctttggaaacggagtcagtccaatcgcactagcaactgctggaacgcaaataatagacggttt

SEQ ID NO: 1757 - DNA, 390 bp, Diabrotica virgifera
  Clone ID: LIB149-022-Q1-E1-D3
aaggatattcagcagctttgaacagaacaaagagtgctcttagaatagttggaggacaagatgctctaattcaggattatccgtaccaagtttcaattctcttttacggaaaacatggatgcggtggttcaataatcaatcgatactatattttgacagcagcacattgtacttatgatgtcacgaaatcagtgctgaccgtacgtgtaaactcttccttcagagacgagcaaggcacagtctacgaggtagatcaaatctttgtacatgatggttttgacgacagcacatacgacaacgatataagcatccttcgtcttgcaacacctttaacctttggaaacggagtcagtccaatcgcactagcaactgctggaacgcaaataaaag

SEQ ID NO: 1758 - DNA, 429 bp, Diabrotica virgifera
  unsure (1)..(429): unsure at all n locations
  Clone ID: LIB150-015-Q1-E1-F8
cactgtgatatacaacatttcatctaatcatgagaatcttatcaactttatgttttgtatttgcactgtttattgttgaaggatattcagcagctttgaacagaacaaagagtgctcttagaatagttggaggacaagatgctctaattcaggattatccgtaccaagtttcaattctcttttacggaaaacatggatgcggtggttcaataatcaatcgatactatattttgacagcagcacattgtacttatgatgtcacgaaatcagtgctgaccgtacgtgtaaactcttccttcagagacgagcaaggcacagtctacgaggtacatcanatctttgtacatgatggttttgacgacagcacatacgacaacgatataagcatccttcgtcttgcaacacctttaaccctttgggaacgagtca

SEQ ID NO: 1759 - DNA, 405 bp, Diabrotica virgifera
  Clone ID: LIB149-006-Q1-E1-G7
acatcatttcatctaatcatgataatcttatcaactttatgttttgtatttgcactgtttattgttgaaggatattcaacaactttgaacataacaaagagtgctcttataatagttgcgtgacaagatgctctaattcaggattatctgtaccaagtttcaattctcttttacggaaaacatggatgcggtggttcaatagtcaatcgatactatattttgacagcagcacattgtacttatgatgtcacgaaatcagtgctgaccgtacgtgtaaactcttccttcagagacgagcaaggcacagtctacgatgtagatcaaatctttgtacatgatggttttgacgacagcacatactacaacgatataagcatccttcgtcatgcaacacctttaaccttt

SEQ ID NO: 1760 - DNA, 410 bp, Diabrotica virgifera
  unsure (1)..(410): unsure at all n locations
  Clone ID: LIB150-003-Q1-E2-B7
acaaaatggcaccgacagctgacaaaactaaaacggttaaagggctccccgcagtcccagaatcagtcttaaaacaccgtaaaagacgtgaagcatcccgtgctaaacaactccagtctgtcatcataaagaaggcagaacagatcaaaaagaggaaagatattttcaaaagagctgaacagtatgttaaggaataccgtttaaaagaaagagacgaagttaggctagttagacaagccaaaaccagaggaaatttctatgttcctgccgaggctaaattggcttttgttgttcgtattaagggtatcaatacagtagcacctaaagtacgcaaagtactccaactattccgtttacttcanatcaacaatggagttttcgttaagttgaacaaggctactattaacatg

SEQ ID NO: 1761 - DNA, 401 bp, Diabrotica virgifera
  Clone ID: LIB3026-019-Q1-E1-A10
agcccacgcgtccgccaaaatggcaccgacagctgacaaaactaaaacggttaaaggactccccgcagtcccagaatcagtcttaaaacaccgtaaaagacgtgaagcatctcgtgctaaacaactccagtctgtcatcaaaaagaaggcagaacagatcaaaaagaggaaagatattttcaaaagagccgaacagtatgttaaggaataccgtttaaaagaaagagacgaagttaggctagttagacaagccaaaaccagaggaaatttctatgttcctgctgaggctaaattggcttttgttgttcgtattaagggtatcaataaagtagcacctaaagtacgcaaagtactccaactattccggttacttcaaatcaacaatggaattttccgtaaat

SEQ ID NO: 1762 - DNA, 389 bp, Diabrotica virgifera
  Clone ID: LIB150-046-Q1-E1-D5
accacgcgtccgcaaaatggcaccgacagctgacaaaactaaaacggttaaagggctccccgcagtcccagaatcagtcttaaaacaccgtaaaagacgtgaagcatcccgtgctaaacaactccagtctgtcatcaaaaagaaggcagaacagatcaaaaagaggaaagatattttcaaaagagctgaacagtatgttaaggaataccgtttaaaagaaagagacgaagttaggctagttagacaagccaaaaccagaggaaatttctatgttcctgctgaggctaaattggcttttgttgttcgtattaagggtatcaataaagtagcacctaaagtacgcaaagtactccaactattccggttacttcaaatcaacaatggagttt

SEQ ID NO: 1763 - DNA, 319 bp, Diabrotica virgifera
  unsure (1)..(319): unsure at all n locations
  Clone ID: LIB150-003-Q1-E1-B7
gacagctgacaaaactaaaacggttaaagggtccccgcagtcccagaatcagtcttaaaacaccgtataagacgtgaagcatcncgtgctaaacaactccagtctgtcatcaaaaagaagggagaacagatcanaaagaggaaagatattttcataagagctgaacagtatgttaaggaataccgtttaaaagaaagagacgaagttaggcgagttagacaagccaaaaccagaggaaatttctatgttcctgccgaagctaaattgggttttgttgttcgtattaaaggggatcaataaagtagcacctaaagtaggc

SEQ ID NO: 1764 - DNA, 458 bp, Diabrotica virgifera
  Clone ID: LIB3026-011-Q1-E1-A9
cccacgcgtccgcggaatggcagacgcagcggcaaagaaaccgaaggcagagaaaaaggcaccaaaggagggtgcaactccaagtgataaaccctccattaaaagacgtcctttcaaaagacatggacgtttatatgctaaagccatcttcacaggttacaaaagaggtcttcgtaatcaacacgaaaatacagccctattatctgtagaaggaaccagatcaaaagatgagagttggttttacgtaggaaagaaatgcgtctatgtatacaaagcaaaaaacaggacatgtgttcccggtaggcccaaatctgtcaaatccaaagttagggctatttggggaaaagtcaccagaccacatggcacaaggggtgcagtgagagccaaattcaataggaatttaccagccaaggctatgggacatcgtattcgtattatgctggtaccatctaagatat

SEQ ID NO: 1765 - DNA, 442 bp, Diabrotica virgifera
  unsure (1)..(442): unsure at all n locations
  Clone ID: LIB3026-032-Q1-E1-B7
atggcagacgcagcggcaaagaaaccgaaggcagagaaaaaggcaccaaaggagggtgcaactccaagtgataaaccctccgttaaaagacgtcctttcaaaagacatggacgtttatatgctaaagccatcttcacaggttacaaaagaggtcttcgtaatcaacacgaaaatacagccctattatctgtagaaggaaccagatcaaaagatgagagttggttttacgtaggaaagaaatgcgtctatgtatacaaagcaaaaaacaggacatgtgttcccggtaggcccaaatctgtcaaatccaaagttagggctatttggggaaaagtcaccagaccacatggcacaaggggtgcagtgagagccaaattcaataggaatttaccagccaaggctatgggacatcgtattcgtattatgctgtnaccatctaagatat

SEQ ID NO: 1766 - DNA, 428 bp, Diabrotica virgifera
  Clone ID: LIB150-037-Q1-E1-E11
cccacgcgtccgcggaatggcagacgcagcggcaaagaaaccgaaggcagagaaaaaggcaccaaaggagggtgcaactccaagtgataaaccctccattaaaagacgtcctttcaaaagacatggacgtttatatgctaaagccatcttcacaggttacaaaagaggtcttcgtaatcaacacgaaaatacagccctattatctgtagaaggaaccagatcaaaagatgagagttggttttacgtaggaaagaaatgcgtctatgtatacaaagcaaaaaacaggacatgtgttcccggtaggcccaaatctgtcaaatccaaagttagggctatttggggaaaagtcaccagaccacatggcacaaggggtgcagtgagagccaaattcaataggaatttaccagccaaggctatgggacatcgta

SEQ ID NO: 1767 - DNA, 412 bp, Diabrotica virgifera
  Clone ID: LIB3026-027-Q1-E1-B5
tcagaatggcagacgcagcggcaaagaaaccgaaggcagagaaaaaggcaccaaaggagggtgcaactccaagtgataaaccctccgttaaaagacgtcctttcaaaagacatggacgtttatatgcgaaagccatcttcacaggttacaaaagaggtcttcgtaatcaacacgaaaatacagccctattatctgtagaaggaaccacatcagaagatgagagttggttttacgtaggaaagaaatgcgtctatctagacaaagcaaagaacaggacatgtgttcccggtaggcgcaagtctgtcaaatccaaagttagggctatttggggaaaagtcaccagacgacagggcacaaggggtgcagtgagagccaggttcagtaggaattgaccagccaaggctatgggaca

SEQ ID NO: 1768 - DNA, 200 bp, Diabrotica virgifera
  Clone ID: LIB3026-001-Q1-E1-E11
accacacgtccgcccacgcgtccggcccaggtcgatggccaaacagttatccggaactgtaaaagaggttttaggaacagcccaatcagttggatgtacaattgatggtaaagcagcacatgatgttattgacgaggttaatgaaggaaccatagaagtaccagatgaataaactattattagaatattttttctaagtt

SEQ ID NO: 1769 - DNA, 294 bp, Diabrotica virgifera
  Clone ID: LIB149-020-Q1-E1-B3
acatccgcgtacaatccccattaatatatccgtattttatacacaattaattcacactgccacccaagttcgctcccaccgacattaaatatgtctacatgagatgtgtcggcagacaacttggagctacctcttctttggctcctacaattggtcctctacgtttgctctccagtccgtcttgtgactatccagtcagttgcacttcctctctgggaaggtcttactttcacagttcatttgaaaatccataatcgtcaacctaccatttccgtactcccatctgcctcctcc

SEQ ID NO: 1770 - DNA, 214 bp, Diabrotica virgifera
  unsure (1)..(214): unsure at all n locations
  Clone ID: LIB150-036-Q1-E1-E11
cctatagagagtcgtattagatncaaatctgtcggcatcggcgtagaatcacgattaatatagtgagtattttatagagaggtgaagtcagaatgccacgcaagttcgatcccacagtcgttgggggtgtatacatgagatgtgtcgggggagaggtgggagctacctcttcgttggctcggacagttggtcgcctgggtttgtatccggggaa

SEQ ID NO: 1771 - DNA, 409 bp, Diabrotica virgifera
  Clone ID: LIB149-006-Q1-E1-B4
agttgaaagaagtgtgtgcttctggttcagcgctggtcaattatccaatactgaattgattacctcgaccagaaatattttaaaatggcatctgttgagaaagctaatcctgaaaagcccggacaggaatctgccccaatccatcacattaggattacattgacttctcgcaatgtccgctcattggagaaagtatgttcagacctaattgatgctgccaagaggcaaaaacttaaagtgaagggaccagtacgtatgccaaccaagatcttaagaattaccactcgtaagacaccttgtggagaaggttccaaaacttgggatagattccagatgagaattcacaagagagttattgacttacattccccatctgaaattgtcaaacaaatcactttcatcaacattg

SEQ ID NO: 1772 - DNA, 391 bp, Diabrotica virgifera
  Clone ID: LIB3026-012-Q1-E1-E8
gtacttctggttcagcgctggtcaattatccaatactgaattgattacctcgaccagaaatattttaaaatggcatctgttgagaaagctaatcctgaaaagcccggacaggaatctgccccaatccatcacattaggattacattgacttctcgcaatgtccgctcattggagaaagtatgttcagacctaattgatgctgccaagaggcaaaaacttaaagtgaagggaccagtacgtatgccaaccaagatcttaagaattaccactcgtaagacaccttgtggagaaggttccaaaacttgggatagattccagatgagaattcacaagagagttattgacttacattccccatctgaaattgtcaaacaaatcaacttcatcaaca

SEQ ID NO: 1773 - DNA, 390 bp, Diabrotica virgifera
  Clone ID: LIB3026-002-Q1-E1-C6
aaaaagaagtgtgtgcttctggttcagcgctggtcaattatccaatactgaattgattacctcgaccagaaatattttaaaatggcatctgttgagaaagctaatcctgaaaagcccggacaggaatctgccccaatccatcacattaggattacattgacttctcgcaatgtccgctcattggagaaagtatgttcagacctaattgatgctgccaagaggcaaaaacttaaagtgaagggaccagtacgtatgccaaccaagatcttaagaattaccactcgtaagacaccttgtggagaaggttccaaaacttgggatagattccagatgagaattcacaagagagttattgacttacattccccatctgaaattgtcaaacaaatc

SEQ ID NO: 1774 - DNA, 435 bp, Diabrotica virgifera
  unsure (1)..(435): unsure at all n locations
  Clone ID: LIB150-042-Q1-E1-C3
aatcatttcaggatggcaatcagaccagtttaccgtcctcaaatcatcaaaaagaggacaaagaagttcatcaggcatcagtccgatagatatggtaaacttaagagaaactggcgtaaaccaaagggtattgacaacagagtcagaaggcgtttcaagggacaatatttgatgccaaatattggttatggttccaattctaagactaggcatatgctaccaacaggtttcagaaaagttttggtacacaatgtaaaagaacttgaagttctccttatgcaaaaccgtaaatattgtgcagaaattgcacatggagtttcgtcaaagaaacgcaaggatattgtagaacgtgctcagcaattgagtattaaggtcacaaatggaaatgctaggttacgtagccaaganaatgaataagctattattttgtttaat

SEQ ID NO: 1775 - DNA, 356 bp, Diabrotica virgifera
  unsure (1)..(356): unsure at all n locations
  Clone ID: pGUT1805
aatgaaaaatcgtgtgtaaaggtagcacacgaataatcatcttttaattttccctataatcctttcaggatggcaatcagaccagtttaccgtcctcaaatcatcaaaaagaggacaaagaaattcatcaggcatcagtcagatagatatggtaaacttaagagaaactggcgtanaccanagggtattgacaacaaagtcagaaggcgtttcaagggacaatatttgatgccaaatattggttatggttctaattctaaaactaggcatatgctaccaactggtttcagaaaagttttggtacacaatgttaaagaacttgaagttctccttatgcaaaaacgcaaatattgtgc

SEQ ID NO: 1776 - DNA, 196 bp, Diabrotica virgifera
  Clone ID: LIB3026-008-Q1-E1-B4
ggacacgtgggggcgtcaaccacaaggtattgaccacagagtcagaaagcgtttcacgggacaatatttgatgccaaatattggttatggttctaattctaaaactaggcatatgctaccaactggtttcacaaaagttttgggacacaatgtaaacaaacttgaagttccccctatgcaaaaccgcaactattgt

SEQ ID NO: 1777 - DNA, 610 bp, Diabrotica virgifera
  Clone ID: pGUT2272
gtgaagatggtcccagtcagatggctcttgaagatctcgctatgttcagatctgttcctggaagcactgtattctacccatccgatgttgtatcagtagaaagagcagtagaattagctgctaacaccaaaggaattactttcatccgtacagctagagccccaactgctgttgtctaccccaacgaccaggtcttcgaagttggaaaagcccttgtaccaatctccagcaacaaagaccaagcactgatcatagcagcaggaatcaccctccacgaatctctgatcgcagcaaaggatatggccaaagcaggaattcacgtcagagttatggatccattcaccatcaaacccatcgacaaacaaggaatcatcaacaacgcccaccaagccggtaacagaatattggtggttgaggaccattacccagaatgttggttcggaaaggcagttttatctgctttagctgaagagagaaatattattggtaaacacgtaaccattccaagagttcctagatccggtagaccagcagatttgttgaactactataagaatgatgctaagaatattgtaaaccatgttgatgaattactcaagaagttgatttt

SEQ ID NO: 1778 - DNA, 390 bp, Diabrotica virgifera
  unsure (1)..(390): unsure at all n locations
  Clone ID: LIB150-044-Q1-E1-C3
accaaacgtccgggcgggaacagcaacagatttgcaaactttgaaggacctggctacacgcatcaggatacatagcgtggaatccactacacttgcaggttccggccatcccactacatcctcctcaattgccgacattctttcagtcctcttcttcagaaccatgcgctacaaagtttcagctcccagagacccatccagcgaccgtttcgttctttccaaaggtcacgctgctccagctctttacggagcatgggtcgagaacggcgttgtagccgctgctgacttaaagaagctgagacaattgggatgtgacctcgaaggtcatcctacacctcgtttgaacttcatcgatgttggtactggatccctangacaaggtctcgctgt

SEQ ID NO: 1779 - DNA, 410 bp, Diabrotica virgifera
  Clone ID: LIB149-047-Q1-E1-E5
tcgcgggtcgacacacgcatctacccacgcgtctggtcgacgtgactgactaaaaatggcgggaacagcaacagatttgcaaactttgaaggacctggctacacgcatcaggatacatagcgtggaatccactacacttgcaggttccggccatcccactacatcctcctcaattgccgacattctctcagtcctcttcttcagaaccatgcgctacaaagtttcagctcccagggacccatccagcgaccgtttcgttctttccaaaggtcacgctgctccagctctttacggagcatgggtcgagaacggcgttgtagccgctgctgacttaaagaagctgagacaattgggatgtgacctcgaaggtcatcctacacctcgtttgaacttcatcgatgttggtactg

SEQ ID NO: 1780 - DNA, 395 bp, Diabrotica virgifera
  Clone ID: pGUT3418
ctcgtgccgattcggcacgagaaaaaaggcaaatctgccataaatgaagtagtaactagagaatatacagtaaatcttcacaagaggttacatggtattagtttcaaaaaacgtgcccctcgtgctattaaggctattcgtcaatttgctttaaaacagatgggtaccccagatgtcagagttgatacgagacttaacaaacaactatggtccaaaggaattaggaatgttcctttcagagtacgtgtacgtctttccagaaggagaaatgatgatgaagattctgtgaacaaattgtacactcttgtaacatatgttccagtagcaacattcaagggtttacagacagaaaatgttgacgcaagtcaagaataactaataaatattttttaagt

SEQ ID NO: 1781 - DNA, 186 bp, Diabrotica virgifera
  Clone ID: pGUT1673
cttgagtaagttaagtatggccaagcagaagggtgataaaaaaggcaaatctgccataaatgaagtagtaactagagaatataccgtaaatcttcacaagaggttacatggtattagtttcaaaaaacgtgcccctcgtgctattaaggctattcgtcaatttgctttaaaacagatgggtacccc

SEQ ID NO: 1782 - DNA, 215 bp, Diabrotica virgifera
  Clone ID: pGUT3357
gttgatacgagacttaacaaacaactatggtccaaaggaattaggaatgttcctttcagagtacgtgtacgtctttccagaaggagaaatgatgatgaagattctgtgaacaaattgtacactcttgtaacatatgttccagtagcaacattcaagggtttacagacagaaaatgttgacgcaagtcaagaataactaataaatattttttaagt

SEQ ID NO: 1783 - DNA, 345 bp, Diabrotica virgifera
  Clone ID: LIB150-024-Q1-E1-A8
accacgcgtccgcccacgcgtccgcccacgcgtccgcaggatagtgggtttgtagtgtgcctaaatgctcagccatggcaaaattattgcgtagaaccaccatgtggacaatttgatcctacacaagacaagttatatgatgttattgaagacctttatggtgacatgctggcccaatttgaaccagaattatttcatatgggcggagatgaggttgcctttcaatgttggaaaagcacgccaaagatcgtcgagtggattaaaagtaaaacttgggaaaccacaacggatgaaggctatttcaaattatgggagtactttcaagataatgcattggagagactt

SEQ ID NO: 1784 - DNA, 393 bp, Diabrotica virgifera
  Clone ID: LIB150-032-Q1-E1-A9
acacgcgtccgacggtaaaataatgtcagtatggcatatttgaatttggcacattttatctggattggattgttaatttattctagctcagcattaaattcatcatggagatgggaatgcgaaaacaatgtgtgtcaaagaaagaggatcacaaatgctacaatctcgacagcactaagtcttccagcttgtcgtttattctgtactgatagtgcaggaatatggccaaaatctaccggagagttctcaatgggcagtctactaacaaaaatcaatgcttacagcatagacgttgtttcaaattcttctggaactgccattgcaagtttaataaaaggcgctataaaagaatttaagtctgatattcaggcttccattacatcgcctatagag

SEQ ID NO: 1785 - DNA, 343 bp, Diabrotica virgifera
  Clone ID: LIB150-032-Q1-E1-A10
tcgtattatagtataattgtcagtatggcatatttgaatttggcacattttatcaggattggattgctaaattattctagctcagcattaaattcatcatggagatgggaatgcgaaaacaatgtgtgtcaaacaaagaggatcacatatgctacaatctcgacagcactaagtcttccagcttgtcgtttattctgtactgatagtgcaggaatatggccaaaatctaccggagagttctcaatgggcagtctactaacagaaatcaatgcttacagcatagacgttgtttcaaattcttctggaactgccattgcaagtttaaaaaaaggggctataaaag

SEQ ID NO: 1786 - DNA, 436 bp, Diabrotica virgifera
  unsure (1)..(436): unsure at all n locations
  Clone ID: LIB150-018-Q1-E1-F10
cccacgcgtccggtctacttggccatgctcaaacattggcctctcaccagaaaaacgaagtatcttttgtcattcacaatttacctgtcatcgcaaaaatggctgctgtagctaaagcatgtggaaatatgttccagttattgcaagggcattctgctgaaacttctggaggactcttaatatgtgtaccccgtgagcaagctgctgcctattgtaaagatatagagaaacaagaaagtttacaagcatggattattggtattgtcgagaaaggcaacagaactgctcgtatcattgacaaacctcgagttatcgaggtcncagctaaagagtagatttaataatacatatgtaatcaactttaagtattttttgacatactgtgggcagttacacgtctaagtatgattcccaacagctttgtacatctaatacg

SEQ ID NO: 1787 - DNA, 339 bp, Diabrotica virgifera
  Clone ID: LIB150-021-Q1-E1-C1
cttgtgagccagtgtttttaacacggtagtacgggtgcattttcgttaaaattcgaaaagccggtatgggcgattatcaagtaacacaagttcaacaagatgctcttggggctgtccagctagagttaggaggaaatcccaacactctagcattacgccggccgttcgaccctttggcccatgatttggaagctagtttcagattgacgcgattcgccgatttgaagggccgtggatgcaaagtaccccaagaagtacttaacaaacttgtaaaggggctccaacaggattataattcggcaaaacatgaacatgctcactttatgcatatggcaattc

SEQ ID NO: 1788 - DNA, 351 bp, Diabrotica virgifera
  Clone ID: LIB150-028-Q1-E1-F8
gagaaacgctcttgtgagccagtgtttttaacacggtagtacgggtgcattttcgttaaaattcgaaaagccggtatgggcgattatcaagtaacacaagttcaacaagatgctcttggggctgtccagctagagttaggaggaaatcccaacactctagcattacgccggccgttcgaccctttggcccatgatttggaagctagtttcagattgacgcgattcgccgatttgaagggccgtggatgcaaagtaccccaagaagtacttaacaaacttgtagaggggctccaacaggattataattcggcagaacatgaacatgctcactttatgcatatggcaattccg

SEQ ID NO: 1789 - DNA, 409 bp, Diabrotica virgifera
  unsure (1)..(409): unsure at all n locations
  Clone ID: LIB149-047-Q1-E1-G8
cacgagtctacagtcactcgtgctaacgcgtgggcaggtggcgggccgcaacatcaagtgtttgagaaaggtatgggtcctgccaattttggtgaagcataccgtcctcgtggtcgagaagatggagaatggcattatatggacagagctcaagaacagaaacgaatggaagaagcagaagatttagatgtgaatgctcaaattcatggaaattggactgtagagaatgccaaatctaagctacatcaattcatgcaagccaataagataaacacggattataaatatacacaagttgggccnaatcactctagaacattcgtcgcagaactcagtttctatgttaaacaacttggaagaactattcatggaagggatactggatctaatanacagactgcacgtaaaa

SEQ ID NO: 1790 - DNA, 428 bp, Diabrotica virgifera
  Clone ID: LIB3026-012-Q1-E1-A6
gcaaacagatgactatggttacaccccttcatcttctgctgttcggttcccgaaaagtagaatgggttgataacgtggttaggttggacaactggatcaatttggacatggatcccgaggtagcttccatgatagtggctctaagacctgcgttggaaagtttagttattagaacttctcagtctccagaagcaatcttggaaatgggagaaactgacgttaaggttgtgtcaacgattaaagaaatatgcagattgcacgcaggaagttttgaactagaaagagccaaaggtagcctgcttcaatcaaataggcctcccagaggacacactctcggagggttcattggaccttctcccaaattcttcaaaggtggctttaatagtcaaggtggtggtggaggtttcagaggtggattccgtggcgat

SEQ ID NO: 1791 - DNA, 276 bp, Diabrotica virgifera
  Clone ID: LIB149-046-Q1-E1-G3
acaattttcgacctgatactatggcaatatttcctatggtaactgttggtccagatcccagacttgatgttgtgatgtctcttatgtagtacggattatatccaaacgtttgtttccacaatgacactagaaaggtactagcatcacaaggcatagccgcacttatgcacaaaacttccgtcaactgaagtaaccaggatcaaggatttccatactcaatcgttgtatttggagaattgatcagtactagagctgtaacttgcaaacagatgacta

SEQ ID NO: 1792 - DNA, 433 bp, Diabrotica virgifera
  Clone ID: LIB150-013-Q1-E1-F10
gtacaacacatttccaagcaaatcgctgaggatcagcgttacaagggtatggtagactgcttcgtacgtatcccaaaggaacagggtgttcttgcatactggcgtggtaacaccgctaacgtcatccgttatttcccaacccaagcccttaacttcgccttcaaagacaaatacaagcagatcttcttgagcggagtagacaaaaagacacaattctggcgttacttcttaggtaacttggcctctggtggtgccgccggagctacctccctctgctttgtatacccacttgatttcgccagaaccaggttggccgccgacgtcggtaaaggtgccggtgaacgtgaattctctggtttgggtaactgcttagtcaaaatcttcaaagctgacggcttgggaaggatatatcgtggatttggtgtatcagtac

SEQ ID NO: 1793 - DNA, 416 bp, Diabrotica virgifera
  Clone ID: LIB150-044-Q1-E1-C8
attccaagcaaatcgatgaggatcagcgttacaagggtatggtagactgcttcgtacgtatcccaaaggaacagggtgttcttgcatactggcgtggtaacaccgctaacgtcatccgttatttcccaacccaagcccttaacttcgccttcaaagacaaatacaagcagatcttcttgagcggagtagacaaaaagacacaattctggcgttacttcttaggtaacttggcctctggtggtgccgccggagctacctccctctgctttgtatacccacttgatttcgccagaaccaggttggccgccgacgtcggtaaaggtgccggtgaacgtgaattctctggtttgggtaactgcttagtcaaaatcttcaaagctgacggcttgggaggattatatcgtggatttggtgta

SEQ ID NO: 1794 - DNA, 419 bp, Diabrotica virgifera
  Clone ID: LIB150-023-Q1-E1-G7
aattaacagccgattacaagtactctaccatattcttttgagaaaagttttaaaagaataaaacaaaatgtctctcgctgatcccgttgcctttatgaaggatttcctcgctggaggtatttccgccgctatttcaaaaacatgtgtagctccaatcgaacgtgtaaagttgcttttgcaagtacaacacatttccaagcaaatcgctgaggatcagcgttacaagggtatggtagactgcttcgtacgtatcccaaaggaacagggtgttcttgcatactggcgtggtaacaccgctaacgtcatccgttatttcccaacccaagcccttaacttcgccttcaaagacaaatacaagcagatcttcttgagcggagtagacaaaaagacacaattctggcgttacttcttaggtaact

SEQ ID NO: 1795 - DNA, 453 bp, Diabrotica virgifera
  Clone ID: LIB150-029-Q1-E1-D1
tacaaactgacactgcaccgcagctaaataacaatatttaaaagaaaaactaaattttttatacaaaaatcactcaaaattaattcttattgtatgaaatttatataggagttcatccgggtaaatcaagatggcaagaggtcagcaaaaactccaatcacaggctaaagctgcggaaaaagccgctaaagccaagaaacaacaggggcacagcgctggagaccagaaaaaagctgctcaaaaggcactggtccatgtttgcgcggtttgtaaagctcaaatgcccgaccccaagacctacaagcagcattttgaaaacaaacatccaaagaatgaggtgcctgcagaacttaaagacatataacgtatatttaatgtttaataaccgtaagtgttcactttaagttgggcacactttcttcttttttacttacttgtttttatgttaatata

SEQ ID NO: 1796 - DNA, 429 bp, Diabrotica virgifera
  unsure (1)..(429): unsure at all n locations
  Clone ID: LIB3026-032-Q1-E1-H7
ccacgcgtccggcaaaaactccaatcacaggctaaagctgcggaaaaagccgctaaagccaagaaacaacaggggcacagcgctggagaccagaaaaaagctgctcaaaaggcactggtccatgtttgcgcggtttgtaaagctcaaatgcccgacccaaagacctacaagcagcattttgaaaacaaacatccaaagaatgaggtgcctgcagaacttaaagacatataacgtatatttaatgtttaataaccgtaagtgttcactttaagttgggcacactttcttcttttttacttacttgtttttatgttaatatattaggatgtatttaattgtataaattcttaccagctgagggtcgcacttttttttctagatcnttgtttttatgttataattttaagaagtatttcttgtntgtataaa

SEQ ID NO: 1797 - DNA, 392 bp, Diabrotica virgifera
  Clone ID: LIB3026-015-Q1-E1-E11
aaagctgacgctgcaccgcagctaaataacaatattttaaaagaaaaactaaattttttatacaaaaatcactcaaaattaattcttattgtatgaaatttatataggagttcatccgggtaaatcaagatggcaagaggtcagcaaaaactccaatcacaggctaaagctgcggaaaaagccgctaaagccaagaaacaacaggggcacagcgctggagaccagaaaaaagctgctcaaaaggcactggtccatgtttgcgcggtttgtaaagctcaaatgcccgaccccaagacctacaagcagcattttgaaaacaaacatccaaagaattaagttcctgcaaaaacttaaggacatataacgtatatttaatgtttaataaccgtaag

SEQ ID NO: 1798 - DNA, 434 bp, Diabrotica virgifera
  Clone ID: LIB150-033-Q1-E1-H6
gttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaatactatgtaaccatcattgatgcccctggacacagagatttcattaagaacatgatcactggtacatcacaagctgactgtgctgtactcattgttgcagctggtactggtgaatttgaagcaggtatttcaaagaatggacaaacacgtgaacatgctcttcctgctttcacccttggtgtaaaacaacttaatgttggtgtcaacaaaat

SEQ ID NO: 1799 - DNA, 607 bp, Diabrotica virgifera
  unsure (1)..(607): unsure at all n locations
  Clone ID: pGUT2286
gtcgtggttacgtagctggagacaccaagaacaacccacccagaggagcttcagacttcactgcccaagtcattgttctcaaccaccctggtcaaatctcaaacggatatacccctgtactcgactgtcacacagctcacattgcctgcaaattcgctgaaatcaaagaaaaggttgaccgtcgttctggtaagaccactgaagaaaatcccaaagccatcaaatctggtgatgccgccattgtcaacttggtacccaccaagcccatgtgtgtagaatcattccaagaattcccaccccttggacgttttgctgtccgtgacatgaggcaaaccgttgcagtaggagtcatcaagagcgttgccttcaaagatcccagcgccggaaaagtcacaaaagctgcagaaaaagcccagaagaagaaatagtctatttggactccactacttanataattttgatatgtnttggttctctatatattaatattggagtatcaatgtatnnttaataactaatgganctattacttgcattgcattatttgtgatctgtaaataaaacttggacaaataaagaaaaaaaaaaaaaaaaaactcaagggggg

SEQ ID NO: 1800 - DNA, 306 bp, Diabrotica virgifera
  Clone ID: LIB150-012-Q1-E1-H5
gttacatcgcaagtatcgtgccttttattctaagtttagttgctgacagttgcacctacgttaattccacacttgcatcatgggtacacagcatagtcataggaacatcgttgtcattggacacgtctattctggtagatctactactactggacatttagtttaccaatgtggtggtcacggctcacatcacatctactgctgcggctgctcctcgtactgcatgggtagaggttcaatcagatatgccctgagtactcgacaaacttaaggccgacagagaatgtggtattaccattgatattg

SEQ ID NO: 1801 - DNA, 399 bp, Diabrotica virgifera
  Clone ID: LIB149-025-Q1-E1-G12
agaactatctgaaattagccctgatagtgagtttaattctctctatatgtggaaattatttagataatgatcagcaaaaccgtagtgttcaagaagaaataaaggagtcatcaccaatatttaaaagatcagcatattatggtaaggcagatggtacaccctttaagaattgtaaggagatattagaatctggtgtaaatatttctggcatttacgaaatacaaccaattggttccaataaattaataaatgtaacatgtgatatggaaacaagaggtggtggatggactgtaatacagagaagaattgacgggtctgttgagttctacagaggttggagagagtataaatttgggttcggagatccaaatggagaactatggctaggattggagagta

SEQ ID NO: 1802 - DNA, 356 bp, Diabrotica virgifera
  Clone ID: LIB3026-009-Q1-E1-G1
cgaactatctgaaattagccctgatagtgagtttaattctctctatatgtggaaattatttagataatgatcagcaaaaccgtagtgttcaagaagaaataaaggagtcatcaccaatatttaaaagatcagcatattatggtaaggcagatggtacaccctttaagaattgtaaggagatattagaatctggtgtaaatatttctggcatttacgaaatacaaccaattggttccaataaattaataaatgtaacatgtgatatggaaacaagaggtggtggatggactgtaatacagagaagaattgacgggtctgttgagttctacagaggttggagagagtataaatttggg

SEQ ID NO: 1803 - DNA, 350 bp, Diabrotica virgifera
  Clone ID: LIB3026-007-Q1-E1-D5
attaaaatgtcggtatccacgaactatctgaaattagccctgatagtgagtttaattctctctatatgtggaaattatttatagaatgatcagcaaaaccgtagtgttcaagaagaaataaaggagtcatcaccaatatttaaaagatcagcatattatggtaaggcagatggtacaccctttaagaattgtaaggagatattagaatctggtgtaaatatttctggcatttacgaaatacaaccaattgggtccaataaattaataaatgtaacatgtgatatggaaacaagaggtggtggatggactgtaatacagagaagaattgacgggtccgttgagttcgacag

SEQ ID NO: 1804 - DNA, 456 bp, Diabrotica virgifera
  Clone ID: LIB150-029-Q1-E1-E7
cccaagcgtccgcttggttttaccagagaaatgcagaataagaagactaaagatttcagtggaggttggagaatgcgtattgcactagctagagctctttatgtcaagccacatcttctcttattagatgaacctaccaaccatttggatttggatgcctgtgtatggttagaagaggaactaagaaattataagagaatattagtgttgatatcacattcgcaagatttcttaaacggagtatgcacaaacataatacacataaataaaaaaaggctcaaatattataccggcaattatgacgcctttgttaagactagaatggaacttttggaaaatcaaatgaaacagtataattgggaacaagatcaaatcaaccatatgaagaactatattgcacgatttggtcacggatcagcaaagcttgcgagacaagcgcaatccaaaggaaaaacg

SEQ ID NO: 1805 - DNA, 407 bp, Diabrotica virgifera
  Clone ID: LIB149-036-Q1-E1-E7
agaaaaagaagagatgagaaaaatcataggaaggtatggtcttacagggcgacaacaggtatgccctattagacaattatctgacggtcaacggtgcagggtagtattcgcttggctagcatggcaagtacctcatatgcttcttcttgatgaacctacgaatcacttggacatggaaacgatcgatgctcttgcagatgctattaatgaatttgaaggaggaatggtgcttgttagtcacgattttagattaatcagtcaggttgcggaagaaatttgggtatgcgaaaaaggaacagttacgaagtggcaaggcgacattctttcatacaaagatcacttgaaaactaaaattttgaaggatgcggcaaaacggaaataatgataaacatttaaagcaatacttc

SEQ ID NO: 1806 - DNA, 416 bp, Diabrotica virgifera
  Clone ID: LIB150-024-Q1-E1-F2
gatttggacacggatcagcaaagcttgcgagacaagcgcagtccaaagaaaaaacgctagccaaaatggtagctcagggtctaacagaaaaagtgactagtgacaaaattgtcactttttatttccccagttgtggtactatacctccaccagtaattatggtacaaaatgtcagttttagatataacgattctacacctttgatttataaaaatttggaattcggtatagatctggacactaggttagcgttggtgggacccaatggagcatgaaaaagtactctcttgaaattattatatggtgatcttactccaacagaaggtatgattaggaaaaactctcatttacgtattgcccggtaccatcagcatctacacgaactgctagacttggacctctcgccgcttgaatat

SEQ ID NO: 1807 - DNA, 400 bp, Diabrotica virgifera
  Clone ID: LIB149-025-Q1-E1-G3
acgagtcatacggtggaaaaatggcagcagaaattgcacttgtattataccaagccatacaaaaaggtgaaatagaatcaaacttaaaaggcgttgcacttggcgattcttggatttctcccttagatgctgaactttcgtatggaccatatttattcaacttgggttttatcgatcgaaatggatacgacgcaataatggaagaagctgcacgagtaaagaaagccatagacaaaggcgactttgacgaagctcttagtctatggtatagtatggaatcattggtggaagttgagacacgtggaattgattggtataatgtctttacaggacgagtatctaataatatcaggggtttggacaagcaaaacacaggtgcatcaagtgttacagacgacct

SEQ ID NO: 1808 - DNA, 414 bp, Diabrotica virgifera
  Clone ID: LIB149-042-Q1-E1-C6
agcggacgcgtgggttcgactacaaaatgcgagtactagtggtattgtgtataatattacaagtagttttgggaaaaagaggttttggtccaacagatcaagaatggggcttctctgaagtaagacctgttgctaatttattttggtggcttcattataccaccgcagatgtctctacaccaacacatagacctcttctaatatggctacagggaggcccaggatcatcttcaacaggttatggaaactttgacgagttaggtccattacattcagatttacatcctatgaatactacttgggtacaatgggctaatgttctgtttgtggataatcctgtcggaaccggatttggatatgtaaccagtgatgacttgttcgcaaaaaattattccccaaatggcacaatttttt

SEQ ID NO: 1809 - DNA, 412 bp, Diabrotica virgifera
  Clone ID: LIB149-029-Q1-E1-H10
gcgtcaggtataaacctattataagaatactactcagttactcagtctactgcttcgactacaaaatgcgagtactagtggtattgtgtataatattacaagtagttttgggaaaaagaggttttggtccaacagatcaagaatggggcttctctgaagtaagacctggtgctaatttattttggtggcttcattataccaccgcagatgtctctacaccaacagatagacctcttctaatatggctacagggaggcccaggatcatcttcaacaggttatggaaactttgaggagttaggtccattagattcagatttaaatcctaggaatactacttgggtacaatgggctaatgttctgtttgtggataatcctgtcggaaccggatttggataagttacagtgatgac

SEQ ID NO: 1810 - DNA, 374 bp, Diabrotica virgifera
  unsure (1)..(374): unsure at all n locations
  Clone ID: pGUT1517
attgaccacagtctgctacgacaattttcttggatgtttttccagattgagagcccaaagcctcgatcttcttgacgacgtccattccttcgactacggcaccgaatacaacgtgcctgttgtccagccaggaagttttgacggtggtgatgaagatctgggatccattggtgtctggaccagcattggccatcgacattactccaggtccggtgtgctttantgtgaagttttcatctgcgaatttgtgtccatagattgattttcctccactgccattgtggttggtgaagtcgcctccttggcacatgaagttgggattgacacggtggatagtggatcctttgtanccaaagcctttttcgccggtgcac

SEQ ID NO: 1811 - DNA, 266 bp, Diabrotica virgifera
  Clone ID: pGUT1709
attgaccacagtctgctacgacaattttcttggagggttttccagattgagagcgcggagcctcgatcttcttgacgacgtccattccttcgactacggcaccgaatacaacgtgcctgttgtccagccaggaagttttgacggtggtgatgaagaactgggatccattggtgtctggaccagcattggccatcgacattactccaggtccggtgtgctttagtgtgaagttttcatctgcgaatttgtttccatagattgatttt

SEQ ID NO: 1812 - DNA, 198 bp, Diabrotica virgifera
  Clone ID: pGUT024
agccttgtgcaccggcgaaaaaggctttggctacaaaggatccaccttccaccgtgtcattcccaacttcatgttgcaaggaagcgacttcacaaccaacatggcactggaagaaaaatcatctatggaaaacaattcccaaaataaaacttcccactaaaacacaccggaactggaattatgttcaatggccatgct

SEQ ID NO: 1813 - DNA, 392 bp, Diabrotica virgifera
  Clone ID: LIB150-044-Q1-E1-D8
aaccacgcgtccgggtgatcaagattttgttgtagacacccttgaagcttccttccgctatccaatggacttcaacttcttcatccaaaacttctcagctgttggatatagcaaaattgttcaacctgaagaagaagccactttcctctacagtttcctaccagctgaagcctacgcaggccgaccatttggattgaacatcttgttgaactatcatgatgcttcaggaaacgctttccaagaagctgtcttcaatgaaacagtccaaattgttgaattagaagaaggacttgatggagaaacattcttcctctatgtcttcctcgccgctggtgtagtattgcttctggttattggacaacaaactctgctatcagttggtaagaagcgca

SEQ ID NO: 1814 - DNA, 327 bp, Diabrotica virgifera
  Clone ID: LIB149-021-Q1-E1-A3
aatctactggagcctctcaactagaaattccggctggccttcctgtcgaattccttgtaggattccgcaacaaaggtgatcaagattttgttgtagacacccttgaagcttccttccgctatccaatggacttcaacttcctcatccaaaacttctcagctgttggatatagcaaaattgttcaacctgaagaagaagccaatttcctccacaatttcctaacaactgaagcctacgcaagccgaccatttggattgaacatcctgttgaactatcatgatgcttcaagaaacgctttccaagaagctgtcttcaatgaaacagtcc

SEQ ID NO: 1815 - DNA, 411 bp, Diabrotica virgifera
  Clone ID: LIB150-042-Q1-E1-A11
cgtcgaccgaaacttctcagctgttggatatagcaaaattgttcaacctgaagaagaagccactttcctctacagtttcctaccagctgaagcctacgcaggccgaccatttggattgaacatcttgttgaactatcatgatgcttcaggaaacgctttccaagaagctgtcttcaatgaaacagtccaaattgttgaattagaagaaggacttgatggagaaacattcttcctctatgtcttcctcgccgctggtgtagtattgcttctggttattggacaacaaactctgctatcagttggtaagaagcgcagtggaggaagtggaggtagcagcaggaaatcggcacctgttgagactggaactaacaatccaaacaatgttgactacgattggttgccaaaacaaac

SEQ ID NO: 1816 - DNA, 600 bp, Diabrotica virgifera
  Clone ID: pGUT3504
ctttggtggataaagttagcgcatctctcggcaatcatgacagttggagcattagtattagagctggtaaccacaggcatagccgaagcgtccgatactctcaaattgtggagacctataaccctaagttcttcatctacaacagaccattcatcatctgtggaccccatacgaagtgtactagcttgatgattttccggaccagtgttgtagaggatagcacagcgccagtaatcatcagagtcaaaggtgtattggtcagcacaggtgccgtgagtgacattttcataaacaaattgccatttgtcttttaaagttgggctgctggtaagcttttgaacgagtcttatggcatcaataagtctatcttgatcttcttttactgttaagtaatttcctaccatatgtggaggtgcaagtggatcgttagacttcaacgtaattctaccacgactcttggtgtgtaaattaacagcactgatagaaacatgttgcggtttttgaggatcagttggatcaattggttcatcaactttgccatctggtgagcaagtagttggactcacggtgaagaaacattgaatatctggatcatcagca

SEQ ID NO: 1817 - DNA, 426 bp, Diabrotica virgifera
  Clone ID: LIB149-006-Q1-E1-F6
gttctttaccgtgagtcaaactacttgctcaccagatggcgaagttaatgaaccaattgatccaactgatcctcaaaaaccacaacatgtttctatcagtgctgttaatttacacaccaagagtcgtggtagaattacgttgaagtctaacgatccacttgcacctccatatatggtaggaaattacttaacagtaaaagaagatcaagatagacttattgatgccataagactcgttcaaaagcttaccagcagcccaactttaaaagacaaatggcaatttgtttatgaaaatgtcactcacggcacctgtgctgaccaatacacctttgactctgatgattactggcgctgtgctatcctctacaacactggtccggaaaatcatcaagctagtacacttcgtatggggtccacagatgatga

SEQ ID NO: 1818 - DNA, 327 bp, Diabrotica virgifera
  Clone ID: LIB3026-016-Q1-E1-F5
cagggattctgatgattactggcgctgtgcaatccgttacaacacttttgcggaaaatcaccaatccagtacacttcgtatgggctccactgacgacgaatggtctgttgtagatgaagaacttcgggttattggtctccacaatttgagagtagcagacgcttcggctatgcctgtggttacaagctctaatactaatgctccaattgtcatgcttgctgagagatgcgctgactttattcatcatagatggggacattatggcaaaaactaactgtatacattaaattaattatatataggtaataataataataaatatagttg

SEQ ID NO: 1819 - DNA, 453 bp, Diabrotica virgifera
  Clone ID: LIB149-026-Q1-E1-B12
tcgcgggtcgacacacgcctctgatctcagtctcattagatgccttggataagatccgttaccaatcactcacaaatccatcctgtctcgactctggaaaagatttgcacattaaaattgttccaaacaagagtgaaggaaccttaaccatcattgatactgggattggtatgacgaaagcagatttagttaacaaccttggtacagtcgcaaaatcaggaacaaaggcattcatggaggccctccaagctggagctgatattagtatgattggtcaatttggtgtaggtttctactcagcctacttagttgctgatcgagtagtggttgtatcaaaaaataacgatgatgaacagtacatttgggaatcatctgcaggaggtagcttcacaataagaccatatgttggagaaccattgggacgtggtacataaattgttctgtacatcaaag

SEQ ID NO: 1820 - DNA, 418 bp, Diabrotica virgifera
  Clone ID: LIB150-042-Q1-E1-E9
acccacgcgtccgcccacgcgtccggctttattgtttgttcctcgtcgtgtaccttttgatttgtttgaaaacaagaagaagaagaacaacatcaaattatatgtacgcagagttttcattatggacaactgtgaagaccttatcccagaatatcttaactttattaagggagtagtagactctgaagatttacctctaaacatttcaagagaaatgttgcaacaaaataagattcttaaggtcatccgcaaaaatttagttaaaaaatgtctggaactttttgaagagcttactgaggacaaagatggatggaagaaattctatgaacaattctcgaagaacatcaaattaggaattcacgaagattcacaaaacagagccaaacttgctgacttaatgcgttaccaaaactccggc

SEQ ID NO: 1821 - DNA, 384 bp, Diabrotica virgifera
  Clone ID: LIB3026-034-Q1-E1-C6
ggaaggtcacgaattacctgaagatgaagaagagaagaagaaacgtgaagatgataaggccaaatatgaaggtctttgcaaagttatgaagagcatccttgataacaaagttgaaaaggttgtggtatctaaccgtttagtagaatctccatgctgtattgtaacctcacaatatggatggactgctaacatggaacgtatcatgaaagcccaagctctccgtgacacatcaactatgggttacatggcagccaagaaacacctagaaatcaaccctgaccattccatcattgaaaaccttagacagaagacagaagttgataaaaatgataaggctgtgaaagatcttgtcatcttgctcttcgagactgccctccttaactc

SEQ ID NO: 1822 - DNA, 413 bp, Diabrotica virgifera
  Clone ID: LIB150-022-Q1-E1-C5
cagacgcgtgggcaatggcggacgcagctccagccggtggacgtggtggattccgaggaggttttggaggtggtggccgtggaggcggtagaggtggtcccagaggccgaggtagaggtcgtggcagaggacgtggtcgtggaaaggaagatcaaaaagaatgggtaccagtaaccaagctaggacgtttagtcaaggatggaaagatccgttctcttgaagaaatctacctgttctctttgccaatcaaagaattcgaaatcatcgatcatttcattggatcagacttgaatgatgaggtattgaaaatcatgcctgtccagaagcaaactcgtgctggtcaacgtacacgtttcaaggcgtttgttgccattggagatagcaaaggacacattggattaggtgtaaaatgc

SEQ ID NO: 1823 - DNA, 381 bp, Diabrotica virgifera
  Clone ID: LIB150-040-Q1-E1-E1
agccgaagaagaatgaactaaacaatggcggacgcagctccagccggtggacgtggtggattccgaagaggttttggaggtggtggccgtggaggcggtagaggtggtcccagaggccgaggtagatgtcgtggcagaggacgtggtcgtggaaaggaagatcaaaaagaatgggtaccagtaaccaagctaggacgtttagtcaatgatggaaagatccgttctcttgaagaaatctacctgttctctttgccaatcaaagaattcgaaatcatcgatcatttcattggattagacttgaatgatgaggtattgaaaatcatgcctgtccacaagcaaactcgtgctggtcaacgtacacgtttcaaagcgtttgttgcc

SEQ ID NO: 1824 - DNA, 419 bp, Diabrotica virgifera
  Clone ID: LIB150-014-Q1-E1-H7
attcccggggcccatcacgcatccggaggaagtccgaactaaacaatggcggacgcatctccagccggtggacgtggtggattccgaggaggttttggacgtggtggccgtggaggcggtaaaggtggtcccagaggccgatgtagaggtcatggcaaaagacgtggtcgtggaaaggaagatcaatgtgaataggtaccactaaccaagctacgacgtttagtcaaggatggaaagatccgttctcttgaacaaatctatctgttctcggtgccaagcaaagaattcgagatcagcgatcatttcattggatgagacttgactggagaggtattaagaatcatgcgtgtccagatccatacgcgtgctgggcaacctagacgtttcagagcgtttgttgccattggtgatagcagagg

SEQ ID NO: 1825 - DNA, 460 bp, Diabrotica virgifera
  Clone ID: LIB150-015-Q1-E1-E8
gatatgttgttgaacggaaaaaaagtatatgtaagtcgctttattccacacaaagaaagagaaaaggaactgggagaaaaagccaagctgttcacaaatgtttatgttaaaaattttggtgaagattttgctgaagaacagttaaaggttatgtttgcaaagtatggtaaaagtaccagctacaagataatgagtaaataagatggtaaatcaaaatgatttgggtttgtaacctttgaaagttcagaggcagcagaagcggcagttgatgctttaaatggaaaagagttggttgaaggaaaaccttttgtatgttggaagaacccaaaagatagctgagcgtcaacaagaactaatacgtcgctttgaagccttaaaaatggtaacacttaatcgctatcagggtgtaaatctctatgttaagaatctacatgatacattagatgatgaacgtctccgt

SEQ ID NO: 1826 - DNA, 409 bp, Diabrotica virgifera
  Clone ID: LIB149-025-Q1-E1-H7
aagcacatttaacttctcagtacatgcagcgtatggcaaatatgagaatgcaccagatgggtcagttcatacaaccaggtgcatctagcggttattttgttcctaccattcctgccgcacaaagattctatggaccagcacagatgactcaaattcgtgctagtaccagatgggccgcccaaacaactgtaagacagggtgctcaaggaggaactactgtataccccggtatgcaaaacacttacagagctactgcccgcccaccaaatcagtcaacaaccatgcgtagcaacatgagtgtacctaggcaaattactggacaacaaccacaaaatgcaattgtacctgctgctgttaacagaacagccaacttcaaatacacttcaaacatgagaaatcaccacaacct

SEQ ID NO: 1827 - DNA, 378 bp, Diabrotica virgifera
  unsure (1)..(378): unsure at all n locations
  Clone ID: pGUT3042
gtacatgcagcgtatggcaaatatgagaatgcaccagatgggtcagttcatacaaccaggtgcatctagcggntattttgttcctaccattcctgccgcacaaagattctatggaccagcacagatgactcaaattcgtgctagtaccagatgggccgcccaaacaacttgtagacagggtgctcaaggaggaactactgtataccccggtatgcaaaacacttacagagctactggccgcccaccaaatcagtcaacaaccatgcgtagcaacatgagtgtacctaggcaaattactggacaacaaccacaaaatgcaattgtacctgctgctgttaacagaacagccaacttcaaatacacttcaaacatgagaaa

SEQ ID NO: 1828 - DNA, 370 bp, Diabrotica virgifera
  Clone ID: LIB150-046-Q1-E1-B2
ccacgcgtccggaagatatttgtccttctacacacaacatggatgtaccccatgttaaacgtgaagattatcagttgacagatatttctgatgatgactacttatcccttatgtctgataatggtgaattacgtgaagatttaaaagttccagatggtgaagttggtggtacagtacgtgcagaacatgctgccggcaaggatatattatgtaccgtactgaagtcttgtggtgaagaagtcgttattgcagtaaaaacaaatactgctcttgataaataataatagccggttgtaagacagcggggtcgagaacgcaggcgtcatcctttgtctactggggattcccgcttttagattttaagaatata

SEQ ID NO: 1829 - DNA, 386 bp, Diabrotica virgifera
  Clone ID: LIB150-046-Q1-E1-B3
tctatagtgagtcgtattaatatttgtccttctacacacaacatggatgtaccccatgttaaacgtgaagattatcagttgacagatatttctgatgatgactacttatcccttatgtctgataatggtgaattacgtgaagatttaaaagttccagatggtgaagttggtggtacagtacgtgcagaacatgctgccggcaaggatatattatgtaccgtactgaaatcctgtggtgaagaagtcgttattgcagtaaaaacaaatactgctcttgataaataataatagccggttgtaagacagcggggtcgagaacgcaggcgtcatcctttgtctactggggattcccgcttttatagtttaggaatatatttagcagattg

SEQ ID NO: 1830 - DNA, 382 bp, Diabrotica virgifera
  Clone ID: LIB149-034-Q1-E1-D9
agcccacgcgtccgcggacgcgtgggatttgtccttctacacacaacatggatgtaccccatgttaaacgtgaagattatcagttgacagatatttctgatgatgactacttatcccttatgtctgataatggtgaattacgtgaagatttaaaagttccagatggtgaagttggtggtacagtacgtgcagaacatgctgccggcaaggatatattatgtaccgtactgaagtcttgtggtgaagaagtcgttattgcagtaaaaacaaatactgctcttgataaataataatagccggttgtaagacagcggggtcgagaacgcaggcgtcatcctttgtctactggggatccccgcttttatattttatgaatatattt

SEQ ID NO: 1831 - DNA, 458 bp, Diabrotica virgifera
  Clone ID: LIB150-019-Q1-E1-F6
ggaggagtagtcgttgactccccaaaatgcagatcttcgttaaaaccttaacgggtaagaccatcactcttgaggtcgagccctcagatactatcgaaaatgtgaaagctaaaatccaggataaagaaggaattcccccagaccagcaacgtctcatcttcgctggaaaacaactcgaagatggtcgtaccttgtctgactataatattcaaaaagaatcaacccttcacttggtgttgagattgagaggaggtgctaagaaacgtaagaagaagaattactccacccccaagaaaatcaagcacaagaagaagaaggttaagttagctgtattgaaattttataaggttgacgaaaatggtaaaatccaccgattgagacgtgaatgccccgctgaacaatgtggagctggtgtcttcatggcagccatggaagacaggcattactgtggcaagtgc

SEQ ID NO: 1832 - DNA, 445 bp, Diabrotica virgifera
  Clone ID: LIB3026-017-Q1-E1-H4
gtggagtagtcgttgactccccaaaatgcagatcttcgttaaaaccttaacgggtaagaccatcactcttgaggtcgagccctcagatactatcgaaaatgtgaaagctaaaatccaggataaagaaggaattcccccagaccagcaacgtctcatcttcgctggaaaacaactcgaagatggtcgtaccttgtctgactataatattcaaaaagaatcaacccttcacttggtgttgagattgagaggaggtgctaagaaacgtaagaagaagaattactccacccccaagaaaatcaagcacaagaagaagaaggttaagttagctgtattgaaattttataaggttgacgaaaatggtaaaatccaccgattgagacgtgaatgccccgctgaacaatgtggagctggtgtcttcatggcagccatggaagacaggcattac

SEQ ID NO: 1833 - DNA, 408 bp, Diabrotica virgifera
  Clone ID: LIB3026-026-Q1-E1-B1
gtccgatggtattacccgttaaggttttaacgaagatctgcacattttcgatagtatctgagggctcgacctcaagagtgatggtcgtacccgttaaggttttaacgaagatctgcattttggggtccagccctcagatactatcgaaaatgtgaaagctaatatccacgataaacagggaattcccccagaccagcaacgtcacatcttcgctggaaaacaactcgaagatggtcgtaccgtgtctgactataatattcacaacgaatcaacccttcacttggtgttgagattgagaggaggtgctaagaaacgtatgaagaagaattactccacccccaagaaaatcaagcacaagaagaacaacgttaagttagccgtattgaacttttaaaaggttgaacaaaa

SEQ ID NO: 1834 - DNA, 422 bp, Diabrotica virgifera
  Clone ID: LIB150-039-Q1-E1-D5
accacgcgtccgcgagagaatacgaatctaaaaattacaaaattagtttaatagattgcaacaaaatgtccgtagcagactttttcatagataaaaatgtattcattactggaggcagtggatttctaggaaaactgataatagaaaagcttctaagatcatgtccaggcatcggaaaaatctatgttttgttaagaccaagaaaaggtaaagcaattgaagagcgtcttgaaaaaattatcgaatcacctatatttaatccattgcgtcatcaaaatccagatgctttgaggaaactcattccaattaaaggcgatgtttcggaattaaatttaggtataagcaaagaagatcgagagttactagttaacactgtacatataatataccattcagcagcttcagttcgttttgatgacttc

SEQ ID NO: 1835 - DNA, 377 bp, Diabrotica virgifera
  Clone ID: LIB150-025-Q1-E1-H6
tctaaaatgcgtcgtatgacgcgtgggtgaaaacttgggattgaataacaaggatatcgaaacattaatcaatgaagtaaatgtagtatttcacatgggagccactttaaagttggaggctaagttgtgcgatgctatagaacagaacacagcaggtacggcaagagttatagacattgctaaaaagatgaagaatatagaagcatttttgcacttcagcacagcgttctgttctgctgatgttgatgtttttgaagaaaaggtttactcgagtcaagataatccaagggatgttatggatgtaacaaaatggttgaacccaaatgcactagaacttgcaactccctcaataatacagccgcatccaaatacataca

SEQ ID NO: 1836 - DNA, 385 bp, Diabrotica virgifera
  Clone ID: LIB150-028-Q1-E1-E7
tacgaaggtgccggtgaataggtgacattggatttatttaagtgcagatataagacaagtaagactaactaaaaatgacaccagatgttccagataggattgctgaagtttttaagggtagtaccatattcctaactggtgctacaggattagtgggtaaagcgctcatagaaaagattctgaagttatgtgatgttaacaaaatatatcttttaatacgagacaagaaaggaaagacaccaaatgaaaggataaaagacatatttagtaatccactctaccaaactgttctggcacgaaaaccagattgtcaaaaaaaatgtataccaattcctggagatgtttcactagtcaatttgggaatatcggacgaaaacagaaaaat

SEQ ID NO: 1837 - DNA, 464 bp, Diabrotica virgifera
  Clone ID: LIB150-030-Q1-E1-E11
gccaaaatcactatagaaacaaaacccagtgaagaagaaattagtccaaatgaatattttaaacttagatcaacagctgtagataaactaaagggtatagggggtgaacagtcgccttatcctcataaattccatgtttcgtcatcactcgagagttttattgagaagtattcatatctgaaagacggtgatattctatagaatgagcaccttagtgtggcaggaagaattcatgctattagagagtcaggtcctaaattagttttctacgacttgatgggtgagggagttaagatacaagtcatggctaatgctagatattatgaagatgaatcgatatttgtagatgatacagctaaaatcaggataggggatatcattggtatagaaggagttccaaccaatacaaagaaaggcgagctgtcaatcctaccacagaaaatcaaacttttggcaccttgttt

SEQ ID NO: 1838 - DNA, 297 bp, Diabrotica virgifera
  unsure (1)..(297): unsure at all n locations
  Clone ID: LIB3026-019-Q1-E1-D5
agcccacgcgtccgcccacgcgtccgtgttaaatttccaacaaatctcaccagtgccgaagctcaaaagttcttgaatgacctttgtattaagcacaatgttgattgcacgccccctagaactgccaacaggttgctggacaagctgattggagatttcattgaagaaaaatcaattaatcccactttcattatcgaacatcctcaagtaatgagtccattggccangtgggatagatctattccgggattgaccagaagattccaactttttggaatgaaaaaagaaatttgcaat

SEQ ID NO: 1839 - DNA, 399 bp, Diabrotica virgifera
  unsure (1)..(399): unsure at all n locations
  Clone ID: LIB150-029-Q1-E1-F10
acaacaccctatagagagtcgtattagnngctgngcccagtggccgaagacnttagtcctgttgtgtatttgacagttaattcatcagctgatgttacactaaagggtatagggggtgaagattctttttatcctcatgtgttccacgtttcgtcatcagtcgagagttttattgataagtactcatatctgacagacggcgatattctatcgattgacgaccttaatgtgggaggaagctttcatgctattaacgagtcaggtcgtatgttagttttctactccttcatgggttagggagttaagatatacttcatggctaatgctaaatattatagtcattagtcggtctttgtagatgatactcctaagatcatgatcaggggatatcattggtac

SEQ ID NO: 1840 - DNA, 330 bp, Diabrotica virgifera
  Clone ID: LIB150-016-Q1-E1-F4
ccacacgcgaccgcccaagcgtccgcccaagcgtccgctggagcaacaaaccgtggtggtagcttttctgacaaggataaattcctttaatttgttgaagaacttcgtaaagcctttgacaatgaaggaaaaggatgggaaattacaatggctgtaccggtagctaaatttaagcttcaagaaggttattacgttaccgagttatgcgacttatttgatgctatccatgttatgtcttacgatctaagaggaaactgggctggttttgcagattaccacagtccactgtataagagacctcatgatcaatgggcctatgagaaactgaat

SEQ ID NO: 1841 - DNA, 363 bp, Diabrotica virgifera
  Clone ID: LIB149-023-Q1-E1-H11
tttccctggaagcctccaaacaataaacgcaaacccaagcaaagtaatggggtactttaacaattggggcaaatacaagacaagaaatggaagatatgctttggacgatgtcccagttgacctatgtacgcatttaatttattcatttattggagttgacgataaatcatggagtattttggttatagatccagagctggatattgaacaaaatggattcagaaactttagtgatattaagaaaactcatccccacgttaaattagaaatagcagtaggagggtgggccgaaggtggatccaagtattccgcactggtagctcaacaggcaagaagggattcttttatcagcagtgtagttgc

SEQ ID NO: 1842 - DNA, 350 bp, Diabrotica virgifera
  Clone ID: pGUT1450
cagaacctcatgtatcaacaacagcaaggcccgaatgggatcgaccaaaaagtacaacttcttcaggcagtgcaacagtagtaacttcatctacacctaaaccacctaaaccaacgtactccagtacggttcccacttcacagcaaaccacaaatggagctcctactcaacctactgcaccttcgtcatcgtcatattatcccgaagatgcagataatttaacagaatgtgatgcagatttcatgccacatagagactgtgataaatactaccgctgtgatcatggcaaacccaccttgtttaactgcgaaccttggacttgttttcatactggtctcaatgtatgcgac

SEQ ID NO: 1843 - DNA, 346 bp, Diabrotica virgifera
  Clone ID: LIB150-043-Q1-E1-F9
tgagtcgtattagcatggaagtagtaatttcattccaaaatgaagatcggactttgtgcttacagcgggtacaaaatttaccccggacatggcaaagcaatggttgaagttgatggagagaggttcactttccggggggcagaatgtgaaagggcgcacttgatgaagaggaagccccgtaaagtagcatggactgtcttgtacagacgtagacataagaagggtcaggacgaagaggccaccacgaagcgtagcagagtgacgcagagattccagagggctagtgtaggtgcgtcgtgagatgatatcatggccacgagatgacgagggcctgagatgaggaagg

SEQ ID NO: 1844 - DNA, 327 bp, Diabrotica virgifera
  Clone ID: LIB150-043-Q1-E1-F8
aggacgcgtgggctgtcatttaagtagtaatttcattccaagatgaagatccgactttgtgcttacagcgggtacaaaatttaccccggacatggcagaactatggttaaagttgatggaaagaccttcactttcctcaactcagaatgtgaaagggcgcacttgatgaaaacgaacccccgtagagtaacatggactgtcttgtagagacgtcaacataataagggtcaggaggaagaagccacgaaaaggcgtaccacaaggacacagaaattccaaatggctattgtacgtgcttcgtgaaatgagatcaaggccatgtagaaa

SEQ ID NO: 1845 - DNA, 412 bp, Diabrotica virgifera
  Clone ID: pGUT2397
agaaggacacagaaattccaaagggctattgtaggtgcttctttaaatgatatcatggccaagagaaaccaaaggcctgaagtaaggaaggcccaaagggagcaagccattcgtgccgctaaggaacagaaaaagagcacaaagacagccaagaaggctacagcccccgccaaggccaaacctgctcctaaacagaaagtaaccaagaatcaacccaaagctgcacctagagtaggaggaaaacgttaatattgtataaacgttatttaataaaataagtttttttccaaaaaaaaaaaaaaaaaaaaaaaaaaaaaaaaaaaaaaaaaaaaaaaaaaaaaaaaattggggggggggccccccccaaaatttcccttttggggggggtttaaaaaaaacggggggggggttt

SEQ ID NO: 1846 - DNA, 394 bp, Diabrotica virgifera
  Clone ID: LIB150-050-Q1-E1-E9
atttagttacgaattgtctgcaaataattaattacaagatggctaaagccccagctgtacgtattgatttaggaaccacatactcctgtgtatgagttttccaacatggcaaagttgaaattattgccaacgagcaaggtaacagaaccacaccatcatatgtggccttcacagacacagaacgtctcatcggacatgctgccaagaaccaggtacccatgaaccccaataacacaatttttgatgccaaacgtcttaatgggcgtcgctttgatgacagtgctgtacagtctgacatgaaacattggccatttgaagtagtaaatgatgcatgtaaaccatacattaaagttgcatacaatggcgaacacaaatccttcacccagaagaagtc

SEQ ID NO: 1847 - DNA, 311 bp, Diabrotica virgifera
  Clone ID: pGUT1597
gcacacgtaacttaagtatttatttaagaattgtctgcaaataattaattataagatggctaaagccccagctgtaggtattgatttaggaaccacatactcctgtgtaggagttttccaacatggcaaagttgaaattattgccaacgaccaaggtaacagaaccacaccatcatatgtggccttcacagacacagaacgtctcatcggagatgctgccaaaaaccatgtatccatgaaccccattaacacaatttttgatgcccaacgtcttatcgggcgtcgctttgatgacagtgctgtacagtctg

SEQ ID NO: 1848 - DNA, 226 bp, Diabrotica virgifera
  Clone ID: LIB150-005-Q1-E1-B4
acatactcctgtgtatgaattttccaacatggcaaagttgaaattattgccaatgaccaaggtaacagaaccacaccatcatatgtggcattcacagacacagaacgtctcatcggagatgctgccaagaaccaggtatccatgaaccccaataacacaatttttgatgccaaacgtcttattgggcgtcgctttgatgacagtgctgtacagtctgacatgaaac

SEQ ID NO: 1849 - DNA, 450 bp, Diabrotica virgifera
  unsure (1)..(450): unsure at all n locations
  Clone ID: LIB150-043-Q1-E1-H7
gatacaagccactggattgagtcgtagcaagttaagtgaggctgtgagatcttgtggttcagtaaacatgaacaaattaatatttttagctttattagtgttcccagcagtcattttcattttcgaaaatggcaaaatggtatcgtatgctgaagaggaccccattgaggacgaagtanaagttgaaggggaagttgactctgatgttgaagcgacgactccagatgaagaagtggatgaagatacaaagtcactttcatcaccatatgctgatactaccctgttgtttgtgaagcctgaatctactggagcctctcaactagaaattccggctggccttcctgtcgaattccttgtaggattccgcaacaaaggtgatcaagattttgttgtagacacccttgaagcttccttccgctatccaatggacttcaacttcttcatccaaaa

SEQ ID NO: 1850 - DNA, 393 bp, Diabrotica virgifera
  Clone ID: LIB149-005-Q1-E1-F1
agcccacgcgtccggaatctttggagaaaagcttgtaaaactcaaaatttgaatgaggttaagtaacttctttttgacacattttctatttatttaaggcaaaatggtatcgtatgctgaagaggaccccattgaggacgaagtagaagttgaaggggaagtggactctgatgttgaagcgacgactccagatgaagaagtggatgaagatacaaagtcactttcatcaccatatgctgatactaccctgttgtttgtgaagcctgaatctactggagcctctcaactagaaattccggctggccttcctgtcgaattccttgtaggattccgcaacaaaggtgatcaagattttgttgtagacacccttgaagcttccttccgctatccaat

SEQ ID NO: 1851 - DNA, 430 bp, Diabrotica virgifera
  unsure (1)..(430): unsure at all n locations
  Clone ID: LIB150-033-Q1-E1-C9
agagacttgctaaaatacaagcaagttaagtgaggctgtgagatcttgtggttcagtaaacatgaacaaattaatatttttagctttattagtgttcccagcagtcattttcattttcgaaaatggcaaaatggtatcgtatgctgaagaggaccccattgaggacgaagtagaagttgaaggggaagttgactctgatgttgaagcgacgactccagatgaagaagtggatgaagatacaaagtcactttcatcaccatatgctgatactaccctgttgtttgtgaagcctgaatctactggagcctctcaactagaaattccggctggccttcctgtcgaattccttgtaggattccgcaacanaggtgatcaagattttgttgtagacacccttgaagcttccttccggctatcaatggacttcaac

SEQ ID NO: 1852 - DNA, 379 bp, Diabrotica virgifera
  Clone ID: LIB3026-029-Q1-E1-F8
acccacgcgtccggttaaactttatcaaaaatggtacaaaaggaatctcagaaagtaaatttaccttgggttgaaaaatatcgtccaagtacacttgatgatttagtgtcgcatgaggatattataaaaacagtcagtaaatttattcgagatgatcaggtaccccacttgctcttctatggacctcccggtacaggaaaaacaagtacagttttggcatgtgcaagacaattgtatactcccgcccagtttccatcaatggtcttagagttgaatgcttcagatgaccgaggaataggcattgtcagaggccatattctgacatttgccagtacaggaacaattttcaagtctggcttcaagcttattattttggatg

SEQ ID NO: 1853 - DNA, 373 bp, Diabrotica virgifera
  Clone ID: LIB150-004-Q1-E1-H11
agtagctttaatttttgtgttaactgttaaactttatcaaaaatggtacaaaaggaatctcagaaagtaaatttaccttgggttgaaaaatatcgtccaagtacacttgatgatttagtgtctcatgaggatattataaaaacagtcagtaaatttattcgagatgatcaggtaccccacttgctcttctatggacctcccggtacaggaaaaacaagtacagttttggcatgtgcaagacaattgtatactcgcgcccagtttccatcaatgggcttagagttgaatgcttcagatgaccgaggaataggcattgtcagagggcatattctgacatttgccagtacaggaacaattttcaagtctggcttca

SEQ ID NO: 1854 - DNA, 318 bp, Diabrotica virgifera
  Clone ID: LIB150-004-Q1-E1-H10
agtagctttaatttttgtgttaactgttaaactttatcaaaaatggtacaaaaggaatctcagaaagtaaatttaccttgggttgaaaaatatcgtccaagtacacttgatgatttagtgtctcatgaggatattataaaaacagtcagtaaatttattcgagatgatcaggtaccccacttgctcttctatggacctcccggtacaggaaaaacaagtacagttttggcatgtgcaagacaattgtatactcccgcccagtttccatcaatggtcttaaagttgaatgcttcagatgaccgaggaataggcattgtc

SEQ ID NO: 1855 - DNA, 397 bp, Diabrotica virgifera
  Clone ID: LIB149-021-Q1-E1-E3
ggtcgaggccgcgtccgaccgtattccaaaggtacaaaaactgttgcaagatttcttcaatggtaaagaattgaacaagtcgatcaaccccgatgaagctgttgcttatggtgcagccgtccaagccgccatcttgcacggagataagtctgaggaagtacaggacttgctcttgctcgatgtcactccactctcattgggtattgaaactgccggaggtgttatgactgccctcatcaaacgtaacactaccattcccaccaagcaaacccagaccttcactacttactctgacaagcaacccggagtacttattcaggtatatgaaggtgaacgtgccatgaccaaggacaacaacctcttgggaaaattcgaacttactggcattcctcctgcg

SEQ ID NO: 1856 - DNA, 344 bp, Diabrotica virgifera
  Clone ID: LIB150-008-Q1-E1-E11
accacgcgtccgcattgctgtagtgcacacgtaatttaagtatttatttaagaattgtctgcaaataattaattataagatggctaaagccccagctgtaggtattgatttaggaaccacatactcctgtgtaggagttttccaacatggcaaagttgaaattattgccaatgaccaaggtaacagaaccacaccatcatatgtggcattcacagacacagaacgtctcatcggagatgctgccaagaaccaagtagccatgaaccccaataacacaatttttgatgccaaacgtcttattgggcgtcgccttgatgaaagtgctgtacaatctgacatgaaac

SEQ ID NO: 1857 - DNA, 279 bp, Diabrotica virgifera
  Clone ID: LIB3026-023-Q1-E1-F12
catcttgcacggagataagtctgaggaagtacaggacttgctcttgctcgatgtcactccactttcattgggtattgaaactgccggaggtgttatgactgccctcatcaaacgtaacactaccattcccaccaagcaaacccagaccttcactacttactctgacaaccaacccggagtacttattcaggtatatgaacgtgaacgtgccatgaccaaggacaacaacctcttgggaaaattccaacttaccggcattcctcctggcgccccgtggtg

SEQ ID NO: 1858 - DNA, 443 bp, Diabrotica virgifera
  Clone ID: LIB150-017-Q1-E1-A12
gggtccaccaacccgtcggcatgattacaggaccaaattaggagtagtttagaataaagtcacattaggaaatacctttaacctttacaatactatcagcggtttttctaataattcagaaatcattccaaaatggaaattcagtacttaactaaggaccatttaattgggtttgataattacaagtataactgcatagactctggcatattgagtatatatgttatgcaccccttctggaactgggtagtaaaatactgtccacgtttcatagctccaaatttactcacatttactggatttctgtttacggtgatcagttacctaatttttgcgctactcgattataacttttatgcttcggactcggatcgtcctgatatagaaccacttgggaactggacgttctgggcagctggcatactactatttgtagcttacac

SEQ ID NO: 1859 - DNA, 401 bp, Diabrotica virgifera
  Clone ID: LIB150-016-Q1-E1-A6
caggaacaaattatgagtagtttagaataaagtcacaataggaaatacctttaacctttacaatactatcagcggtttttctaataattcagaaatcattccaaaatggaaattcagtacttaactaaggaccatttaattgggtttgataattacaagtataactgcatagactctggcatattgagtatatatgttatgcaccccttctggaactgggtagtaaaatactgtccacgtttcatagctccaaatttactcacatttactggatttctgtttacggtgatcagttacctaatttttgcgctactcgattataacttttatgcttcggactcggatcgtcctgatatagaaccacttgggaactggacgttctgggcagctgccaaactact

SEQ ID NO: 1860 - DNA, 403 bp, Diabrotica virgifera
  Clone ID: LIB3026-005-Q1-E1-G9
cccacgcgtccgcggacgcgtgggtttttaccatgtggaatgtgatgatgaatttttatatgacacatttcgaaaagtacaataccggggtgatgttcttgccctggggatatgatttctctatgtgggggacaataataacattccttatagctgggatatttggatcagaaatctggcaattccgatttggcagtgtaacagctggcaacatatttgagctgactctctatatttcttcactcatatcgaatgtacctgtaatatcttataatatttatctatcttacaagaataaaactggcaagatgagaccattttcagacgccatcagaccactcttgcctgtgggatcattctttctaatatcactagtgtggatcctctactcccctggtaacat

SEQ ID NO: 1861 - DNA, 397 bp, Diabrotica virgifera
  Clone ID: LIB3026-034-Q1-E1-F3
gttgattggagagaaagtgctgttttgggagtcaaagatcaaggacagtgtggatcatgctgggctttcagtaccaccggatccctcgaaggtcaactcgccatccacaaaaatcaacgtgttcctctcagtgaacaagaattggtagactgtgataaggtaaacgatggttgtgacggaggtttgatgacagatgccttcttttagattgaacatcatggtctttcatcagaagaacaatacccctatacaggcgtaaatggtcattgcaatcatgtaaaagacaaacaagtctcttcgatcagtggttacgtcaaacttgatgaaactgaaagtgctctagctgatgctctcgctaatgttggtccagtgtcaatagctgtcgaagctgatacat

SEQ ID NO: 1862 - DNA, 397 bp, Diabrotica virgifera
  Clone ID: LIB3026-014-Q1-E1-C12
atcatgctgggctttcagtaccaccggatccctcgaaggtcaactcgccatccacaaaaatcaacgtgttcctctcagtgaacaagaattggtagactgtgataaggtaaacgatggttgtgacggaggtttgatgacagatgccttcttttatattgaacatcatggtctttcatcagaagaacaatacccctatacaggcgtagatggtcattgcaatcatgtaaaagacaaacaagtctcttcgatcagtggttacgtcgaacttgatgaaactgaaagtgctctagctgatgctctcgctaatgttggtccagtgtcaatagctgtcgaagctgatacatggcaattctattcaggtggagttttcaacaataaaaattgtggagacgctctt

SEQ ID NO: 1863 - DNA, 421 bp, Diabrotica virgifera
  Clone ID: LIB3026-035-Q1-E1-C6
aaacaatccttcattgcaaaacacgtagtcgatcccaatgtccaagctgtagaagaagttgattggagagaaagtgctgttttgggagtcaaagatcaaggacagtgtggatcatgctgggctttcagtaccaccggatccctcgaaggtcaactcgccatccacaaaaatcaacgtgttcctctcagtgaacaagaattggtagactgtgataaggtaaacgatggttgtgacggaggtttgatgacagatgccttcttttatattgaacatcatggtctttcatcagaagaacaatacccctatacaggcgtagatggtcattgcaatcatgtaaaagacaaacaagtctcttcgatcagtggttacgtcgaacttgatgaaactgaaagtgctctagctgatgctctcgctaatgttg

SEQ ID NO: 1864 - DNA, 465 bp, Diabrotica virgifera
  Clone ID: LIB149-012-Q1-E1-C5
ccggggccccccacgcgtccgaaaactttgatgagaacctttcaatccaagagatcaaaaatttgttaggagcaaagaaaggtaaattaggcgtggctaaagaatttacacacagtgaagatattcaagttcccaattctttcgatgcaagagaaaactggaaagaatgttcagatgttatcagcaccgttgtagatcaatccgattgtggatcttgctgggccgtcgctgcagcttctgcaatgagtgacagacgatgcatagcatcccagggaaagcttaaagtacctgtttcggctgaaaatctattgtcttgctgcgattcctgtggatatggatgcgaaagaggatatccaaccatggcatggagttattggatagatacaggaattactacaggaggcctttatggcagcaaacagggttgtcaaccttattcgcttcaaccatgtgaacatcatacag

SEQ ID NO: 1865 - DNA, 407 bp, Diabrotica virgifera
  Clone ID: LIB149-040-Q1-E1-A8
gagaaaactggaaagaatgttcagatgttatcagcaccgttgtagatcaatccgattgtggatcttgctgggccgtcgctgcagcttctgcaatgagtgacagacgatgcatagcatcccagggaaagcttaaagtacctgtttcggctgaaaatctattgtcttgctgcgattcctgtggatatggatgcgaaggaggatatccaaccatggcatggagttattggatagatacaggaattactacaggaggcctttatggcagcaaacagggttgtcaaccttattcgcttcaaccatgtgaacatcatacagagggtaataaagtacaatgcagcactttggactatgacacaccttcttgtaaacataaatgtgacgattcggcactcaattataagtccgag

SEQ ID NO: 1866 - DNA, 421 bp, Diabrotica virgifera
  Clone ID: LIB149-042-Q1-E1-E11
acccacgcgtccgcccacgcgtccggaaaactggaaagaatgttcagatgttatcagcaccgttgtagatcaatccgattgtggatcttgctgggccgtcgctgcagcttctgcaatgagtgacagacgatgcatagcatcccagggaaagcttaaagtacctgtttcggctgaaaatctattgtcttgctgcgattcctgtggatatggatgcgaaggaggatatccaaccatggcatggagttattggatagatacaggaattactacaggaggcctttatggcagcaaacagggttgtcaaccttattcgcttcaaccatgtgaacatcatacagagggtaataaagtacaatgcagcactttggactatgacacaccttcttgtaaacataaatgtgacgattccgcactcaattat

SEQ ID NO: 1867 - DNA, 400 bp, Diabrotica virgifera
  Clone ID: LIB3026-002-Q1-E1-G9
tgcctgttgaatctggtgatgagtcctattgctgattaccttattaccaataagattacttctgttggtgctagtagaaaaatatttaacagtataggtgtattcataccgtctgttgccttacttactctgtgttttattggttcagaagaaaaagccttaacagtatttatgttggttatagcagtaggttgcaataccggtattttaattggtttccacgtgaatcacatagatatcgctcccaaccatgcgggtacactcatgggaattactaatgcaattggaaatgtggccgccattctggcgcctttggctgtggatatgtttaaacatgtgggtggttatgaagaaagtgataaagaactgtggaacatcgttttcatcaccgcggcagtac

SEQ ID NO: 1868 - DNA, 402 bp, Diabrotica virgifera
  Clone ID: LIB149-021-Q1-E1-D11
acatttttatgccttaatatacacatacacgtgcaatgtgttgggactgtggcttcttttaacccaaattcctacttacatgagcaaaatcatgaagtttgatataaaatctaacgggactttgacagcctcaatataccttagtcaatggctactgagcatcattttgggatccgtgtcagattatgtgattaacaggaaaattctcagtttaactctaacgagaaaactagtgtctggtgtaggtaccttcggaccagcgatttcacttgtattcctagctcaatgtaccgaagaaaatactgtcaagggtgtgattctgctatttcttgcagtcggtacaggaggtgcccaaatttgtagcattttaatcaacagcgtagatctttcacctaaccatgc

SEQ ID NO: 1869 - DNA, 333 bp, Diabrotica virgifera
  unsure (1)..(333): unsure at all n locations
  Clone ID: pGUT427
aaaattttcaatggaatttctggtattggagctggaacatcattattggtactgagttttttgcctgtaagtgctgttactctttcagttgttatgttagtcagtgctgtaggaatacagtcagcagctaccgcaggatatacgttaaatcatattgatttgtcaccgaatttctctgggacccttcaagcaatctgcaatagctgtggaagtggtttatcgatccttgcaccattatcagttcagttcatngtaggtgatgatgagacaaacaaacttaaatggcgcatcgtatttatagtagccgctatgatgtatattgttccaagcatc

SEQ ID NO: 1870 - DNA, 417 bp, Diabrotica virgifera
  Clone ID: LIB3026-031-Q1-E1-D10
cacacgcgtccggttaatcccgtaagggaccaagagcaatgcggatcatgttgggcatttagtgcagctggtgctcttgaaggacaaagatttttaaaggagggcaaactagaagtactgagtactcaacagttagtacattgttcccgtgattacaaaaatgaaggctgcaatggtggttggcctcattgggcatatgactacatcaaagataatggcctctgtctagagtctaagtacaaatatcaaggatatgacggttactactgcaaagagtgtattccggctatcaaaaaaatcaatggctattcatctataaatcaaactgaagaagcacttaaggaggctgtgggtacggctggcccaattgcagtatgtgtcaacgctaatgacgactggcaactgtacagcgggggt

SEQ ID NO: 1871 - DNA, 411 bp, Diabrotica virgifera
  Clone ID: LIB3026-014-Q1-E1-D11
agcagctggtgctcttgaaggacaaagatttttaaagcagaacgtactagaagtactgagtacccaacagttagtagattgttccggtgattacgacaatgaaggctgcaatggtggttggccccattgggcatataactacattaaagatcatggcctctgtctagagtctgactacaagtatcaaggattagacggtgactgcaaacagtgtaatccggttatcaaaaccatcaatggctatgcatctgtagatcaaaccgaagaagcacttaaggaggctgtaggtactgttggcccaatatcagtatgtgtcaacgctaattgggactggcaactgtatagcgggggtatccttgatagccaaagttgtccaggcgacattttaaaccatgcagttttagctgttgg

SEQ ID NO: 1872 - DNA, 276 bp, Diabrotica virgifera
  unsure (1)..(276): unsure at all n locations
  Clone ID: pGUT528
caccggcagagatggtcgctgcaagaatgttcagaacaaacaagtctcttccatcagtggctacgtagaacttgcaacaactgaaaatgcactcgtttccgctcttgctagcgtaggtccagtttccatcgctgttgatgctgatacatggcaattttatggaggtggagttttcaacaacagaaactgtggaaccgccctcaatcacggtattcttgctgttggatacactanagatgtattcattgtcaagaactcatggggaactagctgggg

SEQ ID NO: 1873 - DNA, 461 bp, Diabrotica virgifera
  Clone ID: LIB150-013-Q1-E1-E7
cccacgcgtccgactttttaaacctattgtgaagaaaaactattaaaaaaacaaaacaaattgtaaaatagtgtaaaaaagtaaaaaatatccaacgaagatgaatccggctgccccaaattatcctatggcgtctttatacgtcggcgatttacattctgatattactgaggccatgctttttgagaaattttcaaccgcgggtcctgtgctttcgattcgcgtgtgtagagacttgattacacgtcgatccttgggttatgcatatgtgaacttccaacaacctgcagatgctgagcgtgctttggataccatgaattttgacttgataaaaggtatgcctatccgcatcatgtggtctcaacgtgatccatcattgagaaaatctggcgttggaaatgtttttatcaagaacttaaatcgttccattgacaacacagccatgtacgatactttctcag

SEQ ID NO: 1874 - DNA, 392 bp, Diabrotica virgifera
  Clone ID: LIB149-005-Q1-E1-F4
aggactttttaaacctattgtgaagaaaaactattaaaaaaacaaaaaaaattgtaaaatagtgtaaaaaagtaaaaaatatccaacgaagatgaatccggctgccccaaattatcctatggcgtctttatacgtcggcgatttacattctgatattactgaggccatgctttttgagaaattttcaaccgcgggtcctgtgctttcgattcgcgtgtgtagagacttgattacacgtcgatccttgggttatgcatatgtgaacttccaacaacctgcagatgctgagcgtgctttggataccatgaattttgacttgataaaaggtaggcctatccgcatcatgtggtctcaacgtgatccatcattgagaaaatctggcgttggaaatg

SEQ ID NO: 1875 - DNA, 370 bp, Diabrotica virgifera
  Clone ID: LIB150-028-Q1-E1-A8
agacaaatacactttttaaacctattgtgaagaaaaactattaagaaaacaaaaaaaattgtaaaatagtgtaaaaaagtaaaaaatatccaacgaagatgaatccggctgccccaaattatcctatggcgtctttatacgtcggcgatttacattctgatattactgaggccatgctttttgagaaattttcaaccgcgggtcctgtgctttcgattcgcgtgtgtagagacttgattacacgtcgatccttgggttatgcatatgtgaacttccaacaacctgcaaatgctgagcgtgctttggataccatgaattttgacttgataaaaggtaggcctatccgcaacatgtggtctcaacggtgatc

SEQ ID NO: 1876 - DNA, 389 bp, Diabrotica virgifera
  Clone ID: LIB149-021-Q1-E1-G1
acaagttcccacggaatcaactgctgcccctggaccatacacaacaccagatctcatatgtacagatgaaaataattattttccttacatttatgattgctcaaaatactacgaatgttccaacggagtaccagttttaatggattgtccaaaaggagaattttggaatattaaactgaataactgcgattggcctcaaaatgttgattgttcatacgttgtaaccacatctggagcatctactgtatctactgaagcacctactaaagcacctacagaagcacctactgatgtacctaccgatgcacctacggaaggacctggaccatactacacgacaccagaaattatatgtaaagaagataatacttatttcccataaatttttg

SEQ ID NO: 1877 - DNA, 331 bp, Diabrotica virgifera
  Clone ID: LIB149-042-Q1-E1-B5
gtgagtcgtattaaaacctacatctgctgccccagatacttccacctcagctacgcaaagcactccttcacaagttcccacggaatcaactgctgcccctggacgatacacaacaccagatctcatatgtacagatgaaaataattattttccttacatttatgactgctcaaaatactacgaatgttccaacggagtaccagttttaatggattgtccaaaaggagaattttggcatattaaactgaataactgcgattggcctcaaaatgttgattgttcatacgttgtaaccacatctggagcatctactgtatctactgaagcacct

SEQ ID NO: 1878 - DNA, 379 bp, Diabrotica virgifera
  Clone ID: LIB149-041-Q1-E1-B4
attaccacaagtgcaaaacctacatctgctgccccagatacttccacctcagctacgcaaagcactccttcacaagttcccacggaatcaactgctgcccctggaccatacacaacaccagatctcatatgtacagatgaaaataattattttccttacatttatgactgcgcaaaatactacgaatgttccaacggagtaccagttttaatggattgtccaaaaggagaattttggcatattaaactgaataactgcgattggcctcaaaatgttgattgttcatacgttgtaaccacatctggagcatctactgtatctactgaagcacctactaaagcacctacagaagcacctactgatgtacctaacgaagcac

SEQ ID NO: 1879 - DNA, 438 bp, Diabrotica virgifera
  unsure (1)..(438): unsure at all n locations
  Clone ID: pGUT3670
cttggctatccaggctgttgaatccaaaccaagggctttccaacaacaacgcccagctggccaaaatgtagcagaagacgacctcgccaagaaagctcaagatttgatcaaaaaagccgatgaagtcgttactggaaacctccccagcaccgaacagatcatcaacaatgtagaggaaaccggcaaaaaattggttagcaacattaaagatttcaacgactaccttaagacccaactcactgcaaacaaaggtgatgtagacaaaatattgagacaagtatctgacaatntgcacgctgccagtgaaaaaatccaaaaagatgttttgggaccacaaggacaaaagaaagcttctgaaatcagagaaaacttacacgcacagatcanatccgctgtcactcanattgaaaaacttactgcagctgtcaaacccgaagc

SEQ ID NO: 1880 - DNA, 428 bp, Diabrotica virgifera
  Clone ID: LIB3026-008-Q1-E1-G12
gggtcggccacgcgtccggcaaaaaattggttagcaacattaaagatttcaacgactaccttaagacccaactcactgcaaacaaaggtgatgtagacaaaatattgagacaagtatctgacaatttgcacgctgccagtgaaaaaatccaaaaagatgttttgggaccacaaggacaaaagaaagcttctgaaatcagagaaaacttacacgcacagatcaaatccgctgccactcaaattgaaaaacttactgcagctgtcaaacccgaagcagagaaagtgaagaatgacttgttggctgctgctaacctcttcttggacaaagccatcaatgttgccgatgacttgaaaaaagtagtcgctgaacacaaaaactaaatgatctagtattttatatttatgatgttttaaatttttatgtaatat

SEQ ID NO: 1881 - DNA, 403 bp, Diabrotica virgifera
  Clone ID: LIB150-025-Q1-E1-C3
gcgtgtgaccacacgcgtccctaaggcatcgccttctacactttcaaaatgaacaaatacttcgttttcgttgccattgccttcttggctatccaggctgttgaatccaaaccaagggcttcccaacaacaacgcccagctgcccaaaatgtagcagaagacgacctcgccaagaaagctcaagatttgatcaaaaaagccgatgaagtcgttactggaaacctccccagcaccgaacagatcatcaacaatgtagaggaaaccggcaaaaaattggttagcaacattaaagatttcaacgactaccttaagacccaactcactgcaaacaaaggtgatgtagacaaaatattgagacaagtatctgacaatttgcacgctgccagtgaaaaaatccaaaaag

SEQ ID NO: 1882 - DNA, 398 bp, Diabrotica virgifera
  unsure (1)..(398): unsure at all n locations
  Clone ID: LIB150-006-Q1-E1-G2
acccacgcgtacgtcataattgaatactagtttgctgtagtgacacaaaatggattggctaaggatcagtttattatgtatatgtatattcaacatctatggtgcaccacatggagagaaagaagttagaattattagtcaaaccaacgaaatcgcccctgacgggggatatagctggagttttcaagctgataatggcataaaagctgaagaaacaggtaccttaatgaaaaccaacgatccagaaaatcctcaagttatcactgctcagggaaattattaatacactgacaatganggtaacaaaatatcactcacatatgttgctgatgatgacggcggtttccaaccacaacgagcccatttaccaacctctccccctattcctccaaatatac

SEQ ID NO: 1883 - DNA, 430 bp, Diabrotica virgifera
  Clone ID: LIB150-026-Q1-E1-E3
caactccccaaaatgaatccttttaaatggaaccggtccacctggggcttggcaacctgtcaatctgttaccgacgtcctgctgaagcaactgctgcaaatgctgcacctgctgcaagtggtccaacagctaacgctcaaccacccgttgctttaatcaaatacgagaatgaaagcgtcaacgctgatggatcatatcagtggagttttgaagcggccaacggcattaaacaagaagaaaagggatccttcaaaccaggtgctagtgaaggcgaaagtattgcagaagtctcaggccaggtcgagtatacagccgatgacggtacccccattcatttatcatacatagccaacgaaaacggcttccaacctcaaggagaccactttgccactcctccaacaattcctgaagcaattcaaaagtctttgga

SEQ ID NO: 1884 - DNA, 409 bp, Diabrotica virgifera
  Clone ID: LIB149-007-Q1-E1-E11
cccacgcgtccgcttgtgaaaaaaaaaattaaaatgaaactgttcatcgtctgcttggccatcttgtcagtctgttacggacgtcctgctgacgcacctgctgcaagtggtccaccagctaacgctcaaccacccgttgctttaatcaaatacgagaatgaaggcgtcaacgctgatggatcatatcagtggagttttgaagcggccaacggcattaaacaagaagaaaagggatccttcaaaccaggtgctagtgaaggcgaaagtattgcagaagtctcaggccaggtcgagtatacagccgatgacggtacccccattcatttatcatacatagccaacgaaaacggcttccaacctcaaggagaccacttgcccactcctccaacaattcctgaagcaattcaaa

SEQ ID NO: 1885 - DNA, 414 bp, Diabrotica virgifera
  Clone ID: LIB150-005-Q1-E2-A1
gtattagtagagaccattggcataaacgaaggtccacaggaggcaagaggaagcctctccgtaagaagaggaagttcgaattaggacgtccagccgcaaataccaaacttggagcacgtagaattcactatgtccgtacacgaggaggtcacttgaagtaccgtgcattgaggattgataaaggagatttcgcatggggcagcgaaggtactgcgcgtagaacacgtattagtgatgtcgtttacactgccagtaatagcgaattggtacgtaccattacattggtaaagaatgccatcgttgatattgacgcaacccctttcagacaatggtacgagagcactatattttacctttaggacgcaagataggggcaaaattgacagcgggagatgaagaaatgttcaataagaa

SEQ ID NO: 1886 - DNA, 332 bp, Diabrotica virgifera
  unsure (1)..(332): unsure at all n locations
  Clone ID: pGUT1747
gaggattgaaaaaggaaatttcgcatggggcagcgagggtactgctcgtaaaacacgtattattgatgtcgtttacaatgccagtaataacgaattggtacgtaccaaaacattggtaaagaatgccatcgttgttattgacgcaacccctttcagacaatggtacgaaagccactatattttacctttaggacgcaagaagggggcaaaattgacagcggaagatgaagaaatgttcaataagaaacgtagcanaaaagtacagaaaaaatatgaaactaggcaaaaaacagctaaagtagaacctgcattagaagaacaattctcaactg

SEQ ID NO: 1887 - DNA, 215 bp, Diabrotica virgifera
  unsure (1)..(215): unsure at all n locations
  Clone ID: pGUT1266
gaaaaaatatgaaactaggcaaaaaacagctaaagtagaacctgcattagaagaacaattctcaactggaaggttattagcttgcttagcgtcaaggccaggacaatgtggtaaagctgatggttacgtcttagagggtanagaactggaattctacattcgtaagattaagtctaagaaagctaaataaatgtttttataagtgtaaacaataa

SEQ ID NO: 1888 - DNA, 340 bp, Diabrotica virgifera
  Clone ID: pGUT3813
gtgatatttagtgcttacttggtacagcagtttcagtgctgtgctttagaataatttattttttaacatttatatagaaatcaaatactaaccaatcaacatgtgtgaagaagaagttgccgctttagtcgtaaacaatggatccggtatgtgcaaagctggttttgctggggatgatgcacctcgtgctgaattcccttcaattgttggacgcccaagacatcagggtgtgatggtaggaatgggacaaaaagatttctatgtatgtgatgaagctcaaaggaaaaagaggtattcttaccttaaaataccccatcgagccccgaatagtcacaaactg

SEQ ID NO: 1889 - DNA, 331 bp, Diabrotica virgifera
  unsure (1)..(331): unsure at all n locations
  Clone ID: pGUT1771
aattccgcacaaggatatttactgcttacttggtgcatcantttcagtgcgtgtggtttagaataatttattttttaacatttatatanaaatcaaatactaaccaatcaacatgtgtgaaaaagaagttgccgctttagtcgtagacaatggatccggtatgtgcaaagctggttttgcttgggatgatacacctccggctgtattcccttcaattgttggacgcccaagacatcagggtgtgattgtatgaatgggacaaaaagattcctatttaagtgatgaagctcaaataaaaaaagtatcctaccttaaataccccatccacacg

SEQ ID NO: 1890 - DNA, 250 bp, Diabrotica virgifera
  Clone ID: pGUT1579
gatatttagtgcttacttggtacagcagtttcagtgctgtgctttagaataatttattttttaacatttatatagaaatcaaatactaaccaatcaacatgtgtgaagaagaagttgccgctttagtcgtagacaatggatccggtatgtgcaaagctggttttgctggggatgatgcacctcgtgctgtattcccttcaattgttggacgcccaaaacatcagggtgtgatggtaggaatgggacaaaa

SEQ ID NO: 1891 - DNA, 407 bp, Diabrotica virgifera
  Clone ID: LIB149-011-Q1-E1-G10
acgtagaaaatcacaccatcgatgataattacaacaataaattgttaacagaggaagagtctgaaagcattttgcaaaaagaagaagcgatgaagcgtttggaagagaaatttaaacgtagaatgcaagatattgctgatttgactgaggagaaacaacgattggagcatttggtgctgcagttgcaaggcgaaaccgagaccattggagagtatgttgctctttaccagcaccagcgaatgatacttaaacaaaaagcgatggaaaaagaccagcaattcaaacaacttgcgacagatagagaacaaatcaaaataaagttagaaaaattaaaccacctcgtaggcgaattactaaaatctaaaaccttgagttcagaaattttgggccagtgtgagcgcttacac

SEQ ID NO: 1892 - DNA, 445 bp, Diabrotica virgifera
  Clone ID: LIB150-016-Q1-E1-H12
cactaaacgaaaaagaaatgctgatgaaagaactagctgccaaaaacgattccttgaatcaactagaaaccatggtggaacagttaaaaggaaatcaacctgatacagctaaattactggctactatggaaagtgacaaagtcgctgctgctcgagctgtccagcaaaatatggaactcaaagagcagttagagagtatggcagaagtatttgccaaaatgaacaatgacaaggtggaactgacagaaaagctaagcattcagcagtctgcaagtaaggacctacttgaaaaattgcaaaaaactgaattgcacttacagatgttaactgatgctatcgaaatcaaagatcgagagctttcgcatctccgagaggcatctgaactaaatgaggtgctggatcacgaagagcaacatacagatgaatcacacgagacttgttcaca

SEQ ID NO: 1893 - DNA, 357 bp, Diabrotica virgifera
  Clone ID: LIB150-008-Q1-E1-D4
atactaaagccctaaacgaaaaagaaatgctgatgaaagaactagctgccaaaaacgattccttgaatcaactagaaaccatggtggaacagttaaaaggaaatcaacctgatacagctaaattactggctactatggaaagtgacaaagtcgctgctgctcgagctgtccagcaaaatatggaactcaaagagcagttagagagtatggcagaagtatttgccaaaatgaataatgacaaggtggaactgacagaaaagctaagcattcagcaatctgcaaataagggactacttgaaaaattgcaaaaaactgaattgcacttacagatgttaactgatgctatcgaaatcaaag

SEQ ID NO: 1894 - DNA, 448 bp, Diabrotica virgifera
  unsure (1)..(448): unsure at all n locations
  Clone ID: LIB150-017-Q1-E1-G4
gtccgcaacttacgtctgtatcagtttgttatcgtgtttcatcagttcgtgttaacagttcagtgaagatgaaggccgtagtcagtgcattgtgtaccgaaaacgggatttccgccatcagcggaaaaatcaccaaacgcaaggatatcgagaacgaggagattcagatgtacctctccaaactcaaggatctcgttccgttcatgcccaagaacaagaaactatcaaaattggaagttattcaatacgttattgactatatttgtgatttacaaagtgctctggaaacgcatcctgccgtcaatgcttttgatgcagctgctgccttaggacagaagaagtcacaagcagcagtcagccccaggcagcctctaagagtcaggccgagccccaacaccatcctggcaccttgcgaagctcctgttcntcanaatgtcacgagttccga

SEQ ID NO: 1895 - DNA, 425 bp, Diabrotica virgifera
  Clone ID: LIB150-047-Q1-E1-A4
cgtccagtctgaatcagtttgttatcgtgtttcatcagttcgtgttaacagttcagtgaagatgaaggccgtagtcagtgcattgtgtaccgaaaacgggatttccgccatcagcggaaaaatcaccaaacgcaaggatatcgagaacgaggagattcagatgtacctctccaaactcaaggatctcgttccgttcatgcccaagaacaagaaactatcaaaattggaagttattcaatacgttattgactatatttgtgatttacaaagtgctctggaaacgcatcctgccgtcaatgcttttgatgcagctgctgccttaggacagaagaagtcacaagcatcagtcagccccaggcagcctctaggagtcaggccgagccccaaacacatcctgggaccttgccaagctcctgttcctcaaa

SEQ ID NO: 1896 - DNA, 343 bp, Diabrotica virgifera
  Clone ID: LIB149-047-Q1-E1-A1
agtttgttaccgtgtatcatcagttcgtgttaacagttcagtgaagatgaaggccgtagtcagtgcattgtgtaccgaaaacgggatttccgccatcagcgggaaaatcaacaaaacccaaggatatcgagaacgaggagattcagatgtacctctccaaactcaaggatctcgttccgttcatgcccaagaacaagaaactatcaaaattggaagttattcaatacgttattgactatatttgtgatttacaaagtgctctggaaacgcatcctgccgtcaatgcttttgatgcacctgctgccttaggacagaagaattcacaagcagcagtcagccccag

SEQ ID NO: 1897 - DNA, 408 bp, Diabrotica virgifera
  Clone ID: LIB149-007-Q1-E1-C6
aaccgttcacgatgaagagtttcctcagtattagcttcggacttttcctgtttttaggaatagaatcaaagtctttaaatgacaatattgttaaaaagcgagtatttgcggatctctatggaaaacttaacccaacggtaagaggagatcccggagaacccctcattttaacggacttgattgaagcaggaaaactggatgaagctcaagataaagctcgtgttcaaggattggacacggatattgaaagttactctgggtatttgactgttgataaagaacatgattctaatttgttcttctggttctttccttcacaaggcaatgcaaattttgacccggtagttctgtggctccaaggaggaccaagatctacatctaggtttggaccttttaaagaaaatggac

SEQ ID NO: 1898 - DNA, 410 bp, Diabrotica virgifera
  unsure (1)..(410): unsure at all n locations
  Clone ID: pGUT3680
ctatctcaaaaaaattttctaatcagaagcactgcacgtcgctgaaacttttgaatactatagagttttaaatttacagcggacaaacagatctcatgatcccttatgttntgacagagagctatttacagaatcttaaatttcctggatccgatgattatgcaaaagcagaaaggattgtatggcatgacgaanatgatccagatgtggttgctgggtacgcgaagacagctggaaatttaaccgaaattttggttagaaacgctggtcatctggtaccgacagatcaaccagaatgggcgctacaacttattaataagtttaccagaaacgtaacttttatctaattgacaataattaaataacattaacaaaaatttgcaaaattgtgtgattctataaataaagaa

SEQ ID NO: 1899 - DNA, 275 bp, Diabrotica virgifera
  Clone ID: LIB3026-005-Q1-E1-E7
gcagaaaggattgtatggcatgacgaaaatgatccagatgtggttgctgggtacgcgaagacagctggaaatttaaccgaaattttggttagaaacgctggtcatctggtaccgacagatcaaccagaatgggcgctacaacttattaataagtttacaagaaacgtaacttttatctaattgacaataattaaataacattaacaaaaatttgcaaaattgtgtgattctataaataaagaatacaacatacaagaaacaaacaaaaaaaccca

SEQ ID NO: 1900 - DNA, 443 bp, Diabrotica virgifera
  Clone ID: LIB3026-032-Q1-E1-C12
ttcgccgggccacgcacgcaaccgcaaacgcgtccgctttacaacaatcaaaccttcacagttaaagctaaaaaagaaatcattttagctgccggaacaataaactctccaaaactattactacaatctggagtcggaccaaaagatgctttggacgctgttggaattaaacagattcataacttaccaggtgtaggacaaaatttaactaaccatgtatctttcaaagtgaattactggattaacagtaccgttgatactagaatcatcacatggaaatctttagaggattatcttaacgatcggactgggcctctctctaccataggaattacggttacatgtcgacttccatctaaatatacaacagcagatgatccagatattcaaatgttcttctctttgagtcaaaatacttgctcaccagatggcgcaatttgatg

SEQ ID NO: 1901 - DNA, 420 bp, Diabrotica virgifera
  Clone ID: LIB149-013-Q1-E1-E4
ccgcaaacttgcacgtgatgttgaactctactgcgacccgcatcctattcgacggcaataaaacagcttacgcagtcaaatttgtttacaacaaccaaaccttcacagttaaagctaacaaagaaatcatgttatctgcaggaacaatgaactcacctaaaattctattacaatctggagtcggaccaagagacgctttggacgccgttggaattgaacagattcataacttacctggtgtaggacaaaatttacgtaagcatgtagctttcagtatgaattactgggttaacagtacagttgataccagaattattacatggcaaactttacaggattacattctaagatgaactggacctctggctagctcaggacttgctgttacaagtcgacttccatctaaatatgctactgctg

SEQ ID NO: 1902 - DNA, 256 bp, Diabrotica virgifera
  unsure (1)..(256): unsure at all n locations
  Clone ID: pGUT512
atcagcagttgcatatttagatggcagtcgactggtaacagcaagtcctgagctagccagaggtccagttcttcttagaatgtaatcctgtaaagtttgccatgtaataattctagtatcaactgtactgttaacccagtaattcatactgaaagctacatggttacttaaatgttgtcctacaccatgtaagtgatgaatctgttcaattccaacagcgtccanagcgtctattggtccgactccagattgtaat

SEQ ID NO: 1903 - DNA, 415 bp, Diabrotica virgifera
  Clone ID: LIB150-005-Q1-E2-A6
agcgattcttgtactatcagcattttttgacccacaaaaaaacacaaaatggatgaactcccaccagaacaaatcgccgtactccgcaaagcttttgaagctttcgacagccaaaaatcaggaagcattccatgtgatatggtagccgacatccttcgtcttatgggtcaacccttcgacaagaaaatcttagaagaactcattgaagaagtagatgctgataaatccggtcgtctcgaattcgaagaattcgttacattggctgccaaattcatcgttgaagaagatgatgaagctatgcaaaaagaacttaaagaagccttcaggttatatgataaagacggaaatggctacatcccaaccacctgcctcaaagaaatcttaagagaattagatgaccagctcacagacaaag

SEQ ID NO: 1904 - DNA, 437 bp, Diabrotica virgifera
  Clone ID: LIB150-044-Q1-E1-D1
accaagcgtccgcccacgcgtccgatactcccccaacactagctttgtcatttttttgtttcgattctgcaatacctagtccgccaaaatgtctgctgatgaactcccaccagaacaaatcgccgtactccgcaaagcttttgaagctttcgacagccaaaaatcaggaagcattccatgtgatatggtagccgacatccttcgtcttatgggtcaacccttcgacaagaaaatcttagaagaactcattgaagaagtagatgctgataaatccggtcgtctcgaattcgaagaattcgttacattggctgccaaattcatcgttgaagaagatgatgaagctatgcaaaaagaacttaaagaagccttcaggttatatgataaagacggaaatggctacatcccaaacaactgcctcaaagaaatcttaagagaat

SEQ ID NO: 1905 - DNA, 425 bp, Diabrotica virgifera
  unsure (1)..(425): unsure at all n locations
  Clone ID: LIB150-008-Q1-E1-A6
gagattcttgtactatcagcattttttgacccacaaaaaaacacaaaatggatgaactcccaccagaacaaatcgccgtactccgcaaagcttttgaagctttcgacagccaaaaatcaggaagcattccatgtgatatggtagccgacatccttcgtcttatgggtcaacccttcgacaagaaaatcttagaagaactcattgaagaagtagatgctgataaatccggtcgtctcgaattcgaagaattcgttacattggctgccaaattcatcgttgaagaagatgatgaagctatgcanaaagaacttaaagaagccttcaggttatatgataaagacggaaatggctacatcgcaaccacctgcctcaaagaaatcttaagagaattagatgacaagctcacagacaaagaattagatatg

SEQ ID NO: 1906 - DNA, 406 bp, Diabrotica virgifera
  Clone ID: LIB149-027-Q1-E1-C12
tccggatcgacccacgcctccgaataagcacaatgaatatcgttggacactctttgggtgctcacgtggctggtgtacctggcagaattctaaatggacaattggatcacattatgggtttggatccagctggtccactattcacaacagaaaacaccagaaaccgtctcatgcccgggagtgcacagtttgtccacgttattcacacttgtggtggtcttataggatatttaaatagcttaagtgatgccgattaatacccaaatggtggaaggaacaatcaacctggttgcgaaaccgatctgtttggtaaatgtgcccatccgttaaccattaagttctatattgaatcgatattaacgggtaacttcaaagccagaaatatcggctcgtatgacgacttcac

SEQ ID NO: 1907 - DNA, 406 bp, Diabrotica virgifera
  unsure (1)..(406): unsure at all n locations
  Clone ID: LIB149-030-Q1-E1-B3
gcgtcagcacggatggcacaacggtcacgactcgccagtctgcgatgagatatccatagctgtcctccagaaaaacgacatanacgttttcctaatcgattggaacanaatcgccagcaacctctacttagtagcttacaaagcagttccagaggtcggtcaattactatgaacactcattagaaatttggtcaacaacaataaattggatttgaataaagcttctatcgttggccattctttgggagctcatgtcgctggattggccggagctgaactgaacggacggattagtaacattgtaggtctggaccctgctctaccatgcttctcatacaacgatatcagtacaagattggacccctccgatgcacaatacgtcgaaagtaatacacacaatgcgcag

SEQ ID NO: 1908 - DNA, 402 bp, Diabrotica virgifera
  Clone ID: LIB149-024-Q1-E1-H11
atcaaattctacttgtttacccaaaaagacctattttatggtacacatctaaacatttccgacaaaggcgaaatcactagatctgatttctcgaaagacaaagacacggtgttctatattcatggatggttggacaacaactcctccgaaactctcataagtatcaaaaatgcatatctgtcaaaatatgacgttaatatgcttgttgtcgattggagtacgttcgcagacagtgtaatttataacgtagcctacgacaatgtagaaccgattggaaatgtacttggacattcaatagaacaccttgttcaaaatactggacaagacttaagcagaatgattatcgttggacactctttgggtgctcacgtggctggtgtagctggcagaattctaaatgga

SEQ ID NO: 1909 - DNA, 465 bp, Diabrotica virgifera
  Clone ID: LIB150-013-Q1-E1-A1
caaaaacggggcacatgtgctttgttaacaatttttagataaaactaactatcgaataattaaaagaacagtaaacttaaaccggtagaagttcttcaaaataacaaaaatgaacagcgaaaagttaaaaaagatgcaatcacaagtccgtatcggaggaaagggcaccccaaggcgtaagaagaaggttgtacactctacacaagcaactgatgacaagaagttacaatcgtcccttaaaaaattatcagtaaacactattccaggcatcgaggaagtaaatatgatcaaagaagatggcacggtaattcactttaataatcctaagactcaggcatcattagcagcaaatactttcgctatcactggacatggagagaacagacagatcactgatatgttaccgggtatattaagccagttgggacctgaaggtatcacccagctcaggagaatagcaaacac

SEQ ID NO: 1910 - DNA, 442 bp, Diabrotica virgifera
  Clone ID: LIB150-022-Q1-E1-H8
cccggggccacccacgagtccgcaaaaacggggcacatgtgctttgttaacaatttttagataaaactaactatcgaataattaaaagaacagtaaacttaaaccggtagaagttcttcaaaataacaaaaatgaacagcgaaaagttaaaaaagatgcaatcacaagtccgtatcggaggaaagggcaccccaaggcgtaagaagaaggttgtacactctacacaagcaactgatgacaagaagttacaatcgtcccttaaaaaattatcagtaaacactattccaggcatcgaggaagtaaatatgatcaaagaagatggcacggtaattcactttaataatcctaagactcaggcatcattagcagcaaatactttcgctatcactggacatggagagaacaaacagatcactgatatgttaccgggtatattaagcca

SEQ ID NO: 1911 - DNA, 329 bp, Diabrotica virgifera
  Clone ID: LIB150-030-Q1-E1-C12
cgtccgaaacgggggacaagtgccttggtaacaaattttaagttaaactaactaacggataaattaaaggacagttaacttaaaacgggtaaaatttctccaaattacaaaaattgaacaaggaaaaggttaaaaaggtggcatcacaagtccgtatcggtggaaaggcacccaaagcgtaagaagaagttgtacactctacacaagcaactgatgacaagaagttacaatcgtcccttaaaaaattatcagtagacactattccaggcatcgaggaagtaaatatgatcaaagaagatggcacggtaattcactttaataatcctaag

SEQ ID NO: 1912 - DNA, 613 bp, Diabrotica virgifera
  unsure (1)..(613): unsure at all n locations
  Clone ID: pGUT2846
aatgattgaatctggagtaatctccttaaaagataagacctccanagtagccttggtctacggacaaatgaacgaacccccaggcgctcgtgctcgtgtagctntgactggattaactgttgctgaatatttccgtgatcaagaaggacaagatgtactgcttttcattgacaacattttcagatttactcaagctggttcagaggtatctgccttgttgggtcgtatcccctctgctgtaggttaccagcctactttggccactgacatgggtagcatgcaggaacgtattaccaccaccaagaagggttccattacatcagtacaggctatctatgtacctgctgatgacttgacagatcctgccccagccaccacattcgctcacttggacgccaccactgtattgtcccgtgccattgctgaattgngtatctacccagctgtagatcctttggattccacctcacgtatcatggaccccaacattattggagccgaacattacaaagttgctcgtgatgtacanaagatctttgcagattataaatcactacaggatattatggctatccggggtatggatgaaatgtctgaagatgacaaacttact

SEQ ID NO: 1913 - DNA, 413 bp, Diabrotica virgifera
  Clone ID: LIB150-049-Q1-E1-E4
agggagaacgtacccgtgaaggtaacgatttataccatgaaatgattgaatctggagtaatctccttaaaagataagacctccaaagtagccttggtctacggacaaatgaacgaacccccaggcgctcgtgctcgtgtagctttgactggattaactgttgctgaatatttccgtgatcaagaaggacaagatgtactgcttttcattgacaacattttcagatttactcaagctggttcagaggtatctgccttgttgggtcgtatcccctctgctgtatgttaccagcctactttggccactgacatgggtagcatgcaggaacgtattaccaccaacaaggaagggtttcattacatcagtacaggctatctatgtacctgctgatgacttgacagattcgtgcccaag

SEQ ID NO: 1914 - DNA, 393 bp, Diabrotica virgifera
  Clone ID: LIB150-049-Q1-E1-E7
aagttgggtgctgtggcaagagcaacttccagccttttggctggaaaatccatcgaaaaagttggttccgaatcccttaaaattgtctcttcatacaatgttcaaaaaagagacttcgctgccaaggctgctgccggtaaggcacaaggaaaagttgtagcggtcattggtgccgtcgttgacgtacaattcgatgaagaactacccccaattctaaatgcattggaagtacaaaaccgtcaacctaggctggtccttgaagttgctcagcatttgggagagaacacagtccgtactattgctatggatggtaactgaacgtattgtccgtggtcaacaggttaacgacacacgataccgaatccgtaaccctgttggtaaagcaaccctggg

SEQ ID NO: 1915 - DNA, 391 bp, Diabrotica virgifera
  Clone ID: LIB150-037-Q1-E1-D4
acccacgcgtccgatcactgccttggctcctagcacaatgaagattaagatcatcgccccaccagaaagaaaataccctgtatggatcggtggttccattttggcctctctatccaccttccaacaaatgtggatttccaaacaagaatatgatgaatctggtccatccatcgtccacagaaaatgcttctaatttgtttttgtccgcatttatattctttatttctatttacataagcccgcccattttccgggcgcgaactgccgtgtttatcgtatgggatcgagaccataaaatatccacactaagccaaagtattactatcttaatttttgtaatttattacctgtgcaaagtaagactattatattattaagctaatactatggg

SEQ ID NO: 1916 - DNA, 322 bp, Diabrotica virgifera
  Clone ID: LIB149-045-Q1-E1-G6
aaaggaaatactcggtttggattggtggttcaattttagcttctctttcaactttcaaacagatgtggatttcaaaacaggaatatgatgaatctggacaatcaattgttcaaaggaagtgcttttaatttttatctatgtttaagtatattctttatatatcttgttttttatatcccccatcttggggcaagaactgcctatgttatatgagtgatcttgtgatttattacacgttcagcataagacttaatgagctttaattttaagaagtgtaagttgaatactctgtttcatatttattttacctttgtaatataat

SEQ ID NO: 1917 - DNA, 135 bp, Diabrotica virgifera
  Clone ID: pGUT049
ggtaccaccatgtaccctggtattgctgataaaatgcataaagaaatcactgccttggctcctatcacaatgaagattatgatcatcgcccctccagatagattatactctgtatggatcggtggtatcattttg

SEQ ID NO: 1918 - DNA, 408 bp, Diabrotica virgifera
  Clone ID: LIB150-042-Q1-E1-A8
accacgcgtccggacaaagagtagttatacctactaaattgagaaataaaattttgacagaattacatactgcacattttggaatagttagaatgaaatctttagctcgtagttattgctggtggcctcacatagaccaggatattgagtcactttgtaaaaattgtttagagtgcaataagcacaagaacaacccaattaaagataattctcatatatgggagccaccaaaattttgttttgaacgagtgcatgctgattacgctggacctttcaatggaggttattattttatattggtagattccttcagtaaatggcctgaaattcattttacaaaaaatactactacaaaaactactattgaaatttgccgaaaaatttttacaacttttggtattcctaaag

SEQ ID NO: 1919 - DNA, 452 bp, Diabrotica virgifera
  unsure (1)..(452): unsure at all n locations
  Clone ID: LIB150-017-Q1-E1-E4
cgcgtccgcatgcaaatgatcatcaggcaaaaactgcttaacagtctttgaattaatattctgttttggaattaaaacagaatctttaattacagataaacgagttctcaatactcttccaaacataagttcacaaggagccttgcctgttgatatgtgtggggctgttctataacttaacaaccacgataacaatctctgctcagtttcatcagaatcaaacttactcgataacaaagctttcttaaaagattgaactgcccgctcagcttgaccattactggctgggtggtatggagcagtacaaatatgccttatattattatttttacaaaaactactgaattcctctgaaatccactganngacattgtcnagtgacatctgctcgggcagtcaaaatctagcanacatactacgtanacatttaattgttaaccctgctgtagttt

SEQ ID NO: 1920 - DNA, 458 bp, Diabrotica virgifera
  unsure (1)..(458): unsure at all n locations
  Clone ID: LIB150-031-Q1-E1-E7
tggcgaaactcatagtagaaactgtgaaagggaaccacttatgtgtcatgaagtacccaagcttccttttgagatagctgcttcagatatcttggactttggtggaaagtcatacttagtcatagttgattattacagtaattggactgagctcattagaataaaaagtaagagtatcagtgaagttatttcacagctaaaaaacgtatttgctacacatggcttaccaagaaaatttgtgtctgacaatgtaccatataacagtattaaattcaaaaatttttgtaactactataatattgaatactcgttttccagtccaagatatcccagaagtaatggcttagccgaaaaggctgtaggtatttgcaaacaaatgttaaggaagtgttcanatcatgatgattctttttattatttgctagagtacagaaacagtccattgtgtggtcttaatg

SEQ ID NO: 1921 - DNA, 438 bp, Diabrotica virgifera
  Clone ID: LIB150-029-Q1-E1-D12
cccacgcgtccgaccaaacgcacgcatgcaaccatgtttaggaacatctgtcttgctctcctcctttttgttgaagtggcggtatgtgttcaaaaactccaagaacattttcaatggaacattttagattatgagtttcccacagaagctattcgaaggaatgctttactgacaggaagatttaagccagaaaataatttgccagttggtatggaaatatggcaagacaaattatttatttcagtgccgagatggaaagaaggcattccagcaactctgaactacgttccattgaacagtccagtcaaaaatccccgattaattccatacccagattttccctccaatgaactgggtaactgtgaaaatggtttgaacaccgtatacaggatgaaagctgatgagtgtgatcgcttatgggtccttgacactggtacc

SEQ ID NO: 1922 - DNA, 423 bp, Diabrotica virgifera
  unsure (1)..(423): unsure at all n locations
  Clone ID: LIB150-010-Q1-E2-H2
ccacgcgtccgatattagtttctctaagtatggtgaaaccgccgggttctgaatatatagataatagagcatctagacactcaacacgtggatatggtaatagaaatcaactaatcaatttagaaactactggtccattcaaaacatggtactactggaatgtgttagatttcgcttatcccagtgaaactgatagagatattgccatacagaatgaggattttattccaaaaaacaatcttccattangtgtggaggtatatggaaaccgaatatttgtatctatgccaaaattgaagccgggcgtaccggcaactttggcagtgataccaagagttccaaaagaaccgtcgccgaagttagtaccttatccaaactgggaatggcacacctcaagaggatgccaaagcatcaactccgttt

SEQ ID NO: 1923 - DNA, 430 bp, Diabrotica virgifera
  Clone ID: LIB150-020-Q1-E1-A1
aattatactatactgtgtgttatttgaccgtgaagcaagcaaacagttcggtttggtgacatcgtactccgttgttatactgtctttgtttcaacgtcatattagttcaatatcgtagaccaatgaaacacgcaataattgcatcattaatagttttcttaattactggttcctcgagtctacaattaataaaagaatggaactttctgacatttgatttcccgccacaattggcggctcataattttaaaccagaagctacagtgcccactggtattgagataactaacgacaggatattcatctctattccgaggttaagatctggagttcctgctacattaacctccattcccatcaataatccaaaagatataagtccggttcttcaagcgtaccctgattggactctacatggtgctgggagtgg

SEQ ID NO: 1924 - DNA, 405 bp, Diabrotica virgifera
  unsure (1)..(405): unsure at all n locations
  Clone ID: LIB150-036-Q1-E1-G8
gggccgacccacgcgtcaagcgaatcacaccgaaaaggcatttcanaaacaaccaaccgtttttctcaaccgcaaaagtggaggaaagaaaaatttaagacattctcgcagtgtagggctcggttttaaaactcccagagaggcaattgaaggttcttacattgacaagaaatgtcccttcactggaaatgtatcaatccgtggccgtattctcactggagttgtccaaaaaatgaagatgcaaaggactattgtcatccgtagagattatttgcattatatcaggaaatacaatcgttttgaaaagaggcatangaatatgtctgtacatttatcaccctgcttcaaggatgtggaaattggagatgtagttacaattggtgaatgcagaccactttcaaaaac

SEQ ID NO: 1925 - DNA, 333 bp, Diabrotica virgifera
  Clone ID: LIB3026-018-Q1-E1-H4
ggcggatcagaccgaaaaggcatttcaaaaacaaccaaccgtttttctcaaccgcaaaagtggaggaaagaaaaatttaagacattctcgcagtgtagggctcggttttaaaactcccagagaggcaattgaaggttcttacattgacaagaaatgtcccttcactggaaatgtatcaatccgtggccgtattctcactggagttgtccaaaaaatgaagatgcaaaggactattgtcatccgtagagattatttgcattatatcaggaaatacaatcgttttgaaaagaggcataggaatatgtctgtacatttatcaccctgcttcaggga

SEQ ID NO: 1926 - DNA, 303 bp, Diabrotica virgifera
  Clone ID: LIB3026-027-Q1-E1-A7
ggggccgatcagaccgaaaagagcatttcaaaaacaaccaaccgtttttctcaaccgcaaaagtggaggaaagaaaaatttaagacattctcgcagtgtagggctcggttttaaaactcccagagaggcaattgaaggttcttacattgacaagaaatgtcccttcactggaaatgtatcaatccgtggccgtattcgcactggagttgtccaaaaaatgaagatgcaaaggactattgtcatccgtagagattagttgcagtatatcaggaaagagaatcgttttgaaaagaggcagaggaa

SEQ ID NO: 1927 - DNA, 443 bp, Diabrotica virgifera
  Clone ID: LIB150-014-Q1-E1-D9
caaccacaaaagacaacatgtgtgacgacgatgttgcggctcttgtcgttgacaatggatccggtatgtgcaaagctggattcgccggagatgacgcaccccgtgccgtcttcccctcaatcgtcggtcgcccaaggcatcaaggtgtcatggttggtatgggacaaaaagactcatacgtaggagatgaagcccaaagcaaaagaggtatcctcacattgaaataccccattgaacacggtatcatcaccaactgggatgacatggaaaaaatctggcatcacaccttctacaatgaactccgtgtagctccagaagaacacccagtcctcctcactgaagctccactcaaccccaaggcaaacagagaaaagatgacccaaatcatgtttgaaaccttcaacacacccgccatgtatgtagccatccaagccgtactctcc

SEQ ID NO: 1928 - DNA, 466 bp, Diabrotica virgifera
  Clone ID: LIB150-030-Q1-E1-A9
caataatctagagagagtcgtatgattttctgtctagtgagcagtgatcaaccacaaaagacaacatgtgtgacgacgatgttgcggctcttgtcgttgacaatggatccggtatgtgcaaagctggattcgccggagatgacgcaccccgtgccgtcttcccctcaatcgtcggtcgcccaaggcatcaaggtgtcatggttggtatgggacaaaaagactcatacgtaggagatgaagcccaaagcaaaagaggtatcctcacattgaaataccccattgaacacggtatcatcaccaactgggatgatatggaaaaaatctggcatcacaccttctacaatgaactccgtgtagctccagaagaacacccagtcctcctcactgaagctccactcaaccccaaggcaaacagagaaaagatgacccaaatcatgtttgaaaccttcaacacacccgccatgta

SEQ ID NO: 1929 - DNA, 370 bp, Diabrotica virgifera
  Clone ID: LIB150-016-Q1-E1-G9
cggggcgccccacgcatccgcacacgcgtccgcccacgcgtccgcctgttcccatatatgggcggccggcgtgttatttttaagtgcactcgacaatccctataaaaacgacgcttcgcgtcattagcgcactcgttgttaacgtcgctgagcgtcgagtccatatacttactcagagtcgctgtaccaccaaaccagaaaaccagaaatcatgtgtgacgacgatgtagcggctcttgtcgtcgacaatggctccggaatgtgcatagccggtttcgccggtgatgacgcccctcggggctgtcctttcatccatcgtaggtcgtcccagaacactaacgtgtcatggtgggtatgggttaaaaagact

SEQ ID NO: 1930 - DNA, 433 bp, Diabrotica virgifera
  Clone ID: LIB150-023-Q1-E1-B2
acgattcttgcaaactgccaacgcctgcagattctggccctctggtcgtggaatctaccacaacgagaacaaaaccttcttagtatggtgcaacgaagaagatcatcttcgtctcatctctatgcaatgggtggtaacttgggagaagtttacagacgtctggttaccgctgtcaatgacatcgagaaaagaattccattctctcacaatgacaggcttggtttccttactttctgcccaactaacttgggtaccactgttcgtgcttctgttcacattaaggttcctaaattggctgccaacatggctaaattggaagagattgctggaaaatacaatctccaagtccgtggtactcgtggcgagcacacagaagctgaaggaggagtctatgatatttccaacaagagacgtatgggtttgaccgaatatg

SEQ ID NO: 1931 - DNA, 377 bp, Diabrotica virgifera
  Clone ID: LIB149-039-Q1-E1-F7
gcgggtcgacacacgcatctagattcattcatactaccaacgcctgcagattctggccctctggtcgtggaatctaccacaacgagaacaaaaccttcttagtatggtgcaacgaagaagatcatcttcgtctcatctctatgcaaatgggtggtaacttgggagaagtttacagacgtctggttaccgctgtcaatgacatcgagaaaagaattccattctctcacaatgacaggcttggtttccttactttctgcccaactaacttgggtaccactgttcgtgcttctgttcacattaaggttcctaaattggctgccaacatggctaaattggaagagattgctggaaaatacaatctccaagtccgtggtact

SEQ ID NO: 1932 - DNA, 207 bp, Diabrotica virgifera
  Clone ID: LIB149-013-Q1-E1-H7
aataactatcatttcttgttcaaggtatgataccttttcatgcaatgtgacaaagtctgcagattctgggactcaggtcgtggtatctatcactttgagaactgtagcttcgtagtaaggtgtaacgaataccatcatcgacgtcacatcactatgcatatgggtggtaacctgggataagttcatagatttctggttaccgctatc

SEQ ID NO: 1933 - DNA, 394 bp, Diabrotica virgifera
  Clone ID: LIB149-006-Q1-E1-G6
aggagaaacaaagctgttttgggagtcaaaaatcaaggaagttgtggatcttgctgggctttcagtgccacaggtgctctcgaaggtcaacttgccattcacaaaaatcaaaaggtcccactaagtgaacaagaattggtagactgtgactcatcaaactctggttgcaatggcggtttaatgacaaatgcctttgcatatgttaagagccacggacttgcatcagaaaagcaatatgcttacaccggcagagatggtagctgcaaaagaggatcaagaacactttctactatcagtggatatgtaaatcttgccaaaactgaagctgcactggctagtgctctttctagcgtaggtccagtatccatagctgtagatgcagatacatggcagc

SEQ ID NO: 1934 - DNA, 401 bp, Diabrotica virgifera
  Clone ID: LIB149-030-Q1-E1-C11
agcgtttagtacaactggaacggtggaaggagcttatttcctgaaaacgggaaatttgatctctctaagcgaacaaaatttggtagattgtgcaagcgacttatgtaatggatgcagtggaggctggatgtataaagcgcttgaatatatcagaaaagctggaggaatcatgtctgaagaggattatccatatactatgaaagatgatgtttgccgagaagatgtcaaaatgtcgctcggtcccatctcgggatacacacatctgaatgcaacggaagaagctttaatttcagctctcgctaccgttggcccaatcgctgtttccgctgatgcaactaaatggtcattatatggaggaggagtttttgatgacgaagaatgtggaaaaaatataaaccatg

SEQ ID NO: 1935 - DNA, 341 bp, Diabrotica virgifera
  Clone ID: LIB3026-018-Q1-E1-A1
acgcccacgcgtccgggtaaaccttggttgtgacggaggtttgatgacagatgccttcttttatgttgaacatcatggtctttcatcagaagaacaatacccctatacaggcgtaggtggtcattgcaaccatgtaaaaaacaaacaagtctcttcgatcaatggttacgtcgaacttgatgaaactgaaagtgctctagctgatgctctcgctactgttggtccagtgtcaatagctgtcgacgctgatacatggcaattctattcaggtggagttttcaacaataaaaattgtggaaacgctcttaaccatggtgttcttgctgtgggatacactaaag

SEQ ID NO: 1936 - DNA, 416 bp, Diabrotica virgifera
  Clone ID: LIB3026-035-Q1-E1-E12
cggacgcgtggggaagatgttcaaggtagaaatgttttaacaaatttccacggtatggatttaaccactgacaagctgaggtccatggttaagaaatggcaaaccttaattgaagcatctgctgatgtcaagacatcagatggatatttacttagggtgttctgcataggctttaccaacaaagaccaactttctcaaaggaaaacatgctatgcacaacatacacaagttagagctatccgtaaaaagatggtagacattattaccagagacatccagggctcagacatcaaagaagtagtgaataaactccttcctgacagcatagccaaggatattgaaaaggcctgccagggtatctaccccctacatgatgtgtacatccgtaaagttaaagtattgaaaaagcctcgttt

SEQ ID NO: 1937 - DNA, 347 bp, Diabrotica virgifera
  Clone ID: LIB150-032-Q1-E1-E9
agacaacaatcatggccgtcggtaaaaataagggtttgtcaaaacgtggcaaaaagggagttaaaaagaaagttgttgatcccttcacacaaaaagactggtacgatgtgaaacctccatcaatgtttgccacccgccaggtcggcaagactttggttaaccgtacccaaggaaccaaaattgcctctgaacgtttgaaattcagaatttttgaagtgtctttacccgatttacaaaatgataatgacgccgaaaggtctttcagaaagttccgtttgatagctcaagatgttcaacgtacaaatgttttatcaaatttccacggttatggatttaaccactgacaa

SEQ ID NO: 1938 - DNA, 281 bp, Diabrotica virgifera
  unsure (1)..(281): unsure at all n locations
  Clone ID: pGUT1882
agggtatctaccccctacatgatgtgtacatccgtaaagttaaagtattgaaaaagcctcgttttgaactctccaaattgttggaattgcatggtgatggaggcaaaggtggtgctggtgactccactggtgaagctggttctaaagtcgacaggcctgagggatacaaaccaccagtacaagaatccgtttaaaattttgttattttgtaaatgaaaagattanaaaagagtataaatacnacgtatctataaaaaaaaaaaaaaaaaaaattcaagggg

SEQ ID NO: 1939 - DNA, 443 bp, Diabrotica virgifera
  Clone ID: LIB3026-030-Q1-E1-E7
ggggtccactacgaagcgctgatgcccagacagtgtaagatttattggtcgtcagctctaccccaaatgggaccaaattaaggactatatcgacgagttggaatttgtaccctttggcaaagccatatacgtgcaccacgatgctgatattgtaaagcaaacacctgagcgttactcattcagttgccaacatggtcgtagagaatgccaaggaaacaagtaccaggcttgtgcactatcgcaaaataaaggcaaagatgtagaagtgcctttggtttattgtatcatgaaaagtatagatccttcttctttcgatactgttgaagaatgtgctaggagatttggattagatattccgaagctgaaatcctgttccgacagcatagaaggagacaaacttctagctaccaaaggagaccgcacgtttcagctggatccaaata

SEQ ID NO: 1940 - DNA, 422 bp, Diabrotica virgifera
  Clone ID: LIB149-048-Q1-E1-F1
gacaaacataaaatggaaagtgtcacggttttgtttgttgctttatgttttgccggcatttccgtacaagctgctgatctaaaagttagcgtctactatgaatctttgtgtccagatagtatcaaatttatcaaagatcagttcaaccctgcttacagcactgtacttaaggacaaaataaacgtagactttgtgccttttggaaaagcaacggcgataaagagtaatggtacatggagctttacgtgccagcacaaagaacctgaatgctacggtaacaaagttcagtcatgtgcaattgacattgcttcgtataatacaagtatcgaatttgtcgtgtgtgctatgaagtcaggagatgctagcgatgatgaattacttaaacagtgtgctgaagacaaccaaatcaaatgggaagacat

SEQ ID NO: 1941 - DNA, 426 bp, Diabrotica virgifera
  Clone ID: LIB149-049-Q1-E1-A9
agacagacacaaaatggaaagtgtcacggttttgtttgttgctttaggttttgccggcatttccgtacaagctgctgatctaaaagttagcgtctactatgaatctttgtgtccagatagtatcaaatttatcaaagatcagttcaaccctgcttacagcactgtacttaaggacaaaataaacgtagactttgtgccttttggaaaagcaacggcgataaagagtaatggtacatggagctttacgtgccagcacaaagaacctgaatgctacggtaacaaagttcagtcatgtgcaattgacattgcttcgtataatacaagtatcgaatttgtcgtgtgtgctatgaagtcaggagatgctagcgatgatgaattacttaaacagtgtgctgaagacaccaaatcaaatgggatgacatcgac

SEQ ID NO: 1942 - DNA, 404 bp, Diabrotica virgifera
  Clone ID: LIB150-010-Q1-E2-E3
caaacgcgaccgggacgcttgtagcttttaggacagcgtcaacctccggtcgtcctcaggcacagaggcccttgtcttttgatctagccagtaccaaaaaaacagcgccaccatggacgcgatcaagaagaaaatgcaagcgatgaagcttgaaaaagacaatgcggctgataaagccgatgcgatggaaggtcaatacaaagacgccaacggtcgtgctgaaaaggtcaatgaggaagtacgtgatcttgaaaagaaactctctcaagttgaaaatgacctcaccaccaacaaaaatgccttagaaaatgccaaccaacaacttgaaaacaaagaaaaacaattaactcaggctgaatctgaagtagcctctcttaaccgtaaagtacaacttattgaagaag

SEQ ID NO: 1943 - DNA, 287 bp, Diabrotica virgifera
  Clone ID: pGUT2065
caacctccggtcgtcctcaggcacagaggcccttgtcttttgatctagccagtaccaaaaaaacagcgccaccatggacgcgatcaagaagaaaatgcaagcgatgaagcttgaaaaagacaatgcggctgataaagccgatgcgatggaaggtcaatacaaagacgccaacggtcgtgctgaaaaggtcaatgaggaagtacgtgatcttgaaaagaaactctctcaagttgaaaatgacctcaccaccaacaaaaatgccttagaaaatgccaaccaacaacttg

SEQ ID NO: 1944 - DNA, 303 bp, Diabrotica virgifera
  unsure (1)..(303): unsure at all n locations
  Clone ID: pGUT3993
tcgcaccaggtccttaagcacagaggcccttgtctttttatctagggccgtcccaaaaaaacgcgcggccatggacnctattcaaaaaaaaatgcaacgattaacttgaaaaagacaatgcggcttataaagccgatgcgatggaatgtcaatacaaagacgccaacggtcgtgctaaaaagtcaatgaggaagtacgtgatcttgaaaaaaaactctctcaagttgaaaatgacctcaccaccaacaaaaatgccttagaaaatgccaaccaacaacttgaaaacaaagaaaaacaattaac

SEQ ID NO: 1945 - DNA, 427 bp, Diabrotica virgifera
  Clone ID: LIB149-012-Q1-E1-D12
tttggaaaaatagacgtactagtaaatgcagcaggtattttgcagaatggatccatcgaaaatacaactttggaaatgtttgataaagtgatgaatattaacgttagagctatgtttgaaatgattagagtttgtacacctcatctgatcaaaactcaaggagcaattgtaaatattagcagcgttactggtttgagggcttttccaggtgtgctagcttattgcatttccaaatcagcggtagaccaactgaccagatgcgttgctttggaattggcttcaaaacaagtaagatgcaacagcgtgaatccgggagtcatcgacaccattttgcacaaacgatcagggcttaatgacgagcagtacaaagccttcttggaaaaaagtagactgacacatgcccttggacgtgcaaggtacgctgaaa

SEQ ID NO: 1946 - DNA, 412 bp, Diabrotica virgifera
  Clone ID: LIB149-043-Q1-E1-F7
gtaaaaatcgagcacctagcaaacggctgcggatcaaaggatctcgagcttggaaactttacaacgaccaaagaacttccatctaaactctcgtcggatgtagataaatccagtgataaagctgacttcgaaaaagccatcgaactcaccagatatgggaaatttcacttcttactactagcagtatgcggcttcgtaagcacctccgaggagatggacgtcatctcgatgtcgttcatcctcccttcggcccagtgcgacttaaacctcaacactcaaaccaaagggtggctcaattccatcatatttattggtatgatggcaggagcctacgtttggggttcagtagcagactcattgggtcgtaaaaaggtgcttattgtgagttccttcatgaatgctctatgtatag

SEQ ID NO: 1947 - DNA, 446 bp, Diabrotica virgifera
  unsure (1)..(446): unsure at all n locations
  Clone ID: LIB149-009-Q1-E1-H2
gccagaaagtcccaagttcttacttacacaaggtaagagtgaagaagctcttgcaatctttaagtacatttaccatgtaaacaccgggaatgatcccgaagactatccagttaaacatctcatctacgaacaagaagagctcactcttgaacaaaaagccaaaattgcaaagagaggcaaatataccaatatgattgttgatattttagataatagtaaacagttgtttgtttcaccaattttgaaattcacagttatttcaattaccatcaactttacatttcacattggatactacggtcttatgatgtggttccccgaaatgtttaacagatttgacgaatacgctaaaattcacgatggtgcagaagctggtgtatgtgaagttgtggactacgttgtcagtantggcagccacagtgccagtgttttatgcagtgacaaga

SEQ ID NO: 1948 - DNA, 261 bp, Diabrotica virgifera
  Clone ID: pGUT1505
aagaagcagagatgtctgctcacaaaacttttatcatcaagcgaaagcttgccaaaaaacttaaacaaaacagacctattccccaatgggtccgtatgaggacaggaaacacaatcagatacaatgccaagaggcgtcactggcgtaaaaccaagctaaagttgtaaattgtttttatattcaattgacctttatttactttagttaataaacattattccataaaaaacaaaaaaaaaaaaaaaaaccccaagggggggc

SEQ ID NO: 1949 - DNA, 219 bp, Diabrotica virgifera
  unsure (1)..(219): unsure at all n locations
  Clone ID: pGUT278
agaagcagagatgtctgctcacaatacttttatcatcaagcgaaagcttgccaaaaaacttaaacaaaacagacctattccccaatgggtccgtatgaggacaggaaacacaatcagatataatgccaagaggcgtcactggcgtanaaacaagctaaagttgtaaattgtttttatagtcaattgacctttatttactttagttaatagacattactc

SEQ ID NO: 1950 - DNA, 257 bp, Diabrotica virgifera
  unsure (1)..(257): unsure at all n locations
  Clone ID: pGUT1697
aagaagcagagatgtctgctcacaaaacttttatgagcaancgaaagcttggcagggaacttaaacaaaacagacctattccccaatgggtccgtatgaggacaggaaacacaatcagatacaatgccaagaggcgtcactggcgtagaaccaagctaaagttgtaaattggttttatattcaattgacctttatttactttagttaataaacattattccataaaaaacaaaaaaaaaaaaaaaaaactcgggggg

SEQ ID NO: 1951 - DNA, 413 bp, Diabrotica virgifera
  Clone ID: LIB149-023-Q1-E1-G5
acggacgcgtgggtcttgatcacatcttgcaaggttgaaacaataactagtagtaaaaatggcagataatctcgatgactcacattttgaaactggagactctggagcctctgcaacataccctatgcaatgctcagccctacgtaaaaacggtttcgtaatgttgaagtctagaccatgcaagattgttgaaatgtccacatccaaaactggtaaacatggtcacgctaaagtccacttggttggtattgatatcttcacaggtaaaaaatatgaagatatttgtccttctacacacaacatggatgtaccccatgttaaacgtgaagattatcagttgacagatatttctgatgatgactacttatcccttatgtctgataatggtgaattacgtgaagatttaaaagttc

SEQ ID NO: 1952 - DNA, 403 bp, Diabrotica virgifera
  Clone ID: LIB150-003-Q1-E2-C12
agttaccatcttgatcacatcttgcaaggttgaaacaataactagtagtaaaaatggcagataatctcgatgactcacattttgaaactggagactctggagcctctgcaacataccctatgcaatgctcagccctacgtaaaaacggtttcgtaatgttgaagtctagaccatgcaagattgttgaaatgtccacatccaaaactggtaaacatggtcacgctaaagtccacttggttggtattgatatcttcacaggtaaaaaatatgaagatatttgtccttctacacacaacatggatgtaccccatgttaaacgtgaagattatcagttgacagatatttctgatgatgactacttatcccttatgtctgataatggtgaattacgtgaagatttaaa

SEQ ID NO: 1953 - DNA, 360 bp, Diabrotica virgifera
  Clone ID: LIB150-003-Q1-E1-C12
agtttccatcttgatcacatcttgcaaggttgaaacaataactagtagtaaaaatggcagataatctcgatgactcacattttgaaactggagactctggagcctctgcaacataccctatgcaatgctcagccctacgtaaaaacggtttcgtaatgttgaagtctagaccatgcaagattgttgaaatgtccacatccaaaactggtaaacatggtcacgctaaagtccacttggttggtattgatatcttcacaggtaaaaaatatgaagatatttgtccttctacacacaacatggatgtaccccatgttaaacgtgaagattaacaattgacagatatttctgatgatgactact

SEQ ID NO: 1954 - DNA, 407 bp, Diabrotica virgifera
  Clone ID: LIB150-045-Q1-E1-D1
accacgcgaccggctgctaaagtttttggcaataattctttcaaatatggacaagtggcaaaaaatgttaggttatttagtgtagctgcaacaaaagaaaactacgagtttattaaagtttccaagactggagaaaagcaaaatgttggactgattcaactcaacagacccaaagcactcaacgccctctgcaatgggttgatatccgaagtatctgaagctttgaactcctttgacaccgacaaatccgtgggggctgtagtcataaccggaaacgaaaaagcttttgcggctggagctgatattaaggagatggtatccaatacctttgcaaaatgtgtcactgaagattttattggtgcttggcagcttatcgctaacatgaagaagcctcttcttgctgcagt

SEQ ID NO: 1955 - DNA, 419 bp, Diabrotica virgifera
  Clone ID: LIB150-006-Q1-E1-G7
acaatatcacaaaaaaatgagtgccgcaactgtgagtcgtattgtcgctgctaaagtttttggcaataattctttcaaatatggacaagtggcaaaaaatgttaggttatttagtgtagctgcaacaaaagaaaactacgagtttattaaagtttccaagactggagaaaagcaaaatgttggactgattcaactcaacagacccaaagcactcaacgccctctgcaatgggttgatatccgaagtatctgaagctttgaactcctttgacaccgacaaatccgtgggggctgtagtcataaccggaaacgaaaaagcttttgcggctggagctgatattaaggagatggtatccaatacctttgcaaaatgtgtcactgaagattttattggtgcttggcagcttatcgctaacatga

SEQ ID NO: 1956 - DNA, 353 bp, Diabrotica virgifera
  Clone ID: LIB150-006-Q1-E1-A1
agaatatcacacgcgcatgagtggccgcaactgtgagtcgtactgtcgctgctaaagtttttggcaataattctttcaaatatggacaagtggcaaaaaatgttaggttagttagtgtagctgcaacacaacgaaaatcacgagtttattaaagtttccaagaccggagaaaagcaaaatgttggactgaatcaactcaacagacccaaagcactcaacgccctctgcaaagggttgatatccgaagtatctgaagcgttgaactcctttgacaccgataaatccgtgggggctgtagtcataaccggatacgaataagcttttgcggccggagctgatattagggagatggt

SEQ ID NO: 1957 - DNA, 417 bp, Diabrotica virgifera
  unsure (1)..(417): unsure at all n locations
  Clone ID: LIB149-003-Q1-E1-E3
agttcatctttctttagtcgcattcagcgctgctctaccaacacttcttggtagaaccgctctggtcaaagaagatggaactgttactctcaccgactctagaggacaccaactggtaatcctcaagagtgttaccgatcccagacaagtcgaagttattctcaggagtccaaacacaagaacccagatgttccaagttggggaaccacttagaactagagaaactatcgaccgtactctcgttggagtttcagcttaccaaaactacaaccaagctgatattcttactgatattttccgtcagtatgaaggtactcttgacgacaccaaatactacagccttcttaacagaatccanatgttagttgaagctggactcattaatgaaaccatctacgatatcatcagagactggga

SEQ ID NO: 1958 - DNA, 454 bp, Diabrotica virgifera
  Clone ID: LIB150-046-Q1-E1-G9
gggtcgatacacgagtctaaatagagccctattatttagttgcactcagcgttgctctaccaacactccttggtagaaccgtaagagtcacagaagatggaactgtatctctcttcgactctagaggataccaactcgtaatcctcaagagtgttaccgatcccagacaagtcgaggttgttctcagaagtccaaacacaagaacccatatgttccaagttggggaaccactgagaactggagaagctatcgaccgtcgtaccctcgctggtgtttcagtttaccaaaactacaaccaagctgatattcttactgatatttttcgtcagtatgaaggtactcttgacgacaccaaatactatagccttcttaacaggattcagatgttagttgaagctggagtcgtcaacgaaaacatctacgatgttattagacactgggatcgtgaataccg

SEQ ID NO: 1959 - DNA, 385 bp, Diabrotica virgifera
  Clone ID: LIB150-027-Q1-E1-A5
tggaactgttactctcaccgactctagaggataccaactcgtaatcctcaagagtgttgccgatcccagtcaagtcgaagttgttctcagaagtccaaacacaagaacccagatgttccaagttggggaaccacttagaactggagaagctatcgaccgtaccctcgttggtgtttcacggtaccaaaacaacaaccaaggtgatattcttactgatattttccgtcagtatgaaggtactcttgacgacaccaaatactacagccttcttaacagaatccaaatgttagttgaagctggactcattaatgaaaccatatacgatattatcagagactgggatcttaaacaccgtgtacaaggaattagtgacattgtccccaac

SEQ ID NO: 1960 - DNA, 413 bp, Diabrotica virgifera
  unsure (1)..(413): unsure at all n locations
  Clone ID: pGUT3099
tcaacacatctggtggacaattcaaaatgatggaaaacatcaacaacttccaagccgcaatcaaagcctacggtgcagctgatattgatgttttccaaaccgtcgacctctgggaaaagaaagacatcgcccaagtaaccaataccctctttgctattggcagacagacctacaagcaccctgaatggaaaggaccttaccttggacccaaacccgctgacgaaaacaagagagaattcactgaagaacaacttanagctggtgagactatgattgggctccaagctggtcaaaacaaaggagcttcccaagccggacagaacatgggtgctggtcgcaaaattatccttggaaaagaatttatttattttttttaacttttacactattntttaatttgtatacgtaacttt

SEQ ID NO: 1961 - DNA, 407 bp, Diabrotica virgifera
  Clone ID: LIB150-046-Q1-E1-G6
acaacaccagtgaattcaaaatatctaacaaaaatgtctctggaacgtcaagtccgtaacaaactcgccgctaaacgcgatccccaacaagacaaagaagctcaagcatggatcgagactatccttggcgccaaattccctccaggtgaagcctacgaagatgttatccgtgacggaactgtcctctgccaactcatcaacaaattggctccaggatcagtcgccaaaatcaacacatctggtggacaattcaaaatgatggaaaacatcaacaacttccaagccgcaatcaaagcctacggtgtagctgatattgatgttttccaaaccgtcgacctctgggaaaagaaagacatcgcccaagtaaccaataccctctttgctaatggcagacagacctacaagca

SEQ ID NO: 1962 - DNA, 322 bp, Diabrotica virgifera
  Clone ID: pGUT4048
attttcaacaccagtggattcaaaatatctaacagaggtgtctctggaacgtcaagtccgtaacaaactcgccgctaaacgcgatccccaacaagacaaagaagctcaagcatggatcgagactatccttggcgccaaattccctccaggtgaagcctacgaagatgttatccgtgacggaactgtcctctgccaactcatcaacaaattggctccaggatcagtcgccaaaatcaacacatctggtggacaattcaaaatgatggaaaacatcaacaacttccaagccgcaatcaaagcctacggtgtagctgatattgat

SEQ ID NO: 1963 - DNA, 407 bp, Diabrotica virgifera
  Clone ID: LIB149-023-Q1-E1-D12
acggtgtcgactcggatcaatcgtatccttatgaaggagtgaacggacagtgcagatttaggagagaggatgttgttgccacatgtactggttttgtggatataggagagaacgacgaaaaaggtttagagatagctctagcaactttaggtccagtgacagcagcaatcgatgccggtaaggagactttccagttttactcagagggaatatacgatgatccagcttgcggaaatacccctgaacaaatgaaccacgcagttctaatagttggatatggacaagaagctgatggtagaaaatactggttggtgaaaaattcatacggtcccaactggggtataggaggatatgtaaagatggccaaggaaaataataaccaatgtggtattgccattcaagctagt

SEQ ID NO: 1964 - DNA, 404 bp, Diabrotica virgifera
  Clone ID: LIB149-025-Q1-E1-F4
aggatgtgcaggtggatatatggacaaggctctagaatacattgaagcagctggaggaataatggccgaaaatgattatccttatgaaggcattgatgataagtgtagatttgataggtctaaagtagctgccaaaattagcaactttacttatattaagaaaaatgacgaagatgacctaaaaaatgcagttgtagtaaaaggacctatatcagtggctattgatgctagttataattttcaattatatgactcaggaatactcgatgatatttcctgcagcagtgacttcaattatttgaaccatggggtactggttgtaggctatggtacagagaaaggacatgattactggatcgtgaaaaattcctggggtgctgactggggaatggatggatatatat

SEQ ID NO: 1965 - DNA, 367 bp, Diabrotica virgifera
  Clone ID: LIB3026-031-Q1-E1-H3
atcaaatggctaagaagcccagacaatcctttattgcacaacacgtagccgatcccagtgtccaagctgtataagaagttgattggcgacatagtgccgtgttgggagtcaaagatgaaggacattgtggatcatgctgggcttgcagtacgaccggatccctcgaatgtcaactcgctatccacgttaatcaacgtgttcctcacagtgaacaagcattggtagactgtgacagatcaggaaatgcaggttgtaacggaggtttgatgacaaaggccgttaactcaggtaaaccccatggtctctcttcagaatctcaatatgcatacaccggcactgtatgatagctgcaagaatgttgacaaca

SEQ ID NO: 1966 - DNA, 417 bp, Diabrotica virgifera
  Clone ID: LIB150-050-Q1-E1-G1
ggacactaagcccttatccaccacacttactcgattccgaaaagaacgaccatcaactaaatcaaaatgcctttcaaaccagcagacaacccaaaatgcccaaaatgcggcaaatccgtatacgccgctgaagaaaaagtagctggaggatacaaataccacaaatcctgcttcaaatgcggtatgtgcaataaaatgctcgactccaccaacgtaactgaacacgaagctgaattgtactgcaaaaattgccatggacgtaaatacggacctaaaggctacggattccgtggtggagctgggtgcttaagtatggacgatggagcccaattcaagggaacacaataattttaagaaggaatcaatgtgaagatggcgggcaaaaccacaccaactgtcaaccgtcctcaattctac

SEQ ID NO: 1967 - DNA, 390 bp, Diabrotica virgifera
  Clone ID: LIB150-025-Q1-E1-H1
tgagtcgtactaatccaccacacttactcgattccgaaaagaacgaccatcaactaaatcaaaatgcctttcaaaccagcagacaacccaaaatgcccaaaatgcggcaaatccgtatacgccgctgaagaaaaagtagctggaggatacaaataccacaaatcctgcttcaaatgcggtatgtgcaataaaatgctcgactccaccaacgtaactgaacacgaagctgaattgtactgcaaaaattgccatggacgtaaatacggacctaaaggctacggattcggtggtggagctgggtgcttaagtatggacgatggagcccaattcaagggaacacaataattttaagaaggaatcaatgtgaagatggcgggcaaaaccacacca

SEQ ID NO: 1968 - DNA, 524 bp, Diabrotica virgifera
  Clone ID: pGUT2617
aggacactaagcccttatccaccacacttactcgattccgaaaagaacgaccatcaactaaatcaaaatgcctttcaaaccagcagacaacccaaaatgcccaaaatgcggcaaatccgtatacgccgctgaagaaaaagtagctggaggatacaaataccacaaatcctgcttcaaatgcggtatgtgcaataaaatgctcgactccaccaacgtaactgaacacgaagctgaattgtactgcaaaaattgccatggacgtaaatacggacctaaaggctacggattcggtggtggagctgggtgcttaagtatggacgatggagcccaattcaagggaacacaataattttaagaaggaatcaatgtgaagatggcggccaaaaccacaccaactgtcagcggtcgtcagttctacccttttccatcccccactatacactaatgtaatatttttagatcttaaattacagacttagttttaatttataaattttcgtatgacacgttataaataagaattc

SEQ ID NO: 1969 - DNA, 437 bp, Diabrotica virgifera
  Clone ID: LIB3026-035-Q1-E1-F4
gaagaagcgtcaagccatgatgcaggctcttaaagaccaaaacaaaaacaaaggacctaacttcaccattaccaagagagacgccgcatccaacctctctgccgctcaacttgaaaggaataagactaaggaacaattggaagaagaaaagaaaatctccctttccatccgtatcaaacccttggtccttgatggccttagcgtagataaactccgcgaaagagccacagaactctgggattgcatcgtcaaattggaaactgaaaagtatgacttggaagaaaggcaaaaacgtcaagactacgatcttaaagaattgaaagaaagacaaaagcagcagttgagacacaaagccttgaaaaagggtctagaccctgaagccctcacaggcaaataccctccaaaaatccaagtagcctccaaatatgaacgtcctg

SEQ ID NO: 1970 - DNA, 437 bp, Diabrotica virgifera
  Clone ID: LIB150-005-Q1-E2-H8
gggccgacccacacgtcagaaaggaaaatggcagaacgtaagaaggctgaagaagaacgtcgcgttcgtgaaattgaagagaagaaacaaagagatattgaggaaaagagacaacgtcttgaagaagccgagaagaagcgtcaagccatgatgcaggctcttaaagaccaaaacaaaaacaaaggacctaacttcaccattaccaagagggacgccgcatccaacctctctgccgctcaacttgaaaggaataagactaaggaacaattggaagaagaaaagaaaatctccctttccatccgtatcaaacccttggtccttgatggccttagcgtagataaacttcgcgaaagagccacagaactctgggattgcatcgtcaaattggaaactgaaaagtatgacttggaagaaagacaaaaacgtcaagactacga

SEQ ID NO: 1971 - DNA, 296 bp, Diabrotica virgifera
  unsure (1)..(296): unsure at all n locations
  Clone ID: LIB150-008-Q1-E1-H8
cccgggcccacccacgcttcggaaaggaaaatggcagaacgtaagaaggctgaagaagaacgtcgcgttcgtgaaattgaagagaagaaacaaagagatattgaggaaaagagacaacgtcttgaagaagccgagaagaagcgtcaagccatgatgcaggctcttaaagaccaaaacaaaaacaaaggacctaacttcaccattaccaagagggacgccgcatccaacctctctgccgctcaacttgaaaggaataagactaatgaacaatttggagaaganaagaaaatctccct

SEQ ID NO: 1972 - DNA, 408 bp, Diabrotica virgifera
  Clone ID: LIB149-044-Q1-E1-C4
ctctaaagtaactcgtactacaaggtggcaaggctaagagatgttggtaagattcggtaattttggtaatgtggtccctttgctggtccagaatggaaaacaacaacaacaaaagggttatggccaccctgaaggcaatttccaaccgtttgaaatcggtcaagaacatccagaaaataacacaatccatgaagatggtgtcagcagccaaatacgccaaggctgaaagggaactgaaagctgtgcgccccatcggtgatggagctagccagttttatgagaaagctgaaattcaacccttagctgatgtgcctcagaagttagtaattgctataacttcagacagaagtctatgtggtgctgttcaaccagtgtctctcgttacattcgtacagaattgggcaaaga

SEQ ID NO: 1973 - DNA, 352 bp, Diabrotica virgifera
  Clone ID: LIB150-029-Q1-E1-A1
cccacgcgtccgcccacgcgtccgcccacgcgtccgcccacgcgtccgcccacgcgtccgggcctgcaaggtggcaaggctaagagatgttggtaagattcggtaattttggtaatgtggcccctttcctggccaaaaatggccagcaccaccagcaaaggggtatggcaaccctgaaggcaatttcaatccgtttgaaatcggtcaagaacatcaagaaaataccacaatccatgaaaatggtgtcagcagccaattacgccagggctgaaagggaactgaaagctgtgccccccatcggtgatggagctacccatttttatgaaaaagctgaaattcaacccttaactga

SEQ ID NO: 1974 - DNA, 406 bp, Diabrotica virgifera
  Clone ID: LIB150-034-Q1-E1-H12
acccgtccgacctgcaaggtggcaaggttaagagatgttggtaagattcggtaattttggtaatgtggtccctttgctggtccagaatggacagcaacaacagcaaaggggtatggccaccctgaaggcaatttccatccgtttgaaatcggtcaagaacatccagaaaataacacaatttgcagtaatggtgtctagaacccaacttatccagcgctgaaagggaactgaaagctgtgcgccccatcggtgatggagctagccagttttatgagaaagctgaaattcaacccttagctgatgtgcctcagaagttagtaattgctataacttcagacagaggtctatgtggtgctgttcacaccagtgtctctcgttacattcgtacagaattgggcaaagatga

SEQ ID NO: 1975 - DNA, 387 bp, Diabrotica virgifera
  Clone ID: LIB150-050-Q1-E1-B7
agcccacgcgtccgcccacgcgtccgcccacgcgtccgttacggtgtggacctcgcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaac

SEQ ID NO: 1976 - DNA, 451 bp, Diabrotica virgifera
  Clone ID: pGUT1482
ccacataccacgctatgaaacccccttatatggggccgatctaacaggagtgtggaactctatatccattatatctaaaatggttaacagaaaagaattcataattaacattcaattgccattgtacacgtatattctggtaaatctactactactggacatttaatttacaaatgtagtggtatcgacaaacttaccatcgaaaagttccaaaaagaatcccaacaaatgggtaaaggctaattcaaatatgcctgggtactctacatacttacagcccatagagaacgtggtattaccattgatattgctgtgcggaaattcgaaacagctaaatactattgaaccatcattgatgcccctggcacagatatttcattaataacattatcactggtacattacaatctgactgtgctgtactcattgatgcaactggtacttggtaatt

SEQ ID NO: 1977 - DNA, 428 bp, Diabrotica virgifera
  Clone ID: LIB150-035-Q1-E1-G7
gtggacctcgcgcctggagttacatcccaagtagtgttccttctagtctaagtttaacttctaagagttgcatttaccttatttcgaaacaatcaaaatgggtaaggaaaggattcatataagtatcgttgtcattggacacgtagatgctggataaatctacaactactgggcattcaagttacaaaagtggaggcatcgacaaatgtaccagcgaaaagttcggtacatacacctaagatatgggtaaacgttcattcacatatgcctgtgtactcgacacacttaaggccgaaatagaccgtggtattaccattgatattgctttgtggaaattcgagacaacgtaatagtatgtaaccatcattgatgccccagtacacagagatttcgttaagaacatgatgactggtacatcacaagctgac

SEQ ID NO: 1978 - DNA, 444 bp, Diabrotica virgifera
  unsure (1)..(444): unsure at all n locations
  Clone ID: LIB149-029-Q1-E1-E1
agaagaactttcacaatcaccagtagcaccaacgtcgctgtaggagcagtttctagcggagcaagtatttcaggtcnctacacattggaagctggatatttaggatataatgaaattgttgaaaaagaattacaaggaggatggacctatgtctgggacaatgaacagcaagttccccatatgtacaaaggagaccaatgggtaggatttgatgatccaaaagccgtacaagttaaaaccaaatatgcacaagataaaggacttggtggtgttatggcttgggctatcgaaacagatgatttccaaggattatctggagttaaaaatccactcttaagagctattaatgaacaattggcaacatcttcaaacgctgctgctgaaacaaatgaaagtgcagctgcagctgcggaatcctcagctttcgctgcagaatcttcggct

SEQ ID NO: 1979 - DNA, 440 bp, Diabrotica virgifera
  Clone ID: LIB149-009-Q1-E1-C2
cccacgcgtccgcaataattgacttggattttttagtaataatgaaggcggtactactagttttggcttgtgttttggtttctgcttactcccaatgtgatgaaaaaccagatgttgaagtagtttgctactggggaagctggtctgtatacagaaaagaaaacggcaaatttgcaactaaagacattgatgtaaaaagttgtaccacagttatatatgcatttgcaggtattaatttagatcaaaagacaacatcactggacacgtataaagatttagacttaaagggctttgcaaattttacagcccttaaacaagacaacccttgtttgacaacaatgttagctattggtggctggaatgaaggttctcgaaaatattctgtgatggcaaattccaaacaactacgtgaagattttgcagacagtgttatagcattt

SEQ ID NO: 1980 - DNA, 447 bp, Diabrotica virgifera
  Clone ID: LIB3026-022-Q1-E1-B2
gtacggcgtcgagattccagggccaccaggcctccgtaaaaaggaaaccaatgggtaggatttgatgatccaaaagccgtacaagttaaaaccaaatatgcacaagataaaggacttggtggtgttatggcttgggctatcgaaacagatgatttccaaggattatctggagttaaaaatccactcttaagagctattaatgaacaattggcaacatcttcaaacgctgctgctgaaacggatgaaattgcagctgcagctgcggaatcctcagcttccgctgcagaatcttcggcttcagctgcagaatcatcagcttccgctgcagagtcgtcagcttcggctgcagaatcctcagcttctaacacaaacagtgaggctgcttcaaatacctcaaacaatgaagccgcgtcaaattcaaaagttcagaacagtgtgtgctctaag

SEQ ID NO: 1981 - DNA, 413 bp, Diabrotica virgifera
  Clone ID: LIB149-047-Q1-E1-H2
ctaaaaatattcgtactttttaactttaatactcacaattaagtattattaaaatgcgtttagttgccataggactgtttgtggtacttccgtcacttgtattgtcggagttttctacagaagattgttgggctcttggatttcacaaagcaaacttactgtgttcgtcatgtgatcaattagtcaaatttcaattagatgaacttgtaaatcattgtaaagaatgctgtcacccagatgaagttaattcatcagaaaaagtttattataaagcggttctagaagtttgtacttgcaaatttggtgcatatccacaaatccaagcctttatcaaaagtgatagacctgataaattccccaacttacaaattaaatacctcagaggactcgatcccatcattaaactgtatgat

SEQ ID NO: 1982 - DNA, 446 bp, Diabrotica virgifera
  Clone ID: LIB3026-032-Q1-E1-H6
cacgcgtaagcaaggttgtgtaaaatatacgtactttttaactttaatactcacaattaagtattattaaaatgcgtttagttgccataggactgtttgtggttcttccgtcacttgtattgtcggagttttctacagaagattgttgggctcttggatttcacaaagcaaacttactgtgttcgtcatgtgatcaattagtcaaatttcaattagatgaacttgtaaatcattgtaaagaatgctgtcacccagatgaagttaattcatcagaaaaagtttattataaagcggttctagaagtttgtacttgcaaatttggtgcatatccacaaatccaagcctttatcaaaagtgatagacctgataaattccccaacttacaaattaaatacctcagaggactcgattccatcataaaactgtatgataaggaatgacatctg

SEQ ID NO: 1983 - DNA, 415 bp, Diabrotica virgifera
  Clone ID: LIB149-028-Q1-E1-H9
atttgagattattttctggatctacgacatggttgtgtaaaatatacgtactttttaactttaatactcacaattaagtattattaaaatgcgtttagttgccataggactgtttgtggtacttccgtcacttgtattgtcggagttttctacagaagattgttgggctcttggatttcacaaagcaaacttactgtgttcgtcatgtgatcaattagtcaaatttcaattagatgaacttgtaaatcattgtaaagaatgctgtcacccagatgaagttaattcatcagaaaaagtttattataaagcggttctagaagtttgtacttgcaaatttggtgcatatccacaaatccaagcctttatcaaaagtgatagacctgataaattccccaacttacaaattaaatacctc

SEQ ID NO: 1984 - DNA, 397 bp, Diabrotica virgifera
  Clone ID: LIB150-027-Q1-E1-H10
agcacaaatagtagagacgaaaaatacaagatatcccattggaaaatatgtccgtgctccatttggatggcgaactctaaccatatcaaatggacaaataccagatgaagataaaccactggatgttctaccagattacggaaagttgccagtttcgctaggattgggagtactgggaatgaccggcatgactgcttactttggtttactagaagtctgcaaaccaaaggctggagaaaccatagtaatatctggagcagctggtgctgttggtaacttggtaggacaaatcgctaaaattaaaggattaacagtcataggaatagcaggatcagatgaaaaaggaaagtggcttaaacaagaacttgggtttgatcaatttattaatttccaaaaa

SEQ ID NO: 1985 - DNA, 427 bp, Diabrotica virgifera
  Clone ID: LIB150-020-Q1-E1-B4
agttgaaatagtagattgttgttttacatttgtttaagagtaacataaaaaaatccagtatgttggaatggttggttatggtgttttttcaactgtcagtttttgactgtgctgttaaaaataacaataataggtcactgcatgtgccaaattttgccaaccgtaatttaagtgacgctagttcaacctgtaaagctaaatattggacccttgtaaaatattttgatggctttccgaagaatactgatatgacgattcgggaagaaaatttgccaccactaaaaaatggagaatttttagccaaagcagttttcttaagcgtggacccataccagagagtacttgggtcttttccagatcaagtaaaacttggagaaccatttttggggcagcaaatagcacaaatagtacagacgaaaaatacaag

SEQ ID NO: 1986 - DNA, 388 bp, Diabrotica virgifera
  Clone ID: LIB150-028-Q1-E1-A4
gattgttgttttacatttgtttaagagtatcataaaaaagtccagtatgtggaaatggttggttttggtgttttttcaactgtcagtttttgactgtgctgttaaaaataacaataataggtcactgcatgtgccaaattttgccaaccgtaatttaggtgacgctagttcaacctgtaaagctaaatattggacccttgtaaaatattttgatggctttccgaagaatactgatatgacaattcgggaagaaaatttgccaccactaaaaaatggagaatttttagccaaagcagttttcttaagcgtggacccataccagagagtacttgggtcttttccagatcaagtaaaacttggagaaccatttttggggcagcaaataaca

SEQ ID NO: 1987 - DNA, 301 bp, Diabrotica virgifera
  unsure (1)..(301): unsure at all n locations
  Clone ID: pGUT1357
gttttatccatatttattattggaaataaaatataaaatgagaaataaatttaacggttggatttggctacacgtacaagttcatccttctttttgatagcatatgaatttgatgatcccttggcagcattgattaattcatcagccaaacattcagcaatagttttaatattaaggaatgctgcttccctagcacctgtgcagagcaaccaaattgcttggttaacccttctcgatggtgacacatcaacagcttgtcttcttacagtatcagctctaccaatacgagtanaatcttctc

SEQ ID NO: 1988 - DNA, 285 bp, Diabrotica virgifera
  Clone ID: pGUT1375
gttttatccatatttattattggaaataaaatataaaatgagaaataaatttaacggttggatttggctacacgttcaagtacatccttctttttgatagcatatgaatttgatgatcccttggcagcattgattaattcatcagccaaacattcagcaatagttttaatattacagaatgctgcttccctagcacctgtgcagagcaaccaaattgcttggttaacccttctcaagggtgacacatcagcagcttgtcttcttacagtaccagctctaccaata

SEQ ID NO: 1989 - DNA, 300 bp, Diabrotica virgifera
  unsure (1)..(300): unsure at all n locations
  Clone ID: pGUT1371
gttttatccatatttattattggaaataaaatataaaatgagaaataaatttagcggttggatgtggctactcgttctacttcatccttctttatgatagcatatgaatatgatgatcccttggcagcattgattacttcatcagccaaacattcagcaatagttttaatattacggaatgctgcttcactagcagctgtgcagagcaaccaaattgcgtggttaacccttctcggtggtgacacatcaacagcttgtcttcttacagtancagctctaccaatactagtataatcttct

SEQ ID NO: 1990 - DNA, 400 bp, Diabrotica virgifera
  Clone ID: LIB149-027-Q1-E1-H10
aaattggttctgttcctaccagccctctgcagaaaaatgggtgtcccatactgcatagttaaaggtaaagcaagacttggacttctagtaaggcgcaagacttgttcatctgtagctcttacacaagttgactctggagacaggtccaacttcaacaaacttttggaagtaatcaaaactaacttcaacgaccgtgttgatgaaatcaggaggcactggggtggtggtttgcttggatccaaatctgctggtcgtattgccaagttagagagagccaaggctaaagaattggctcagaaacaaggttaagaagaaagttttcttgttttaataacaggactttgtaataaataaatttattaagttaaaaaaatatactaaaaacaaaaaagaaataaaa

SEQ ID NO: 1991 - DNA, 401 bp, Diabrotica virgifera
  Clone ID: LIB150-001-Q1-E1-A2
cccacgcgtccgctcgaagtgaggttgtctgtggtgtagatttaattttttaaatattataaacatcccttgaggatttaatttccaagatggtccaaaagaaacctaagaagaaggtaggaaagaaagtagctgcagctcctcttgcagtcaagaaaattgaacagaaaaaagaaattaacccactttttgaaaagaggcctagaaattttggaattggtcaggatattcaacctccccgtgatttatctcgatttgtaaaatggccaaaatacatccgtattcaaagacaaaaggctgtacttcaaaagagattgaaagttccaccaccaattaaccaattctctcaaaccattgacaaacaaacagccacccaattatttaaagtcttgggaaaatac

SEQ ID NO: 1992 - DNA, 390 bp, Diabrotica virgifera
  Clone ID: LIB150-025-Q1-E1-D2
tcgcgtgtcaacacacgactctatagtgagtcgtattatagatattacaaacatcccttgaggatataatttccagtatagcctaaaataaacctataattaaggtaggatagacagtagctgcaactcctcttgcactcaagattattgaagatcaaatcgacattatcccactttttgaaaaaaggccaataaattttggaattgagcaggatattcaatctccccgtgatttaactcgatttgtagaatggccaaaatacatccgtattcatagataactagctgtacatcacaatgagattgaaagttccaccaccaattaagcaattctctcaatccattgacacctcaccagtcacccaaatatttagggtcctggtaaaatac

SEQ ID NO: 1993 - DNA, 397 bp, Diabrotica virgifera
  unsure (1)..(397): unsure at all n locations
  Clone ID: LIB149-022-Q1-E1-A12
gggtcgacgcccgcgtccaagcaaattcaatctcaaaaaagcgtaaattcgttggagatggtgtcttcaaagccgaattaaatgaatttttaacccgtgaactctccgaagatggttattccggtgtggaagtacgtgttaccccaacacgtacagaaattattattatggccaccagaaccgacagggtgttaggtgagaagaacaggaggataagagaattgacttctgttgtacagaagaggtttagcttccctccagattccgtagttttgtatggtgaaaaagtagccaacagaggtctgtgtgctattgcccaagctgagtcacttaggtttaaattgattggtggtttggccgtccgtanggcttgctatggtgtcttgaggtacatcat

SEQ ID NO: 1994 - DNA, 394 bp, Diabrotica virgifera
  unsure (1)..(394): unsure at all n locations
  Clone ID: LIB150-027-Q1-E1-H8
cacgcctctagactgagtcatactaaaaaaagcgtaaattcgttggagatggtgtcttcaaagccgaattaaatgaatttttaacccgtgaactttccgaagatggttattccggtgtggaagtacgtgttaccccaacacgtaccgaaattattattatggccaccagaaccgacagggtgttaggtgagaagaacaggaggataagagaattgacttctgttgtacagaagaggtttagtttccctccagattccgtagttttgtatggtgaaaaagtagccaacagaggtctgtgtgctattgcccaagctgagtcacttaggtttaaattgattggtggtttggccgtccgtanggcttgctatggtgtcttgaggtacatcatggaatg

SEQ ID NO: 1995 - DNA, 339 bp, Diabrotica virgifera
  unsure (1)..(339): unsure at all n locations
  Clone ID: LIB150-034-Q1-E1-A2
agacaatggcatcttcactcacaaaatggcgtaaattcgttggcgatggtgtcgtcatagccgaattaagtgaatttttaacccgtgaactcgccgaacatggatagtccggtgtggaagtacatgttaccccatcacgtacatgaagtactattatggcgactagatacgacaaggtgttaggtgagaataccaggaagataagagaattgacttccgttgtacatcataggtttagcttacctccagattccgtaattctgtaaggcgaaaaagtatccaacagaggtctgtgtgctngtgcccaagctgagtcagttaagtttaaattgattggag

SEQ ID NO: 1996 - DNA, 447 bp, Diabrotica virgifera
  unsure (1)..(447): unsure at all n locations
  Clone ID: LIB150-019-Q1-E1-C4
cccacgcgaccgcccacgcgtccgcaaaaatgggtatcgacatcaaccataaatacgaccgtaaggttaggagaacagaacctagaagtcaagatgtatatttacgtcttttagtaaaactgtaccgttatttagcccgtcgtacaggggccaaattcaataaaataatcctgaaaagattgtttatgagcaaaatcaacagaccaccactatctttatccaagttagtgcgtttgatgaagaagcctggccgtgatggacttattgctgtcgtagtaggaacaattactgatgatgctaggatttttgaaattcccaaattgtctgtatgtgcccttcgcgtgacacaaactgctanggccaggatcttgaaagctggaggtgaagtcatcaccttcgaccaattggcactcagggccccaactggcaataaaactgtattgctac

SEQ ID NO: 1997 - DNA, 415 bp, Diabrotica virgifera
  Clone ID: LIB149-004-Q1-E1-B6
atcagaaatgggtatcgacatcaaccataaatacgaccgtaaggttaggagaacagaacctagaagtcaagatgtatatttacgtcttttagtaaaactgtaccgttatttagcccgtcgtacaggggccaaattcaataaaataatcctgaaaagattgtttatgagcaaaatcaacagaccaccactatctttatccaagttagtgcgtttgatgaagaagcctggccgtgatggacttattgctgtcgtagtaggaacaattactgatgatgctaggatttttgaaattcccaaattgtctgtatgtgcccttcgcgtgacacaaactgctagggccaggatcttgaaagctggaggtgaagtcatcaccttcgaccaattggcactcaaggccccaactggcaataaaact

SEQ ID NO: 1998 - DNA, 403 bp, Diabrotica virgifera
  Clone ID: LIB150-045-Q1-E1-B10
tatcgacatcaaccataaatacgaccgtaaggttaggagaacagaacctagaagtcaagatgtatatttacgtcttttagtaaaactgtaccgttatttagcccgtcgtacaggggccaaattcaataaaataatcctgaaaagattgtttatgagcaaaatcaacagaccaccactatctttatccaagttagtgcgtttgatgaagaagcctggccgtgatggacttattgctgtcgtagtaggaacaattactgatgatgctaggatttttgaaattcccaaattgtctgtatgtgcccttcgcgtgacacaaactgctagggccaggatcttgaaagctggaggtgaagtcatcaccttcgaccaattggcactcagggccccaactggcaataaaact

SEQ ID NO: 1999 - DNA, 423 bp, Diabrotica virgifera
  Clone ID: LIB149-031-Q1-E1-B12
aggccaatctctataacgttattgttgctcaagcgtccgaaaatttaacagaaaatgccaaaaatgctactcaaaagactcctagtacaccagaaggaacggccgttgcatatattagtttagttgtaatggccttacttccaatattctttggttcttttagatctgtgtcctaccataaggataataaagtagaaaaaatgaccaaaagagatgcagcagtatttccaattgtagcttcatgttccctttttggactctacatagtatttaaattattttcaaaagaatatataaatcttttgttaacaggatatttctttttcttgggtgtcttagctctaactcatttattaagccctgttgtaagtaaattagtgccagcagcaataccaaacattccatttcatataatgtttacac

SEQ ID NO: 2000 - DNA, 388 bp, Diabrotica virgifera
  Clone ID: LIB150-046-Q1-E1-E5
acgaaaatttaacagaaaatgccaaaaatgctactcaaaagactcctagtacaccagaaggaacggccgttgcatatattagtttagttgtaatggccttacttccaatattctttggttcttttagatctgtgtcctaccataaggataataaagtagaaaaaatgaccaaaagagatgcagcagtatttccaattgtagcttcatgttccctttttggactctacatagtatttaaattattttcaaaagaatatataaatcttttgttaacaggatatttctttttcttgggtgtcttagctctaactcatttattaagccctgttgtaagtaaattagtgccagcagcaataccaaacattccatttcatataatgtttacaca

SEQ ID NO: 2001 - DNA, 411 bp, Diabrotica virgifera
  unsure (1)..(411): unsure at all n locations
  Clone ID: LIB149-005-Q1-E1-E1
aacatttgaaaacatggccaatctctttaacgttattgttgctcaagcgtccgaaaatttaacagaaaatgccaaaaatgctactcaaaagactcctagtacaccagaaggaacggccgttgcatatattagtttagttgtaatggccttacttccaatattctttggttcttttagatctgtgtcctaccataaggataataaagtagaaaaaatgaccaaaagagatgcagcagtatttccaattgtagcttcatgttccctttttggactctacatagtatttaaattattttcaaaagaatatataaatcttttgttaacaggatatttctttttcttgggtgtcttagctctaactcatttattaagccctgttgtaagtaaattantgccaacaacaataacaaa

SEQ ID NO: 2002 - DNA, 405 bp, Diabrotica virgifera
  Clone ID: LIB149-031-Q1-E1-C10
aaaagaaaaggtgtcaagatgacatgtaaaaggcgcaatggagggcgctccaagcacggccgtggtcacgtaaagccagttcgatgcaccaactgtgctagatgcgttcccaaggataaggcaatcaagaagttcgtcatcagaaacattgttgaagccgccgctgtgagagatattactgaggcatcagtatatcaagcttacgttctccccaagctctatgcgaagctccactactgtgtatcctgcgctatccacagcaaagttgtgcgtaatagaagcaaaaaggataagagagtcagaactcctccacagagaaacttccctggtaaggacaatgctagagttcagcaacaacaacctaagaagtaaactgtttctttagttttacaaataaaatttaag

SEQ ID NO: 2003 - DNA, 396 bp, Diabrotica virgifera
  Clone ID: LIB3026-026-Q1-E1-D8
agtcaagaaaaggtgtcaagatgacatgtaaaaggcgcaatggagggcgctccaagcacggccgtggtcacgtaaagccagttcgatgcaccaactgtgctagatgcgttcccaaggataaggcaatcaagaagttcgtcatcagaaacattgttgaagccgccgctgtgagagatattactgaggcatcagtatatcaagcttacgttctccccaagctctatgcgaagctccactactgtgtatcctgcgctatccacagcaaagttgtgcgtaatagaagcaaaaaggataggagagtcagaactcctccacagagaaacttccctggtagggacaatgctagagttcagcaacaacaacctaggaagtaaactgtttctttagttttacaat

SEQ ID NO: 2004 - DNA, 185 bp, Diabrotica virgifera
  Clone ID: LIB3026-027-Q1-E1-H3
gaaaaggtgtcaagataccatgtaaaaggcgcaatggagggcgctcaaagcacggccgtggtcacttaaacccatttcgatgcaccaactgtgcaagatgcgttcccaaggataaggcaatcaagaacttcgtcatcagaaacattgttgaagccgccgctgtgagagatattactgaggcatca

SEQ ID NO: 2005 - DNA, 471 bp, Diabrotica virgifera
  Clone ID: pGUT2580
cggtacgaggtaaaaagcaatgtgacgatgccacacttaattataagtgcgagttaacctttgcttcaggtccagcgcattacttcaagtcagttgcaaatattcaaaaggaaatagtaaagaatggtcctgtagaagcaacttttgacgtatacagtgacttcctgaattacaaaagtggtgtttatcaacatgtcgctggatcatatgtaggagggcatgccgtcagaattttaggttggggagaagagaatggagtagcttattggttggttgctaattcatggaatgaagattggggagacaagggattgtttaaaatacttcgcggagaaagtgaatgcggtttcgaggatggtgttgttgccgcacctgcatatggttaatcctacataaacaaaatattgctataacgcttaattatgatttattttattataattaaaattggttcctaaaaaaaaaaaatta

SEQ ID NO: 2006 - DNA, 471 bp, Diabrotica virgifera
  Clone ID: LIB3026-011-Q1-E1-G2
tttgaagtgacatacacctacttgcagaactcaatgtaacgatcccgcacttaattataagtccgagttaacttttgcttcaggtccatcgtattcgttcactacagtagccaatatgcaaaaggaaatattgacaaatggtccggtagaaacgactttccacttgtacagtgatttctggagttataaaagtggtgtttatcaacatgtcgctggagatgatttaggataccattccgtcaaagttttaggttggggtgtagagaatggagtcccatattggttggctgctaattcatggaatgaagattggggagacaagggattatttaaaatacttcgcggaaaaaatgaagtagagttcgagtaccaaatgatggcggcacgtccaaaagtctaattttaaacaaaatattggtgttacgcttatgtaggtacgttttattttaaataaaaaacttgatttctaaa

SEQ ID NO: 2007 - DNA, 410 bp, Diabrotica virgifera
  Clone ID: LIB149-012-Q1-E1-G2
gaaaaaggattttaggaaatgtaaaaggattaaggcacattgaaaatatccagtttcaaaatccttccaatgcaagggaaaactggaaagactgttcagatgttatcagcactattgtagaccaatctgcttgtggatcttgctgggcaatgtctgcagcatctgcaatgagtgacagacgatgcatagtcacccagggaaagcttaaagtgcctgtttctgctgaaaatttattgtcttgttgcgatgactgtggatttggatgcgccggaggatatatagatgatgcatggtcgttttggcaagagaatggaattactacaggaagtctttacggcagcaaccaaggttgtcaatcatattcgcttcaaccttgtgaacatcatacaaatggtactaaagtgcaatgc

SEQ ID NO: 2008 - DNA, 338 bp, Diabrotica virgifera
  Clone ID: LIB3026-014-Q1-E1-D1
accacgcgtccggagattaaacgagtttaatattagtgtgtttgctcttcatcctggaatgatagctactgacataatcactagacatctttcgcctgttgtctacagaggtgttgcgccattatccaaatttttgtttaaaactcctgaagaaggtgcgcaaacaacaatctatgtagctaccgaaccaggtatagagcatctaacgggaggatttttctcagaatgtcattatcaagaacattacaaaactgctagagacccagaattagcgcgacagctttgggatgaaacgattaaattgttaaattataatgattgattaaagtattgagaac

SEQ ID NO: 2009 - DNA, 404 bp, Diabrotica virgifera
  Clone ID: LIB150-043-Q1-E1-G5
atttgatactgaccagtgaagaacatctctgaagatgatcgtctacaattacacgatctatatcaagtatatagctttcgctgtgatcgctatatcactaccgttcatagcgttaatcgttttgaaatttttccaaaagttcagtgccgggaaagtgcggagtttggtttgcttaagtggtaaaacggccattgtgactggagctggctcaggaataggatacgaaaccgccctccacctcgcctccaggggatgtcgagtaattctcgccgacagaaaagaagctgctaaagctaaggcaaaaataatagccattacgaacaattcaaacatcgaaacgaaaatcctcgatttaacttcattgcagtcggtgaggaagtttgccaaggaaataaactcgacag

SEQ ID NO: 2010 - DNA, 434 bp, Diabrotica virgifera
  Clone ID: LIB150-043-Q1-E1-G6
acaagaatctaaagtgagtcgtattagtgaagaacatctctgaagatgatcgtctacaattacacgatctatatcaagtatatagctttcgctgtgatcgctatatcactaccgttcatagcgttaatcgttttgaaatttttccagaagttcagtgccgggaaagtgcggagtttggtttgcttaagtggtacaacggccattgtgactggagctggctcaggaataggatacgaaaccgccctccacctcgcctccaggggatgtcgagtaattctcgccgacagaaaagaagctgctaaagctaaggcaaaaataatagccattacgatcaattcagacatcgagacgaaaatcctcgatttaacttcattgcagtcggtgaggaagtttgccaaggaaataaactcgacagaagaaagattagacatttt

SEQ ID NO: 2011 - DNA, 424 bp, Diabrotica virgifera
  Clone ID: LIB150-043-Q1-E1-A12
accacgcgtccgcttacttttcggtggcaagtggtggcggaagtaacttagctaacatacgttaatatagcagtaacatttttagtagtaaaaaaataaaaatcaacaaaaaaatggtaaaacctgtaagaaaatctgcaaataaaaatccacctattttgagccacgaatttgttattcaaaatcatgccgatattgtgtcatgtattgctatggtgtttgtagttggccttatggtacaagctacatctccaattgcttcaatattcataactctgcagcacaatgtaacagaagcaggagaggtgcccctttacagtcctggtgtgaaagattgggcttgtatatttttctacaccttgatttgcgttgttatccatgccattattcaagaatacatcttggacaaagtctccaagaaact

SEQ ID NO: 2012 - DNA, 447 bp, Diabrotica virgifera
  Clone ID: LIB150-017-Q1-E1-C1
tgtccatatcttgtgacgtgtctttgcgtggcacttgcggtaaattttgattgttgtaaatgtagattagtggggaaaccttacttttcggtggcaagtggtggcggaagtaacttagctaacatacgttaatatagcagtaacatttttagtagtaaaaaaataaaaatcaacaaaaaaatggtaaaacctgtaagaaaatctgcaaataaaaatccacctattttgagccacgaatttgttattcaaaatcatgccgatattgtgtcatgtattgctatggtgtttgtagttggccttatggtacaagctacatctccaattgcttcaatattcataactctgcagcacaatgtaacagaagcaggagaggtgcccctttacagtcctggtgtgaaagattgggcttgtatatttttctacaccttgatttgcgttgttatccat

SEQ ID NO: 2013 - DNA, 326 bp, Diabrotica virgifera
  Clone ID: LIB150-044-Q1-E1-A12
ttacttttcggtggcaggtggtggcgggagtaacttagctaacatacgttaatatagcagtaagatttttagtagtagaggagtaagaatcaagagagggatggtaaaagctgtaagaaaatctgggggggtaatccacctagtttgagccacgaagttgttattcaaaatcatgccgatattgtgtcatgtattgctatggtgtttgtagttggccttatggtacaagctacatctccaattgcttcaatattcataactctgcaggacagtgtgacagaagcaggagaggtgcgccttgacagtcctggggtgaaagattgggc

SEQ ID NO: 2014 - DNA, 416 bp, Diabrotica virgifera
  Clone ID: LIB149-004-Q1-E1-G11
gactcgcgggtcgatgcaagcctctagtctggtgcaaccaactgtcttaggttcccaggtcagttgaatgctgatcttagaaaattggctgtcaacatggttcccttcccccgtctccacttcttcatgcccggattcgctccactcacctcaagaggcagccaacaatacagagcgttgacagttccagagctcacacagcaaatgtttgatgccaagaacatgatggcggcttgtgatcccagacacggaaggtaccttacagtagctgcagtattcagaggtaggatgtcaatgaaagaagttgacgaacagatgctcaacatccagaacaagaacagcagctacttcgtcgaatggatccccaacaacgttaaaacagccgtttgtgatatcccaccaagaggtctcaagat

SEQ ID NO: 2015 - DNA, 381 bp, Diabrotica virgifera
  unsure (1)..(381): unsure at all n locations
  Clone ID: LIB150-032-Q1-E1-H3
gggtccaggcacgcgtccgaaccacatgtcttaggttcccaggtcagttgaatgctgatcttagaaaattggctgtcaacatggttcccttcccccgtctccacttcttcatgcccggattcgctccactcacctcaagaggcagccaacaatacagagcgttgacagttccagagctcacacagcaaatgtttgatgccaagaacatgatggcggcttgtgatcccagacacggaaggtaccttacagtagctgcagtattcagaggtaggatgtcaatgaaagaagttgacgaacagatgctcaacatccagaacaagaacagcagctacttcgtcgaatggatccccaacaacgttaanacagccgtgtgtgatatcc

SEQ ID NO: 2016 - DNA, 373 bp, Diabrotica virgifera
  Clone ID: LIB149-026-Q1-E1-G8
gacacacgcgtaagagacatgcgtctgcccacgcgtccgcccacgcgtccgaccttacagtagctgcagtattcagaggtaggatgtcaatgaaagaagttgacgaacagatgctcaacatccagaacaagaacagcagctacttcgtcgaatggatccccaacaacgttaaaacagccgtttgtgagatcccaccaagaggtctcaagatgtctgccactttcatcggcaactcaaccgccatccaagaattgttcaaacgtatctccgaacaatttacagctatgttcaggaggaaagctttcttgcattggtacaccggataaggtatggatgaaatggaattcacggaagcagaatccaacatgaacga

SEQ ID NO: 2017 - DNA, 369 bp, Diabrotica virgifera
  Clone ID: pGUT2612
ggaacatggtgactaggggaaatatgtcgttgtcatttaattcttttatcaggtttttgtaataattaacaccggcttcatttacttcattactatatcctgtaggtaagactctggaccacgaaatagaaaaacgataatgatcaactcccaaatcctttaatagagccacatcttccttgtatttgtgataagagtcgcaggctacatcgccgttagcgttaccaaaaattcgtgatggatcctcgtgcgtaaaattatcccaaatgttttgtcctttgccatcctcgttccatgcaccttcgacttggtaggatgctgtagctgtaccgaatataaaatatcctggaaacgttttattgtttagtt

SEQ ID NO: 2018 - DNA, 390 bp, Diabrotica virgifera
  Clone ID: LIB149-039-Q1-E1-G10
acggacgcgtgggcttttttattagttggtatcactgtttgtgatactgaactaaacaaaaagcggtttccaaaagattttatgtttggagtggctacatcttcatatcaaattgaaggtgcttggaacgaagatggcaaaggagaaagcacttgggaccattttgttcaccaaaccccatcacccattgtaaataattatacaggtgatgtagcttgcgattcttaccataaaatgaaagaagatgtggctttattaaaatatttaggagtcaagcattacagattttctctatcgtggtcaagaattctcccaacaggttacaccaacaaaataaaccaaactgcaattaaatactataaaagcctgatcagagaactcacaaacaat

SEQ ID NO: 2019 - DNA, 321 bp, Diabrotica virgifera
  Clone ID: pGUT3883
ctttatcagttaaaagtatttataagcagtgatgatgttacttattggttgacattcaacgaacccaaacaaatatgcaaccaaggttacggtagcaaaagtaaggcacctcttgttgactcacctggtattggggaatacctttgtgcccataatcttcttaaggctcacgctaaagcatggcgtttgtatgacgtgcagtttcgtagtacacaaaaaggaaagggtggaattactgtagatacagcttggtttgagccagacacaaatattgctgacgatgtagttgctgcagaacgagcacaacagtttaatcatgga

SEQ ID NO: 2020 - DNA, 386 bp, Diabrotica virgifera
  Clone ID: LIB149-033-Q1-E1-F10
aagtgattctgattgttcagtttttgtagttgtacagttttcgtattaggaaataaatcaaatatggcatcaggagtaactgtagcagatgcctgcaaaaaggtccatgaagaaatcaaaagggacaaaaaacacagatttgcaattttctacatcaaggatggcaaacagattgatgttgaacacataggagaaagaaatgcagagtatgatgatttcctaactaaactgcaagagggaggagctaatgaatgtcgttatggacttttcgattttgaatacatgcaccagtgccagggaacctcagagtcaaccaagaaacaaaagttattcctgatgtcgtggtgtcctgaaactgcatctgtcaaaaaagaagatggtgtatg

SEQ ID NO: 2021 - DNA, 363 bp, Diabrotica virgifera
  Clone ID: LIB3026-019-Q1-E1-F11
cccacgcgtccggtcgattttattcagtgattctgattgttcagtttttgtagttgtacagttttcgtattaggaaataaatcaaatatggcatcaggagtaactgtagcagatgcctgcaaaaaggtccatgaagaaatcaaaagggacaaaaaacacagatttgcaattttctacatcaaggatggcaaacagattgatgttgaacacataggagaaagaaatgcagagtatgatgatttcctaactaaactgcaagagggaagtgctaatgaatgtcgttatggacttttcgattttgaatacatgcaccagtgccagggaacctcagagtcaaccaagaaacaaaagttattcctgatg

SEQ ID NO: 2022 - DNA, 315 bp, Diabrotica virgifera
  Clone ID: LIB3026-031-Q1-E1-C3
aattgactcgcgcaggcgtacccccagctgccggtacgacaacgtccccaacagatctccgaagacagacagtcgattttattcagtgattctgattgttcagtttttgtagttgtacagttttcgtattacgaaataaatcacatatggcatcacgagtaactgtagcagaatccctgaaaaaagtccatgaagaaatcaaaagggacaaaaaacacagatttgcaattttccacatcaaggatggcaaacagattgatgttgaacacatatgagaaagaaatgcacagtatgatgaattcccaactaaactgc

SEQ ID NO: 2023 - DNA, 478 bp, Diabrotica virgifera
  Clone ID: pGUT2212
caataaaaaaaaattatataaaaatggcaaaaaagacatacgatctattgtttaaacttttattaattggtgattccggagtagggaaaacatgtatattattccgattttcagatgatgcattcacaactacatttatatcaacaataggtatagatttcaaaataaaaactgttgaattgagaggtaaaaaaatcaaactgcagatatgggatactgctggtcaagaaagatttcacaccatcacgacttcttactacagaggagcaatggggattatgttagtttatgatattaccaatgagaagagttttgaaaatatagtcaaatggttaagaaacatagatgagcatgctaatgaagatgtggagaagatgatattaggcaataaatgtgatatgacagacaagagggtgggtagtaaagaaaaacccataacctattcgctcgggaacataacatcagattcatggaaaca

SEQ ID NO: 2024 - DNA, 428 bp, Diabrotica virgifera
  Clone ID: pGUT2313
caataaaaaaaaattatataaaaatggcaaaaaagacatacgatctattgtttaaacttttattaattggtgattccggagtagggaaaacatgtatattattccgattttcagatgatgcattcacaactacatttatatcaacaataggtatagatttcaaaataaaaactgttgaattgagaggtaaaaaaatcaaactgcagatatgggatactgctggtcaagaaagatttcacaccatcacgacttcttactacagaggagcaatggggattatgttagtttatgatattaccaatgagaagagttttgaaaatatagtcaaatggttaagaaacatagatgagcatgctaatgaagatgtggagaagatgatattaggcaataaatgtgatatgacagacaagagggtggttagtaaagaa

SEQ ID NO: 2025 - DNA, 350 bp, Diabrotica virgifera
  Clone ID: LIB3026-030-Q1-E1-F4
ggggccacccacgcgtccgtataattttaattgtgtgtgtattggataatagtgcattatgcacattaatatgtggagaatatgatagtaagcattaaatgtgatatgacagacaagagggtggttagtagagaaagaggagaaactatcgctcgtgaacataacatcagattcatggaaacatccgccaaggtcaacataaacatataactagctttcagcgaactggtatacgccatcctggtgaaaaccgccagaagacacaacactgtggacaagatgattgtttagatagcactgcaataattatgaagtctatgagtaaggtgtatgtaccggtgcaaaagcta

SEQ ID NO: 2026 - DNA, 449 bp, Diabrotica virgifera
  unsure (1)..(449): unsure at all n locations
  Clone ID: LIB150-017-Q1-E1-F1
gatgaaaataaaacctcaaaatggtaaacggtaggataccgtcggttcattctaaaacctatgtaacgcctaagcgtccatatgagaaggcccgtttagatcaagaattgaaaatcatcggagcctttggtctcagaaacaaacgtgaagtatggagagtaaaatacactctagccaaaatccgtaaggccgccagagaactgcttactctagaagagaaagaacccaaaaggttgtttgaaggtaatgcactcctacgtcgtttggttcgtattggagtactagacgagaacagaatgaagctcgattacgtattgggtctcaagattgaagatttcttggaaagacgtctgcaaacacaagtcttcaaatctggtctagctaagtcaatccatcatgctanggtattgatcagacaacgacacattcgggtccgcanacaagttgtg

SEQ ID NO: 2027 - DNA, 397 bp, Diabrotica virgifera
  Clone ID: LIB149-016-Q1-E1-H4
gttgaaaataaaacctcaaaatggtaaacggtaggataccgtcggttcattctaaaacctatgtaacgcctaggcgtccatatgagaaggcccgtttagatcaagaattgaaaatcatcggagcctttggtctccgaaacaaacgtgaagtatggagagtaaaatacactctagccaaaatccgtaaggccgccagagaactgcttactctagaagagaaagaacccaaaaggttgtttgaaggtaatgcactcctacgtcgtttggttcgtattggagtactagacgagaacagaatgaagctcgattacgtattgggtctcaagattgaagatttcttggaaagacgtctgcaaacacaagtcttcaaatctggtctagctaagtcaatccatca

SEQ ID NO: 2028 - DNA, 384 bp, Diabrotica virgifera
  Clone ID: LIB149-020-Q1-E1-F5
agttgaaaataaaacctcaaaatggtaaacggtaggataccgtcggttcattctaaaacctatgtaacgcctaggcgtccatatgagaaggcccgtttagatcaagaattgaaaatcatcggagcctttggtctcagaaacaaacgtgaagtatggagagtaaaatacactctagccaaaatccgtaaggccgccagagaactgcttactctagaagagaaagaacccaaaaggttgtttgaaggtaatgcactcctacgtcgtttggttcgtattggagtactagacgagaacagaatgaagctcgattacgtattgggtctcaagattgaagatttcttggaaagacgtctgcaaacacaagtcttcaaatccggtccaact

SEQ ID NO: 2029 - DNA, 368 bp, Diabrotica virgifera
  unsure (1)..(368): unsure at all n locations
  Clone ID: LIB3026-013-Q1-E1-E3
ttcactgattccgctatgcatggtgatatggaacaaagagagcgtgacgttattatgcgtcagttcagaacaggatcatctanggttttaataaccactgatctgttagcgagaggtatagatgtacaacaagtttccctagttattaattatgatttgccttctaatagagaaaattacattcacaggattggtcgaggtggtcgatttggtcgtaagggtgtagcaataaatttcgtaacggacgatgataaacgcacgcttaaggatatcgaacagttctataatacaaagatagatgaaatgcctatgaacgttgcggatctcatataaaagcgagctaataaagagtgttggtgtgttctacg

SEQ ID NO: 2030 - DNA, 431 bp, Diabrotica virgifera
  Clone ID: LIB149-032-Q1-E1-G10
acaacaccctatactgagtcgtattatgcaggtcagatcgtctttgtgagtgtgactcgaatggcccatctaatgaatacatttagccctaaagctatgacagcccactaggtatggagccagaaggtattattgaatccaactgtgagtacgtcgtcgatacattcaactacatgaagctaagtgacgaagttgtaacacgaatttatgcctatggttttgaacaaccttcggcgacccatgagagagtcatcattccttctgtagcgggacacgatgttactgctcaagctcagtcaagtgctggtattactggcacattcaccatcactattttacatctaatggacacgtcactgagggagtgccacgctcttattttggcaccaacttatgaattggctcaacagattcaaaaagtagtagttgcc

SEQ ID NO: 2031 - DNA, 383 bp, Diabrotica virgifera
  Clone ID: LIB150-006-Q1-E1-A4
ctatattggattttattgaaaaatacaattattaatgttacatacatcccgccacaaatggagaaacggaaataaaatagtgatattgcaattaccagaaagaaacataattaggtacatcgatttaatatttattataatttttaaactagatacatacaatttaaggcagaaaacaatcaccagaaaaaacttcactgtttccgctatgcatggtgatatgggacaaagagagcgtgacgttattatgcgtcagttcagaacaggatcatctagggttttaataaccactgatctgttagcgagaggtatagatgtacaacaagtttccctagttattaattatgatttgccttctaatagagaaaattacattcacagga

SEQ ID NO: 2032 - DNA, 352 bp, Diabrotica virgifera
  Clone ID: LIB149-047-Q1-E1-B1
attcccgggccaacactctatcgtaagtcatattattaaacgttactatatcgaggaaattaaaaacaacaagaccttttacactgattccaatggcagacaattaattaaaagaataagaaatgatcatgaattccacgatgatgatgtagaagctgcttcgtctaattattatccagttacgtcaaagatttctatagaagacatcaaaagtgacttaaagctctccatattaactgacagatcacaaggaggaacgagtttaaaagacggggaagtagaattaatgctccatcgaaggactttaaaggacgactacaaaggtgtagaagaacctctacaagaaatggaa

SEQ ID NO: 2033 - DNA, 423 bp, Diabrotica virgifera
  Clone ID: LIB150-015-Q1-E1-D5
caccacattactcaggattccaggcagaaaaagtctaacagaaaacgaattggtttttaaagctgttgataatcccgctcttggttttaaatcatactttatacagaaatatgaaagtaatgatattccaaaggggataacaaaagggcgctcgattgatgagtcaccaaacactgaatttgatattgacccagacaccggtatgatcacggaaataagcattaatggtcattccatcaacttcacacaggatttcttgtattatcaaggatacgttggtgataacgagaaatttatcaaccgatcttccggagcttacatattcagaccttatggagatccctttaaagtggcaactaaggctaacttcaaggttaccagaggtcctgtagtaaccgaggtccaccaaacgttcaacgactg

SEQ ID NO: 2034 - DNA, 416 bp, Diabrotica virgifera
  Clone ID: LIB149-003-Q1-E1-C11
aattctacaggccaccaaacagttatttgctcaaaattcctacaacacgtcgagaaattatgacgaaaatctaaggcatttaagagaaataatgggaattatgcaacaccatgatgctataactggaaccgagaagcaacacgtggcaaacgattatgttagaggaatacacagagcaattactgatgttgaaaaagaaatgggagaagttttcgacgaacttctcaacacggatcttaaactggaactggcttcatgtttattaacaaatgttagcatctgtaaagtatcacaagaatcagataaatttgttgtagcagtgtacaatcctctgggatggagtgtaacacattatgtaagattaccagtggataatggggattatatgatcaatgaaggtgaattatacgatctta

SEQ ID NO: 2035 - DNA, 457 bp, Diabrotica virgifera
  Clone ID: LIB149-014-Q1-E1-C10
aaaaagcagaaaaaaatggctttgaagcattagtagttaccgtggattttgctctatatggtatacatttaggagatttaagaagccaatttaagacaccacctcatcttcagtcgatgaattttaaccagtatacagagggcgagaatgcaataaacttctatgagtttactgacccagaagtagaatggagctacattacttggttaaaaactatcactaatctacccatcgtagtcaaaggggtattgaccggtgaagacgctattgcagcagcagatgctggagcttctgctattctcgtatcgaaccatggtggtagacaactagatagtcttccctcagcgatagaagcattaccagaggtatcaaaggcagtaggacatagaattgaactatacatggacggaggaatcagagatgggactgatgtatataaagctctaggactgggagc

SEQ ID NO: 2036 - DNA, 444 bp, Diabrotica virgifera
  Clone ID: LIB3026-032-Q1-E1-G8
cgaaaccacatggaagaaaatggctacaattgtatatttttcgaagcagggaaattacgaaagattttgtaaaagaagcagaaaaaaatggctttgaagcattagtagttaccgtggattttgctctatatggtatacatttaggagatttaagaagccaatttaagacaccacctcatcttgagtcgatcaattttaaaaagtatagagatggcgataatacaataaacttcgttgattttactgacccagaagtagaatggagctacattacttggttaaaaactatcactaatttacccatcgtagtcaaaggtgtattgaccggtgaagacgctattgcagcagcagatgcgggagcttccgctattctcgtatcgaaccatggtggtagacaactagatagtcttccctctgcgatagaagcattaccagaggtgtcaa

SEQ ID NO: 2037 - DNA, 403 bp, Diabrotica virgifera
  Clone ID: LIB149-031-Q1-E1-G11
atcagaacagggaaattacgaaagattttgtaaaaagagcagaaaaaaatggctttgaagcattagtagttaccgtggattttgctctatatggtatacatttaggagatttaagaagccaatttaagacaccacctcatcttcagtcgatcaattttaaccagtatacagagggcgagaatgcaataaacttctatgagtttactgacccagaagtagaatggagctacattacttggttaaaaactatcactaatctacccatcgtagtcaaaggggtattgaccggtgaagacgctattgcagcagcagatgctggagcttctgctattctcgtatcgaaccatggtggtagacaactagatagtcttccctcagcgatagaagcattaccagaggtatc

SEQ ID NO: 2038 - DNA, 266 bp, Diabrotica virgifera
  Clone ID: LIB3026-030-Q1-E1-F3
ccttgaatgcaacttcaaaccccttcaaaagtgtcaccaaaattcaattcacgggccgtcgtttaaaaacttcttaacgggaaaaaccctggctttaccaaactaaacccccttgaaaaaaatccccctttcccaaactggcttaaaaccaaaaaggcccgaaccaatcccccttccaaaaatttgcccaccccaaatggcaaatggaaccccccctgtaccggcccattaaccccggcgggtttggtggttacccccaactttac

SEQ ID NO: 2039 - DNA, 244 bp, Diabrotica virgifera
  Clone ID: LIB3026-031-Q1-E1-E3
tcttacatgcaacttcatacctcttctaaattgtccccaaatttcatttcactggccttctttttaaaacttcttgactggaaaaaccctggctttacccaacttaacccccttgcaacaaatccccctttcccaaactgggttattaccaaaaaggcccccaccgttcccccttcccaaaatttccccaccctaaatggcaaatggaaccccccctttaccggcgcattaaccccggcggttt

SEQ ID NO: 2040 - DNA, 401 bp, Diabrotica virgifera
  unsure (1)..(401): unsure at all n locations
  Clone ID: LIB149-025-Q1-E1-H1
aaatnnantcntantanataaaaaaaaaaaaaaaaaaaaaaaaaaaaggggcggccgcccaaaaggttcaagcctaacttacccttgaaggcaacttcaaacccctccaaaagggccaccaaaatccatttcacgggccttcgtttaaaaacttcttaacgggaaaacccctgccgttaccaaacttaaccgccttgcagaaaatccccctttcgcaaactggcttaataccaaaaaggcccgaaccgttcgcccttccaaaaatttgcccaccctaaatggcaaatggaaccccccctgtaccggcccattaaccccggcggttttggtggtaacccccaccttaaccgcaaaacttgcaaccgcccaaccgccggccccttccgcttccttcccttcct

SEQ ID NO: 2041 - DNA, 404 bp, Diabrotica virgifera
  Clone ID: LIB149-024-Q1-E1-E11
acccacgcgtccggtgatagcaggcattccaaaagaagcgcgagaaagaggcgtgtaccccgaagatgcattgagagagcggttcttaaaagtagaacaagtcgccagaacagtggcattaattccagaggagggtgcagcactaccggtccacttgttgtcctatttgcagtcgttgatccttataaaggccgctagtcctattcctcaaagcgaattaaataatgaaataatagatgtttcgacgttaaacacaaacgacattcttcaaagagccaggtattggttagatcgaggtgacttcacacagacgttgaggtacatgaatttactcaaaggtgctgcacggtgcgtggcgaaggaatggatggacgagactagaatttatttggaaacccaacaag

SEQ ID NO: 2042 - DNA, 283 bp, Diabrotica virgifera
  Clone ID: LIB3026-023-Q1-E1-B4
agagcacattagaccattggaacctgaaataacagctgtacaaaaagcagcagctgatgacgatggattggtcaacgccgtgatagaaggcattccaaaagaagcgcgagaaagaggcgtgtaccccgaagatgccttgagagagcggttcttaaaagtagaacaagtcgccagaacagtggcattaattccagaggagggtgcagcactaccggtccacttgttgtcctatttgcagtcgttgatccctagaaaggccgctagtcctattcctcaaagcgaa

SEQ ID NO: 2043 - DNA, 450 bp, Diabrotica virgifera
  unsure (1)..(450): unsure at all n locations
  Clone ID: LIB150-029-Q1-E1-A8
cccacgcgtccggaacgaagttaaaccagagacgtgggatacacttaagagcaagacgagatctaagcacgagtgtgtaagacgagcgacagaaaaagctgaaatcgctgttagagacataaacaaattaaaagaaattgtttccaaaccatcattcgatgctgatcccattaccaaacagacgatccaaagtaatatcagcagagttcaagaagacatagaacacgccaggagggaatttgaacacgaacaaaagatgggcagcgtagccgaaaaatactgggacaaagtagaaaaagctagacaaaacttttccgaagaattggagagtctctttcctacgatagatctttcgaaaaaacacctctgcataaatgaagaggacttggatctttttgttcctcacacatatgcccatgtactgtantatcaaaaagagttggctaagat

SEQ ID NO: 2044 - DNA, 374 bp, Diabrotica virgifera
  Clone ID: LIB150-035-Q1-E1-G10
ctgaactgtgtcggtgtgatttcgcagttaaataaaagaaaagttcaaaatcgtgatcgaaaaaaccttttattatattaatacaattttttaaaatggctgcaatgtctgtgataggtatcgatttgggaaatgaatcctgttatgtagctgtcgcaaaggctggtggaatcgaaaccattgcaaatgactacagtttaagggctactccatcatgcgttgctttttctggaaagaaccgcatattgggagttgcggcgaaaaatcagcaagtcaccaatatgaagaacactgtatatgggctaaaaaggctgttaggtagaaagtttagggatcctcatgtcaaaaaagaaattcagtttttaccatataca

SEQ ID NO: 2045 - DNA, 407 bp, Diabrotica virgifera
  Clone ID: LIB150-020-Q1-E1-D5
acgtgaactgaactgtgccggtgtgatttcgcagttaaataaaagaaaagttcaaaatcgtgatcgaaaaaaccttttattatattaatacaattttttaaaatggctgcaatgtctgtgataggtatcgatttgggaaatgaatcctgttatgtagctgtcgcaaaggctggtggaatcgaaaccattgcaaatgactacagtttaagggctactccatcatgcgttgctttttctggaaagaaccgcatattgggagttgcggcgaaaaatcagcaagtcaccaatatgaagaacactgtatatgggctaaaaaggctgttaggtagaaagtttaaggatcctcatgtcaaaaaagaaattcagtttttaacatatacagttgtagaagaaaaaaacgggggtat

SEQ ID NO: 2046 - DNA, 301 bp, Diabrotica virgifera
  unsure (1)..(301): unsure at all n locations
  Clone ID: LIB150-041-Q1-E1-F2
aagatgtatcatatgacatgaagagagcagatatggaaactttatgtgctcatctgtttgaaagagttgaagtaagcttaaagcaatgtctcaaacaatcaggattgtcattggatgacatttacgctgtagaaatagtgggcggatctagcagagtacctgctattaancatttaatagagaaagtattccacaaagtaccaagtactacattaaatcaggatgaagctgtgagccgtggttgtgctctacagtgtgcgatgctatctcctgctataaaagttcgggattttagcgttac

SEQ ID NO: 2047 - DNA, 444 bp, Diabrotica virgifera
  unsure (1)..(444): unsure at all n locations
  Clone ID: LIB150-017-Q1-E1-G3
cacacgcgtccgcatgagtgtaatccaattagacaccgaagacaaacaagaatacagtttcttccccaattcctctggattcgtccaattccgtgtcagagcagctaacgatgcacatctagcccttaccacccaggcagcagaatgcgaacccatgtacgaaatcttcatcggaggatggggcaactcaaaatccatcatccgtaaaaacagaagcaaaccagacgtagccgaagtaccaactccaggaattttgcaccccaatgaattccgtggattctggatcagatggcaaaatggtaacattgccgtcggcagagaaaacgaacaagctcctttcttgtcttggaacgattatgaacccattcacaacattgaatacgtaggtgtctgcaccggttggggagcanatggttcatgggtagttgaacccccacaatctgg

SEQ ID NO: 2048 - DNA, 415 bp, Diabrotica virgifera
  Clone ID: LIB150-030-Q1-E1-D10
cggacgcgtgggcgacgtattcagtttgaattccgatattacgaagtgttctgtttagtgtccggctggatttttaattcaaactttcaacatgagtgtaatccaattagacaccgaagacaaactagaatacagtttcttccccaattcctctggattcgtccaattccgtgtcagagcagctaacgatgcacatctagcccttaccacccaggcagcagaatgcgaacccatgtacgaaatcttcatcggaggatggggcaactcaaaatccatcatccgtaaaaacagaagcaaaccagacgtagccgaagtaccaactccaggaaattttgcaacccaatgaattccgtggaatctggattagatggcaaaatggtaacattgccgtcggcagagaaaacgaacaagctcc

SEQ ID NO: 2049 - DNA, 441 bp, Diabrotica virgifera
  unsure (1)..(441): unsure at all n locations
  Clone ID: LIB150-043-Q1-E1-A1
accacgcgtccgcttcactacttactctgacaaccaacccggagtacttattcaggtatatgaaggtgaacgtgccatgaccaaggacaacaacctcttgggaaaattcgaacttaccggcattcctcctgcgccccgtggtgtccctcagattgaagtaaccttcgacattgatgccaacggtatcttgaacgtcacagctattgaaaaatccaccaacanagaaaacaagatcaccatcaccaatgataaaggtcgtctcagcaaagaagacattgaaagaatggtcaacgatgcagaaaaataccgtaacgaagatgataagcaaaaggctaccatctctgccaagaacgtcctcgaatcatactgtttcaacatcaagagcaccatggaagatgacaaaatcaaggacaagatcagcgaaagtgacaaaactaccgt

SEQ ID NO: 2050 - DNA, 403 bp, Diabrotica virgifera
  Clone ID: LIB150-037-Q1-E1-A9
catcattcctgcccaaaacactggattgttccctgagaagacttctttcttccaggctttgagtatccccaccaagatttccaagggtactattgaaatcatcaatgatgtccacacaaccaacccggagtacttattcaggtatatgaaggtgaacgtgccatgaccaaggacaacaacctcttgggaaaattcgaacttaccggcattcctcctgcgccccgtggtgtccctcagattgaagtaaccttcgacattgatgccaacggtatcttgaacgtcacagctattgaaaaatccaccaacaaagaaaacaagatcaccatcaccaatgataaaggtcgtctcagcaaagaagacattgaaagaatggtcaacgatgcacaaaaataccgtaacgaag

SEQ ID NO: 2051 - DNA, 405 bp, Diabrotica virgifera
  Clone ID: LIB3026-012-Q1-E1-E1
cgaaatcatcagcaaatatcaagtcccagagctcaacgtccaaaacggagtcctcaaatcgctttcaattttgtttgaagatatccgtgcgatgggaaaggagtatatttatgccgtaaccccgcttctggaggatgcactcatggattgggatttaatccataggcaaacagcttgtacggctattaagcataaggctcttggtgtatacggattcgggtgcgaagatgccctcatccatcttctgaactatgtttggcccaatatttttgaaacttctccacatttggtgcaagccttcatggacgccattaaaggaatgccagttgcgttaggaccgatcaaaattctgcactatacgttacagggtctctttcatccagccagcaaagtacgggatgtata

SEQ ID NO: 2052 - DNA, 206 bp, Diabrotica virgifera
  Clone ID: LIB3026-010-Q1-E1-E1
accacgcgatccgccaatatcgagtcgcagagctcaacgtccaatgcggagtccgcaagtcgcttggatttttgttggaatatatcggtgagatgggaaaggattatatttatgccgtggccccgcgtctgggggaggctcgcaggggtggggatttagtggatagggagacagcttgtgcggctattaagcatatcggtcttggt

SEQ ID NO: 2053 - DNA, 405 bp, Diabrotica virgifera
  Clone ID: LIB150-033-Q1-E1-H9
aaaagaataaaaacgtttatttgaaacatgcagtggaaaacttacaagccaagaatgttccagctgtagttgcagagaatatattggataaattagactttcgcagtccagagtttgctgaaggtataaaagaacttgctaaagttctaaatgtagtttgtcatcccgatccccttgttacactgaaagcagtacgaaaagtggtaattcaaagaatgtcaccagattgtgttgaacatcccgaaaaatatgtgttaaagggaacaccctttcctattcaagacgctgatctgggctttgatttaaatgatccagttttgaatcaagcagcaaaaatattgaggatgatctacatccaagatatgcgaaatttgcagacgagagctaacgaacttattgtagctg

SEQ ID NO: 2054 - DNA, 358 bp, Diabrotica virgifera
  Clone ID: LIB149-027-Q1-E1-F3
ccacgcgtccgcgaaaagtggtaattcaaagaatgtcaccagattgtgttgaacatcccgaaaaatatgtgttaaagggaacaccctttcctattcaagacgctgatctgggctttgatttaaatgatccagttttgaatcaagcagcaaaaatattgaggatgatctacatccaagatatgcgaaatttgcagacgagagctaacgaacttattgcagctgtacaatctgttacagctaaccctaagacggacaccaaactaggaaaagttggtttctaaataaacaaattaactaataaatatttaattgaatattggaatgaatatttaatttaatatataaggtgtcccaaaag

SEQ ID NO: 2055 - DNA, 421 bp, Diabrotica virgifera
  unsure (1)..(421): unsure at all n locations
  Clone ID: LIB150-020-Q1-E1-A7
agcgaccttagcgaaaatggcaacttcaatctcaaaaaagcgtaaattcgttggagatggtgtcttcaaagccgaattaaatgaatttttaacccgtgaactctccgaagatggttattccggtgtggaagtacgtgttaccccaacacgtacagaaattattattatggccaccagaaccgacagggtgttaggtgagaagaacaggaggataagagaattgacttctgttgtacagaagaggtttagcttccctccagattccgtagttttgtatggtgaaaaagtagccaacagaggtctgtgtgctattgcccaagctgagtcacttaggtttaaattgattggtggtttggccgtccgtanggcttgctatggtgtcttgaggtacatcatggaatgtggagctaaaggatgtgaa

SEQ ID NO: 2056 - DNA, 404 bp, Diabrotica virgifera
  unsure (1)..(404): unsure at all n locations
  Clone ID: LIB150-050-Q1-E1-A6
aagcgaaaatggcaacttcaatctcaaaaaagcgtaaattcgttggagatggtgtcttcaaagccgaattaaatgaatttttaacccgtgaactttccgaagatggttattccggtgtggaagtacgtgttaccccaacacgtaccgaaattattattatggccaccagaaccgacagggtgttaggtgagaagaacaggaggataagagaattgacttctgttgtacagaagaggtttagtttccctccagattccgtagttttgtatggtgaaaaagtagccaacagaggtctgtgtgctattgcccaagctgagtcacttaggtttaaattgattggtggtttggccgtccgtanggcttgctatggtgtcttgaagtacatcatggaatgtggggctaaa

SEQ ID NO: 2057 - DNA, 415 bp, Diabrotica virgifera
  Clone ID: LIB149-004-Q1-E1-B2
agaattaattaatgtgattagaaagtgtatagttttagaactagccatcacttacttaaatttctttaatagactcattgttttaatatagtttggtcagttagttaataaagtgtaattaaaaatgagtgaccccacaaatcctactggactacctagaactttaaattatgaagcattaaaggctcatataatatcgcacaaaataaattgcggcctatggataattagggtcatatgcattctctgctccatagcttacttcattccaatttttggaaatccttacaactactattacaaagtactcctaacaaatgcagctatcatcgcattgagattacatcaaatgatatgcagagtgcaattcacgagacaatttgctgcataattactttcagaagatagttgtcac

SEQ ID NO: 2058 - DNA, 470 bp, Diabrotica virgifera
  Clone ID: LIB149-016-Q1-E1-F12
acacaagactctagaatgagtcgcattatgttggcagtacattttataattattggagtcggaatatttaattaatgtgattagaaagtgtatagttttagaactagccatcacttacttaaatttctttaatagactcattgttttaatatagtttggtcagttagttaataaagtgtaattaaaaatgagtgaccccacaaatcctactggactacctagaagtttaaattatgaagcattaaaggctcatataatatcgcacaaaataaattgcggcctatggttaattagggtcataggcattctctgctccatagcttacttcattccaatttttggaaatccttacaactactattacaaagtactcctagcaaatgcagctatcagcgcattgagattacatcaaaggataggcagagtgcaattcacgagacaatttgctgcagaattactttcagaagata

SEQ ID NO: 2059 - DNA, 434 bp, Diabrotica virgifera
  Clone ID: LIB150-022-Q1-E1-D3
tatgacgaaaggcgttgttagttacttcgttgtgtcgacatttttctgtttagtgtaccgattaatcttcaaatattacaatggctgaccaactcaccgaagaacaaattgctgaattcaaagaagctttctcactattcgataaagatggtgatggtacaattacgactaaagaattaggaacagtaatgagatctctaggacaaaatccaacagaggctgaattacaggatatgatcaatgaagtagatgccgatggtaacggcacgatcgatttcccagaatttttaacgatgatggcacgtaaaatgaaagataccgatagtgaggaagaaattcgtgaagcattccgagtgttcgacaaagacggcaatggtttcatctcagcagcagaattgcgccacgtcatgaccaacttgggtgaaaaattgaca

SEQ ID NO: 2060 - DNA, 388 bp, Diabrotica virgifera
  Clone ID: LIB3026-014-Q1-E1-F4
agagaggcgtagttagttacttcgttgtgtcgacatttttctgtttagtgtaccgattaatcttcaaatattacaatggctgaccaactcaccgaagaacaaattgctgaattcaaagaagctttctcactattcgataaagatggtgatggtacaattacgactaaagaattaggaacagtaatgagatctctaggacaaaatccaacagaggctgaattacaggatatgatcaatgaagtagatgccgatggtaacggcacgatcgatttcccagaatttttaacgatgatggcacgtaaaatgaaagataccgatagtgaggaagaaattcgtgaagcattccgagtgttcgacaaagacggcaatggtttcatctcagcagcag

SEQ ID NO: 2061 - DNA, 422 bp, Diabrotica virgifera
  Clone ID: LIB3026-021-Q1-E1-C7
acgcccacgcgtccgcaaaatgtctttggtaataccagagaagttccaacacattcttcgtatcttaggtacgaacattgatggtaagaggaaggtacaattcgctcttacagcaattaagggtgtaggtagacgatatgccaacattgtactcaaaaaggctgacgtaaacttggacaaacgtgctggagaatgttccgacgaagaagtagagaaaattattaccattatgtccaacccacgtcaatacaaaattcctgactggttcttgaacagacaaaaagatatcattgatggtaaatacagtcagttgacttcttccagtcttgactccaaacttcgtgaagatttggaaaggatgaagaaaattcgtgcccacagaggtatgagacactactggggtcttagagtaagaggtcaac

SEQ ID NO: 2062 - DNA, 319 bp, Diabrotica virgifera
  Clone ID: LIB150-015-Q1-E1-G8
gtaatgaaaaaaaatttctatttccttataaatattacatttacttcttcttagatacaccaacagtacgtccacgacgtccagtagttttggtgtgttgacctcttactctaagaccccagtagtgtctcatacctctgtgggcacgaattttcttcatcctttccaaatcttcacgaagtttggagtcaagactggaagaagtcaactgactgtatttaccatcaatgatatctttttgtctgttcaagaaacagtcaggaattttgtattgacgtgggttggacataatggtaataattttctctacttcttcgtc

SEQ ID NO: 2063 - DNA, 403 bp, Diabrotica virgifera
  Clone ID: LIB150-044-Q1-E1-A6
aatgaattaaggagatcaacatggcatccactttgtttgctcttactgcaagagcaatcagaaatgttccaaaaactactggacaagctgctgctatgagcagttatgcccgcactttaattggcaaaagggaaatagtaggttttggatacaatggagaacctaattatgcagatagggcagatttcccaatgccagccattaggtggagagaaccctcagccgacacaaatgctttgagagaaaaggagaaaggtgattggaaaaatttaagtatggaagaaaagaaagctttatacagagcttcgttctgccaaacttttgctgaatttaaagccccaacaggagaatggaagtcagtcgttggattgggtttagtattagtatctggagctttttggat

SEQ ID NO: 2064 - DNA, 273 bp, Diabrotica virgifera
  unsure (1)..(273): unsure at all n locations
  Clone ID: LIB3026-022-Q1-E1-B10
gtcnggaaacctcagccgactctnttgctttgagagatcgggagactggtgattggacaaatttaagtatggaagacaagaaagctttatccagagcttcgttctgccacacttttgctgaatttagagccccaacaggagaatggaagtcggtcgttggattgggtttagtattagtctctggagctttttggatcttcgatttctttacaggatttgtgtccagccctctacctcttacttgcgaccaggagcagagagaggctcgtttga

SEQ ID NO: 2065 - DNA, 490 bp, Diabrotica virgifera
  unsure (1)..(490): unsure at all n locations
  Clone ID: LIB150-030-Q1-E1-A4
ggtcgacacaagcgtctgcaaatagtccatactcagcaagatcaaggtatcccttaccactcaattggaagataccaagagattggccgatgaagagagcagagaacgcgctaccctcctcggcaaattcagaaacttggaacacgacttggacaaacatccgtgaacaagttgaaaaaagaagccgaagccaaggctgatatccaaagacaactcagcaaagccaacgctgaatctcaactctggcgccagaaatacgaatctgaaggagttgctcgctctgaagaactcgaagaagctaagaggaaactccaagctcgtcttgctgaggctgaagaaaccatcgaatctctcaaccagaaggttgtagctcttgaaaagaccaaacaacgtttggccactgaagtcgaagacttgcaactcgaagtcgaccgtgctaacgccattgccaatgctgctgagaagaaacanaaggccttcgacaaaatca

SEQ ID NO: 2066 - DNA, 383 bp, Diabrotica virgifera
  Clone ID: LIB150-002-Q1-E1-H7
cccacgcgtccggaaaaatctaaacgtaaggttgaaggcgacttgaaactcacccaagaggctgtagctgacttggaacgcaacaagaaggaactcgaacaaaccatccaacgcaaagacaaggaaatctcatcactcactgccaaactcgaagacgaacaatccgttgttggtaaacaacaaaaacaagttaaggaactccaggctcgcattgaggaactcgaagaggaagttgaagctgaacgtcaagcccgtgctaaagctgagaaacaacgcgctgatttggcccgcgaattggaagaactcggggaacgtcttgaaaaaaccggtggtgctagctcagcccaaatcgaactcaacaagaaacgtgaaccgaactcgcc

SEQ ID NO: 2067 - DNA, 418 bp, Diabrotica virgifera
  Clone ID: LIB149-016-Q1-E1-D5
gaggccgtctaggtttcgtagctggagtaatcaatagagaaagagttcctgcttttgagagaatgttgtggcgtatttccagaggaaatgttttcctgaggcaagccgaaattgagacacctatggaagatcccgcaacggggattgcatacaacaagaccgtcttcgcagccttctttcaaggagaacagttaaaaacaagaataaagaaagtatgtgctggcttccatgcttctctctatccttgtccaaacacgatcactgaaagaaacgatatgcttaaaggtgttcgcactcgtcttgaggatcttaacctggtgttaaatcaaacaagagatcatcgtcaacgagtactggtcagcgttgccaaagaattacagaactggagtataatggtaagcaaaatgaaggctatata

SEQ ID NO: 2068 - DNA, 395 bp, Diabrotica virgifera
  Clone ID: LIB149-037-Q1-E1-D5
accacgcgtccgcccacgcgtccgcaagcaacgatattcctgttgtccagaaggctttagccgatggatctagtgcttccggaagctcaatcccatcgtttctcaatgttatcaacactcacgaagcacccccaactttcaacagaactaacaaatttaccagaggcttccaaaacttgatagatgcctatggtgtggcctcctacagagaagtcaatccagccttatacacaattatcactttccctttcttattcgccgtgatgtttggagattgcggccacgccatgatcatgtttctatttggcttgtacttggtgttatcagaaaagaagatcaacgctatgaaaaataaaagcgaaatatttgtgatatttttcggaggaagatacatc

SEQ ID NO: 2069 - DNA, 426 bp, Diabrotica virgifera
  Clone ID: LIB3026-021-Q1-E1-B8
acgggagtcaataccttttcacccgaaggaagattatttcaagtagaatatgctatagaagctattaagttaggatctaccgctattggaatatgcaccagtggtggagtagtgcttgctgtagaaaaacgcattacttcccccttaatggaacctactacgattgagaaaattgtagaagttgacaaacatattggatgtgcggtttcaggacttatggcagattcaaggactatgatagatagagctcgtgtggaatgtcagaatcattggtttgtctacaatgaaaatataagtgtagaatcctgtgcacaaggtgtatcaaatttggctattcagttcggagattctgatgaagatggtgcagccatgtctaaacccttttggagtagcaatttggtttgctggtatagatgaaaaaggacc

SEQ ID NO: 2070 - DNA, 367 bp, Diabrotica virgifera
  Clone ID: LIB150-037-Q1-E1-G2
agttttcaatgctattacaagtttcttttgtataattttataaatattgttaatcgttaacatagtcctgtttacaaaatgtttcctacaagaagtgaatacgatagggggagtcaataccttttcacccgaaggaagattattcaagtagaatatgccatagaagctattaagttacgatctaaccgctattggatatgcaccagtggtggagtagtgcttgctgtagaaaaacgcattacttccccattaatggaacctactacgattgagaaaattgtacaagttgacaaacatattggatgtgcggtttcaggacttatggcagattcaaggactatgatagataaagctcgtgtggaatgtc

SEQ ID NO: 2071 - DNA, 375 bp, Diabrotica virgifera
  Clone ID: LIB149-043-Q1-E1-A3
cgcgtccgaacggtggatcgtaacaaacattcgtaactgaaaaatttagtttgacatcagtgttgtgccggcaatttttcaatcgatatgtttctcttagtgttattttctgtgattgcgtatttcgtatacaagaagattaaacggctcatgggccatcctcctctaactaaaaaactagaagagacatggtggggtcctgaggctcctggatctgtcaaaccggaagttaaaccttttactattagcgtatcagatgaggtactcaaagatcttcaataccgccttgaccaccaccgacctttcactcctcctctcgaaggaatcgtccacgaatatggcatcaacaccaatctagtcaagaccatagtcgac

SEQ ID NO: 2072 - DNA, 431 bp, Diabrotica virgifera
  Clone ID: LIB149-016-Q1-E1-D1
cgcgggtcaacacacgcgtctacagacacgtgtgttacgacgtctcgattgtatgtagagtgtgtgaactcaccaagaattcaaggggagtagctcaaaagttggagctccagtggcaatccatgtaccgagattaaatgtctagtgttcactgacgatgtttggtcctccataaatgtcatattagggcaaaatatggcgaaaagtggtaaagccggcaaaaagtagatactagtgtcaagccgttcaaaattcaaatttcacatgaaattttaaaagacttgaaagacagactggatcgtactcttccattccaaccaccactagatggcgtgaaacaacattatggaatgaacactaatcttctgaaaactatagtggactattggaagaacaaatacgattggagacaacgggagaagtttttcaac

SEQ ID NO: 2073 - DNA, 388 bp, Diabrotica virgifera
  Clone ID: LIB149-005-Q1-E1-H6
agtgttggcccgtcaaatggctaacaagccaaaacaaaccttcattggaaaacacgtagaagatcccaatgtccaagctgcagatgaagttgattggagatcaagcgctgacttgggagtcaaggatcaaggaaactgtggatcatgctgggctttcagtaccaccggatccctcgaaggtcaactcgccatccacaaaaatcaacgtgttcctctcagtgaacaagaattggtagactgtgacacagtaaatgctggttgtgacggaggtttgatgacagatgcctttaactatgttaaaggccatggtctctcttccgaatctcaatatgcatacaccggcagagatggtcgctgcaagaatgttcagaacaaacaagtctcttcc

SEQ ID NO: 2074 - DNA, 351 bp, Diabrotica virgifera
  Clone ID: LIB149-007-Q1-E1-B6
cccacgcgtccgcccacgcgtccgggctaacaagccaaaacaatccttcattgcaaaacacgtagtcgatcccaatgtccaagctgtagaagaagttgattggagagaaagtgctgtttggggagtcaaagatcaaggacagtgtggatcatgctgggctttcagtaccaccggatccctcgaaggtcaactcgccatccacaaacatcaacgtgttcctctcaatgaacaagaattggtagactgtgataacgtaaacgatggttgtgacggaggtttgatgacagatgccatcttttatattgaacatcatggtctttcatcacaagaacaatacccctacacaggggt

SEQ ID NO: 2075 - DNA, 380 bp, Diabrotica virgifera
  Clone ID: LIB3026-021-Q1-E1-G2
gaagtcgggcgcaattgattttcctgaagttttctgttggaggttggagccatacagccggcgctttaaaaacgtttttcgcgctttagtctgtgttacctctagagtgttctgtaattacaaaaatgggtagaacaggggatgaatctgacgatggaattcttggtgtgagcgagttcacaaaaaacaagaacatctggaaggcacttctcgccgaatgcctaggaacattcctcctggtattcataggatgcggttcctgtataaatatgatcgaaggagatggtggggcaattattaaaatttccttcgcgtttggtctgacgatagccactgttgttcaggcgatagctcatgttagtggaggccacattaatcct

SEQ ID NO: 2076 - DNA, 246 bp, Diabrotica virgifera
  Clone ID: LIB3026-013-Q1-E1-D2
accacgcatccgcccacgcgtccgttacaaaaatgggtagaacaggggatgaatctgacgatggaattcttggtgtgagcgagttcacaaaaaacaagaacatctggaaggcacttctcgccgaatgcctaggaacattcctcctggtattcataggatgcggttcctgtataaatatgatcgaaggagatggtggggcaattattaaaatttccttcgcgtttggtctgacgatagccactgttg

SEQ ID NO: 2077 - DNA, 388 bp, Diabrotica virgifera
  Clone ID: LIB3026-018-Q1-E1-H9
agcccacacgtccggaaagaaggaagacgtgagaccgaaaagcctcattttctttttgttcctttgcggaatttactataaatagtatttaaaaaatggctcctaaacaaagaatgcgtctggctaacgagaaagccatgaagaatgtcactttgagaggaaatgtaccaaaatcaacaaaacaaagtcaagaatcatcacctgtaggaccatggctattggcactttttgtgtttgtagtatgtggatccgccgttttccaaatcatccaatcaatccgcatggcttaatcttgtaaatcttatattttatttaaaaatatatgtttaatttggatttttaatatatttccgtttatttcgtattgtgcaatcctttaaatatcaat

SEQ ID NO: 2078 - DNA, 418 bp, Diabrotica virgifera
  Clone ID: LIB149-003-Q1-E1-A9
gacccaagcgtccacccacgcgtccgcccacgcgtccgcggacgcgtggggaaagaaggaagacgtgagaccgaaaagcctcattttctttttgttcctttgcggaatttactataaatagtatttaaaaaatggctcctaaacaaagaatgcgtctggctaacgagaaagccatgaagaatgtcactttgagaggaaatgtaccaaaatcaacaaaacaaagtcaagaatcatcacctgtaggaccatggctattggcactttttgtgtttgtagtatgtggatccgccgttttccaaatcatccaatcaatccgcatggcttaatcttgtaaatcttatattttatttaaaaatatatgtttaatttggatttttaatatatttccgtttatttcgtattgtgcaatcctttaaat

SEQ ID NO: 2079 - DNA, 368 bp, Diabrotica virgifera
  Clone ID: LIB150-025-Q1-E1-A4
gaaaaagtttaaactcaacaaccaaaatgcgttgatgtttcccaatccaagttgggcaagcccggattcaaattcggtattgctggctgggatttgtactgcctggaacatggcatccaacctgacggtcagatgccatcagacaagactgttggaggaggagatgacagtttcaacacattcttcagtgaaactggtgccggcaaacatgtacctagagcagtatttgtagatttggaaccaacagtagtagatgaagtacgtaccggcacataccgtcaattgttccacccagaacaactcatcactggcaaagaagatgccgccaataactatgctagaggtcactatacaattggtaaagaaat

SEQ ID NO: 2080 - DNA, 263 bp, Diabrotica virgifera
  Clone ID: LIB150-033-Q1-E1-H2
acccacgacatctgaatcgtattacattggctcacacgtccggcggtattttggttccattgggggggtaaaatttaaaactccaccagcaaaattgcgttgatgttacccaattcaagtttggcaaggccggagttcaaattggtaatgcctgctgtgagttgtcctgcctgtaacatggcatccaacttgacggtcagatgccatcatacaagactgtttgcggaggagatgacagtttcaacacattcttcagtgaaact

SEQ ID NO: 2081 - DNA, 413 bp, Diabrotica virgifera
  Clone ID: LIB150-041-Q1-E1-B11
ctcacgggccgacacaagcctctagattaaatcgtataatgttgttttacatttgtttaagagtatcataaaaaagtccagtatgtggaaatggttggttttggtgttttttcaactgtcagtttttgactgtgctgttaaaaataacaataataggtcactgcatgtgccaaattttgccaaccgtaatttaggtgacgctagttcaacctgtaaagctaaatattggacccttgtaaaatattttgatggctttccgaagaatactgatatgacaattcgggaagaaaatttgccaccactaaaaaatggagaatttttagccaaagcagttttcttaagcgtggacccataccagagagtacttgggtcttttccagatcaagtaaaacttggagaaccatttttggggc

SEQ ID NO: 2082 - DNA, 350 bp, Diabrotica virgifera
  Clone ID: LIB150-010-Q1-E2-H6
cacaagtccgcaacgcgtccgatttgtttaagagtatcataaaaaagtccagtatgtggaaatggttggttttggtgttttttcaactgtcagtttttgactgtgctgttaaaaataacaataataggtcactgcatgtgccaaattttgccaaccgtaatttaggtgacgctagttcaacctgtaaagctaaatattggacccttgtaaaatattttgatggctttccgaagaatactgatatgacaattcgggaagaaaatttgccaccactaaaaaatggagaatttttagccaaagcagttttcttaagcgtggacccataccagagagtacttgggtcttttcca

SEQ ID NO: 2083 - DNA, 371 bp, Diabrotica virgifera
  Clone ID: LIB149-025-Q1-E1-F1
gcgactcgaagtgaggttgtctgtggtgtaaaattaaatttttaaataataataaaaatcccttgaggattaaatttcaaaaatggtccaaaagaaaccaaagaagaaggtaggaaagaaagtagctgcagctcctcttgcagtcaagaaaattgaacagaaaaaagaaattaacccactttttgaaaagaggcctagaaattttggaattggtcaggatattcaacctccccgtgatttatctcgatttgtaaaatggccaaaatacatccgtattcaaagacaaaaggctgtacttcaaaagagattgaaagttcctccaccaattaaccaattctctcaaaacattgacaaacaaacagccacccaat

SEQ ID NO: 2084 - DNA, 295 bp, Diabrotica virgifera
  Clone ID: LIB150-009-Q1-E1-H8
tctgtggtgtagatttaattttttaaatattataaacatcccttgaggatttaatttccaagatggtccaaaagaaacctaagaagaaggtaggaaagaaagtagctgcagctcctcttgcagtcaagaaaattgaacagaaaaaagaaattaacccactttttgaaaagaggcctaaaaattttggaattggtcaggatattcaacctccccgtgatttatctcgatttgtaaaatggccaaaatacatccgtattcaaagacaaaaggctgtacttcaaaagagattgaaagt

SEQ ID NO: 2085 - DNA, 394 bp, Diabrotica virgifera
  Clone ID: LIB150-034-Q1-E1-F11
gagaaatccaccacaacctttgggaggtttaccaggtgctgctgctccagtacagcaggctgtacacattcaaggtcaggaaccattgacagcaaccatgttggctgctgctccaccacaggagcaaaaacagatgttgggtgaaagattgtttccacttatccaacgcatgtatccagacatggcaggtaaaatcactggtatgttattggagattgacaacactgagctgctacacatgttggaacaacaggagtcccttaagaacaaagtggaagaagcagttgctgttttacaagcccatcaagccaagcaagctgctactactcagattaagaaagagtagttgctgaagcagtgatgattttatgtgttatatttttaagcataaata

SEQ ID NO: 2086 - DNA, 359 bp, Diabrotica virgifera
  unsure (1)..(359): unsure at all n locations
  Clone ID: LIB150-013-Q1-E1-A2
cagtcaacaacaatgcgtagcaacatcagtgtacctagaccaattactggacaacaacctcaaagtggagttgtccttccgctggccgcacagcagacttcanatatacttcgaacatgagagatccacctcaatccttgggaggtataccaggaactgcggctcctgtacagcaagctgtacacatccagggtcaagagccacttacagcaacaatgttggctgctgctcccccacaggaacagagacagatgttgggtgaaagattgtttccacttatccaacgcatgtatgcagatatggcagggtaaatcactggtatgttgttgggaattgacaatactgagttgttgcaaatg

SEQ ID NO: 2087 - DNA, 456 bp, Diabrotica virgifera
  unsure (1)..(456): unsure at all n locations
  Clone ID: LIB150-015-Q1-E1-B8
caacgcgtccgacagtaccatgtgtcactagcataatactcaaaaaattaatatttaattttgtgaacttagttaacatcattttgaaaaatgcggtacactttgagttacatcggtgctaccctagcgtccactgtaacactgatttttgccctctactactgcctcacgggaaaaggagagcaagttagtttagcatggttattgttgaatgtgtctccccacatgtgggcaggtctaggaattggccttgctgtatcattatcagttgtangagctgctgcaggaattcacactacaggagtcagtatcgtangagctggtgttaaagcccccagaatcaaaaccaaaaatttaatttctattattttctgtgaagctgtggctatctatgggttaattatggctatagtactctgtggaagttggaagaatttcgatgtagacctattcaac

SEQ ID NO: 2088 - DNA, 352 bp, Diabrotica virgifera
  unsure (1)..(352): unsure at all n locations
  Clone ID: LIB149-020-Q1-E1-D6
aagtgtcactagcataatactcaaaaaattaatatttaattttgtgaacttagttaacatcattttgaaaaatgcggtacactttgagttacatcggtgctaccctagcgtccactgtaacactgatttttgccctctactactgcctcacgggaaaaggagagcaagttagtttagcatggttattgttgaatgtgtctccccacatgtgggcaggtctaggaattggccttgctgtatcattatcagttgtangagctgctgcaggaattcacactacaggagtcagtatcgtangagctggtgttaaagcccccagaatcaaaaccaaaaatttaatttctattatttt

SEQ ID NO: 2089 - DNA, 445 bp, Diabrotica virgifera
  Clone ID: LIB150-017-Q1-E1-D1
cccacgcgtccggctaaaaatgtcttcaatcggcggcgataacgacgatgcattcatcgcaaagttgcggggtttaccttggtcggcgactccagatgatattcttaatttttttgacgattgcagtattttggacggaaaagatggtgtacacatgactacatctagagaaggacggcctagcggtgaagctttcgtagaattcgaatctgaagaggatttagagacagctttgcaaaaggatagagaacacattggaaataggtacattgaggtttttaaggtgaacaaggctgaaatggaatgggtggtaaaacggtcaggcacttcatctggcttgaacgatgatggatgcgttaggcttagagggctaccctttggctgttctaaggaagaaattgctcaatttttcacaaggttggagattgtacccaacgggaataac

SEQ ID NO: 2090 - DNA, 404 bp, Diabrotica virgifera
  Clone ID: LIB149-042-Q1-E1-D2
agaaaaatgtcttcaatcggcggcgataacgacgatgcattcatcgcaaagttgcggggtttaccttggtcggcgactccagatgatattcttaatttttttgacgattgcagtattttggacggaaaagatggtgtacacatgactacatctagagaaggacggcctagcggtgaagctttcgtagaattcgaatctgaagaggatttagagacagctttgcaaaaggatagagaacacattggaaataggtacattgaggtttttaaggtgaacaaggctgaaatggaatgggtggtaaaacggtcaggcacttcatctggcttgaacgatgatggatgtgttaggcttagacggctagcctttggctgttcctagggacaaattggcccaattttccaaag

SEQ ID NO: 2091 - DNA, 427 bp, Diabrotica virgifera
  Clone ID: LIB150-018-Q1-E1-E5
tggatccgaaaaattcagcatagatgcaaccgaagttatggatatgttattgaagacacatggagatggagctgaattacccgacgacgatccccaaactagttatcttatttccgcttggtctagaatatgtaaagttcttggtaagaatttcgaacaatatttgcctttagtaatgggaccagtaataagaacggcagctatgaaacctgatgttgcccttttagacaacgacgatatgcaaggagtagaaggtgatgacgattggcaatttgtatccttaggagaacagaagaacttcggaattcgcacggcaggtcttgaagacaaagctgctgcctgtagtatgcttgtttgctatgcacgtgagctaaaagaaagtttctcaaattatgccgaagaagtcgtcaaacttatggtaccaatg

SEQ ID NO: 2092 - DNA, 403 bp, Diabrotica virgifera
  unsure (1)..(403): unsure at all n locations
  Clone ID: LIB150-043-Q1-E1-D6
aatccgaccacgcgtccgatttccttcaacctctggccttatatatgaacgacanaacaccgaagtcagacaagcagtggcttacggatggggagtgctancgcattttgggggtgaacagtttgcaggagaattacctaaagctgtacccatgttagtcgaagttataaacgaacctgaatcgaaagaccctagaaatattaacgctacggagaatgctataccggctgttactaaaattatgaagtataataactcacagattaaccttgatgaaattattccactgtggttctcgtggttgccagttatagaagatgttgacgaatcgcctcatatttatgggtatatgtgcgatttaatagagcagaataatcaacacattttaggcgtaaataattcc

SEQ ID NO: 2093 - DNA, 425 bp, Diabrotica virgifera
  Clone ID: LIB149-004-Q1-E1-A12
tacaaccctctagattcagtcgtaatagctcgtagcagttttctcgtcagcttttgctgtcgaatttgaaattgtcaataaagaaattggtgctgtatgggtaggaatacaaggaaacgatggcaaggaagcgttagcaaatggtgggttcattcttgaagcaggagctagtagatcagtgcaagcgccagaagattgggctggtcgattttgggcaagaacatggtgtgacataaatactcaacattgtgacacaggtgattgtggaaatagaattgaatgtggaggcaatggaggtgcaccaccagcatccttggctgaaatcactctaaaaggatggggaggcctagactactacgacatatccctagtagatggctttaatatagccgttagctttgaacccgtaggtggaagcggtgacg

SEQ ID NO: 2094 - DNA, 458 bp, Diabrotica virgifera
  unsure (1)..(458): unsure at all n locations
  Clone ID: LIB149-010-Q1-E1-B9
agtttcgatacatattgctcgtagcagttttctcgtcagcttttgctgtcgaatttgaaattgtcaataaagaaattggtgctgtatgggtaggaatacaaggaaacgatggcaagaaagcgttagcaaatggtgggttcattcttgaagcaggagctagtagatcactgcaagcgccaaaagattgggctggtcgattttgggcaagaacatggtgtgacataaatactcaacattgtgacacaggtgattgtggaaatagaattgaatgtggaggcaatggaggtgcaccaccagcatccttggctgaaatcactctaaagggatggggaggcctagactactacgacatatccctagtagatggctttaatatagccgttagctttgaacccgtangtggaaacggtgacggaagtcagtacagctgtaaaaaatgtgcatgcggacgtaatttg

SEQ ID NO: 2095 - DNA, 369 bp, Diabrotica virgifera
  unsure (1)..(369): unsure at all n locations
  Clone ID: pGUT582
attaaacctctcgtattccaatacgagtggctggaacaagacttggcaacggcgattttacccgaaaacagagaaaagcaaccatggattatagtgatgggtcatcgccctatgtactgttccaacactgatcatgatgactgtacacatcacgaaaccataacaagagtatgattgcctttcttacaattcttcggattgganaacttgctttacaattatggagtcgatttagctatatgggcccatgagcattcttatgaaaagctgtggcctgtttataattacaccgtttacaatgggagctacgatcagccttacgtanatccaggggctcctgtacagttcaccactggctcggccggctgc

SEQ ID NO: 2096 - DNA, 357 bp, Diabrotica virgifera
  unsure (1)..(357): unsure at all n locations
  Clone ID: pGUT591
attaaacctctcgtattccaatacgagtggctggaacaagacttggcaacggcgaatttacccgaaaacagagaaaagcaaccatggattatagtgatgggtcatcgccctatgtactgttccaacactgatcatgatgactgtacacatcacgaaaccataacaagagtaggattgcctttcttacaattcttcggattgganaacttgctttacaattatggagtcgatttagctatatgggcccatgagcattcttatgaaaaggctgtggctgtttataattacaccgtttacaatgggagctacaagcagccttacgtanatccaggggctcctgtacagttcaccactggc

SEQ ID NO: 2097 - DNA, 430 bp, Diabrotica virgifera
  Clone ID: LIB3026-017-Q1-E1-A1
catggcttcagagagatatagcttttctttaactactttcagcccctctggaaagttggttcagattgaatatgcattagccgctgtagcggcgggtgctccatcagtaggaattaaagcatcaaatggtgtggttattgcaacagagaacaagcacaaatcaattctgtatgatgaacacagtgtccataaagtagaaatgatcacaaaacacattggtatggtttattctggtatgggtcctgactatcgccttcttgtgagacaagcacgcaagatggctcagcagtattacctagtataccatgaacccattcctacagtacagttggtgcaaagagtagcgactgtaatgcaagaatacacccaatcaggaggagttagaccatttggagtgtcgctactgatttgtggttgggataacaacaga

SEQ ID NO: 2098 - DNA, 262 bp, Diabrotica virgifera
  unsure (1)..(262): unsure at all n locations
  Clone ID: LIB149-038-Q1-E1-B7
tatagtgagtcgtattaaccagangtcatcancacgaagacaaaagttaaaaattttgtttgtaattgcaggtaatcatggcttcagagagatatagtttttctttaacgactttcagcccctctggaaagttggttcagagtgaatatgctttagccgctgtagcggcgggtgctccagcagtatgaattaaagcatcaaatggtgtggttattgcaacacagaacaggcacaggtcaagtctgtatgatgaacacagtgt

SEQ ID NO: 2099 - DNA, 608 bp, Diabrotica virgifera
  Clone ID: pGUT3298
atttaacatcgttctggcctgtaaatactcctaataacttaaaaaatggcagatgacaaacaccccgtctatggacccttctttggagtcatgggagccgcggctgctatcattttcagttcgctgggcgccgcctatggtacggcaaaatcaggaaccggtattgccgctatgtcggtcatgaggccggaacttatcatgaaatgtattatcccagttgtcatggcgggtatcattgccatctacggtctggtcatagctgtactgatctctggtaacatccaagacagctctacatattcattgtacagtggttttgtccatttgggtgctggtctttcagtaggattttcaggattggcggcaggtttcgctattggtatcgtaggtgacgctggtgtaagaggtaccgcacaacagccaagactcttcgtaggaatgatcttgatcctcattttcgccgaagtattaggtctttatggtctcatcgtcgccatttacctctatactagagcttaagcgcccagctcccctaaatttcatctcctaaacacagcgtaccaaaaagtgcgcatctcgccccgatcattttgttttaatgtctacat

SEQ ID NO: 2100 - DNA, 409 bp, Diabrotica virgifera
  Clone ID: LIB149-033-Q1-E1-B5
aggttccgtagtgtgttgtgcacatttaacatcgttctggcctgtaaatactcctaataacttaaaaaatggcagatgacaaacaccccgtctatggacccttctttggagtcatgggagccgcggctgctatcattttcagttcgctgggcgccgcctatggtacggcaaaatcaggaaccggtattgccgctatgtcggtcatgacgccggaacttatcatgaaatgtattatcccagttgtcatggcgggtatcattgccatctacggtctggtcatagctgtactgatctctggtaacatccaagacagctctacatattcattgtacagtggttttgtccatttgggtgctggtctttcagtaggattttcaggattggcggcaggtttcgctattggtatcgt

SEQ ID NO: 2101 - DNA, 506 bp, Diabrotica virgifera
  Clone ID: pGUT3424
gcagattcagaccgttcgttcccctttgactgtgacttaccaaaagaatgtgtgataaaaatctttaagactacactttctgaattcaaacaaagggataagtacatcaaagatgaccatagattcaaggacagaatatgaaaacaaactgctaggaagactgtatacatttgggccgaaaaggaaatggccaacttgatgagacttcagaaagcagaaataccttgcccaaaagttgtgacacttaagaatcatttgttagtgatgtcttttataggagaaaaccacaggcctgcgccaaaattgaaagatgctgtcatgtcagatgctgattacatagttgcttatgaacaggttactgaaaatatgaaggccctctatgacaaagcaaatttaatacatgcagatctatcagaatataacattttgtggtatcaagaccaatgctattttattgatgttaggcaatctgtagagcctagtcatgaaaacgcattccacttttt

SEQ ID NO: 2102 - DNA, 423 bp, Diabrotica virgifera
  Clone ID: LIB149-049-Q1-E1-F11
acaccactctaaagtgagtcgtaataatcacagatttatgaacagaaaaggaaagcatgcttctagatcgactgtaaatatttctgctgagagggagatgatccacctgatgcaaatgcagaaggctggaataccttgcccaaaagtagtaacacttatgaaaaatgtattggtgatggagtttatcggcgaaaaccaaatacccgctcctacattgaaggatataatggcagatgttcattgcacaaatgcttatgagcaggttattgaatatatgaggatactctataccaaggcagatttggtacatgcagatctaacggaagataatattttgtggcaccacgataaatgctatttcattgatgtcagtgaagcactagagcctagccatgaacaagcattcttctatctatacaagga

SEQ ID NO: 2103 - DNA, 243 bp, Diabrotica virgifera
  Clone ID: pGUT1036
atccgaatccagtttgcggattatattccccgccgccgccgcttgcccccggtgtagtggagtcatatttctcgtacatcgattgagttttatcatatcccagtatacacgattctacataattcttcgccaactgctctgccatatctaaagctatggaattgttagtgttcttaagccctaagatgacgatctcttgtaaaggatgccaagcattcggcaagttccattgctcaccgctgt

SEQ ID NO: 2104 - DNA, 403 bp, Diabrotica virgifera
  Clone ID: LIB149-014-Q1-E1-D10
caaataactactcatgtaaagtgttgatatagataaacaaagtacctaaacaatacctggcgtcgtaatgttgtgaacaagtcatagtaaaattaacaacttctgtgaaaacatttaagaaattatttcatatacgtcttttgacaatttctagtcgatatgaagtgctacattgtgtacgcttcggcagtattattcagctatatcagcgctgagaccgtacaatcatgtgatagtttaatttattgtcaaggggagctgttggacacagtgcaatccgcaaggatcttcagtgactcaaagacgttcgtggatttgagccaacgccaatccccggatgaaactttaggaaatttcaaaaagtttatggcaaaatgtaacgataatccgactaaagatgaag

SEQ ID NO: 2105 - DNA, 383 bp, Diabrotica virgifera
  Clone ID: LIB150-030-Q1-E1-D7
agaaaatgctgatgatctgtcgcaagcactaatgataattaccaatgccatttacttcaaaggaacatggactcgtaaatttgataaaaatagatcaacgcttggaaacttctatacatctcctgataatataagatctagcagaaacttaaaattagttcaatacatgactaccactgacgaatttctttattacgaggacagatctttggatgcgaaaattgtcaggttggaatacaagggaagtgactatgccatgtatatagtcctaccgaacactttgggaggattaagcagccttatcaaaaatgtggacataaacaaaataggaactataaagttccaaatgacacaacaagttgttgaggttactattccaaagt

SEQ ID NO: 2106 - DNA, 406 bp, Diabrotica virgifera
  unsure (1)..(406): unsure at all n locations
  Clone ID: LIB150-029-Q1-E1-H9
gacagaactgaatatatgctcaacattgggacatcgatgtttgtagatgaaggtctatacgttttatctaaattcgaagaccttgcaagaaaaagcttcaaaacagacatcataaagactaactttgacaaacaggaaaaggctagtaaagatattaattcgtgggtggaacagcttactcatggtaaagtgaagaaaatagtcaatgctgatgatcggtcgcaagcactaatgataattaccaatgccatttacttcanaggaacatggactcgtaaatttgataaaaatagatcaacgcttggaaacttctatacatctcctgaaaataaaaagatctagcagaaacttaaaattagttcaatacatgactaccactggacaatttctttattacgaagacaga

SEQ ID NO: 2107 - DNA, 418 bp, Diabrotica virgifera
  unsure (1)..(418): unsure at all n locations
  Clone ID: LIB149-006-Q1-E1-H2
gcgtccaattgatctctttggaggtgctggagtaggaaaaactgtactgattatggaacttattaaaaacgtagctaaagccatggtggttactcagtattcgctggagtangagaacgtacccgtgaaggtaacgatttataccatgaaatgattgaatctggagtaatctccttaaaagataagacctccaaagtagccttggtctacggacaaatgaacgaacccccaggcgctcgtgctcgtgtagctttgactggattaactgttgctgaatatttccgtgatcaagaaggacaagatgtactgcttttcattgacaacattttcagatttactcaagctggttcagaggtatgtgccttgttgggtcgtatcncctctgctgtaggttaccagcctactttggccactgaca

SEQ ID NO: 2108 - DNA, 440 bp, Diabrotica virgifera
  Clone ID: LIB3026-020-Q1-E1-B9
gcgtccaggaccacaacattattggagccgaacattacaaagttgctcgtgatgtacaaaagatcttgcaagattataaatcactacaggatattattgctatcttgggtatggatgaattgtctgaagatgacaaacttactgtatctcgtgctagaaagatccaacgtttcctttcacaacctttccaagttgctgaagtcttcactggtcatgctggaaaacttgttcctcttgaagaaaccattaagggattccaaaagattcttgctggtgaattagatcacttaccagaagtcgccttctacatggtaggacccattgaagaggttgtccaaaaggtagaaaaattagctgaatctacataaatgctaggataactttgtatatttatttgtatgtgattccatcaatctgcagagagaaagacgtttcttttt

SEQ ID NO: 2109 - DNA, 410 bp, Diabrotica virgifera
  Clone ID: LIB150-047-Q1-E1-B5
atgctaatgcaagcgaggatggatccatgatccctaccataaagactgcattcctacttgcccagaaaggtgtctcaatggtgtctgcaccatcactggccaatgctcctgcaatgccggaaacacactcagctctagcggaaaatactgccttcctcactgtagcggaggctgtggtgttggaggaaactgcgtaggtcctgagacctgtgcttgtgacaaaggtttctctttggatgcaagaacccgcaaatgcaactaccattgcgaaggaggctgtggagaaggaagctgcattggaccgaaccaatgttcctgcaaaccaggatatagacaagctggacactcttgtgtagcagattgcccaagaggatgccacaatggagactgtgtaacaccaaacagatgtt

SEQ ID NO: 2110 - DNA, 418 bp, Diabrotica virgifera
  Clone ID: LIB150-014-Q1-E1-D7
cgacaattaacagaagctacggacgcagaagataccggcatccggtgatattgaaagtggtttaaaaaaaatagatagataataatatggctttcaagctggtggtgggcgccacggccttgatggccttttctcttctgagccagagcgtagaagccgctcagctgcagggagtagcaagaaataactccagaagaggtatctgtaccttggaagttcctactattgacctaattcctgcagaagacagacatggcgttatacctagaggaaatggatccagaaacggatacagtaaaatagatgtgtgctgtagtggatacgaaagagttccaagaacccacttgcaatgtgagcctgtctgtgatcactgcgaaaatggtaactgcacgtctcctggtcattgcgaatgcaagcg

SEQ ID NO: 2111 - DNA, 431 bp, Diabrotica virgifera
  Clone ID: LIB149-043-Q1-E1-D5
gtccatttgttgtcaaagaccccatggtaattggtcatgaagcttcaggaacagttgtgcaagttggaaaaaatgttaaaaatcttaaacaaggtgacagattacccatcgaacctggtgtaccatgccgtacctgccatcactgtaaaactggtgcttatcatctctgccccgatatcttcttcggtgcgactcctcctgatgatggtaacctctccagatactacgtacatgacgctgatttctgttggaaacttcctgataacatggatctcgaagaaggtgctttgatggaacccttgtctgttggtgtccacgcttgtaaacgagctgaaattaaagtaggtgacgtttgtcttattaccggagctggaccaatcggtctcgttactctcttatcggctaaagctatgggagcttcaaaagttgtt

SEQ ID NO: 2112 - DNA, 401 bp, Diabrotica virgifera
  Clone ID: LIB149-043-Q1-E1-D6
gccacgcgaccgaagcatttgttgtcaaagaccccatggtaattggtcatgaaccttcaggtacagttgtgcaagttggaaaaaatgttatcgaatcttaaaccaggtgacagagtagccatcgagcctggtgtatcatgccgtacctgccagcacggtaaaactggtgcttatcatctctgccccgatatcttcttctgtgcgactcctcctgatgatggtaacctctccaggtactacgtacatgacgctgatttcagttggaaacttcctgaggacatggatatcgacgaatgtgctttgatggaacccttgtcggttggtgtccacgcgtgtaaacgagctgaaattatgagtacgtgacgtttgtcgtactaggggagctggaccaatcggtctcg

SEQ ID NO: 2113 - DNA, 400 bp, Diabrotica virgifera
  Clone ID: LIB150-036-Q1-E1-H3
cccacgcgtccgtgctactgaagattggggatcccagactgccacagtaggtatttggattgatgctggcagtaggtatgaggatgataaaaataatggagttgctcacttcatggaacacatggcatttaagggtaccagtaaaagaacccaaagtcagttagaaattgaaattgaagacctaggtgcccaattgaatgcctacacaagcagagagcagacagtatattattccaaatgtttagccaaagatgtaccaaaggccatagaaatcttggctgatatcatccagaatgccaaattgggagaggctgaaatcgaacgagaaagaggtgtaatccttaaggaaatgcaagaagtcgaatctaatttacaagaagttgtatttgatcatttacat

SEQ ID NO: 2114 - DNA, 409 bp, Diabrotica virgifera
  Clone ID: LIB150-025-Q1-E1-B12
gtcgcgggccgacccaaaagtccaggcgtcaactctaaagttttctcgatcttttgcaaaattacctaaatacgaaactgcattaaaagcctgtagacaaaatattattagaggagcagccacccagccagattcacaaactgttgttctaaatgtaccaccaacaaaagtcagcactttgaaaaatggtatcagagttgctactgaagattggggatcccagactgccacagtaggtatttggattgatgctggcagtaggtatgaggatgataaaaataatggagttgctcacttcatggaacacatggcatttaagggtaccagtaaaagaacccaaagtcagttagaaattgaaattgaagacctaggtgcccaattgaatgcctacacaagcagagagcagaca

SEQ ID NO: 2115 - DNA, 443 bp, Diabrotica virgifera
  Clone ID: LIB150-023-Q1-E1-F4
acaagccgctaaactgagtcgtataaaaattaccttgacaaccactacaaatctagcagaattgttgttgctggagcaggtggaattgaacaccaagatttagtgaaactcgctgagagccatctgggttccttaaacaatacatatccaggaaaagttccagtaattgctccatgtcgtttcactggatcagaaattagagtcagagatgattccctgcctttggcacacattgcccttgctgttgaaggggctggttggtccgaccctgataccctcacattgatggttgcttctactttgttgggtgcttgggacaggtcccaagcctccgccaaacagaatgctaccaacttagctagagctagtggggaaggtgacttgtgtcattcctaccaaagcttcaatacctgctataaggatactgggttgtggggagtgta

SEQ ID NO: 2116 - DNA, 326 bp, Diabrotica virgifera
  Clone ID: LIB3026-007-Q1-E1-F8
gataccctcacattgagggttgcttctactttgttgggtgcttgggacaggtcccaagcctccgccaaacagaatgctaccaacttagctagagctagtggggaaggtgacttgtgtcattcctaccaaagcttcaatacctgctataaggatactggtttgtggggagtgtatttcgtctcagatcctcgtaagattgaggatatggtctttaacattcaacaagaattcatgagactttgcacttccgtaactgaaggtgaagttgagcgtgctaaagctcttcttactgccaacactcgtcttcaacttgacactactagtgc

SEQ ID NO: 2117 - DNA, 341 bp, Diabrotica virgifera
  unsure (1)..(341): unsure at all n locations
  Clone ID: pGUT4273
ggcggctttagctggtagacgcaaggctaagctagtagacaattcggcctatttgcaattcatgtggaaggctgatgtagttgaaagctggatcgccgataaggagagccacgtcaagagcgaagagtttggaagggatttatcttctgttcagaccttgttgactaaacaggagacctttgacgctggtcttactgcatttgaacatgaaggtattcaaaacataactgcacttanagatcaactaatttcttccaaccacgaccaaactcaagctattgtccaaagacatcaagctgttatttccagatgggcaaaacttctaaacgactctgacgcac

SEQ ID NO: 2118 - DNA, 168 bp, Diabrotica virgifera
  Clone ID: LIB150-001-Q1-E1-H1
cccacgcgtccggaaagtcgatgctggcttgacagcttcgcaacaaaatcttttggatagcaactcgatctccgccagacagaaccagatcaaccaacaatatgacaggcttctacagttggccaacgaacgtcgcaccaaactcgaagagacagtcaaggccaaggt

SEQ ID NO: 2119 - DNA, 411 bp, Diabrotica virgifera
  Clone ID: LIB149-004-Q1-E1-F11
acccacgcgtccgcgagttttacgttgcttgcccaacactagaaggaagcttaatggactggtgctgagaagcctcattactcaaatatatcctgtagctgaacgtgatgccctccttagtttcgtcgaggaagcttctggagaactcgacgccacccagtcacgagcaagatcagctgttaagtcacctgttcccgaggtagatacatatataaatcttttaatactagtacgtttaattgataccaataagttagttgaagcagagcgctgttctcaagctcttatgaataaaataactaaccaaaacagacgtactatagatcatattgctgccaagtgttatttctatcactcaagagttgctgaattgaccaacaaattggattcaattagagggtttttacattc

SEQ ID NO: 2120 - DNA, 395 bp, Diabrotica virgifera
  Clone ID: LIB150-004-Q1-E1-G11
acagcgaatattttcctttcctcatcagttcaatattaacaataaattgttttgttgaaattgaaatcacaaattactttataaaatggtaactctcgaagacgttgaaatgaaaaatgcagacagtcctccaggattagaagctggtgatacaaagaaagataccgacctacaaagtgtaatagaaattcgtgaacatgcaagacaaatagaaaaatcagtcacaagtaaagaaaaccgtttcatcttacgagttttacgttgcttgcgcaacactagaaggaagcttaatggactggtgctgagaagcctcattactcaaatatatcctgtagctgaacgtgatgccctccttagtttcgtcgaggaagcttctggagaactctaggccaacc

SEQ ID NO: 2121 - DNA, 446 bp, Diabrotica virgifera
  unsure (1)..(446): unsure at all n locations
  Clone ID: LIB150-012-Q1-E1-G7
tttggatcgtgtttcccaaattaaagaagaattaccttcagtagcagaactaggtggactacgtcttactcctttagaatttgaaaaggacgatgacaccaatttccacatggactttatagttgctgcttcaaatcttcgtgcagctaattacaaaataccgcctgctgatagacataaatcaaaacttattgctggtaagattattcccgccatagcaacaacaacctcagtagtcgctggaatggtttgcttggaactctacaaactcaccagaagttacacatcgctaactccattcagaaataatttcattaaacctcgcgctgccctttcttcagttgctcnagaacaatcgcagcccaacaaatggaatactgtggtaacaaatggacactatgggaccgcttcgacgttcagggagagatgacgcttagtgaattttt

SEQ ID NO: 2122 - DNA, 377 bp, Diabrotica virgifera
  Clone ID: LIB149-019-Q1-E1-H6
cccacgcgtccgggcgtaaagatagcagttacggattctcaaatggctatgaatggtaataatgtggatttggatcgtgtttcccaaattaaagaagaattaccctcagtagcagaactaggtggactacgtcttactcctttagaatttgaaaaggacgatgacaccaatttccacatggactttatagttgctgcttcaaatcttcgtgcagctaattacaaaataccgcctgctgatagacataaatcaaaacttattgctggtaagattattcccgccatagcaacaacaacctcagtagttgctggaatggtttgcttggaactctacaaactcaccagaagctatacatccctaactccaatcaaaaataa

SEQ ID NO: 2123 - DNA, 447 bp, Diabrotica virgifera
  Clone ID: LIB150-017-Q1-E1-C7
cagaaaagctcttctagaaactgccaaagacaacagctctgattcagaagagttcagagaagatctgatgaacattgccagaactacactcagctcaaagattctttcacaagatagggaatattttgccaaactggcagtagatgctgtgctgagattgaaaggtacaggtgatttacaatccatccagctgattaagaaaactggtggtactttggaagattccgttttggatgaaggttttttattggacaaaaaacctgatgtacatcaaccaatgagagtagaatatgcatgcatcctgatagccaacactcctatggacacagataagatcatagtattttggttctcacattagggtaaattcaatggctaaaattgcagagctggaatctgcagaaaaggaaaaaatgaaagataacgtgatcaaaattcttaaacata

SEQ ID NO: 2124 - DNA, 390 bp, Diabrotica virgifera
  Clone ID: LIB150-028-Q1-E1-B7
agacttttgacaaattaaaattttgaacaatttattttattaatttcaatcacattgcagttttaaaaagaattaaaaatggtatccctaaatcccgtaagaattctcaagcaagaagccgaggaagaaagggcagagattgcccgactcagtagttttgtaggtgctatagctataggagatttggttagaagcaccttgggaccaaaaggaatggataaaattttagtatccagtggtagatctgcaggatcagttgaagttactaacgacggagcaactatcctaaaatcggtgggtgttgataatcctgctgctaaaattttggtggatatgtcaaaagtccaggatgatgaagtaggagatggcaccacatcagtgacagtatta

SEQ ID NO: 2125 - DNA, 347 bp, Diabrotica virgifera
  Clone ID: LIB3026-033-Q1-E1-B7
tgtttggagcgaatatcatttttgctctcggtgggcttgctttaatcgtcgtaggagtactatacgagctagagataaatgattttactgaagctataccagaagaatacagctcaataggcgtagctcccatactgaccattgtagtaggctcaataatatttgtcatcgcattctttggatgctgtggagccattagagaaggccgatgtttgcttacaacgtacggtgtaatattgttggtaatatttttgcttcaaatcgccgttggagtctttgcttttatggaagtaagggataaggataatttcaaaacccaagtgaacaggcaactggatactttgttt

SEQ ID NO: 2126 - DNA, 420 bp, Diabrotica virgifera
  Clone ID: LIB149-023-Q1-E1-G11
gggtcgaccacgcgtcgataaaaatatataacagaaactagcgactagcgtcaatatgtgcggaacagcaatgggttgtgccaaagggattgtgaaattgtttgtgtttggggcgaatatcatttttgctctcggtggtcttgctttaatcgtcgtaggagtactatacaaactaaacataaatgattttactgaagctataccagaagaatacagctcaataggcgtagctcccatactgaccattgtagtaggctcaataatatttgtcatcgcattctttggatgctgtggagccattagagaaagcccatgtttgcttacaacgtacggtgtaatattgttggtaatatttttgcttcaaatcgccgttggagtctttgcttttatagaaataaaggataaagataatttcaaaac

SEQ ID NO: 2127 - DNA, 343 bp, Diabrotica virgifera
  Clone ID: LIB149-039-Q1-E1-E6
aatttttatttattttaaaataataaaatattttttagtaaaattaaagaaaaatttaatttaatgatagttaattattattgtgaaagaatatttaattttataaaagaaaaatttattttttgtaccttgtgtatcagggattattaattaataattatatatttaataatttcgaatttaaaagagctaaaaaattaaaatttttaatgtaaaataaatattttaaataatttttttgtaaagaaatgttaatcgtttttaaatatatctaaatttttaagaaataaattaaatttaattattaacaatatatttataattaaatatttttatattatta

SEQ ID NO: 2128 - DNA, 351 bp, Diabrotica virgifera
  Clone ID: LIB3026-018-Q1-E1-D2
acgtatttattttaaaataataaaatatttttttagtaaaagtaaagaaaaattttatttagtgatagttaattagtattgtgagagaatactttatttttataaaggaaaaatttattttttgtaccttgtgtagcagggattactaattaataattatatatttattaatttcgaatttagaagagctaaaaaattaaaatttttaatgtaaaatatatattttaaataatttttttgtaatgaaacgttattcatttttaaatataactaattttttaagaaataaattttcattatttattaacaatatatttataaataaatatttttaaattaccaatactaacg

SEQ ID NO: 2129 - DNA, 413 bp, Diabrotica virgifera
  Clone ID: LIB150-032-Q1-E1-F4
cgggtccacgcacgcgtccgacgacgaatcagctgcactactagccaatctgaacgtcggtccaaattttgtgtcaattgtggtgtacaagttaaaactcatcatccagtatgcctgactgtatcgcagtcgatgtaggccaagccggagtcgaaagcggtgatgcctgctgggagttgtactgcctggaacatggcattcaaactgactgtcagatgccagcagacagaactgttggaagatgagatgacagtttcaatacattcttcactgaaactggtgtcggcaaacatgtacctagagcagtagttgtagatttggaaccatcagtacttgatgaagtatgtagtggcatataccgtcaattgttccacacagatgagctcatcaatggcaaagatgatgccgccaaa

SEQ ID NO: 2130 - DNA, 356 bp, Diabrotica virgifera
  Clone ID: LIB150-036-Q1-E1-D12
cgggtcgacacaagcctctatacagacgtcgtattaactactagccagtctgaacgtcggtccaaattttgtgtcatttgtggtgtcacagttaacaactcatcaaccagtatgcgtgactgtgtcgcagtccatgttggccaagccggtgtcgaaagatgtaatgcctgctgggagttgtactgcctggaacatggcatccaacctgacggtcagatgccagcagacagaactgttggcagatgcaatgacagtttcaatacattcgtcactgacactgatgccggtaaacatgtacctatagcagtagttgtagatttggtaccaacagtactatatggaatacgtagcggcat

SEQ ID NO: 2131 - DNA, 395 bp, Diabrotica virgifera
  Clone ID: LIB3026-015-Q1-E1-E2
cagattgtaaagagagctttaagagtaccttgcatgaccattgctcgtaatgcaggagtagatggagcgtctgtggtagctaaagtagaacaacaacaaggagattatggttatgatgcgctcaacaatgaatatgtaaacatgtatgaaaggggagttattgatcctaccaaggttgtccgaactgccattgtagatgcctccggtgttgcctctctcttgaccacagctgaagcagtcatcacagaaattccaaaggaagaaccagccatgcccgccggcggcatggggggaatgggaggaatgggcggcatggggggaatgatgtaaacccatcttaaacatactttcaatagactgttctaacttaagtctaatgtttgccgccaaagtgg

SEQ ID NO: 2132 - DNA, 392 bp, Diabrotica virgifera
  Clone ID: LIB3026-034-Q1-E1-G3
cccacgcgtccgtattgatcctaccaaggttgtccgaactgccattgtagatgcctccggtgttgcctctctcttgaccacagctgaagcagtcatcacagaaattccaaaggaagaaccagccatgcccgccggcggcatggggggaatgggaggaatgggcggcatggggggaatgatgtaaacccatcttaaacgtactttcaatagactgttctaacttaagtcgagtgtttgccgcgaaagtggcaagttggacagtatctgtcaaaaggttccattttcgtatttggcagaccctttaaatacttttttatactgtttgttgtgctacataaattcgtgtgaagttttcttatgtgtaccacgaattaaattgcgtgaatgagaaa

SEQ ID NO: 2133 - DNA, 383 bp, Diabrotica virgifera
  Clone ID: LIB150-013-Q1-E1-C3
tttagttttttttagaataaaaaatttatttagaaatatatattgtatacataacaacattcaacagcaaccccccgtcttttaatacacctgaagcatcgtaagtggaagcagaaacgtttccaccgtggcccgtccagttggtgtggacgaatttaccttctttacccaataattcatatgtgtgtgccccgaagtagtctctttgagcttgcaaaagatttgctggaagacgctcagatctgtatccgtcgtagaaggccaaagcggtacttaaagctggagttgggatacctaaagtgacagcagtagttagaacattcctccatccctgttgagctttggtaatagcgtctaaaaagaatgggtccaataacaaggag

SEQ ID NO: 2134 - DNA, 305 bp, Diabrotica virgifera
  Clone ID: LIB149-034-Q1-E1-D2
agtcactttacgtattccaactccagctttaagtaccgctttggccttctacgacggatacagatctgagcgtcttccatcacatcttttgcaagctcatagagactacttcggggcacacacatatgaattattgggtaaagaaggtaaattcgtccacaccaactggacgggccacggtggaaacgtttctgcttccacttacgatgcttaaggtgtattaaaagacggggggttgttgttgaatgttgttatgtatacaatatatatttttaaatgaattttttattctataaaatacaaat

SEQ ID NO: 2135 - DNA, 605 bp, Diabrotica virgifera
  unsure (1)..(605): unsure at all n locations
  Clone ID: pGUT3529
cgtgccgaattcggcatgaggtaaaaaacaagcacaatggctcccaaacgtaataatatgattccaaatggccatttccacaaggattggcaacgattcgtcaagacttggtttaaccagcctgcccgtaaaattcgcagaaggaataatcgtattaagaaggctcgtgctattgcccctaggcctgctgctggacctttaaggcctgtcgtaaggtgtccatcaatcaggtaccatactaaagtacgcgctggacgtggatttaccctccaggaattaaaagctgcaggtcttaaccccagatttgcaaggactgttggtattgctgtagatcacagacgaagaaacaaatcagtagaatcaatccaactgaacgctcaacgtcttaaagaatacaaatccaaattaatcctcttccccatccacgaaaagaagaagattagagctggtgaagccactgaagaagaacgtagaatagcttcacaattacagggagaagttctccccatcaaacagtcaagtctcagaacanaggctagagttccaactgaggagggaaagaaatttgagcatatgtaacattgaggaaggcccgtgccgatgca

SEQ ID NO: 2136 - DNA, 351 bp, Diabrotica virgifera
  Clone ID: LIB3026-025-Q1-E1-F8
ccacgcatccgcacacgcgtccgacgaaaagaagaagattagagctggtgaagccactgaagaagaacgtagaatagcttcacaattacagggagaagttctccccatcaaacagtcaagtctcagaacaaaggctagagttccaactgaggaggaaaagaaatttgaagcatatgtaacattgaggaaggcccgtgccgatgcaagacttgtaggtatccgtgctaagagaattaaggatgctgcagaaaacccagaggatgtgacaaaagctgctgcaggcaaagaaaagaaatccaaaaagtaaattaatgtataatttttatataagataataaaggatttgttatc

SEQ ID NO: 2137 - DNA, 411 bp, Diabrotica virgifera
  Clone ID: LIB150-028-Q1-E1-G12
actcgcgggtcgatacaagcctctataatgattcatcgaaccttgaagagcgcatccttggtgctgcaccaaaagccaacctcgatgaaacaggacgagtcttaagtattggtgacggtatcgcccgtgtatatgggttgaacaacatccaagccgatgagatggtggaattctcctccggtctcaaaggtatggcccttaacttggaacctgacaacgttggtgttgtagtatttggtaatgacaaactcattaaggaaggtgacattgtcaagagaactggtgccattgtagatgtgcctgtaggtgaccaaattttgggacgtgtagttgatgccttaggtaacccaattgatggcaaaggtccattaaacaccaaacaacgtttccgtgtaagtatcaaagcccccg

SEQ ID NO: 2138 - DNA, 170 bp, Diabrotica virgifera
  Clone ID: LIB3026-003-Q1-E1-H7
gttgctggttccatgaaactggaattggaccactaccgtgaagtaactgcttttgcccaattcagttcagatcttgatgctgctacgcaccaattgttgagcatatgtgtacgtcttactgacttgttgagacagggtcaatacatacccatggctattgaataacaagt

SEQ ID NO: 2139 - DNA, 461 bp, Diabrotica virgifera
  unsure (1)..(461): unsure at all n locations
  Clone ID: LIB150-030-Q1-E1-F7
ctcaatcttgagagggtcacgtttgttgtattcgtatttcgtgttttaacgttccaaagaaaaacaatccaaaatggttcatcacattaaagataaggatgacttggaagctaaattcaaagaagctggaaccaacttggtagttctcgacttctcagctgcctggtgcggaccttgtaaaatgattagccccaaattggacgaattggctgccgaataccccaacgtcgttattgtaaaaatcgacgttgatgaatgcgaagatctcgctatggaatacaacatcaagtccatgcccacattcattttcctgaagaacggtcaagaaatcgcgaatttcagcggagctaactacgaaagactaaaacanaccattgaagataacaagtaatgcaaaacccagaatattctgcctaaatattttttaataaattattcanaataaatatgtattaatgata

SEQ ID NO: 2140 - DNA, 357 bp, Diabrotica virgifera
  Clone ID: LIB150-030-Q1-E1-F8
ataatgagtcgtattagtcacgtttgttgtattcgtatttcgtgttttaacgttccagagaaaaacaatccaaaatggttcatcacattaaagataaggatgacttggtagctaaattcacagaggctggaaccaacttggtagttctcgacttctcagctgcctggtgcggaccttgtaaaatgattagccccatattgggcgaattgggtgccgaataccccaacgtcgttattgtcaaaatcgacgttgatgaatgcgatgatcgcgctatggaatacaacatcacgtctatgcccagattcattttcctgaagaacggtcaagagatcgcgagtttcagcggcgctaactacg

SEQ ID NO: 2141 - DNA, 373 bp, Diabrotica virgifera
  Clone ID: LIB3026-001-Q1-E1-F3
attcaatagaagtttatcaagatgttgatgccaaaaaagaatagagtatgtatttacgaatacctcttcaaagagggagtcatggtagctaaaaaagattaccatgccccaaaacaccccgaactagaaactatccctaaccttcaagtaattaaggctttacaatcacttaaatcaaaaggttacgtaaaggaacaattcgcctggaggcattattattggtatttgactaactctggcatcgaatacctccgcacattcttacacttacctggagaaattgtcccatctaccttgaaacgcccagcaaggacagaaaccacccgtcctagaccagctgctctcagatctgagacatctaaaccttcagaag

SEQ ID NO: 2142 - DNA, 386 bp, Diabrotica virgifera
  Clone ID: LIB149-020-Q1-E1-G5
aacctcttcaaagagggagtcatggtagctaaaaaagattaccatgccccaaaacaccccgaactagaaactatccctaaccttcaagtaattaaggctttacaatcacttaaatcaaaaggttacgtaaaggaacaattcgcctggaggcattattattggtatttgactaactctggcatcgaatacctccgcacattcttacacttacctggagaaattgtcccatctaccttgaaacgcccagcaaggacagaaaccacccgtcctagaccagctgctctcagatctgagacatctaaaccttcagaagaccgtgcaggatacagaaggactcctggaggccctggagctgacaagaaagctgatgttggtccaagaactgg

SEQ ID NO: 2143 - DNA, 415 bp, Diabrotica virgifera
  Clone ID: LIB150-042-Q1-E1-C5
tcgccggtcgacgcacgcgaccacccacgcgtctggtaataacagagccgcactccaagaaggccaaaaagatgtccaacaccctggaacaacttaaagccgtgactacagtggttgcagacactggggactttgaggctatgaaagccttcaagcctaccgatgcaaccaccaacccttccctcatattggctgcagcggctctaccacaatacaaacccatcatcgacaaagctatccaatacggcaacaaactcggcggagacatgagccagaaattggacaacaccatggatatgctatgtgtcctggttggtgtggaaattttgaaaattggtccaagacgagtttccactgaagtccatgcaagactgtccttcaacaaggaaacaagtgttgccaaaacccgcaaaat

SEQ ID NO: 2144 - DNA, 409 bp, Diabrotica virgifera
  Clone ID: LIB149-041-Q1-E1-E10
gggtccagccacgcgtccgaacaagacgtccgccaacgcgtccgcccacgcgtccggtacgatctgcgctaccgtgaccatccagattttgatttttttgaccttttcctgacgacatttcatttcctcatgtcagaagtacgtttacacgccggggtgataacagagccgcactccaagaaggccaaacagatgtccaacaccctggaacaacttaaagccgtgactacagtggttgcagacactggggactttgaggctatgaaagccttcaagcctaccgatgcaaccaccaacccttccctcatattggctgcaacggctctaccacaatacaaacccatcatcgacaaagctatccaatacggcaacaaactcgacggacacatgagccagaatatggacaaca

SEQ ID NO: 2145 - DNA, 408 bp, Diabrotica virgifera
  Clone ID: LIB150-027-Q1-E1-C8
tttggacacgtgaagcatattcttggaatcttcacaatcccaaaatgccgctgtcgtgtcgattttataaagaaaaataccccgaagtggaagatgtagtcatggtaaatgtaagggccatcgctgaaatgggggcatacgtccatttactagaatacaacaatatagagggcatgatcctgttgtctgaattgtccagaaggcgtattaggtcaattaacaaattgattcgtgtaggaaaaaccgaacccgttgtagttataagggtagacaaggaaaagggatatatagatctttccaaacgtcgtgtaagtgctgaagatgtagaaaaatgtacagagaggtttgcgaaggccaaggctgttaattcaattttaaggcatgttgccgaattactaaagtatgaat

SEQ ID NO: 2146 - DNA, 370 bp, Diabrotica virgifera
  unsure (1)..(370): unsure at all n locations
  Clone ID: LIB149-006-Q1-E1-G12
acggacacgtgggcggacgcgtgggtagtttttggacacgttaagcatattcttgggaatctcacaatcccaaaatggcgctgtcgtgtcgattttataaagaaaaatacccgaagtgggagatgtagtcatggtaaatgttagggccatcgctgaaatgggggcatacgtccatttactagaatacaacaatatagagggcatgattctgttgtctgaattgtccagaaagcgtattaggtcaattaacaaattgattcgtgtaggaaaaaccgaacccgttgtagttataagggtagacaangaaaagggatatatagatctttccaaacgtcgtgtaagtgctgaagatgtagaaaaatgtacagag

SEQ ID NO: 2147 - DNA, 381 bp, Diabrotica virgifera
  Clone ID: LIB149-034-Q1-E1-F11
actcgcgggccgacacacgcctcaacagtcactcgtacgaacgcgtggggatattttgtcggtatacacgtttcgtgtctcaagacttaaaaatgcgttacgtggctgcttacttattggccgttttgggcggcaaagcctctcccaatgctgcagatcttgaaaaaatcttgggatctgtaggtgttgaagctgaaggagaaagagtaaagaaagtcatcagcgagctcagtggcaagtctgttgaagaactcattgctcaaggtcgtgaaaagttgagctccatgccagttggtggtggtgccccagctgctgccggaggtgccgctgctgctgctccagctgctgaagaaaagaaagaggccaagaaggaagaaaaga

SEQ ID NO: 2148 - DNA, 264 bp, Diabrotica virgifera
  Clone ID: LIB3026-027-Q1-E1-B1
agtaaagaaagtcatcagcgagctcagtggcaagtctgttgaagaactcattgctcaaggtcgtgaaaagttgagctccatgccagttggtggtggtgccccagctgctgccggaggtgccgctgctgctgctccagctgctgaagaaaagaaagaggccaagaaggaagaaaagaaggttgaatctgaatcagaagacgacgacatgggctttgctctattcgactagactcattagttgtaagatcaaccttgttttgtacc

SEQ ID NO: 2149 - DNA, 437 bp, Diabrotica virgifera
  Clone ID: LIB149-013-Q1-E1-G6
gggtccacccaaacgtccgaagaaaataattttttacaacataatattttcagatattaaatcaagatggtactagcagatttaggtcgtaaaattacgaccgccttgcagtctttaagcaaggcaacagttattaatgaagaggtcttaaatggaatgctaaatgatatttgtcgggcactcattgaggctgatgttaatatcaaattagttaaatctctcagggaaaatgttaaatctgttattgactttgatgaaatggctggtggtctcaacaagaggaggatgatccacagtgcagtatttaaagagcttgtcaaattggtagacccaggagtaaagccatatcaacctgttaaaggcaaaccaaatgttattatgtttgttggtttacaatgttctggtaaaacaaccacttgtaccatactagcttatca

SEQ ID NO: 2150 - DNA, 432 bp, Diabrotica virgifera
  Clone ID: LIB150-044-Q1-E1-F7
aacacgcgtctgatatgtcgcatcaactgaagacatgagaaaataattttttacaacataatattttcagatattaaatcaagatggtactagcggatttaggtcgtaaaattacgaccgccttgcagtctttaagcaaggcaacaattattaatgaagaggtcttaaatggaatgctaaatgatatttgtcgggcactcattgaggctgatgttaatatcaaattagttaaatctctcagggaaaatgttaaatctgttattgactttgatgaaatggctggtggtctcaacaagaggaggatgatccaaagtgcagtatttaaagagcttgtcaaattggtagacccaggagtaaagccatatcaacctgttaaaggcaaaccaaatgttattatgtttgttggtttacaaagttctggtaaaacaccac

SEQ ID NO: 2151 - DNA, 412 bp, Diabrotica virgifera
  Clone ID: LIB149-005-Q1-E1-B2
agcccacgcgtccgcccacgcgtccgcaaaacactagcgggagttgttgttgttgtttaacctagaaaattttagaatgggtaacgagtttagagatttggctgacgatttagaaaattggatgtcgcggttaccacaaaatgtgcgacaaataccaattactaatatttctatcccaggttctcatgacagctttacagccaacattacgaaagactctgatatatcccctgatgccgaagatatagttaaagaactctcaattttgggccccttatttaaagaggtcatagcaaggtggtcacgaactcaaagctttttagccaatgatcaacttattagaggtattagatattttgatattagaacttctacaaaagaaggaactgacgaactttatatagtacatagt

SEQ ID NO: 2152 - DNA, 408 bp, Diabrotica virgifera
  Clone ID: LIB149-005-Q1-E1-G10
gaccgacccgtccaccacgcgaccgcaaaacactagcgggagttgttgttgttgtttaacctagaaaattttagaatgggtaacgagtttagagatttggctgacgatttagaaaattggatgtcgcggttaccacaaaatgtgcgacaaataccaattactaatatttctatcccaggttctcatgacagctttacagccaacattacgaaagactctgatatatcccctgatgccgaagatatagttaaagaactctcaattttgggccccttatttaaagaggtcatagcaaggtggtcacgaactcaaagctttttagccaatgatcaacttattagaggtattagatattttgatattagaacttctacaaaagaaggaactgacgaactttatatagtacat

SEQ ID NO: 2153 - DNA, 431 bp, Diabrotica virgifera
  Clone ID: LIB150-037-Q1-E1-C2
aaccggattggtaaagtttgttgtagtttcagtgatcttcattttgaactctttttttttttcaatatgcgaactacgtactttacattagttgtaatattagctgtagctgtacaagaacatgcatctcaacaattaccagtaacgcaagcttgcttgggatgtatatgtgaagctatttccaactgtaatgtaactagcggttgttctggtgaggtttgtggaccatttcggatcacctgggcatattgggcagatgctggaaagcccaccgtgaaaggagtatcaccagaagacaataatgcatatggatcttgtgctactgatacgtattgttctgcattagctgttcaaggatatatgaataaatttcaacaggattgcaatggtgatggtaaaatagactgtgacgattatgcaagtattcacac

SEQ ID NO: 2154 - DNA, 423 bp, Diabrotica virgifera
  unsure (1)..(423): unsure at all n locations
  Clone ID: LIB150-026-Q1-E1-C2
acaacaccctaaagtgagtcgtattaaaattaaaaaaaagctacaatgcgattcgcaatgttagcaatttgtttagcacttgtggctgtaacggcagtagaaagcgtacaaaccaactggctcaatgacccactttactcctgcgtcagatgcttgtgtcatgctagaagtggatgctggatcagacaaaattgtgccaagtactcaattaaccaggattactggataaaagcaggttctctcactgcttcaccagatgaaagttcaacaagtccatcagcatatcaaaattgtatgagggatgaaaactgtattgtcggtactatcattaattatactggacgcttangagatatggattgcaactgcgacggagtcttcgattgtaaagacatggcagccattcatcttatgggggccggt

SEQ ID NO: 2155 - DNA, 400 bp, Diabrotica virgifera
  Clone ID: LIB150-026-Q1-E1-C4
ccccaaaaaaaagtcgtattaaaggaaaacggtgaagatttttcaaaagatgtctcagcagagcatcaaaatggatcacgtgatgctccacccgatagtggaagtgcagaaacgcccgggcgtgacgatgatagacaattatttgttggtggcatgtcttgggaaaccactgatagggagttacgagaacattttggccaatatggcgaaatcgaaagtataaatgtaaagacagatcccaacactggtagatcaaggggatttgcattcatagtatttaccacaacagaagctattgacaaagttgtagctgcaggtgaccatgtcattaatggcaaaaaagttgaccccaaaaaagccaaagcgaggcatggaaaaatatttgtaggtggtctcacct

SEQ ID NO: 2156 - DNA, 388 bp, Diabrotica virgifera
  Clone ID: LIB150-039-Q1-E1-H6
aggacgtgttaggtgttagtagctcttaggctaagtataatattagttttttaatttatcggcacacaggcagttctaatggagaacggtgaagatttttcaaaagatgtctcagcagagcatcaaaatggatcaggtgatgctccagccgatagtggaagtgcagaaacgcccggccgtgacgatgatagaaaattatttgttggtggcatgtcttgggaaaccactgatagggagttacgagaacattttggccaatatggcgaaatcgaaagtataaatgtaaagacagatcccaacactggtagatcaaggggatttgcattcataggtattaccacaacagaagctattgacaaagttgtagcctgcagtgaccatgtcatta

SEQ ID NO: 2157 - DNA, 416 bp, Diabrotica virgifera
  Clone ID: LIB3026-022-Q1-E1-D12
cccgtccggatattggtcatactgtaggacatgcagtaacaggattgttcagtggtggtggatcaagtgaagcacctgtccaacagccaccacaacaagtagcaccccaacaacagtatgctgggacaggagcagctggagaacaaggcccatgttcttgggaaattaagcaatttttacaatgttcatctacacagtctgatttgtcattatgccaaggattcaatgaagctctacaacaatgcaaagttagaaacaatattgctgtttagacaagctcgtgatatattttaaattccggtgttactgagatgttaaaattattctaaacattacctcacagaatgcactatatatgtagataggaatgttacagaaatgttaaattaaatgtttttgccaataccacaacccaa

SEQ ID NO: 2158 - DNA, 403 bp, Diabrotica virgifera
  Clone ID: LIB3026-002-Q1-E1-A7
acccacgcgtccgcccacgcgtccgatcctgttactgcatgtcctacagtattgttcagtggtggtggatcaagtgaagcacctgtccaacagccaccacaacaagtagcaccccaacaacagtatgctgggacaggagcagctggagaacaaggcccatgttcttgggaaattaagcaatttttacaatgttcatctacacagtctgatttgtcattatgccaaggattcaatgaagctctacaacaatgcaaagttagaaacaatattgctgtttagacaagctcgtgatatattttaaattccggtgttactgagatgttaaaattattctaaacattacctcacagaatgcactatatatgtagataggaatgttacagaaatgttaaattaaatgttt

SEQ ID NO: 2159 - DNA, 420 bp, Diabrotica virgifera
  Clone ID: LIB150-027-Q1-E1-C11
gtcgatacaaccctctaggatgatacactaatattggcagtacttggtaacagagaagtgcccattccagatcatatagatattttccatttaactagggagatgcctgcttctgataaaacagctcttgaatgtgttatggaggtagatgaagaaagagtaaggttggaaaagttggcagaagagctagttgcatgtgaagatgacgaatctcaggaacagctaatggatatctacgagagattggatgatatggcagctgatacagctgaagcaagagctgctaatattctacatggtcttggttttaccagagaaatgcagaataagaagactaaagatttcagtggaggttggagaatgcgtattgcactagctagagctctttatgtcaagccacatcttctcctaataaatgaa

SEQ ID NO: 2160 - DNA, 238 bp, Diabrotica virgifera
  Clone ID: pGUT1628
aatgaagtccgaactaggagaatattcgtgttgatatcacattcgcaacatttcttaaacggagtatgcacaaacataatacacataaataaaaaaaggctcaaatattataccggcaataatgacaccattgtcaagactagaatggaacttttggaagatcatatgatacagtattattgggatcaagatcgtatctcccatatgaagaactatattgcacgatctggtcacagat

SEQ ID NO: 2161 - DNA, 424 bp, Diabrotica virgifera
  unsure (1)..(424): unsure at all n locations
  Clone ID: LIB149-045-Q1-E1-C1
atttctcaagacagtagtcctcgttttccttgcaagcttccaaacaatagacgcaaccccagccaaagtagtgtgttactttagcaattgggctatatacagaccaggaagtggaagatatgctttggacgatgtcccagttgacctatgtacgcatttaatttattcatttattggagttgacgataaatcatggagtattttggttatagatccagagctggatattgaacaaaatggattcagaaactttagtgatattaagaaaactcatccccacgttaaattagaaatagcagtaggagggtgggccgaaggtggatccaagtattccgcactggtagctcaacaggcaagaagggattcttttatcagcagtgtagttgcttttatgaanggatacaattttggacggttttgacct

SEQ ID NO: 2162 - DNA, 381 bp, Diabrotica virgifera
  unsure (1)..(381): unsure at all n locations
  Clone ID: LIB150-043-Q1-E1-C1
gacacagaaaagttaacaaccttagttttatgcattgcgtttttttgtaatttgaggtaaacacaagcatccggtttttacaaaaggttttccaaaacagtagtccctccttttcccttgcaagcttcaaaacaatagacgcaacccagccaaagtagtgtgttactttagcaattgggctatatacagaccaagaagtggaagatatgctttggacgatgtcncagttgacctatgtacgcatttaatttatttatttattggagttgacgataaatcatggagtattttggttatagatccagagctggatattgaacaaaatggattcagaaactttagtgatattaagaaaactcatccccacgttaaattagaaat

SEQ ID NO: 2163 - DNA, 412 bp, Diabrotica virgifera
  Clone ID: LIB149-013-Q1-E1-E5
agaaaatcttaggtatagtactgcgattgctggcagtcgcgtactgtgtagaatcatttgttatttcagatgattataccgtaactgtgaaaaccaataatggaaaaataaaaggtggctttggagctagatcacatgcaaataaagatgaaattctatattggtttagaagtattccatttgccgaacctccagttggagatttaagatttgctgcacctgtaccaaaagccaattggtcaggagttttagatgtacgacataaagctcaggaatgtattcaaggttcacctgtagctggcaatgaagattgcttgtatctaaaaatatatagccgtcacagaccaagcaaattgcacaaactcccagtagtagtatggatttatggaggggctttctttgaaggctctgc

SEQ ID NO: 2164 - DNA, 410 bp, Diabrotica virgifera
  Clone ID: LIB3026-001-Q1-E1-D3
caagaagctcttagactgtattccgcttacacaaaagtatatgcttatcacttctgctatgaaggaccactatggggtcgtaccaatcgtacttataatggtgttggtcatactgaagatttggcctacatatttgactataacaaaataggaagtgaagaagattacttggcaagagaacgaacagtgaggctatgggcaaactttattaaatatggcgacccaactccaaagcgtgaattattattgcagaatgtaatctggccagaaaattctgttgttgaaaaggccgaaaacttgaaatttttagaaattaacaatgatcttacggtgaaaggtcttcccaattctgacaaaattgtgttttggaacaatttgtatacgaaatatccaagacctccatatactac

SEQ ID NO: 2165 - DNA, 367 bp, Diabrotica virgifera
  Clone ID: LIB149-007-Q1-E1-H8
gtgaccatgtcattaatggcaaaaaagttgaccccaaaaaagccaaagcaaggcatggaaaaatatttgtaggtggtctcacctctgaattgagtgatgatgacatcaagaactatttctcacaatttggatcgatcattgatattgaaatgccatttgacaagcaaaagaaccaaaggaaaggattctgcttcatcacatttgaatctgaacaagtagtgaatgagttactcaagcaacccaaacaaaccattaaagacaaagaggtcgatgtaaagaaagccacacccaaaccagaccaaatgggcggccccatgatgggcatgcgcggtatgcgaagcggaggcagaggcggtccaatgagggg

SEQ ID NO: 2166 - DNA, 326 bp, Diabrotica virgifera
  unsure (1)..(326): unsure at all n locations
  Clone ID: LIB150-009-Q1-E1-G5
aggacgcgtgggcgactgtacgacgtgttatgtgttagtagctcttaggctaagtatactattagttttttaacttatctgcacacaagcatttccaatggataacggtgacagatttttcataagatgtctcaacagatcatcaaaatggatcacgtgatgctccatccgatattgctactgcaaaaacgcccggccgtgacgatgatagacaattatttgttggtggcatgtcatgggaaaccactgatatggagttacgagaacattttgcgcaatatggcgatatcganagtatcaatgtaaacacagatcccaacactggt

SEQ ID NO: 2167 - DNA, 411 bp, Diabrotica virgifera
  Clone ID: LIB150-027-Q1-E1-C5
cccacgcgtccgcaaaatcagtaatgagcagtaatgagtaatgtaatgtttataaaagttttccagaaattttaaaagcatttttttatagttgtgagttactgaagaagatttctggatataacctaaaaatgccgaaatactactgtgattactgcgatacttacctaactcacgattcacctagtgtgcgaaaaactcattgtactggcagaaaacataaagacaatgtcaaattcttttaccaaaaatggatggaagaacaagcccaacatttaatcgatgccacaacggctgccttcaaagctggtaaaattgcaaacaacccatttgctcaacctggaaagggagtagccattccaccaccggcacaacttaccatgggtcagagaccacctggagcacctggaa

SEQ ID NO: 2168 - DNA, 331 bp, Diabrotica virgifera
  Clone ID: LIB3026-014-Q1-E1-D8
ataaaaatgccgaaatactactgtgattactgcgatacttacctaactcacgattcacctagtgtgcgaaaaactcattgtactggcagaaaacataaagacaatgtcaaattcttttaccaaaaatggatggaagaacaagcccaacatttaatcgatgccacaacggctgccttcaaagctggtaaaattgcaaacaacccatttgctcaacctggaaatggagtagccattccaccaccggcacaacttaccatgggtcagagaccacctggagcagctggaggtccgggtatgatgccaccagcaggtatgggtccaggtccaggcc

SEQ ID NO: 2169 - DNA, 390 bp, Diabrotica virgifera
  Clone ID: LIB149-005-Q1-E1-F6
aatcagcccacgcgtccgcttatttaaatatttgtaatctttctttatgtggttttccttttatgtctggattttattctaaagatttaattgttgaaattttatcttttagttatttaaatatttatatttatataattttttatatttctattggtttgacagttgcttatagatttcgtttaacttattattctttaacgggtagatttaattatctagctttaaatatattatctgaaactggttatttaatacttaagggtataagaggattaattttatttgtagtttttagtggaagattattttcttgattagtattttctactcctatttttagttgtcttccttttttaataaaaattataactttgatttttattatag

SEQ ID NO: 2170 - DNA, 329 bp, Diabrotica virgifera
  Clone ID: LIB3026-021-Q1-E1-G12
accacgcgtccgtatttatgtggttttccttttatgtctggattttattctaaagatttaattgttgaaattttatcttttagttatttaaatatttatatttatataattttttatatttctattggtttgacagttgcttatagatttcgtttaacttattattctttaacgggtagatttaattatctagctttaaatatattatctgaaactggttatttaatacttaagggtataagaagattaattttatttgtagtttttaatggaagaataatttcttgattagtattttctactcctatttttatttgtcttcccttttt

SEQ ID NO: 2171 - DNA, 441 bp, Diabrotica virgifera
  Clone ID: LIB149-029-Q1-E1-C7
acggtatccacgaactatctgaaattagccctgatagtgagtttaattctctctatatgtggaaattatttagataatgatcagcaaaaccgtagtgttcaagaagaaataaaggagtcatcaccaatatttaaaagatcagcatattatggtaaggcagatggtacaccctttaagaattgtaaggagatattagaatctggtgtaaatatttctggcatttacgaaatacaaccaattggttccaataaattaataaatgtaacatgtgatatggaaacaagaggtggtggatggactgtaatacagagaagaattgacgggtctgttgagttctacagaggttggagagagtataaatttgggttcggagatctaaatggagaactatggctaggattggaaagtatttaccatttgacagcatttgaagctaatgag

SEQ ID NO: 2172 - DNA, 424 bp, Diabrotica virgifera
  Clone ID: LIB149-026-Q1-E1-G12
tacaatcccctagagtgagtcgtattacctgataatgagtttaattctcactatatgtggaaattatttagacaatgatcagcaaaaccgtattgttcaagatgagatacaggagtcatcaccaatatttaaaagatcagcatattatggtacggcagatggaacaccctttaagaattgtaaggagatattaaaatctggtgtaaatatttctggcatttacgagatacagccaattggttccaatagattaataattgtaacatgtgatatggaaacaagacgtggtggatggactgtgatacagagaagaattgacgggtctgttgagttctacagaggttggagagagtataaatttgggttcggagatctaaatggagaactatggctatgattggaaaatatttaccattttgcagca

SEQ ID NO: 2173 - DNA, 430 bp, Diabrotica virgifera
  unsure (1)..(430): unsure at all n locations
  Clone ID: LIB150-047-Q1-E1-D7
caagcctctaaaatgagtcataatatggttcaaatttaggaaaatttatgtattgtatgggtataaatcctagtctagagtatttaaaaggtgcaggaatgacagaaaaagaaggagaaaaaaaattaacactcgatgaatgtttaaacgcctacgcagaactgaaaaagtcaataaaagattttgggtgttacgaagactttattgaatgtttaaaattgtatgacaaaaacgagaatggttttatgttagttggagaattaagtcattccctattaactttaggagaaaaattaaatgacgctgaagtagatgaagtttttgaacaatgtctggatgaagagaatgatgatggggaaattccttatatacctttcctcagaaggatgtgcgagttggacncaccattgaaacccaagaaaaaataaag

SEQ ID NO: 2174 - DNA, 448 bp, Diabrotica virgifera
  Clone ID: LIB150-019-Q1-E1-F3
gtccggtaattgaaaccagtgcggggtggtgatcaacatggcagacaagctaaaagatacagaaatagaaactggagagtttgctcttgaaacgtacggagacggagacggtaaactagatggttcaaatttaggaaaatttatgtattgtatgggtataaatcctagtctagagtatttaaaaggtgcaggaatgacagaaaaagaaggagaaaaaaaattaacactcgatgaatgtttaaacgcttacgcagaactgaaaaagtcaataaaagattttgggtgttacgaagattttattgaatgtttaaaattgtatgacaaaaacgagaatggatttatgttagttggagaattaagtcattccctattaactttaggagaaaaattaaatgacgctgaagtagatgaagtttttgaacaatgtctggatgaagagaatgatgat

SEQ ID NO: 2175 - DNA, 422 bp, Diabrotica virgifera
  Clone ID: LIB150-022-Q1-E1-C3
gatgactgatcacattttccatcgttgagaccagaacaactaaaacacttccaacatggcggacgatgaggaaaagaagaggaaacaggccgaaattgaacgcaaaagggccgaggtcagggctcgtatggaagaggcctcaaaagccaagaaggccaagaaaggtttcatgacccctgagagaaagaagaaacttaggttactgttgagaaagaaagccgccgaagaattaaagaaagaacaagaacgcaaagcagccgaaaggaggcgtatcattgaagaaaggtgcggtaaacccaaacttgtcgatgacgcaaatgaaggcccattaaaacaagtatgtgagggatatcacagacgtattgtagacctagaaaataagaaatttgacctcgaaaaagaagtggaattcagagattttc

SEQ ID NO: 2176 - DNA, 331 bp, Diabrotica virgifera
  Clone ID: LIB150-011-Q1-E1-A9
gttgactgctcacattttccatcgttgagaccagaacaactaaaacacttccaacatggcggacgatgaggaaaagaagaggaaacaggccgaaattgaacgcaaaagggccgaggtcagggctcgtatggaagaggcctcaaaagccaagaaggccaagaaaggtttcatgacccctgagagaaagaagaaacttaggttactgttgagaaagaaagccgccgaagaattaaagaaagaacaagaacgcaaagcagccgaaaggaggcgtatcattgaagaaaggtgcggtaaacccaaacttgtcgatgacgcaaatgaaactgaacta

SEQ ID NO: 2177 - DNA, 316 bp, Diabrotica virgifera
  Clone ID: LIB150-038-Q1-E1-H12
gaggtacttttatccggttgtgtacgacgatttaggggtcctggacgttgaaaatggttctggaaggtgaaggcctggtttcgccggagatgacgcatcccgtgccgtcttcccctcaatcgtcggtcgcccaaggcatcaaggtgtcatggttggtatgggacaaatagactcatacgtaggagatgaagcccaaagcaaaagaggtatcctcacattgaaataccccattgaacacggtatcatcaccaactgggatgacatggaaaaaatctggcatcacaccttctacaatgagctccgtgtgtctccatta

SEQ ID NO: 2178 - DNA, 289 bp, Diabrotica virgifera
  unsure (1)..(289): unsure at all n locations
  Clone ID: LIB149-028-Q1-E1-B11
tacttggtncagcagttgcagtgctgtgctttaggatattttatttcttaccatctctctaggtgtcaaatactagccactcatcatgtgtgatcaagatgttggcgcattactcgtggacaatggatgtggtatgtgcaaagctggctttgccggggatgatgcacctcgtgctgtattcgcttcacttgttggccgcacaggacatcaaggtgtgatgggaggcatgggacacatagattcctgggtaggtgaggaagctcaatgtctgtcaggtatcctgacctta

SEQ ID NO: 2179 - DNA, 429 bp, Diabrotica virgifera
  unsure (1)..(429): unsure at all n locations
  Clone ID: pGUT1480
gttactgcacggttgccatgaacctattcaatggaaccggtaccgctgattacgccgtgactggtacatggtccgacaaagcagctaaagaggcagacaaatatggaaacgtcaatctagtattcccaaaagccagcataccaggcagtattcctcctcaaaacacgtggaagatgaatccaaatgcttcctacgtatactactgtgataatgaaactgtcgatggtgttgcattccattacattcccgaaaccaatggtgttccactagtcactgacatgtcatccaacataatgaccaagaaactagacatctcagaaatcggctgcatcattgctggtgcccaaaagaatattggacctgcaagagtagtagtggttattgtccgtgaagatcttctangaaatccatgaaatgctgtccatctgt

SEQ ID NO: 2180 - DNA, 392 bp, Diabrotica virgifera
  Clone ID: LIB150-050-Q1-E1-C11
ccacgagtccgcaaatatggaaacgtcaatctagtattcccaaaagccagcaaaccaggcagtgttcctcctcaaaacacgtggaagatgaatccaaatgcttcctacgtatactactgtgataatgaaactgtcgatggtgttgcattccattacattcccgaaaccaatggtgttccactagtcactgacatgtcatccagcataatgaccaagaaactagacatctcaaaattcggctgcatcattgctggtgcccaaaagaatattggacctgcgggagtagtagtggttattgtccgtgaagatcttctaggaaatcccatgaaatgctgtccatctgtaatggacttcactcacatagccaaagaaaactctgtacataacactcc

SEQ ID NO: 2181 - DNA, 430 bp, Diabrotica virgifera
  Clone ID: LIB3026-010-Q1-E1-B9
accacgcgtccgcccacgcgtccgaaaacttaaattttttcaaaatgggtcgtatgcacgcaccaggaaaaggtattgcccagtcggcattgccatacagaaggagtgtaccaacatggttgaaagtcacaccagaagaagtaaaagaccatatttttaaacttggcaagaaaggcttgactccatcacaaattggtgttatcctcagggattcatatggtgttgcccaagtaaggtttgtttctggaaacaaaatcttgcgtatcatgaaagctatgggtcttgcccctgatctaccagaagatttgtactaccttatcaagaaggcagtagctatccgcaaacatttagaacgtaacagaaaagacaaggacagcaaattccgtttgattttggtagaatcacgtatccaccgtttggctaggtacta

SEQ ID NO: 2182 - DNA, 329 bp, Diabrotica virgifera
  Clone ID: LIB3026-023-Q1-E1-H2
gtccgataatgaaacacgttagtaacgtgaaatacaacttaaattttttcaaaatgggtcgtatgcacgcaccaggaaaaggtattgcccagtcggcattgccatacagaacgagtgtaccaacatggttgacagtcacaccagaagaagtacacgaccatatctttaaacttggcaagaaaggcttgactccatcacaaattggtgttatcctcagggattcatatggtgttgcccaagtaaggtttgtttctggaaacaaaatcctgcgtacccataaagctatgggtcttgcccctgatctaccacaagatttggtccaccttatc

SEQ ID NO: 2183 - DNA, 476 bp, Diabrotica virgifera
  Clone ID: pGUT3445
ggaataaacacttccacaatgcaaattttcgtgaaaactctcactggtaaaaccatcaccctcgaggttgagccatccgatacaatcgaaaatgttaaagctaagatccaagacaaagaaggtatccccccagaccagcaacgtttgatcttcgctggaaaacaactcgaagatggacgtaccttgtcagactacaacatccagaaggaatccacccttcacttggtgctccgattgagaggaggtctcatcgagccttcccttcgtattttagccatgaagtacaactgcgagaagatgatctgccgtaaatgttacgccagattacacccaagggccaccaactgcagaaagaagaagtgtggacacacgaacaacttgcgccccaagaagaagctaaagtagactattacgaggttattttttacaatgttaatatcttacaattccagatgttacttgaacatttatcggca

SEQ ID NO: 2184 - DNA, 487 bp, Diabrotica virgifera
  Clone ID: pGUT3665
ccacaatgcaaattttcgtgaaaactctcactggtaaaaccatcaccctcgaggttgagccatccgatacaatcgaaaatgttaaagctaagatccaagacaaagaaggtatccccccagaccagcaacgtttgatcttcgctggaaaacaactcgaagatggacgtaccttgtcagactacaacatccagaaggaatccacccttcacttggtgctccgattgagaggaggtctcatcgagccttcccttcgtattttagccatgaagtacaactgcgagaagatgatctgccgtaaatgttacgccagattacacccaagggccaccaactgcagaaagaagaagtgtggacacacgaacaacttgcgccccaagaagaagctaaagtagactattacgaggttattttttacaatgttaatatcttacaattccagatgttacttgaacatttatttaactaattataggaaatgacatcaatc

SEQ ID NO: 2185 - DNA, 423 bp, Diabrotica virgifera
  Clone ID: LIB3026-009-Q1-E1-E10
ggagaaaataaggaaactaaaaggaatgttgagtgaaaatggtggtgagaggactgttgttttcgttgaacaaaagaggactgctgactttttaggaagtttcttatctgaaaatggaatgaaatccaccagtatccacggtgatcgtctacagcgtgaaagggaacaagctttgtgggatttcaagaaagggatctgtaatgtacttgttgcaacaggtgttgctgcgagaggattggatatagaaggtatagagcatgtcatcaactttgatttgccgaagtcaaaagatgaatatgttcatcgtatcggaagaacagggcgtgtcggaaataagggtaaagctaccagttttttcgactcttccagcgattctgctctggcacctgctctagctgttattctgaagcaagctggacaaga

SEQ ID NO: 2186 - DNA, 412 bp, Diabrotica virgifera
  Clone ID: LIB3026-026-Q1-E1-H12
aaggagactaaaaggaatgttgagtgaaaatggtggtgagaggactgttgttttcgttgaacaaaagaggactgctgactttttaggaagtttcttatctgaaaatggaatgaaatccaccagtatccacggtgatcgtctacagcgtgaaagggaacaagctttgtgggatttcaagaaagggatctgtaatgtacttgttgcaacaggtgttgctgcgagaggattggatatagaaggtatagagcatgtcatcaactttgatttgccgaagtcaaaagatgaatatgttcatcgtatcggaagaacagggcgtgtcggaaataagggtaaagctaccagttttttcgactcttccagcgattctgctctggcacctgctctagctgttattctgaagcaagctggacaa

SEQ ID NO: 2187 - DNA, 438 bp, Diabrotica virgifera
  unsure (1)..(438): unsure at all n locations
  Clone ID: LIB149-036-Q1-E1-H9
ctcccgggtcgatacacgcctctaaagtgaatcattgcagatgaaagaactagctgccaaaaacgattccttgaatcaactagaaaccatggtggaacagttaaaaggaaatcaacctgatacagctaaattactggctactatggaaagtgacaaagtcgctgctgctcgagctgtccagcaaaatatggaactcaaagagcagttagagagtatggcagaagtatttgccaaaatgaataatgacaaggtggaactgacagaaaagctaagcattcagcagtctgcaagtaaggacctacttgaaaaattgcaaaaaactgaattgcacttacagatgttaactgatgctatcgaaatcaaagatcgagagctttcgcatctccgagaggcatctgaactaaatgagatgctggatcacgangagcaacatacaga

SEQ ID NO: 2188 - DNA, 429 bp, Diabrotica virgifera
  unsure (1)..(429): unsure at all n locations
  Clone ID: LIB150-005-Q1-E2-D4
gggccgaggcacgcgtccaatactaaaagccctnaaacgaaaaaagaaatgctgatgaaagaactagctgccaaaaacgattccttgaatcaactagaaaccatggtggaacagttaaaaggaaatcaacctgatacagctaaattactggctactatggaaagtgacaaagtcgctgctgctcgagctgtccagcaaaatatggaactcaaagagcagttagagagtatggcagaagtatttgccaaaatgaataatgacaaggtggaactgacagaaaagctaagcattcagcagtctgcaagtaaggacctacttgaaaaattgcaaaaaactgaattgcacttacagatgttaactgatgctatcgaaatcaaagatcgagagctttcgcatctccgagaggcatctgaactaaatgagatgctg

SEQ ID NO: 2189 - DNA, 445 bp, Diabrotica virgifera
  Clone ID: LIB150-031-Q1-E1-E1
gttcaatacctgagatagtgggttcatagctagacagaaccacagtggacttaacgaatatccttggaacaggccccggctgattgcgatattttcagtttcgatgttattttcaccaggtatttgaaggtgaattctagtcttccactctgtcattatatgctgtaaaaaggtcactatattatcatcgactttatatattctcaatatatctataagccattcatgcggcactgaatcaaaggccttcttgtaattaatgaaggcagtaaataggttcctctttttggaatatgcttgtttagaaattactgagtcgatgataagttgttctttgcaacccatggaacccttagcgcatcctttctgttgacgctctatgatattgtttagagcacagtgttggtagatacgctgggctacacaggatgtgaccaatttatac

SEQ ID NO: 2190 - DNA, 490 bp, Diabrotica virgifera
  Clone ID: pGUT3782
gcaacccatggaacccttagcgcatcctttctgttgaggctctatgatattgtttagagcacaatgttggtagatacgccgggttacacaggatgtgaccaatttatacaaagttggaagacaagtaattgggcggtacttggatggatcttgggtgttattttgatccttgggtattaaataagtagttccctgagttagaaatgatggtaattcctgcggattagaaataacatgattaattaatgttgataagcactcatgaatactccaaaactttttaagccagaagttctggactccgtctggtccaggagatttccagttatgaagctctttgatgacatttgagacttcttcagtcgtgaatggttcgtagttagcagtgacgtagtggtgacagttgtgcgtcgtatcttctatccagccagcattgttgttaaaaacagctggtgtggaaagttgatttccccaaaactcatgaatttct

SEQ ID NO: 2191 - DNA, 358 bp, Diabrotica virgifera
  Clone ID: LIB149-019-Q1-E1-G6
atcagcaacgtctacctcgaaggaactctcttgaaacccaacatggttacagcaggtcaatcctctgcaaacaaagccacaccagcacaagtagcagaagccacagtaaccgctttacaacgcagattgccccctgcagttcccggtgtcaccttcttgtctggaggacaatccgaagaagaagctaccgtcaacttaaacgccatcaaccaattcccaggaaagagaccgtgggcgctaactttcagttatggacgtgcccttcaagcttccgttctccgcgcctggggaggaaaagacgaaaacgtcaaagctggacaagaagaattgatgaaacgtgcgaaggctaacagcgaag

SEQ ID NO: 2192 - DNA, 297 bp, Diabrotica virgifera
  Clone ID: LIB150-049-Q1-E1-B11
aacccacgcgtccgcctctcttcggcagcaatgacgaatgcaccacacagggtttggacgatttggccaagcgttgcgcccaatacaaaaaagatggttgccacgtcgctaaatggcgttgcgtgttgaagatcagcgcacagacaccttccatccaatcacttattgaaaatgccaacgtactggctcgttatgcgtccatctgccaggccaacataatcgtacccatcgtggaacctgaaatcttacctgacggtggacacgagcttctcacctgtcagaagacaccagaaacag

SEQ ID NO: 2193 - DNA, 348 bp, Diabrotica virgifera
  Clone ID: LIB149-020-Q1-E1-E8
acccacgcgtccgcccacgcgtccgcggacgcgtgggtttgctttggccattttagtttgcgtcggtcttaccgtcagcgcccaaaagaatgactttttgtgcgatacctgcgtaggaatagtaaaagtagtccaggactacgtacgaaaagaaattccattggaagaagttgaaaaagaagtgaaagaattgtgccaagttttaccaggagaattggaaaaattgtgcgaggacaagttaattccagcaatcgaccaaatgtacaaccagatggaagacactcctcctagagatttatgcgtagagttggaattctgtaattaatttgtttgttagaatattataat

SEQ ID NO: 2194 - DNA, 387 bp, Diabrotica virgifera
  Clone ID: LIB150-004-Q1-E1-B7
acccacgcgtccgcccacgcgtccgcggacgcgtgggttaagataaatatattattacatgatatcagccatttcgaaaaccatatagatcactgcacaaatcacttaaataaaacggctgtttggtttgtttcgacactgccaactagtttatgcttttgttgaagccgctgggtatgtttttaccctcatcatttattttgagtcagttatttaattacatttagtctgccaacttaattttgcactccattacatgggccaatatctgccccttcccctaaagtacctatgtttaccgtaaaccactcactttggatgtgctatatataaatgtatatgtattaaaataaaaactgctaccaagctctatttgttttctgttgt

SEQ ID NO: 2195 - DNA, 353 bp, Diabrotica virgifera
  Clone ID: LIB150-046-Q1-E1-G4
accagtatatgcgtggaaaggggaaacagacgaagaatacgtttggtgtatcgaacagaccttagttttcccagacggaaaaccattcaacatgattcttgacgacggaggtgatctcacgaacttggtacacactaaatacccacaatatttgaccggatgtaaaggaattagcgaagaaaccaccactggagttcacaacttgtacaaaatgtacaaggaaggtacattgaaggttccagctatcaacgtcaacgattcagtcacaaagagtaaattcgacaatctgtacggctgtagggaatctctcatcgatggaatcaaaagagcaacagatgttatgctcgctggta

SEQ ID NO: 2196 - DNA, 326 bp, Diabrotica virgifera
  Clone ID: LIB149-009-Q1-E1-G5
gtacccggtatagacggtgacggtagagcgaggattcatatagaaatcataaatcaatcagttttttgtgaagacatttgggaagaagttcagtacagtttagcagtcctttaggaataatttaccatggctaaacaatcatacaaagttgccgacatgagcttggccgaatggggccgcaatgaaatcactttggccgaaaatgaaatgcccggcctgatgagtctacgagcgacatacaaggacaacacgattttgaagggggccaaaataactggatgtcatcacatgactgtacaaacagcagtattaattgaaaccctcgc

SEQ ID NO: 2197 - DNA, 316 bp, Diabrotica virgifera
  Clone ID: LIB149-021-Q1-E1-F6
cccacgcgtccgcccacgcgtccgcccacgcgtccggtcgattggtacagcaaggaaatgccaaatccaccatattaaattcaccacacaatgatattcactgtagtattattaaaacaaattgtattacattgcatttaatattttttaataaaaatatattttgacaaaaaaaaaaaaaacaaaaaaataaaaaataaaaagaaagtggaaatttcaacaacaaaaacagtaaaaaaaaaacatcaatcacagtgttcatgacatgttaaaggggcggcccctccaaggattcgacattaactcacggggaaat

SEQ ID NO: 2198 - DNA, 427 bp, Diabrotica virgifera
  Clone ID: LIB150-017-Q1-E1-H6
ccacgcgtccgcccacgcgtccgcccacgcgtccggttattgtgaaatcattcattattcgagaatgaatcctctaaaaggtttggtgtttttcctttaagttttgagcgataaaaatcccatgttattattggtctgcattttgaaagatccttgagttgtagttgacgattggtcaatagttttggccgaacgatcgagaagaaatgcatcgtttggacgcgagagagacgtgacgatgtaaagttagttctaaaagtacatcagctctgtaagcatctttttgttagaactcaaaaagtcgcactttgccggccaaaatggttttcttcttatagtaaaagaactaatggatttctaacatgtcaaggaatataatgacaatagtttcacggcattttaatggatatattattgtgaaacagtt

SEQ ID NO: 2199 - DNA, 432 bp, Diabrotica virgifera
  Clone ID: LIB150-046-Q1-E1-B11
acagacacttgggttatgcgcccttcaacgtttcccgaaattataagtctctcaagattattatcacttcttcttgcaatatggccgaaaaattttaagacgatggagaggcaaatagaggaaagtcgagtctgaatattaagctcttggaggattgagtggtttgttctgtgttccgtccatgagatccgaattattcttctccagcagcacatttcaaaggcgtcaatcctttttctgtcgtccgatttcattgttcatatttcgaatctgtaattaaatatgggaaaaattaaggctcgtactaatcttattttggtgttcttcgacaagaagtgatctttccagattttcgataatcgactcatagcgtttttggccatgcctattctcctacgtatttctgtttcacaagattctgtattactgatg

SEQ ID NO: 2200 - DNA, 427 bp, Diabrotica virgifera
  Clone ID: LIB150-044-Q1-E1-H5
accacagaatagtagagagcagcgaaaagttcggtttatcacttaacatcaaaaaaacaaaaataatgatggtgtcgaaatctccacaaaatttttctgacataaccgtacatgatcaaagaattgagcgtgttagaaaatataattacctgggaactgtgaataatgaaaacaacgacaactctgaagaaatcaagatcagaatagaaaaagctagagctacttttaccaaaatgaaaacagttttatgcggaagagagctaagtttaaatcttaaaattcgcctcatgagatgttacgtgctgtcagttcttttctatggaatggaagcttggacactgaaaaaggtcgatacaaggaaaatagaagcattcgagatgtggatgtaccgcaggatactgagaatatcgtggacagagagagtgac

SEQ ID NO: 2201 - DNA, 391 bp, Diabrotica virgifera
  Clone ID: LIB150-003-Q1-E1-H9
gaaaattttacgtgctcacttcgacatcaacaactctccgtcggaagaccaaattcacgagatggcatcacaaagtggcttaccgccgaaagttataaaacactggtttagaaacacattgttcaaagaacgacaacgtaataaagatagtccgtacaattttaacaatccaccttcaactacattaaatttagaagaatacgaaaaaactggtgaagctaaagtaatgcccttgaacagctcggggagcagcattgaagagaataagtcaaaagaatcaccaaaactttcgcaagaaattaaacacgaattaaaagaggaacctgtcgatgactttcccaaactaaacgaagagaaaatacaagaacctatagacgaaaaacctaacata

SEQ ID NO: 2202 - DNA, 396 bp, Diabrotica virgifera
  unsure (1)..(396): unsure at all n locations
  Clone ID: LIB150-003-Q1-E2-H9
cgggccgacccacgcgtcaagaaaattttacgtgctcacttcgacatcaacaactctccgtcggaagaccaaattcacgagatggcatcacaaagtggcttaccgccgaaagttataaaacactggtttagaaacacattgttcaaagaacgacaacgtaataaagatagtccgtacaattttaacaatccaccttcaactacattaaatttagaagaatacgaaaaaactggtgaagctaaagtaatgcccttgaacagctcggggagcagcattgaagagaataagtcaaaagaatcaccaaaactttcgcaagaaattaaacacgaattaaaagaggaacctgtcgatgactttcccaaactaaacgaagagaanatacaagaacctatagac

SEQ ID NO: 2203 - DNA, 428 bp, Diabrotica virgifera
  Clone ID: LIB150-010-Q1-E2-F9
ccaacgcgtccgcgcctttggtactggtgcagcttggttaaattatcaagcatttcggctaaacaaaaaagcaacatggcaactgaaaacgaacaaggagactgtcctgacgatttggaatctgtcgaagaagaggaagttgatggatccaaacagttagatttccctaacgtttatgctgcccttcaaagtcagaggaatgctgcgatgcttgcactcttacctacctcagttaagagaagaattaaggctctaaagagaatccaattagaggcaactaatattgaagctaaattcttcaaagaggtacataatctaaaatgtaaataccacaagttgtaccagcctctttacgagaaaagaaataccattgtcagcgggcaatacgaacccactgatgaagaatctcaatggtcgtccgatgatga

SEQ ID NO: 2204 - DNA, 365 bp, Diabrotica virgifera
  Clone ID: LIB150-010-Q1-E1-F9
accacgcgtccgcgcctttggtactggtgcagcttggttaaattatcaagcatttcggctaaacaaaaaagcaacatggcaactgaaaacgaacaaggagactgtcctgacgatttggaatctgtcgaagaagaggaagttgatggatccaaacagttagatttccctaacgtttatgctgcccttcaaagtcagaggaatgctgcgatgcttgcactcttacctacctcagttaagagaagaattaaggctctaaagagaatccaattagaggcaactaatattgaagctaaattcttcaaagaggtacataatctagaatgtaaataccacaagttgtaccagcctctttacgagaaaagaaa

SEQ ID NO: 2205 - DNA, 410 bp, Diabrotica virgifera
  Clone ID: LIB150-002-Q1-E1-A2
cccacgcgtccgcccacgcgtccgggtggccctgctcctgatcaagtctccgatgctatatatgaacacactaagaaaataaaatcgtacaaatatacgcctaaactagaaactgatagacttattgatatattaggaactaccgcagtcaaagtggacggacgtgattttatcgttgaagttatcgattccacggcaaactatgtagcattgatgaaggacatcttcgacttcaaaaagttgagaactttgattcgtggaactgagcagcgtccccccttcaatgtacttatcgattccatgaacggagtgactggcgtttatgtacgacgtatttttgttgaggaactcggtgcaagtcctgacaataatgtatgccgaatcgttccattggacaacttcggcgaaat

SEQ ID NO: 2206 - DNA, 326 bp, Diabrotica virgifera
  Clone ID: LIB150-027-Q1-E1-H1
cacacgcgtccggccacgcttccggagaaagtgacacaacgaatgatatgatgaaccatttagcaaccttagcattagctggtgccttagttggaactgcattcacatctgacagtatttccaacgccgttaacattgcctacatcttttcctacgtcgataccatcgacaacagtctaagtaaccatcaacgtatccggatacgtttcgactatggctcaaggttaatctgcacgttgtcaagtagaggaagcatcggagccaccattggcatatacattgataactacgtactgacaaatgtactatcagatgcacaacacatg

SEQ ID NO: 2207 - DNA, 452 bp, Diabrotica virgifera
  Clone ID: LIB150-023-Q1-E1-D7
actcgcgggtcgatacaagcctctaaacagacgtcctggtaaaatatgacaaaaaataaagtgattttagtaacaggagggacgggattagttggcagtgctataaaagaaataattcaattagaaaaacggacagatgaaacctgggtatttttaagcagtaaagatggagatttatgtgattataatgagactaaaaaaatatttgaaaaacaccagccaacacatgtcattcacttagctgctatggttggaggactctttcataatatgtcacataatttggattttttaagaaagaatttaaaaatgaatgacaacgtactgcaaattagttttgaaagtggcgttcaaaaggtggtgtcatgcctttctacctgtatatttccggataaaacagagtatcctattgatgaaactatggtgcacaatggaccaccacacccctccaa

SEQ ID NO: 2208 - DNA, 380 bp, Diabrotica virgifera
  unsure (1)..(380): unsure at all n locations
  Clone ID: LIB3026-003-Q1-E1-F4
cggtcgacaatcccggggaaataattcaattagaaaaacggacagatgaaacctgggtatttttaagcagtaaagatggagatttatgtgattataatgagactaaaaaaatatttgaaaaacaccagccaacacatgtcattcacttagctgctatggttggaggactctttcataatatgtcacataatttggatttgttaagaaagaatttaaaatgcgatgacgacgtactgcanattcgcggtgacgaggggnnttcaaaangtggcgtcaggccagtcgcgcctgtatatttccggataaaacagagtatcctattgatgaaactatggtgcacaatggaccaccacacccctccaatttccgatacagttatg

SEQ ID NO: 2209 - DNA, 412 bp, Diabrotica virgifera
  unsure (1)..(412): unsure at all n locations
  Clone ID: LIB149-019-Q1-E1-E9
aatttcacctagtcaccatgttccactgggataccccacaacctttagaagatataggtggctggaccaatgacactatcatcgatagattcgtggactatgctcagttcctctttgaaacttttggtgacgatgttcagatgtggctgacttttaacgaaccaaaacaaacctgcaatggaggatatggaaacggaattcttgcacccggtatccaatcgcctggcgtaggggaatacttgtgtacccataacgtgatcaaagctcatgctgcagtatggcatttgtatgacgaaaaatacagacggcgtcaaaacggtcaccttggaataactcttgactgtttttttggtgagccagatagtgacagtcaggaagatanagatgctgccgaaagaatgttgcaatttaa

SEQ ID NO: 2210 - DNA, 445 bp, Diabrotica virgifera
  Clone ID: LIB3026-006-Q1-E1-E9
cccacgcgtccgaaactattcaagggttgcctatagactttttggagatgatgttaagttttggatcacgataaatgaacctctgacaatatgttattatggttatggtacaggagccgtcccaccttttattcagtcagaaggtattttggagtatcagtgtttacgcaaccttcttaaagctcatgctagagcttaccatgtctacgctgaagagtttagaaataaacaacaaggaaaactatctatgtcctttaatacaaacgcctttctacctggaagtgacaatcccaaagatatccaagccacggagagagttcagcaatttaatcttggagtctatgctcacccaattttcgttggagactggccagaaatagtaaaaacccgagtagccatccgcagtaaattagaaggaagaaatgaatcccgtcttccagcattc

SEQ ID NO: 2211 - DNA, 409 bp, Diabrotica virgifera
  Clone ID: LIB149-020-Q1-E1-E9
acccacgcgtccgggctaacaagccaaaacaatccttcattgcaaaacacgtagtcgatcccaatgtccaagctgtagaagaagttgattggagagaaagtgctgttttgggagtcaaagatcaaggacagtgtggatcatgctgggctttcagtaccaccggatccctcgaaggtcaactcgccatccacaaaaatcaacgtgttcctctcagtgaacaagaattggtagactgtgataaggtaaacgatggttgtgacggaggtttgatgacagatgccttcttttatattgaacatcatggtctttcatcagaagaacaatacccctatacaggcgtagatggtcattgcaatcatgtaaaagacagacaagtctcttcgatcagtggttacgtcgaacttgatga

SEQ ID NO: 2212 - DNA, 431 bp, Diabrotica virgifera
  unsure (1)..(431): unsure at all n locations
  Clone ID: LIB3026-004-Q1-E1-D8
caaacgcgtccgcgccgattggtccagcgcagaattccaagccatgttggaccgtcagatggctaacaagccaaaacaatccttcattgcaaaacacgtagtcgatcccaatgtccaagctgtagaagaagttgattggagagaaagtgctgttttgggagtcaaagatcaaggacagtgtggatcatgctgggctttcagtaccaccggatccctcgaaggtcaactcgccatccacaaaaatcaacgtgttcctctcagtgaacaagaattggtagactgtgataaggtaaacgatggttgtgacggaggtttgatgacagatgccttcttttatattgaacatcatggtctttcatcagaagaacaatacccctatacaggcgtanatggtcattgcaatcatgtanaagacaaacaagtctcttcga

SEQ ID NO: 2213 - DNA, 437 bp, Diabrotica virgifera
  unsure (1)..(437): unsure at all n locations
  Clone ID: LIB149-049-Q1-E1-A8
aggcatcaccaaaatttctcttgcttttctcgtattttattgtttagttctatcgtaaaatacttgatacgatggttgtctttttagttttgcatatagccataaagacaaaaaaatatagacctgaatttattgtcttttggacagtgtgatcacttgcattgccttgaggtaggatgattcgccgttttgtgttgctttgtcggagtttcgcgataacttctggtaaacaagaggttatatacctatcagaagtaaccgttcttcgatcttctaaagcaattgttgccacatgaccagattttgacacaaaagttgcgaccgacactcttcgagaacggatcacttttgttggtttttcctcatcgtgaaacattcacacagcgaatttgcgttgattttacggttcgtangagtaaatcaaagattcatcgcta

SEQ ID NO: 2214 - DNA, 370 bp, Diabrotica virgifera
  Clone ID: LIB150-021-Q1-E1-A5
atctttttaaaaatatatagactttgagtactttattgctttccaaaatatgtcccaacaagatcgatacacttttgcatacgttcaaaccaaatgctaaaacagttaatccagtctccaacaatggttgaacaattcgatgttttgaagctccaagctagtcttttgggcagtgtgagcacttgcattgccctgatgtaggatgattcgccgttgtgtgttgctttgtcggagtttcgctataatttctggtaaacaaacggttatataccaatcagaagtaaccgttcttcgttggtctaaaacaattattgccacatgaccagattttggcacaaagttgcgatcattgtctttgacacacttcgag

SEQ ID NO: 2215 - DNA, 182 bp, Diabrotica virgifera
  Clone ID: pGUT911
aatttcctctcttaaagcgatcaagaaattacgtttaagtctaagatctcttgacaatcgggcgaaaatctttatcaccaccgaaatattttaagttccccaaattatatattgtccaaaaatattttgttatatccaaacattttattcctccaataccaagaatattacctctcttattt

SEQ ID NO: 2216 - DNA, 67 bp, Diabrotica virgifera
  Clone ID: pGUT1998
gcgcggtggcgtttcggcgtcgtcgatgtttcggaaagatgaccaaacttgatcatttagaggaagt

SEQ ID NO: 2217 - DNA, 411 bp, Diabrotica virgifera
  Clone ID: LIB149-023-Q1-E1-B5
aagaagtactgagtactcaacagttagtagattgttcccgtgattacaaaaatgaaggctgcaatggtggttggcctcattgggcatatgactacatcaaagataatggcctctgtctagagtctaattacaggtatcaaggatatgacggttactactgcaaagagtgtattccggctatcaaaaaaatcaatggctattcatctataaataaaactgaagaagcacttaaggaggctgtaggtacggctggcccaattgcagtatgtgtcaacgctaatgacgactggcaactgtacagcgggggtatccttgagagccaaagttgcccaggcggcgaaagtataaaccatgcagttttagctgttggatatggttcagaaaatggtaaagacttttggcttatcaaga

SEQ ID NO: 2218 - DNA, 328 bp, Diabrotica virgifera
  unsure (1)..(328): unsure at all n locations
  Clone ID: pGUT029
gcatataactacattaaagatcacggcctctgtctagagtctgattacaagtatcaaggattagacggtgactgcaaacagtgtaatccggttctcaaaaccatcaatggctacgcatctgtacatcaaaccgaagaaacacttaaggatgctgtaggtactgttggcccaatatcattatgtgtgaacgctaattgggactggcaactgtacagcggaggtatccttgatatccaaagttgtccacgcggcattttanaccatgcagttttagctgtcggatatggttcaaatcatggtaaatacttttggcttatcaagaattcat

SEQ ID NO: 2219 - DNA, 438 bp, Diabrotica virgifera
  Clone ID: LIB150-024-Q1-E1-C7
ctcgcgggtcgacacacgcctctaaagtcactcgtatgacgcgtgggataaaaattactgccaaaatggcaggtcgtaccgcaaatccaaggagaatacccgaaaatgaatcaacaattcaatacgttcaagccgatggattggctgtaatgaacatggttaaacattgccatgaagaatctactaccaagatggacattgcacaaggggcacttttgggattaagagtagataatagacttgaaatcactaactgtttcccattccctaaacaaactgatgaatatacagatgaagatgaatatcagctatcaatgatgagaagacttaggagagtaaatgttgatcattttcatgtatgatggtatcacagtgctgatgtgggcaattttttaagtcatccgcttcttgaatcacagtttcattagcagacatcca

SEQ ID NO: 2220 - DNA, 394 bp, Diabrotica virgifera
  Clone ID: LIB150-042-Q1-E1-C2
cgcgtgggcggacgcgtgggaaaaattagtgccaaaatggcaggtcgtagcgcagatccaaggagaatacccgaaaatgaatcaacaattcaatacgttcaagccgatggattggctgtaatgaagatggttaaacattgccatgaagaatctactaccaatatggacattgcacaaggggcacttttgggattaggagtagataatagacttgaaatcaccaactgtttcccattccctaaacaaactgatgaaaatacagatgaagatgaatatcagctagcaatgatgagaagacttaggagagtaaatgttgatcattttcatgtaggatggtaacaaagtgctgatgtgggcaattttttaggtcctccgcctcctgaatcacagtttc

SEQ ID NO: 2221 - DNA, 443 bp, Diabrotica virgifera
  Clone ID: LIB150-032-Q1-E1-D5
tccgggtccacccacgcatccgattgtaccaaaggatgtaaatgctgctattgcaaccattaagaccaaacgtaccatccaattcgtagactggtgtccaactggtttcaaagtaggtatcaactaccaaccaccaactgttgtacctggaggtgatttggctaaagtacaacgtgccgtatgcatgttgtccaacactacagctattgctgaagcctgggcaagattggaccacaaattcgatcttatgtatgccaagagagctttcgtccactggtatgtacgagagggtatggaagaaggtgaattctctgaagctcgtgaacatttggctgctttggagaaagattatgaagaagttggtatggactccggagaaggtgagggtgaacgagctgaagaatattacatttgattccaaacatgacaaatcacctgttttt

SEQ ID NO: 2222 - DNA, 405 bp, Diabrotica virgifera
  Clone ID: LIB150-003-Q1-E2-E10
ctgcattactagctaatctgaacgtctgtcgtaattttgtttcatttgtggtgtaaaagttaaaactcatcaaccaaaatgcgtgaatgtatctcagtccatgttggccaagccggagtccaaatcggtaatgcctgctgggagttgtactgcctggaacatggcatccaacctgacggtcagatgccaacagacaagactgttggaagaagagatgacattttcaacacatccttcagttgaaactggtgccggaaaacatgtacctaaaccattatttgtagatttggaaccaacagtagtagatgaagtacgtaccggcacataccgtcaattgttccacccagaacaactcatcactggcaaagaagatgccgccaataactatgctagaggtcactatac

SEQ ID NO: 2223 - DNA, 400 bp, Diabrotica virgifera
  Clone ID: LIB150-005-Q1-E2-B6
acaaattccatgagatccaagttaaacgaagtattcaacgtagtaaaagaagtaaacatattagactcaaaagacgaggcgaatctccgtttgttgaaaaggcctgaactaggaatcacctttaccaagctccactgctggcgtctcacgcagttcgaaaaatgtgtatttttggatgcagacacgttgatatgagaaaactgtgatgaattatttgaacgggaagaattatcagcagctccagatattggttggccagactgcttcaattctggtgtttttgtataccgtccgtccaatgaaacttacgacaaactaattcaatttgccctagataagggaagttttgatggtggagatcaaggacttcttaatttatatttttcggactgggcacaca

SEQ ID NO: 2224 - DNA, 316 bp, Diabrotica virgifera
  Clone ID: LIB150-008-Q1-E1-B6
caaattccatgagatccaagttaaacgaagtattcaacgtagtaaaagaagtaaacatattagactcaaaagacgaggcgaatctccgtttgttgaaaaggcctgaactaggaatcacctttaccaagctccactgctggcgtctcacgcagttcgaaaaatgtgtatttttggatgcagacacgttgatattagaaaactgtgatgaattatttgaacgggaagaattatcagcagctccagatattggttggccagactgcttcaattctggtgtttttgtataccgtccgtcaaatgaaacttacgaaaaact

SEQ ID NO: 2225 - DNA, 362 bp, Diabrotica virgifera
  Clone ID: pGUT2460
gagaactagtctcgagttttttttttttttttttaacaaaaaagggctgtatttattacactacacttgatccaaaactgtaccattaaacttagtaccctattttgctagagcttccaattccttaatttctttgccagctggggtttttttttaaagggccagtttaccatcacgttcggccttaatttaattttctacctccctaaggcctgcttcctttttggaaaccctgttttgggggaaggctccataagcaactcccaaagcaggaaaactccattttccgaacttgattaagggagaaacacgaactggacctggaagggcaaactttattagggcttttcttgaacttcggt

SEQ ID NO: 2226 - DNA, 402 bp, Diabrotica virgifera
  Clone ID: LIB3026-015-Q1-E1-G11
ttttcgtcccctttgactttcaacgtcaatagaatttttaccgaagttcaagaaaagccccaaaaatgtccgccctccagctccagttcgtgtttctcctttaatcaagttcggaagatggagttttcttgctttgggagttgcttatggagccttccaccaaaacaggctctccaaaaaggaagcaggcattagggaggtagaaaataaaattaaggcagaacgtgatgctaaactggccattgaaaagaaagccgcagctgacaaagaaattaaggaattggaagctctagcaagataggttactaagtttaatgttacagttttgtatcaagtgtagtgtaataaatacagccattttttgttaatattgtctttaatatcctcaggcagtgacataaa

SEQ ID NO: 2227 - DNA, 433 bp, Diabrotica virgifera
  unsure (1)..(433): unsure at all n locations
  Clone ID: LIB149-029-Q1-E1-D1
acggaagcgtgggtttggactcaccgatacccacgatagcttatctgacgtacaaggaatggttatggaagctgctttgacgttcatgttcctacttgtcatccaaggagtttgcgatgcctaccgaaaagacttgaagggatctggtcctttggctattggattagctgcagtcgcttgccatttgactggaattccatacacgggatcaagtatcaaccccgctcgttcctttggaccagctgtaatcatgaaccattggcatcatcactggatctactgggttggtcctctgcttggangaagtctcgctggggttatctacaagatcttatttaaagtacgaaaagacgaatcatacgacttataaatttaatactcatcaataattttagttcttaactacgtaattttttgttaattataaataatt

SEQ ID NO: 2228 - DNA, 320 bp, Diabrotica virgifera
  Clone ID: LIB3026-019-Q1-E1-H9
ctgcagtcacttgccatttgactggaattccatacacgggatcaagtatcaaccccgctcgttcctttggaccagctgtaatcatgaaccattggcatcatcactggatctactgggttggtcctctgcttggaggaggtctcgctggggttatctacaagatcttatttaaagtacgaaaagacgaatcatacgacttataaatttaatactcatcaataattttagttcttaactacgtaattttttgttaattataaataattttaatttaattaaataatactaacaaaactttaaaacaaattaaataaataaaa

SEQ ID NO: 2229 - DNA, 389 bp, Diabrotica virgifera
  Clone ID: LIB149-039-Q1-E1-E11
cccaagcctctaaagtaactcgtactaacgcgtgggcggaacacctcaagtattagaaagggctggactcacacccaaggagatcgatgtttgggaattccatgaagcctttgcaggtcaaattttggcgaacttaaaagcgcttgacagtgactggttcgctcagaaatacatgaatagacagaatagagttggagctcccgatctcaacaagttcaatgcctggggaggatcactttcaatcagacatccaattgctgctacaggtgtaagattggctatgcacacagctaatagattagttagagaagatggtcaatttggattggttgctgcatgtgctgctggtggtcaaagagtagccatgattttggagagacatcctgatg

SEQ ID NO: 2230 - DNA, 414 bp, Diabrotica virgifera
  unsure (1)..(414): unsure at all n locations
  Clone ID: LIB150-026-Q1-E1-B10
tcgttggaccaccctatactgaatcgtgagacatattaattagacatagcataaaaatgagaaacctactactaaaagcaaataaagcgaagaacctccaacagagactgtctttgttggcttcgatcagacctgattactttgtaccagatctcccatcaattgccgaattttcttctggagagactatgggccattcagccgacaggctcgctgctgcctttggagcaaaccgcaaggagcaagacgaatttgccttaaggtcacataccanagcacaagaagctgctgataaaggttacttaaccgacatcgtgccattccaagtaccaggagttgcaaagcaagtcgaataagataatggtatccgtgtatcaagtcctgaaaaattggcgtcactcaaaccagctttta

SEQ ID NO: 2231 - DNA, 419 bp, Diabrotica virgifera
  Clone ID: LIB149-030-Q1-E1-H10
actcgtggtccgatacaatactcagtagtgagtcgtattatttatataaagtaaaacacaaatttcacgatgcaagtgcctcctgtatttatcgatatgtccctggaagaccaggcccaagaactcagggtgtatttaaaaagtcttggcgctgaaatttctgaagaaaagtctccgaaaggtatagaagacgatttacataaaattattggagtatgtgattcgtgttttaaagagggccaggaaaatgatgtggagatggtgttaaatgacatagtttccataatggttttgattccattggaaagatcagaaaacatcatcctagccttctgtgaaaaactcacaaaagcacagggccaaaagttaggtttagtatgtcttagagcattatggttactcttccaatcattggatga

SEQ ID NO: 2232 - DNA, 406 bp, Diabrotica virgifera
  Clone ID: LIB149-020-Q1-E1-B11
cccacgcgtccgtttatggccagtgtggctaatagataaataataaatatattttatataaagtaaaacacaaatttcacgatgcaagtgcctcctgtatttatcgatatgtccctggaagaccaggcccaagaactcagggtgtatttaaaaagtcttggcgctgaaatttctgaagaaaagtctccgaaaggtatagaagacgatttacataaaattattggagtatgtgattcgtgttttaaagagggccaggaaaatgatgtggagatggtgttaaatgacatagtttccataatggttttgattccattggaaagatcagaaaacatcatcctagccttctgtgaaaaactcacaaaagcacagggccaaaagttaggtttagtatgtcttagagcattat

SEQ ID NO: 2233 - DNA, 421 bp, Diabrotica virgifera
  Clone ID: LIB150-020-Q1-E1-E3
agcaacgatggaaagcagctcaagatgctggaaagttcaaagaagaaatcgtacccgttccaattaaagagaaaaaagagatggtcaactttgaggttgatgagcatccaagaccgtggactaccctggatatgttaaaaaaactgcccacaatatttaaaaaggacggattggtcacagctggaacagcttcaggtatcagtgatggtgcaggcgctgttgtagttgcaagtgaagctgcttcatccaagcacaacctcaaaccactagccaggatcgttgctcactcagtggtcggtgtagacccctccattatgggattcggaccagctccagcaatcagaaacattctcaaggccaccggaaaaacgttggacgacattgacttgatagaaatcaatgaagcttttggtgcacaaac

SEQ ID NO: 2234 - DNA, 381 bp, Diabrotica virgifera
  unsure (1)..(381): unsure at all n locations
  Clone ID: LIB150-005-Q1-E1-C5
ccggggccaccacgcgtccggaaaactgtaaagtaaacgattcaagtgaaaaaataatgacttctctaactaaaggaatttttattgttggtgcgaaacgtacaccttttggtacatttgggggcaaattggccaaatctcacatcaccgatctccaagtaattgcttccaaaggtgccttagccgctgctaatgttaaacccgaactagtcgacactgtagtcattggtaacgtcattccgtctgtagcagctgatggtggtttccttgcaagacacgtattgctcaaatcangtattcctttagaaaaacccgccttttcagtgaataggctatgtggttctggattccagtctcttattaatggattacaagacatat

SEQ ID NO: 2235 - DNA, 355 bp, Diabrotica virgifera
  Clone ID: LIB150-004-Q1-E1-E10
aatcgctcccccagaaaggaaatactccgtctggatcggtggatccatcttggcctccctctccaccttccaacagatgtggatctccaaacaagaatacgacgaatccggcccaggaattgtccaccgcaagtgcttctaagctatttaatcaattcatacctaataagctatttttcatgttgtttgtactgtgtttacatctttgcagttcttaaataatatgcgaccgtggttgtaactgccagacagacttttaagatcttataacaccttataattatttattatttgttatatttacttactataactattttgtaactgggcaggtaaataaatcctatctagtact

SEQ ID NO: 2236 - DNA, 354 bp, Diabrotica virgifera
  Clone ID: LIB150-017-Q1-E1-H5
atcgctcccccagaaaggaaatactccgtctggatcggtggatccatcttggcctccctctccaccttccaacagatgtggatctccaaacaagaatacgacgaatccggcccaggaattgtccaccgcaagtgcttctaagctatttaatcaattcatacctaataagctatttttcatgttgtttgtactgtgtttacatctttgcagttcttaaataatatgcgaccgtggttgtaactgccagacagacttttaagatcttataacaccttataattatttattatttgttatatttacttactataactattttgtaactgggcaggtaaataaatcctatctagtact

SEQ ID NO: 2237 - DNA, 449 bp, Diabrotica virgifera
  Clone ID: LIB149-007-Q1-E1-D12
gaaaatggcaacttcaatctcaaaaaagcgtaaattcgttggagatggtgtcttcaaagccgaattaaatgaatttttaacccgtgaactttccgaagatggttattccggtgtggaagtacgtgttaccccaacacgtaccgaaattattattatggccaccagaaccgacagggtgttaggtgagaagaacaggaggataagagaattgacttctgttgtacagaagaggtttagtttccctccagattccgtagttttgtatggtgaaaaagtagccaacagaggtctgtgtgctattgcccaagctgagtcacttaggtttaaattgattggtggtttggccgtccgtatggcttgctatggtgtcttgaggtacatcatggaatgtggggctaaaggatgtgaagtagtagtatcaggaaaattgagaggtcaaagagccaaat

SEQ ID NO: 2238 - DNA, 447 bp, Diabrotica virgifera
  unsure (1)..(447): unsure at all n locations
  Clone ID: LIB150-019-Q1-E1-B1
cttagcgaaaatggcaacttcaatctcaaaaaagcgtaaattcgttggagatggtgtcttcaaagccgaattaaatgaatttttaacccgtgaactttccgaagatggttattccggtgtggaagtacgtgttaccccaacacgtaccgaaattattattatggccaccagaaccgacagggtgttaggtgagaagaacaggaggataagagaattgacttctgttgtacagaagaggtttagtttccctccagattccgtagttttgtatggtgaaaaagtagccaacagaggtctgtgtgctattgcccaagctgagtcacttaggtttaaattgattggtggtttggccgtccgtanggcttgctatggtgtcttgaggtacatcatggaatgtggggctaaaggatgtgaagtagtagtatcaggaaaattgagaggtcaaag

SEQ ID NO: 2239 - DNA, 394 bp, Diabrotica virgifera
  Clone ID: LIB3026-034-Q1-E1-B8
ggaggtttaattaaacatttaccattgacttgtacttatttaaatatttgtaatctttctttatgtggttttccttttatgtctggattttattctaaagatttaattgttgaaattttatcttttagttatttaaatatttatatttatataattttttatatttctattggtttgacagttgcttatagatttcgtttaacttattattctttaacgggtagatttaattatctagctttaaatatattatctgaaactggttatttaatacttaagggtataagaggattaattttatttgtagtttttagtggaagattattttcttgattagtattttctactcctatttttatttgtcttccttttttaataaaaattataactttga

SEQ ID NO: 2240 - DNA, 409 bp, Diabrotica virgifera
  unsure (1)..(409): unsure at all n locations
  Clone ID: LIB3026-023-Q1-E1-F11
cacgcctccggaagtttanataaacatttaccattgacttgtacttatttaaatatttgtaatctttctttatgtggttttccttttatgtctggattttattctaaagatttaattgttgaaattttatcttttagttatttaaatatttatatttatataattttttatatttctattggtttgacagttgcttatagatttcgtttaacttattattctttaacgggtagatttaattatctagctttaaatatattatctgaaactggttatttaatacttaagggtataagaggattaattttatttgtagtttttagtggaagattattttcttgattagtattttctactcctatttttatttgtcttccttttttaataaaaattataactttgattttta

SEQ ID NO: 2241 - DNA, 416 bp, Diabrotica virgifera
  Clone ID: LIB149-035-Q1-E1-D10
gactgaagtcaaggataaaggatcttgtggatcctgttggatttttagtacaactggaacagtggaaggagcttattttcttaaaacaggaaaattggtctctttaagtgaacaaaatctcgtagattgcgcaaaagaagactgttatggatgttcaggtgggtacatggacaaggcattagaatacattgaaacagctggaggaataatgtctgaaaacgattatccttatgaaggtattgatgataaatgcagatttgatagctccaaagtagctgcaaaaattagtaactttacttatattaagaagaacgatgaagatgacctgaaaaatgccgttattgcaaagggacccatatcagtagctattgatgccagttttaattttcaattatatgattcaggaatactcgatg

SEQ ID NO: 2242 - DNA, 417 bp, Diabrotica virgifera
  Clone ID: LIB149-021-Q1-E1-G8
acccacgcgtccgcccacgcgtccgcctgattcctttgattggagaggatcaggtgcagttttggaagttaaggaccaaggcagttgtggatcttgttggtcgtttagtgttactggagcattagaaggacttaatttcttagcaaataacgtaacacttcctctaagtgaacaagaacttgtagactgtacggcactatacggtaacgctggttgcaatggaggaaatatgcaatacggttttaagtatgttaaatctaaaggtatatcaagtgaagcagcatatccgtacgcaggagtagatgagtcttgtagacgaaatgcgagcaatattgtttttaaaataaaaggtttccaaacggtctcaaaagatgatgattcattgagacgtgctattgccaaggttgggcccaaaac

SEQ ID NO: 2243 - DNA, 423 bp, Diabrotica virgifera
  Clone ID: LIB3026-029-Q1-E1-E1
agaagtgatttcggtatatgatagccaaaatgacggaaggtacagctactattcgaaccagaaagttcatgaccaacagacttttggctagaaaacaaatggttgttgatgttttacatcctggtcaaccatcagttaagaaaactgaaataagggaaaagttagccaaaatttataaagtactcccagatgtagtattcgtctttggctttaggacaaacttcggaggtggtaaatccactggatttgctttaatttatgatacattagatttcgccaaaaaattcgaacctaaacataggttagcaaggcatggtctctatgagaagaaacaacagacaagaaaacaacgtaaagaacgtagaaacagaatgaagaaagttaggggcaccaaaaaaagtaaagttggtgcttctgctaaaa

SEQ ID NO: 2244 - DNA, 393 bp, Diabrotica virgifera
  Clone ID: LIB3026-002-Q1-E1-H4
cccatgcatctaaattaactaatcaaaccagaaagttaatgacaaacaaactttgggctagaaaacaaatggttgttgatgttttacatcctggtcaaccatcagttaagagaactgaaataagggaaaagttagccaaaatttataaagtactcccagatgtagtattcgtctttggctttacgacaaacttcggaggtggtaaatccactggatttgctttaatttatgatacattagatttcgccaaaaaattcgaacctaaacatacgttagcaaggcatggtctctatgagaagaaacaacatacaagaaaacaacgtaaagaacgtaaaaacagaatgaagaaagttaggggcaccaaaaaaagtaaagttggtgcttctgctaaaa

SEQ ID NO: 2245 - DNA, 423 bp, Diabrotica virgifera
  Clone ID: LIB3026-026-Q1-E1-D1
cccacgcgtccgcccacgcgtccgcccacgcgtccgcaaacaaggattccccatgaaacaaggtgttcttacaaacggtagagtaagacttttactttcaaaaggtcactcctgctacagacccagacgtaccggtgaacgtaaaaggaaatcagttcgtgggtgcattgttgatgggaacctcagcgtgttggccctagtcattgtaagaaaaggagaacaagaaattcccggacttactgacaccaccatcccacgtcgcctgggacccaagagagcatccagaatccgtaagctcttcaaccttagcaaagaagacgatgtacgtcaatatgtagtaaagagacctttggcccaaaaagaaggtaagaagttaagaaccaaggcccccaaaatccaacgtcttattacacccgttggttt

SEQ ID NO: 2246 - DNA, 239 bp, Diabrotica virgifera
  unsure (1)..(239): unsure at all n locations
  Clone ID: pGUT3579
atctggaggtaacgacaaacaangattccccatgggacactgtgttcttacaaacggtggagtaaaacttttactttcaaaaggtcactcctgctacagacccagacgtaccggtgaacgtaaaaggaaatcagttcgtgggtgcattgttgatgggaacctcagcgtattggccctagtcattgtaagaaaaggagaacaagaaattcccggacttactgacaccaccatcccacgtc

SEQ ID NO: 2247 - DNA, 406 bp, Diabrotica virgifera
  Clone ID: LIB3026-027-Q1-E1-B12
agccgaaagtaacacgtgctgctgaagtaatttttgtgaattttagtcctaaaataagtaaaaaagatgcctttagcagtcgacttattgcatccttctgccgaaaaacagaggagatcccacaaattgaaaaggttggttcagcatcctaacagttactttatggatgttaagtgtcccggctgttatgcaatttcaacaatattctcgcacgcccagtccgcagtcccatgcaaaggttgttctacaatcctttgcacttccactggaggcaaagcgagacttacagaaggttgcagtttcaggcgcaagcaacattaaactaatgaatatattgtgactgtaactatatattgttttctaataaattgtattaataaagtaaaaaataaataaaagggcggcc

SEQ ID NO: 2248 - DNA, 392 bp, Diabrotica virgifera
  Clone ID: LIB3026-029-Q1-E1-B5
acccacgcgtccgattttagtcctaaaataagtagaaaagatgcctttagcagtcgacttattgcatccttctgccgaaaaacagaggagatcccacaaattgaaaaggttggttcagcatcctaacagttactttatggatgttaagtgtcccggctgttatgcaatttcaacaatattctcgcacgcccagtccgcagtcccatgcaaaggttgttctacaatcctttgcacttccactggaggcaaagcgagacttacagaaggttgcagtttcaggcgcaagcaacattaaactaatgaatatattgtgactgtaactatatattgttttccaataaattgtattaataaagtacaaacatgccggacacagggcggccgctccacag

SEQ ID NO: 2249 - DNA, 361 bp, Diabrotica virgifera
  unsure (1)..(361): unsure at all n locations
  Clone ID: LIB149-029-Q1-E1-E6
acccacgcgtccgcccacgcgtccgatcagtggctacgtagaacttgcaacaactgaaaatgcactcgtttccgctcttgctagcgtaggtccagtttccatcgctgttgatgctgatacatggcaattttatggaggtggagttttcaacaacagaaactgtggaaccgccctcaatcacggtattcttgctgttggatacactaaagatgtattcattgtcaagaactcatggggaactagctggggtgaaaaaggttacatcagagtagcccgtggtcacaacttgtgtggtantaacctcatgaactcctaccctaaatgttaatgattaatgttaatgaaacaacaaatagaattc

SEQ ID NO: 2250 - DNA, 353 bp, Diabrotica virgifera
  unsure (1)..(353): unsure at all n locations
  Clone ID: pGUT562
cttcgatcagtggttacgtcgaacttgatgaaactgaaagtgctctagctgatgctctcgctaatgttggtccagtgtcaatagctgtcgaagctgatacatggcaattctattcaggtggagtgttcaacaataaaaattgtggagacgctcttaaccacggtgttcttgctgtgggatacactanagatgtcttcatcgtcaaaaactcatggggaacaagctggggtgaacaaggttacatcacactngcccgtggtaccaacttatgtggtattanactcatgaactcttacgccaagttgtagataacagttaatgataagtgatatatntataatgatacatgatat

SEQ ID NO: 2251 - DNA, 414 bp, Diabrotica virgifera
  Clone ID: LIB150-050-Q1-E1-A8
tcttagtcctagtcctagacttcaaatcttaagaaaaatgtcttattccatagtagagagaggatctccgttctcacccgattatagggtttatatcgaaaatcaaaatggtccaatctcacctcttcatgacattcctttgttagtggatggaaaccctaaggttttcaatatggttgtagaagttcccaggtggacaaatgcaaaattggagataacgatgaaagaaattcttatcccaatcaaacaagatatcaaaaaaggcaaacctagattcgtttcaaattgtttcccccaccatggatatatctggaactacggtgctctaccccaaacttgggaaaatctcgaacatcttgatgatggcacaggttgcaaaggtgacaacgatcccattgatgtcatagaaattgg

SEQ ID NO: 2252 - DNA, 443 bp, Diabrotica virgifera
  unsure (1)..(443): unsure at all n locations
  Clone ID: LIB149-049-Q1-E1-G2
accacgcgtccgatangaaaaagtttgtgtgacaattctcatattttatttagtcttagtcctagtcctagacttcaaatcttaagaaaaatgtcttattccatagtagagagaggatctccgttctcacccgattatagggtttatatcgaaaatcaaaatggtccaatctcacctcttcatgacattcctttgttagtggatggaaaccctaaggttttcaatatggttgtagaagttcccaggtggacaaatgcaaaaatggagataacgatgaaagaaattcttaacccaatcaaacaagatatcaaaaaaggcaaacctagattcgtttcaaattgtttcccccaccatggatatatctggaactacggtgctctaccccaaacttgggaaaatcccgaacatcttgatgatggcacaagttgcaaaggtgacaacga

SEQ ID NO: 2253 - DNA, 411 bp, Diabrotica virgifera
  Clone ID: LIB150-033-Q1-E1-G9
atatagacatcaaaaaaataaaattatagaacgtgaaaagtcacaaatcgaacactttttttacttctccgtttgtgaacgaacgtaaaattcacgtcaaattctccagacactaagggacccaaaatgactgaccgcaaagcagttattaaaaatgccgatatgagcgaagacatgcagcaagatgctgtagactgcgctacccaggcgatagaaaaatacaatatagaaaaggatattgccgcctacattaaaaaagaattcgacaaaaaatacaatccaacatggcattgtatcgtcggtagaaatttcggatcatacgtgacccacgagacccgccacttcatctacttttacctaggacaagtggcgatactattgttcaagagtggttaatctccaaaaagccca

SEQ ID NO: 2254 - DNA, 398 bp, Diabrotica virgifera
  Clone ID: LIB150-029-Q1-E1-E1
gcgccagggagaaaaggtatcaaaaaattgaatatcgctttattcaacaaaataataaaattatagaacgtgaaaagtcacaaatcgaacactttttttacttctccgtttgtgaacgaacgtaaaattcacgtcaaattctccagacactaagggacccaaaatgactgaccgcaaagcagttattaaaaatgccgatatgagcgaagacatgcagcaagatgctgtagactgcgctacccaggcgatagaaaaatacaatatagaaaaggatattgccgcctacattaaaaaagaattcgacaaaaaatacaatccaacatggcattgtatcgtcggtagaaatttcggatcatacgtgacccacgagacccgccacttcatctacttttacctag

SEQ ID NO: 2255 - DNA, 430 bp, Diabrotica virgifera
  Clone ID: LIB150-037-Q1-E1-D8
acccacgcgtccgcccacgcgtccgcccacgcgtccgaatgaagaccgctcagctagctcagaagatggaaaccatgggcgaatcgtcacttcgcaacttcacagtcgaaacacccactgaatcagtctaccaattcgaaggagaagattatcgtgagaagcagaaaaccatcggcttgagcaactggatagaacctcccaaaagagaaaggaaggccaactatgccgtcgatgcttacttcagagaagctttaagggtttctgagcctaaagctcctaaggctccaagaccaccaaaacagcccatcgtacaagatttccagtttttcccgccgagattattcgaacttttgggacaggagatctacttttacaggaaatctttgggatataaggttccgaaaaacttggaacttggacctgacgcgtc

SEQ ID NO: 2256 - DNA, 559 bp, Diabrotica virgifera
  unsure (1)..(559): unsure at all n locations
  Clone ID: LIB150-006-Q1-E1-D12
cacgaactgtagactcatggatctttttacaggtttcttgcttattctattcaaaaaccacgttcttcgtatcgtaaggggtacgtcaaggatactgtacactgtacggacacaaagtgacgaaagtcgaaacggaaacgtatttgcttctaaggattccgaaataacagatgaagatatcgatagtatattggaaaagggagaaatgaagaccgctcagctagctcagaagatggaaaccatgggcgaatcgtcacttcgcaacttcacagtcgaaacacccactgaatcagtctaccaattcgaaggagaagattatcgtgagaagcagaaaaccatcggcttgagcaactggatagaacctcccaaaagagaaaggaaggccaactatgccgtcgatgcttacttcagagaagctttaagggtttctgagcctaaagctcctaaggctccaagaccaccaaaacagcccatcgtacaagatttccagtttttcccgccgagattattcgaacttttggaccaggagatctacttttacangaaatctttgggatat

SEQ ID NO: 2257 - DNA, 408 bp, Diabrotica virgifera
  Clone ID: LIB150-042-Q1-E1-H6
tgtttataaaagtatagtgaacgtgaataaaatacaaggaatattccagcgtgacaaatacgttaataatggcgaaaatgttggatagtagtcccaatgcggcactcaacaaatcgcttcttcagcattaccttactctacccattccagatggtaaatgccaggctacgtatatttggattgacggatcaggagaaaatgtcagatgcaaaactaggactttagattttgttccaacatgcccaaaagaattaccagtgtggaacttcgacggaagttcaacaaatcaagccaaaggacacaactcagatgtctttctgtgcccagtagctatgtacaaagatccattcctcagaggaaacaacaaattagtcctatgtgatacatacaaatacgatagaactccca

SEQ ID NO: 2258 - DNA, 335 bp, Diabrotica virgifera
  Clone ID: LIB150-049-Q1-E1-A8
tgtttataaaagtatagtgaacgtgaataaaatacaaggaatattccagcgtgacaaatacgttaataatggcgaaaatgttggatagtagtcccaatgcggcactcaacaaatcgcttcttcagcattaccttactctacccattccagatggtaaatgccaggctacgtatatttggattgacggatcaggagaaaatgtcagatgcaaaactatgactttagattttgttccaacatgcccaaaagaattaccagtgtggaacttcgactgaagttcaacagatcaatccaaaggacacaactcacatgtctttctgtgcccaatagctatg

SEQ ID NO: 2259 - DNA, 332 bp, Diabrotica virgifera
  unsure (1)..(332): unsure at all n locations
  Clone ID: pGUT1567
attcggcacgagggaaaacaaaaacaagaaaacaagatgttgaagttttccgtaattttaggtcttttgacagtatcattggcgcttcctagtactcacaatgaagtttataaactgggaaatactaatcaggcgcttaagatcattaatggaaacccagctaaaccacatcaatttccctatcaggtaggaatgtacgtgtatacttcttccagatccgatttctgtggaggttcgcttatatctcctaactatgttcttactgcagctcattgcgttgacaaagctgtgaaggtanatatggtatntggtgctcacaacataacaaatcc

SEQ ID NO: 2260 - DNA, 358 bp, Diabrotica virgifera
  unsure (1)..(358): unsure at all n locations
  Clone ID: LIB149-042-Q1-E1-D3
agttcatatctgttgattaaaaaatttagaaggaaagtccaaaaatgaaggtttatgttttaatattatttttggttacattggttgcgttcggggtacaaggattgatangaggcaccctaatttatccacacagtttgccttatatggttttcctaaacgtttctggatcaacaaatacaactagatgttcgggagcccttatttccaaagattatatcttaacagcagctagatgtcttaaaaattcaaccgctgtacgggtagtacttggtgcagatgatataagtgtaaacgaagaaatgcaagtttcttttgatactacccaatctaattttataatacatgaaaattttgt

SEQ ID NO: 2261 - DNA, 344 bp, Diabrotica virgifera
  Clone ID: LIB149-020-Q1-E1-E1
acttgactcccaactcattcacaagcctaagcgagacattacatcccgctttgtagctgatcctcaattgactgttccagaatcaattgactggagagaaaagggggcagttaatcccgtaagggaccaagagcaatgcggatcatgttgggcatttagtgcagctggtgctcttgaaggacaaagatttttaaaggagggcaaactagaagtactgagtactcaacagttagtagattgttcccgtgattacaaaaatgaaggctgcaatggtggttggcctcattgggcatatgactacatcaaagataatggcctctgtctagagtctaagtacaaatatc

SEQ ID NO: 2262 - DNA, 417 bp, Diabrotica virgifera
  unsure (1)..(417): unsure at all n locations
  Clone ID: LIB149-049-Q1-E1-D12
cccacgcatccgatcgaggaacacaatgctaaatacgaaagtggagaagaaacctactacttggctgttaacanattcccccaatggtccaagcgctgaattccaagccatgttgggccgtcagatggctaacaagcccaaacaatcctttattgcaaaacacgtagccgatcccaatgtccaagctgtagaagaagttgattggagagatagtgccgttttgggagtcaaagatcaaggacagtgtggatcatgctgggctttcagtaccaccggatccctcgaaggtcaactcgccatccacaaaaatcaacgtgttcctctcagtgaacaagaattggtagactgtgacacatcaagaaatgctggttgtaacggaggtttgatgacagatgcctttaactatgttaaacgcca

SEQ ID NO: 2263 - DNA, 576 bp, Diabrotica virgifera
  Clone ID: pGUT2223
atcatgcgcgaccatgcgcggactattatcgaactgatgggtcacgagtgagggaattagtaattatctgttcatattgcgaaccgctgcatcgatatgtatacctctgaactacctgaacagctgacggtcaatggggtatacgtcgatactatcattaaacatctcgagggtatgaaaaactgagcaggtgatgcagtcgacgatcaagacagagctgaaaacgtgatcgacagatgtctattgaccatctatcgagggagcgcccagtacccagttggctgtatcgtgagtcgtcttacacttcactgagcgtagctctactggcacgtaagtggtacgtggaggttcaaaagatcgccggatccacaatgggaagtcaatcctggtgcaaaccgagatgaaaatggtaacgttaacgctggtgttgagcataagaggaaaggagaaaaacccgactttgatgcaggatggaataaagtagtcagtgggcccaatagagctaaaccaacatggcatgtcggtggtacctttagattcaagagatcacctgtacctgattggcaagtcaaccct

SEQ ID NO: 2264 - DNA, 250 bp, Diabrotica virgifera
  unsure (1)..(250): unsure at all n locations
  Clone ID: pGUT4148
gcaagttcaacccaggctttgtcctgaacgagcttgggagacctcatggcaggaagtgaaagtgaaaattctgggaagaccatgatttcgaagctggctggagcaaagtagtacgaggacccaatagagccaagcctacatggcacgtangcggtacttgaggttcaaaagatcgccggatccacaatgggaagtcaatccttgtgcaaaccgagatgaaaatggtaacgtcaacgcctgtgttgagctt

SEQ ID NO: 2265 - DNA, 416 bp, Diabrotica virgifera
  Clone ID: LIB149-009-Q1-E1-D11
catgcaatgtcttcacaaatactgttttttctttgcttgtattttatcgctggaagaacaaatgctctgagttgtaaagacgaaaacaatcgtgatgtagattggtttgttgcatacaaaatacctatccaaagtggtcgtggagatataattaaggctggtcttggacatatttatttaacgtctaccaattcatcgacatggactttttctaaacgttcaattggagataatagttcccttattggaaacactcttcatgacttttattacaatagaaccaaattaagttatattttgtacaacgatgaaccaccaaatcatccaaaatctgcagcgaaaggtcacacgaagggagttgttatttcaaatgcagcaagaggttactggttagtacattccgttcctaaatttcc

SEQ ID NO: 2266 - DNA, 396 bp, Diabrotica virgifera
  Clone ID: LIB149-032-Q1-E1-G8
acccacgcgtcaacccacgcgtctgctacacaaatactgttttttctttgcttgtattttatcgctggaagaacaaatgctctgagttgtaaagacgaaaacaatcgtgatgtagattggtttgttgcatacaaaatacctatccaaagtggtcgtggagatataattaaggctggtcttggacatatttaattaacatctaccaattcatcgacatggactttttctaaacgttcgattggtgataatagttcccttattggaaacactcttcatgacttttattacaatacaaccatattaagttaaattttgtacattgatgaaccaccatatcatccaatatctgcagcgataggtcacacgaaaggagttgttatttcgaatacaccaaga

SEQ ID NO: 2267 - DNA, 415 bp, Diabrotica virgifera
  Clone ID: LIB150-037-Q1-E1-E9
acgaagttttttctcactaaagatttgctgtattttcagcactttgcaatttataaatcagtaaaatggttgcccaaaagaaacagaagaaggcgattgaaagtatcaacagccgtttggctttggtaatgaaatctggcaaatattgtctgggatacaagcagaccttaaaaacattgagacaaggtaaatcaaaaacttattatcatttctaacaacactcctcccctaaggaaatccgaaattgaatactacgctatgttggctaaaactggagtccaccattattctggaaataatgtagagctaggcacagcatgcggaaaatacttcagggtgtgcgctatgtccattacagatcccggagacagtgatatcattagattcatgcctgcatctgaaagttgtgaaaaat

SEQ ID NO: 2268 - DNA, 266 bp, Diabrotica virgifera
  unsure (1)..(266): unsure at all n locations
  Clone ID: pGUT1617
ctagtgccaatattcggcacgagcgagagagagagagaactagtctcgagttttttctcattaaagatttgctgtattttcagcactttgcaatttataaatcagtaaaatggttgcccaaaagaaacagaacatggcgattgagagtatcatctgccgtatggctttggtaatgaaatctggcaaatattgtctgggatacaagcagaccttanaaacatcgacacaaggtatatcaaaacttattatcatggctaacaacactc

SEQ ID NO: 2269 - DNA, 197 bp, Diabrotica virgifera
  Clone ID: pGUT2083
ctcgtgcccgattccggacgaaggaaccccgaagggtcaaagaaggaaattcattcccgtttcgactgtcaaagttggatgtttgtatgacggatagcgtttcggcgtcgtccgcttcttatattcttcgtgtcgatgtcgaacgcgtgcacttttcctctagtaggacgtcgcgatccgttgggtgtctgtctaag

SEQ ID NO: 2270 - DNA, 309 bp, Diabrotica virgifera
  unsure (1)..(309): unsure at all n locations
  Clone ID: pGUT493
tcggcaccaggtccgatcgccatcaaacacagaacgtgcttgctacgggccgaacgctaactgaagtancggccctgcgccattagtataccgtcgagcgagtctgtcggaacatcaagggtccgcataattaaaaattacgcgggctccacctcgagtcttagacagacacccaacggatcgcgacgtcctactagaggataagtgcacgcgttcgacatcgacacgaagattatnacaagcggacgacgccgatacgctatccgtcatacaaacatccaacttcgacagtcgaaacgcgaatgaatt

SEQ ID NO: 2271 - DNA, 406 bp, Diabrotica virgifera
  Clone ID: LIB149-019-Q1-E1-E10
gtggattaaaggagacggaatcacgattcaaggaacagaaagtcatttgctaaatggtcgtggtgaactatggtgggacggacatggtgaccacagcaataaaaagaaacctcaattcatgttaattcaggcaacaggaaattcacttttaaaagacattaaagtaaagaattgtcctcacacatgcattggtatatcggattcccatgatattactcttcaacactggactattgattgccaagatggagatacaaaaggaggagctaataccgatggatttgatattgcaaaatcgtacaaagtaacaataaaagatactacagtaaggaaccaagatgattgtatttgtgtaaatcaaggtcagcatttggttttccaaaacatgcactgcattgggggccat

SEQ ID NO: 2272 - DNA, 346 bp, Diabrotica virgifera
  Clone ID: LIB3026-017-Q1-E1-C9
acccacacgtccgcggacgcgtgggtcaatgtacaacaagattacaatggaggtggttcttcaggatatgcaacaagcaatattcaaattaatggtttgcatcttcagagtgtcactggatctttaaaatcaggtaaggctgtctatattctatgcggaaataaggcttgttctaactttaattggtccagtatctcaatatatggaggaaacgagaagaacggctgtaattaccatcccaatggatttagttgttaattaaaaataattatttgatataatatttatatttatgagctaataaagagttatataaataaaaaaaaaaaaaaaaaaaaagggcggc

SEQ ID NO: 2273 - DNA, 272 bp, Diabrotica virgifera
  Clone ID: LIB149-020-Q1-E1-C11
ctcagaagtcttagaccattagacacagatacagttatgaaatcggtagctaaaacacaccatcttatatcagttgaattaggttggccaacatgtggtatcggcgctgaaattctcgcaagaataatggaaaccgaaaccttcttccatctagaccaaccagccatcagaatcacaggtgccgatgttcctatgccatacgcgaaatccttagaagccgccgcccttccaacagccaaaggatttcgtcaacccaccgaaaagccaattga

SEQ ID NO: 2274 - DNA, 404 bp, Diabrotica virgifera
  Clone ID: LIB149-020-Q1-E1-C12
atgcaaaactcaacacagagtcgtattaccattacacacagatacagttatgaaatcggtagctaaaacacaccatcttatatcagttgaattaggttggccaacatgtggtatcggcgctgaaattctcgcaagaataatggaaaccgagggcttcttccatctagaccaaccagccatcagaatcacaggtgccgatgttcctatgccatacgcgaaatccttagaagccgccgcccttccaacagccaaagatgtcgtcgacgcatcgaaaaagctattgaaagtcaagtagatctcgtaaaattatccagtaacaaatcatcataatacatccgatcaacactatgaaactgcaaggaagaaagttcaaagttgaattctgaatgcattggattcgagtg

SEQ ID NO: 2275 - DNA, 419 bp, Diabrotica virgifera
  Clone ID: LIB3026-021-Q1-E1-B7
acgcccacgcgtccgtgaaaacgacatcatttacaacaaagagagaaactatttttatcgtgcatggatggaaggatagccataaggcagatgttaattctcatgtcagagaatatatactcagggaccacgatgttaatatctttgtcgtcgactggagtccaattgctggaaaaggttacttaacagcacaggggtctatgcaaaaagttggaggatatatagcagacttcgccagatctctgaataaaaaatacggtttacaacttaataagttgaaatttgtaggtcattccctgggtgctcatatctgtggatgtgctggagctgctttggatggacaagtcgacagaattgttggtttagattcagctggtcctctattcagagaagagagaacagacaaccgtattgacgct

SEQ ID NO: 2276 - DNA, 444 bp, Diabrotica virgifera
  Clone ID: LIB149-026-Q1-E1-B8
acttccgatgatattaaagtttattttagaaacaaagatcatcctgagagttcagtaccaatagacattaacgatagttcggaagtcgatgcgttgggattttcaccaaataaagatacaatgtttgttgtccacggctggcacaacggtcacgactcgccagtctgcgatgagatatccaaagctgtcctccagaacgacgacataaacgttttcctaatcgattggaacaaaatcgccagcaacctctacttagtagcttacaaagcagttccagaggtcggtcaattactaggaacactcattagaaatttggtcaacaacaataaattggatttgaataaagcttctatcgttggccattctttgggagctcatgtcgctggattggccggagctgaactcaacggacgggttagtaacattgtaggtctggaccctgct

SEQ ID NO: 2277 - DNA, 395 bp, Diabrotica virgifera
  Clone ID: LIB150-044-Q1-E1-A11
tcatcatcacacgcaccgacaagatagcacccgagttcggtttctttgctccacgcgtgcgcatcaacatgagaattctcgctctttgtatgggcaaccacgaactgtacatgcgcagacgtaaacctgatactatcgacgtgcaacacatgaaagcgcaagcgcgtgacgaatagatggcgaaacaacagcagatcgaaaagctccagtctgaaatagcggcaagagaaatggccgataagaaacagcaagagtatgaagatagaatcaaagccatgcaagaagagatggacagaagtctagctaactatatggaagctcaagagatgattagacgattggacgaacgattgaaacaattgcacgctgccatagaagaaatggaatagagaccg

SEQ ID NO: 2278 - DNA, 411 bp, Diabrotica virgifera
  Clone ID: LIB150-002-Q1-E1-A7
cgaaaccaaggaaactgccatggacaaaatccacagagagaatgttcgtcaaggaagagacaaatacaagactcttcgtgaaatccgcaagggcaacaccaagcgcagagtcgaccaattcgaaaatatgtaaattgtttttaaccttcatatcaaacaatctaggagtcctacctattatttcgagttaaaaaaaaccaatattactaaagaacctttcaatgctcaacgcgagatgatcattttttcaaaatacttttaaaaaatatttttaagtttttcggttcagttattacttaacacgttaagtattattcttatattttctttttgatatgtattagagccctattggctcagttaagtggccttagaagttaactactttttgctttgttagattattttgct

SEQ ID NO: 2279 - DNA, 392 bp, Diabrotica virgifera
  Clone ID: LIB149-048-Q1-E1-A4
gagaaacctcaccgtcgatcgcttgtgtgacattctgttggatgaatctatcgggcctgaaatcaatcgcttggcagctgttaataatttgattcttgacgtggatggtgagaagtgtttggattatagttataataagctgatcgacgtgatgaaggatgttagttgggacggcgatgctgctgagggaagtcgtcaatggacatatcaaacctgtacagaatttggttattatcaaacttcctcctacaaacctcatatatttggcacccgatttccacttagtttctccattcagcaatgccaagatattttcggatcttcatacaatgaaacgtttctaaatcatgctatagaaaggacgaacgttctttacggtggtttagacattg

SEQ ID NO: 2280 - DNA, 402 bp, Diabrotica virgifera
  Clone ID: LIB149-045-Q1-E1-H12
cgatacacgcatctaaaggaattcataataaaaacctcaccgtcgatcgcttgtgtaacgttcttttggacgaatctaccggacttgaaatcaatcgcttggcagctgttactaagttaagtcttgacgcggatggtaatagctgttttgattacaattataataatatggttgactctatgaaggaagttagttgggatagcgatgctgcctatggaagtcgccaatggacatatcaaacctgcacagaatttggttattttcaaacttcctcttacaaacctcatatatttggtacccgatttccacttagtttctccattcagcaatgcctagatactttcggatctttatacaatgaaacgtgtctaaaccatgctatagagaggaccaacgttctat

SEQ ID NO: 2281 - DNA, 391 bp, Diabrotica virgifera
  Clone ID: LIB150-049-Q1-E1-D5
agcccacgcgtccggtcatttgtcatataaatagcaaccgcgccaagaaaatcatcaagttcgtttggaaagctgcattactagctaatctgaacgtctgtcgtaattttgtttcatttgtggtgtaaaagttaaaactcatcaaccaaaatgcgtgaatgtatctcagtccatgttggccaagccggagtccaaatcggtaatgcctgctgggagttgtactgcctggaacatggcatccaacctgacggtcagatgccatcagacaagactgttggaggaggagatgacagtttcaacacattcttcagtgaaactggtgccggcaaacatgtacctagagcagtatttgtagatttggaaccaacagtaatagatgaagtacgtaccg

SEQ ID NO: 2282 - DNA, 386 bp, Diabrotica virgifera
  Clone ID: LIB150-007-Q1-E1-D12
ctgaattatcaggtgatctgcaggtcagtcatcattttgtatcaattgtggtgataatagtttaaacacatcattgaagatccttgcatgtatctcagttcatgtaggtcaagccggggtctaaatcggtaatgcctgctgggagttgtcctgcccgcaacatgggatcgaacctggaagtcagattcatcatacataactgttggaggacgcgatgatagtttcatcacattcttcaatgaaactggtgcccgcattcatgtacctaaatcagtacttgtacatttggaactaagagtacttgatgaagtacgtacaggaaaatatcgtcaattgttccagtcagactacctcatcactggcaatcaacatgacggcaattacta

SEQ ID NO: 2283 - DNA, 325 bp, Diabrotica virgifera
  Clone ID: LIB3026-033-Q1-E1-C8
caaacgcgtccgaagcactgccacaatgggtaaaataatgaaatcaggaaaagtcgtattggtcctcgggggccgatacgccggcagaaaagccgtagtcgtcaaaacctacgatgaaggtacatcagataaacaatacggacatgccttagtagctggaattgataggtacccaaggaaaatccacaaacgcatgggcaaaggcaaaatgcacaagaggtccaagatcaagccttttatcaaagtattgaactacaaccatctcatgcccactagatactctgtagatttggcatcagacttgaaagttgtacccaagggactc

SEQ ID NO: 2284 - DNA, 335 bp, Diabrotica virgifera
  Clone ID: LIB3026-028-Q1-E1-A8
cccactcatcagttgtcatttcactgccacaatgggttttttagtgaaatcaggaaaagtctttatggaccgcgggggccgtaacactggcagaaaatcctttatcttcaaaacctacgattttagtttatgtaccttgctgtaccagggatccttaattactggttatgaaatgaacactttgaaattccacagacccatgggcttaggctttttactcgtgaggtccatatttcagccatttatcatggtatggaacgtcaaccatctcaagcccactacatattctgtagatttggcatcagacttagttattgtacccatagtcctcatta

SEQ ID NO: 2285 - DNA, 348 bp, Diabrotica virgifera
  Clone ID: LIB150-013-Q1-E1-F11
gtcggccataactatcgaaggaccgaatttccaagaccaaaaatgttttccgccttcttcaacaaggcctcttgccaggctttacctgaaaaccaaactttaccacaaccagttgacgactcaccaagggcattagtaaaatcattggtagctggaagacagattgcagcagctgctgctgctgaaggtgacagttgtgaatttggatcagcacactactttgctccttgtggtctaagaggtatcctctcatgtggtatcactcacacagctgtagtaccacttgatttagtaaaatgccgtatccaagtagatcctgctaaatacaagagtgtaattaatggtttt

SEQ ID NO: 2286 - DNA, 286 bp, Diabrotica virgifera
  Clone ID: LIB150-021-Q1-E1-B3
agtcggccataactatcgaaaggaccgaattttcaaaaacaaaaatgttttccgccctcctcaacaaaggcccctgccaagctttacctgaaaaccaaactttaccacaaccagttgacgactcaccaagggcattagtaaaatcattggtagctggaagacagattgcagcagctgctgctgctgaaggtgacagttgtgaatttggatcagcacactactttgctctttgtggtctaagaggtatcctctcatgtggtatcactcacacagctgtagtaccact

SEQ ID NO: 2287 - DNA, 648 bp, Diabrotica virgifera
  Clone ID: pGUT3274
gttacaatgaatttaacaaacataaatgcagtaggtcttcaacttcagtacaaccaaccccacatctacctgcagcaggtactctcagatattaaaactcgtgtaccagatctagcaagtgcagctcaaaatgtcactgttaagtccgctccattctatcgtgttgcccaaatctattcaaagaagaaagtggcctttacctcattcgccaaacacagaaaattcaaccaggaactgtacgaagatctggtggctccatacttaaaacaagatttagtggttgaaacatggccaaatggggctggtagattacattccaattgtagccgtgtatataaggtaaacaatattcagaagatcaatatgtctgtcgttaacgtatcatttaatacgactagcgaccattccaaatgggctgtaacttcaaattccagcagttcatggagttgtgtaggagatatcaatcgtgcgcaacatcaactggaaagaggtggtggaactgtgtgcctacaaaatcaaaaattatctacaaatttccacaagttaattagtgccgtagaagagtgcccaagaaaggagtcctttgatattccgacagtgataaatggtataaaatttattaatataaataatatatattctgtagag

SEQ ID NO: 2288 - DNA, 541 bp, Diabrotica virgifera
  Clone ID: pGUT2530
attttatacattaatcactgtcggaatatcaaaggactcctttcttgggcactcttctacggcactaattaacttgtggaaatttgtagataatttttgattttgtaggcacacagttccaccacccctttccagttgatgttgcgcacgattgatatctcctacacaactccacgaactgctggaatttgaagttacagcccatttggaatggtcgctagtcgtattaaatgatacgttaacgacagacatattgatcttctgaatattgtttaccttatatacacggctacaattggaatgtaatctaccagccccatttggccatgtttcaaccactaaatcttgttttaagtatggagccaccagatcttcgtacagttcctggttgaattttctgtgtttggcgaatgaggtaaaggccactttcttctttgaatagatttgggcaacacgatagaatggagcggacttaacagtgacattctgagctgcacttgctagatctggtacacgagttttaatatctgagagtacctgc

SEQ ID NO: 2289 - DNA, 432 bp, Diabrotica virgifera
  Clone ID: LIB150-012-Q1-E1-H9
cacacgcgtccgaaaccatcaagatgtccatggttccacttcttttccgtgactggtgggatgaagaagacctcatgcgtccttccagacttctcgaccaacaattcggtttgggattaagaagagatgatcttcttaactcgataagagatatacccagaagatctgcattgtcgtccagatatattagaccatgggctacatccactgccctacaaagacaagattccggctcaaccattacacaagaccagaataaatttcaggttattttagacgtccaacaattcgctcctaacgaaatcactgtgaaaaccaacgggaacagcatcttggtagaaggtaaacacgaagaaagacaagacgaacatgggtatataatgagacactttgtcagacgatacgttcttccacaaacccacgatgccgaaa

SEQ ID NO: 2290 - DNA, 376 bp, Diabrotica virgifera
  Clone ID: LIB150-046-Q1-E1-D7
acagattcagtcagttaatttagaactgaaaatttatattcgcagcgcgaacaataagtaatttacaatgtagtcgtcaagtgaaaaatgtctctgataccgctaccatatttttttggcgatggaccctacagcagatcatcaaggctatttgatcaacattttggtcaagttttggaaccggaagatttgctacaacctatctcaagacagttcctcagatgtcctgccggctatctcagaaactggcagtctgcgtcgtctggaaatgattccggctctacaatacatttacgagaagaccagttctcagccaacttggatgttcagcagtttaaacccgatgaaatatctgtgaaagttaccggagaccggg

SEQ ID NO: 2291 - DNA, 676 bp, Diabrotica virgifera
  unsure (1)..(676): unsure at all n locations
  Clone ID: pGUT3293
ctacactgttctttggcttgtagatagcggacgtgatataaaatacaaaaatgtttgcctgtgctagactgattgcccctgccaccagaagcgcactcgttgccaacacaaaacaatacttgaggccactgagcagtgtagtaaaccaaagtcaaatacaggtacagaatgtgcaacaacacaagcaacctaccctcctccccgctatccgcagtttccaaactacaccagtcagcagagacattgactctgcagctaaattcattggtgctggtgctgccacagttggagtagctggatcaggagctggtattggaacagtgttcggttcactcatcatcggttacgccagaaaccctagcctaaaacaacaactcttctcatacgccatcttagggttcgccttgtccgaagctatgggtctcttctgtcttatgatggcgttcttgttattgttcgccttctaaataatcggcctttacgggcaacatcatcttattccaccgttcgttacgtcaacaccatgtaactcatatttttaacttanataaaattcaataggacttttattaatttaatgtgcgcgctctggatgaatatgtgtccaattcttttcatttctactaacatcgagagaatttgggcttactttcaacgaagaatggcatgtatttat

SEQ ID NO: 2292 - DNA, 612 bp, Diabrotica virgifera
  unsure (1)..(612): unsure at all n locations
  Clone ID: pGUT3314
gatagcggacgtgatataaaatacaaaaatgtttgcctgtgctagactgattgcccctgccaccagaagcgcactcgttgccaacacaaaacaatacttgaggccactgagcagtgtagtaaaccaaagtcaaatacaggtacagaatgtgcaacaacacaagcaacctaccctcctccccgctatccgcagtttccaaactacaccagtcagcagagacattgactctgcagctaaattcattggtgctggtgctgccacagttggagtagctggatcaggagctggtattggaacagtgttcggttcactcatcatcggttacgccagaaaccctagcctaaaacaacaactcttctcatacgccatcttagggttcgccttgtccgaagctatgggtctcttctgtcttatgatggcgttcttgttattgttcgccttctaaataatcagcctttacgggcaacatcatcttattccaccgttcgttacgtcaacaccatgtaactcatatttttaacttaaataaaattcaataggacttttattaatttaatgtgcgcgctctggatgaatatgtgtncaattcttttcatttctactaacatcgag

SEQ ID NO: 2293 - DNA, 643 bp, Diabrotica virgifera
  unsure (1)..(643): unsure at all n locations
  Clone ID: pGUT3428
gtcacctcaaagcaaaatcaggtgcctacatagaccttaaatctgtcaaacctaacgaatccacaacagcaactttaaaatcactcagtatgtccaacttaaaaagtgacgctatcttcgaatttatcattgaccaagtcaaggctgatcccagcaaagccaaatctgttggtggagtcttcttgtacaatattacaaaggatggcaaacaagttaaacaatggaccatggatttgaaaaatgctaaggtctttgaaggaaaacctgaaggcaaaccgaacacaaccttgaccatctcagatgatgatttcatgcaaatggctgaaggaaaacttaaccctcaacaagctttcatgaagggaaaactcaaggtcaccggaaacatcatgttggcacaaaaattagcacctcttcttaagaccaatgctaaactgtaaacgtcactttaaattaagtttaaaatgaatatttctgttaaactatttttttacgttgtgtctggtatagcaatgcgaggtgattgttaaaaattatatttttttggttaagctggtatctttattttagcagatttttacacttttttgtctaaaggaaactgatgtttatattatacattntatatnatacttgaatatataaa

SEQ ID NO: 2294 - DNA, 446 bp, Diabrotica virgifera
  Clone ID: LIB3026-032-Q1-E1-F8
ccacgcgtcagcaaacgcgtgggcggacgcgtgggcggacgcgtgggcttcgcggaactcgaaacgaacagttctcctgtcacgtcaaggcaaaatcaggtgcctacatagaccttaaatctgtcaaacctaacgaatccacaacagcaactttaaaatcactcagtatgtccaacttaaaaagcgacgctatcttcgaatttatcattgaccaagtcaaggctgatcccagcaaagccaaatctgttggtggagtcttcttgtacaatattacaaaggatggcaaacaagttaaacaatggaccatggatttgaaaaatgctaaggtctttgaaggaaaacctgaaggcaaaccgaacacaaccttgaccatctcagatgatgatttcatgcaaatggctgaaggaaaacttaaccctcaacaagcgttcatgaagggaaaactc

SEQ ID NO: 2295 - DNA, 399 bp, Diabrotica virgifera
  unsure (1)..(399): unsure at all n locations
  Clone ID: pGUT2084
ttgcaactgacttgaagtaatgcgctggacctgaagcaaaggttaactcggacttataattaagtgtgggatcgtcacattgcttcaagtcagttgcaaatattcaaaaggaaatagtaaagaatggtcctgtagaagcaacttttgacgtatacagtgacttcctgaattacaaaagtggtgtttatcaacatgtcgctggacatatgtaggagggcatgccgtcagaattttaagttggggagaagagaatggagtagcttattggttggttgctaattcatggaatgaagattggggagacnnagggatgtttanatacttcgcngagaaagtgaaatgccgttcgagggatggtgtgttgccgcacctgcatatggttaatcctacataaacaaa

SEQ ID NO: 2296 - DNA, 378 bp, Diabrotica virgifera
  Clone ID: LIB150-048-Q1-E1-E7
tgattaatagaattgtgacagtttaaattgttgcttcagaatagagagaaaaatgattccgctgttacttctgttgataccgtattgttctggtctaagaatggatatagttacacattcatctgatgaagtcactaactctaaagagcttcatccactatctgatgaattcattaactccatcaatgcagcaaaatccacatggactgcaggaagaaattttgctcaggacaaatcaatggactatatcattaaattgatgggggtattacctgaccataagaactatatgcctcctgtattgacacataaactagaagctctagaaattccagccgatttcgatgctcgtcagcaatggccacattgcccaacaat

SEQ ID NO: 2297 - DNA, 417 bp, Diabrotica virgifera
  Clone ID: LIB149-012-Q1-E1-A1
gatcgtagttgaataggcgttaactttgtgtgttttggcaggtccgatggctgcaataagaaaaaaattggtgattgttggtgacggagcatgtggaaaaacatgtcttttaatagtatttagtaaagatcagttcccagaagtatacgtgcccactgtattcgaaaactatgtggcggatattgaagtagatggaaagcaggtagaactcgccttatgggataccgcaggtcaagaagattatgatcgtctgcggcccctttcatatccagacaccgatgtgattttaatgtgcttctcagtagactcccccgactcattagaaaacatcccagaaaaatggaccccagaggtaaaacacttttgtccaaatgtgccaattattctggtaggcaataagaaggatctgcgtaacga

SEQ ID NO: 2298 - DNA, 421 bp, Diabrotica virgifera
  Clone ID: LIB149-003-Q1-E1-G1
gggccgacgcacgcgtccacccacacgtccggttcgtagttgaatacgcgttaactttgtgtgttttggcaggtccgatggctgcaataagaaaaaaattggtgattgttggtgacggagcatgtggaaaaacatgtcttttaatagtatttagtaaagatcagttcccagaagtatacgtgcccactgtattcgaaaactatgtggcggatattgaagtagatggaaagcacgtagaactcgccttatgggataccgcaggtcaagaagattatgatcgtctgcggcccctttcatatccagacaccgatgtgattttaatgtgcttctcagtagactcccccgactcattagaaaacatcccacaaaaatggaccccagatgtaaaacacttttgtccaaatgtgccaattattctggt

SEQ ID NO: 2299 - DNA, 406 bp, Diabrotica virgifera
  Clone ID: LIB150-033-Q1-E1-B4
taaaattagacttataaggttaagtttgtgtaatttgcagtaatttgtcattattaaaagatttacaattgttgattgtgcagtaacagttaattagggcggaaccggtaaaagtacaagaatacaaagaagaagtaaagaaacaggctgaatcattagtactcaaaggatttccagaaactatcgtaaaattgaacagtatcctcgaaacgtctcactttaaaaacagaagcttcaacgatgttcatcaagacttaaacataccaatcccagagccaatcatcttgaacagtcacagtgagctgccagtggcaaaaaaggccaaactggaccccagcctcatccaggatggcactaaagttatgattctacctactggagcagtttccactaacaaaaatatagt

SEQ ID NO: 2300 - DNA, 454 bp, Diabrotica virgifera
  Clone ID: LIB150-029-Q1-E1-D2
gcaatttcagtggctaacttcctttctctaaacacgttaagttatccagtctattttttaggttaagtttgtgtaatttgaaggtaatttgcagtaatttgtcattattaaaagatttacaagtgttgagtgtgcagtaacagtttattatggctgaatctgtaaaagtacaagaatacaaagaagaagtaaagaaacaggctgaatcattagtactcaaaggatttccagaaactatcgtaaaattgaacagtatcctcgaaacgtctcactttaaaaacagaagcttcaacgatgttcatcaagacttaaacataccaatcccagagccaatcatcttgaacagtcacagtgaactgccaatggcaaaaaaggccaaactggaccccagcctcatccaggatggcactaaagttatgattctacctactggagcaatttccactaacaaaaa

SEQ ID NO: 2301 - DNA, 428 bp, Diabrotica virgifera
  Clone ID: LIB150-013-Q1-E1-B10
cccacgcgtccgatttagtcaaaaaggtactttgaaaacacatttgagagtgcacactggagaaaaaccctacaagtgtgaaacttgtttaaaacagtttagggaagcatatactttaaaagcacatttggtagtgcacactggagaaaaacctcacaagtgtgaaatttgtttcaaagagtttagtacagtaggggatttgaaagcacatttgagaacacatactggaataaaaccgtataaatgtgaaatttgtgaaaaacagtttagtagaacaagtgatttgaaaagacatttgaaaatacacactggagaaaaaccctacaagtgtgaaatttgttttaagcaatttagtcaaaacagtattttgaaatcacatttgagagtacacactggagaaaaaccctacagtacaagtgtgaaacttg

SEQ ID NO: 2302 - DNA, 446 bp, Diabrotica virgifera
  Clone ID: LIB150-020-Q1-E1-F2
ggtcgacgcccgcgtccgagcagatcatttgaaaacacatttgagagtgcacacgggagaaaaactttacagtgtgaaatctgttttaagcaatttattggaacagattatttgaaaaaacatttgagggtccatactggagaaaaaccccacaagtgtgaaatctgttttaagcaatttagtgaagcaggtactttaaaaagacatttgagagtacacactggggaaaagccttataaatgtgaaatttgttctaagcgatttcgtcaagcagtcactttgaaaaaacatctgagagtgcacactctagaaaaaccttaccagtgtgaaatttgttttaaacagtttaatagaacagatcatttgaaaacacatttgagagtacacacgggagaaaaacctcacaagtgtgaaatttgttttaagcaatttattggaacatatga

SEQ ID NO: 2303 - DNA, 442 bp, Diabrotica virgifera
  Clone ID: LIB150-019-Q1-E1-A5
acgcgaccgtgagtactaagcactttcgtttatctcgtttaaaatttgtctttgagtttttaagaaatatgagggtggaaatttttttgctaattcttattgcagctgtctgttattccattccgaccatacctgatttggatgactttgaagaactgaaaacaaaatgtgataagaggggaggaaatggcacatttgcaaaaataaagacttccatagatgaaactcaaacttgtattgaagacctgatcgacatcgataagtttgctgaagaacttgaagagtccaaaaagacaggatctatggatgaagtatttgccaaatactgcaaaaaacgccctgatgtcaggaaatgtataaaaaaattttatgatgcccttgaaccatgcttagacgaagcagaaaagaaaggtcttaattttcacctatagcattttaaccg

SEQ ID NO: 2304 - DNA, 422 bp, Diabrotica virgifera
  Clone ID: LIB150-045-Q1-E1-B2
tgcagggtatcatgcaatttcgtttatctcgtttaaaatttgtctttgagtttttaagaaatatgagggtggaaatttttttgctaattcttattgcagctgtctgttattccattccgaccatacctgatttggatgactttgaagaactgaaaacaaaatgtgataagaggggaggaaatggcacatttgcaaaaataaagacttccatagatgaaactcaaacttgtattgaagacctgatcgacatcgataagtttactgaagaacttgaagagtccaaaaagacaggatctatggatgaagtatttgccaaatactgcaaaaaacgccctgatgtcaggaaatgtataaaaaaattttatgatgctcttgaaccatgcttagacgaagcagaaaagaaaggtcttaatttcacctat

SEQ ID NO: 2305 - DNA, 467 bp, Diabrotica virgifera
  Clone ID: LIB3026-009-Q1-E1-D8
ggatttggaaggtacaaaatgaccaactctaaaggttaccgccgaggaaccagggatctatttgcccgcaagtttaaaaaacgtggtgtaattccactttccacatatttgagagtctacaaagttggagatattgtagatatcaagggtaatggtgcagttcaaaagggtatgccccacaaagtgtaccatggtaagacaggacgtgttttcaatgttactgcacatgcattaggtgtaattgtaaacaaaagggttcgaggaagaatcatccccaaaagaatcaatctccgtattgaacatgtaaaccactccaagtgtcgtcaagacttcttgcaaagagtaaaatccaacgaaaagctacgtaaagaagctaaagaaaagaacgttaaagtagaacttaagagacaacctgcccaacctaggccagcacatattgttagcggaaaggttccagcacaggtgct

SEQ ID NO: 2306 - DNA, 466 bp, Diabrotica virgifera
  Clone ID: pGUT2372
gcaagtttaaaaaacgtggtgtaattccactttccacatatttgagagtctacaaagttggagatattgtagatatcaagggtaatggtgcagttcaaaagggtatgccccacaaagtgtaccatggtaagaccggacgtgttttcaatgttactgcacatgcattaggtgtaattgtaaacaaaagggttcgaggaagaatcatccccaaaagaatcaatctccgtattgaacatgtaaaccactccaagtgtcgtcaagacttcttgcaaagagtaaaatccaatgaaaagctacgtaaagaagctaaagaaaagaacattaaagtagaacttaggagacaacctgcccaacctaggccagcacatattgttagcggaaaggttccagcacaggtgcttgctcctatcccatatgaattcattgcttaggtttgtttatcttaaaataaaatcctttatataat

SEQ ID NO: 2307 - DNA, 390 bp, Diabrotica virgifera
  Clone ID: LIB149-010-Q1-E1-C2
gtttttatcccgtgagatatttttgcagtccttttaataaaattcttcataattcaccatgaagggctgcgttttcaacatcgacaacggttatttggaaggcctgtgtcgtggctttaaatgtgggatcctgaaacaatccgattatttgaatttggtccagtgtgaaactcttgaagatttaaaactgcacttgcaaggcactgactatggaacttttttggccaatgaaccttcacctttgtcagtatccgtcatcgattcaagacttcgagaaaaactcgtgattgagttccagcacatgcgtaaccaagcagtagagcctctctcgacatttatggacttcattacctacagttacatgatcgacaacataattttgcttattac

SEQ ID NO: 2308 - DNA, 372 bp, Diabrotica virgifera
  Clone ID: LIB149-010-Q1-E1-A4
acgcgtccagttaatatcccgtgagatatttttgcagtccttttaataagattcttcataattcaccatgaatggctgcgttttcaacatcgacaacggttatttggaaggcctgtgtcgtggctttaaatgtgggatcctgaaacacgccgattatttgaatttggtccagtgtgaaactcttgaagatttaaaactgcacttgcaaggcactgactatggaacttttttggccaatgaaccttcacctttgtcagtatccgtcatcgattcaagacttctacaaaaactcctgattgagttccagcacatgcgtaaccaagcagtatagcctctctcgacatttaagggcttcattacctaaagttacat

SEQ ID NO: 2309 - DNA, 347 bp, Diabrotica virgifera
  Clone ID: LIB149-041-Q1-E1-F4
ccgtccgagcacagacagacgtctacaatttcatgttgaaactcgatggaaccgtaaacaaatccaatttgggggcaaactcaatcttgggtgtgtcacaacccgttgccattaccggagccgcaaataagggattaccattgtacatacatgtagctgatttgtctggaaacaaagacatcattttgcacgttcctgccttcaacgtcatcaatggtggatcgcacgctggtaacaagctatctatgcatgaattcatgatgcttccaactggagctgccaacttcacagaagccatgcgcatgggaagcgaagtctaccatcacctcaagaaagtcaacaaggat

SEQ ID NO: 2310 - DNA, 423 bp, Diabrotica virgifera
  unsure (1)..(423): unsure at all n locations
  Clone ID: LIB149-039-Q1-E1-E2
ctttgcttcagccggttgacagacgtctgggtggtgcgattttatatccagaaaatatcaaatagctgctcttcaaagatgcccatcaaaagcatcctcgctcgccaaatcttcgactctcgtggtaaccccaccgtcgaagtcgatctcgtcaccgaattgggattgttccgtgctgctgtaccatctggagccagtactggtatctacgaagctcttgaactccgtgacaatgtcaagggagaataccacgccaaaggtgtcaaaactgccatcaacaacatcaattccataatcgcacctgaactgatcaaatcaggcctagaagttaccgcacanacagacgtcgacaatttcatgttgaaactcgatggaaacgaaaacaaatccaaattgggggccaacgctatcttgggtgtgtca

SEQ ID NO: 2311 - DNA, 445 bp, Diabrotica virgifera
  Clone ID: LIB150-014-Q1-E1-H3
gggcccaccgacccttcggcaaagccatcgggttaaatgggggttaaattgaacaatttaacaatacaagaaatatggctccgcatcggctcagcaacacaaaccttcttcttgccgaagtaaatgaaacacagaagacacacctgtcgtccaaagaaacttaccaaccgacgcagaccactcaagctaaacctgctaaaaaggaaaaaagcgatggatcggaaatagtatggcttaatgtaatggtatttattctgctacattctgcggctttgtatggattgtggctgatgttgtccctacaaacttcatggaagacatttgtatttagcgcaatctacttatcattcgccagtacaggagtgactggaggagcgcatcgtctctgggcgcacagagcctacaaagcgaagctgcccttcaagatatggttgatgttgggaca

SEQ ID NO: 2312 - DNA, 402 bp, Diabrotica virgifera
  unsure (1)..(402): unsure at all n locations
  Clone ID: LIB150-006-Q1-E1-E1
acccacgcgtccggttacatggtggtttaagtgaaccattttactataccagaaatatggctccgcatctgctcagcaacacaaaccttcttcttgccgaagtaaatgaaacacagaagacacacctgtcgtccaaagaaacttaccaaccgacgcagaccactcaagctaaacctgctaaaaaggaaaaaagcgatggatcggaaatagtatggcttaatgtaatggtatttattctgctacattctgcggctttgtatggattgtggctgatgttgtcnctacaaacttcatggaagacatttgtatttagcgcaatctacttatcattcgccagtacaggagtgactggaggagcgcatcgtctctgggcgcacagagcctacaaagcgaagctgccct

SEQ ID NO: 2313 - DNA, 428 bp, Diabrotica virgifera
  Clone ID: LIB150-018-Q1-E1-D7
cggacgcgtgggctgaaatccaaattttttataaatataaccttaaagaagtctgtaaagatttaagcatgatttaacgaaatattaaatttttaactttaaaatgccgaactcagatattgatgataacgaaaaagtaactgggcccgtcgacaatgcatgggaactgaaaattccagaattcaaaccagaagataatccacatggattattagaggaaagtagtttcgccacattatttccacaatacagagaacaatatttaagacaagtatggcctttagttaagaaaactctgggtgaatataatataaaagcagaactagatgttgtagaaggtagtatgactgttaaaaccacaaggcaaacatgggatccttacattattattaaagcaagagatgtgataaagttaatgtctagaagtg

SEQ ID NO: 2314 - DNA, 278 bp, Diabrotica virgifera
  Clone ID: LIB150-018-Q1-E1-D3
gggctgaagtcgaggcttattagacatatgaccgctaaagaagtctgtaaagatttaagcatgatttaacgagctagtaagtttttaactttaacatgccgagctcagagattgatgataacgacaaagtacctgggcccgtcaacagtgcatgggaactgagaattccagaattcaaggcagaggataatccacatggattattagaggaaagtagtttcaccacattatttccacagtacagagaacagtatttaagacaggtatggcctttagtt

SEQ ID NO: 2315 - DNA, 389 bp, Diabrotica virgifera
  Clone ID: LIB150-028-Q1-E1-G11
gggttgtacttgggataaaagacctttttgtatttccaaatacattgtcatataaattaaaaaagaaatggctgccatcagatctatgtctcgccttcttattaatagatcacttcaaaccactgcaaagaggacctatgccgaccaaatgaacttcacatttgcagctggaaatcaggtttactatactgcaacttcagttaaacaagtagatgtgccatctttctctggtagctttggtatcctccccgcccatgtacccacactggctgtgctaaaacctggagtagtcactgtttacgaagatggtggtaatgttaagaaaatctttgtttccagtggtactgtcaccatcaatgatgattcatcagttcagattcttgctgaag

SEQ ID NO: 2316 - DNA, 423 bp, Diabrotica virgifera
  unsure (1)..(423): unsure at all n locations
  Clone ID: LIB150-029-Q1-E1-G3
cggacacgtgggttaggtttgtacttggaataaaatacccttttgtatttccaaatacattgtcatataaattaaaaaagaaatggctgccatcagatctatgtctcgccttcttattaatagatcacttcaaactactgcaaagaggacctatgccgaccaaatgaacttcacatttgcagctggaaatcaaggttactatactgcaacttcagttaaacaagtagatgtaccatctttctctggtagctttggtatcctcnccgcncatgtacccacactggctgtgctaaaacctgnagtagtcactgtttacgaagatggtggtaatgtaaaaaaatccttggttccaattggaacggtaacaatcaatgaagaatccacaattcaaaatcctggctgaaaaacccaaccaattaaaaa

SEQ ID NO: 2317 - DNA, 344 bp, Diabrotica virgifera
  Clone ID: LIB149-047-Q1-E1-A11
caagaatccatctagagtattaagttcataaggaacggagtaacacattaagcaagatgacatgattagaggaattaactcaagcaatatgatgaaaaccccatatttttatcctcaatggcaacaatacaatacgtgccttgctgcccctactatcactgggaaaggcaccgcaagattgaacccaaagctaagcacttctcccatggcaagaaagatcaatctagtaggccaaactaaaccgataattcaaagagacttgcaaagatatcaaatcatgcatatacgaattcagagaagaaccaaataatattcatagataatcttgatcataaatccacaat

SEQ ID NO: 2318 - DNA, 319 bp, Diabrotica virgifera
  Clone ID: LIB149-047-Q1-E1-A12
aattcatatagaacggtgtaacacattaagcatgatgacatgattagatgaattatctcaagcaatatgattaaaaccccatattattatcctcaatggcaacattacaatacgtgccttgctgcccctacgatcactgggaaaggcatcgcaagattgaacccacagctaagcacttctcccatggcaagaattatcaatctagtatgccaaactaaaccgattattcagagagacttgcaaagatatcaaatcatgcatatacgatttcagagaattaccatataataatcatagataatcttgatcataaatccac

SEQ ID NO: 2319 - DNA, 536 bp, Diabrotica virgifera
  unsure (1)..(536): unsure at all n locations
  Clone ID: pGUT3211
gagcgttggttttaatttattggatccgttctccatctccattcggcagcgctggtttgacacgaactcacctcacctcacttcattcaagtcccagtagccaaatcgttagtttatcagatccttccctgttctttatcaaaaaccgaaaatgtctttagacgagagattccaaaaggctgctgccgatatcaagaacttgaaaagcaagcccactgacaatgatctattagaaatttacggattgttcaaacaagctaccgaaggagactgcaccacagcccgacctggactgttggaccttaaaggaaaagccaaatgggactcgtggaacggcaggaaaggatccagtcaagacaaagctaaggaagaatacatcgcaaaagtacagtcgttgatcgatagcttaggactcgcataaggcatttttatcatcactnttttttaagggaaaactattttgttatcattatactctatggttctaataaaaacaattttcttgaaaaaaaaaaaaaaaaaacctgagggggggc

SEQ ID NO: 2320 - DNA, 456 bp, Diabrotica virgifera
  unsure (1)..(456): unsure at all n locations
  Clone ID: pGUT778
ctggtttgacacgaactcacctcacctcacttcattcaagtcccagtagccaaatcgttagtttatcagatccttccctgttctttatcaaaaaccgaaaatgtctttagacgagagattccaaaaggctgctgccgatatcaagaacttgaaaagcaagcccactgacaacgatctattagaaatttacggattgttcanacaagctaccgaaggagattgcaccacagcccgacctgaattgttggatcttaaaggataagccaaatgggattcatggaacggcaggatatggatcantcaaaacaaagctaaggaagaatacatcgcaaaagtacagtcgttgatcgatagcttaggactcgcataaggcatttttatcatcactttttttttaaagaatnactattttgttatcataatactgtatgggttctaataaaacaattttctggt

SEQ ID NO: 2321 - DNA, 361 bp, Diabrotica virgifera
  Clone ID: LIB3026-033-Q1-E1-A3
tccgaaaatttctttagctgttgtcggttaaggaacagcttacaaaatgaaattcaacagattagtaaccgcttcaagaagcaaaaataggaaaaggcatttcacaggcccatcccacatcagaagaacccttatgtccgcacccttgtctaaagaacttagacaaaagtacaatgttagcactatgccaatccgcaaggacgatgaagtacaagttgtaagggggcactacaaaggccaacaagtaggtaaagttgtacaagtatacaggaagaaattcgttatctacattgaaaggattcagagagaaaaagccaatggagctagtgtaaatgtaggaatccaaccttcaaaagttgtt

SEQ ID NO: 2322 - DNA, 460 bp, Diabrotica virgifera
  Clone ID: LIB3026-009-Q1-E1-G3
cccacgcgtacggttgtcggttaaggaacagcttacaaaatgaaattcaacaaattagtaaccgcttcaagaagcaaaaataggaaaaggcatttcacagccccatcccacatcagaagaacccttatgtccgcacccttgtctaaagaacttagacaaaagtacaatgttagcactatgccaatccgcaaggacgatgaagtacaagttgtaagggggcactacaaaggccagcaagtaggtaaagttgtacaagtatacaggaagaaattcgttatctacattgaaaggatccaaaaagaaaagccaatgggacctaatggaaaaggtaagaatcaaccttcaaaagttggtaatggtaaaactaaaatgggcaaggacaggaagaagatcattgacagaagagccaaaggacgtttggctgctttgggcaaagacaaaggaaaatacactgaagaat

SEQ ID NO: 2323 - DNA, 413 bp, Diabrotica virgifera
  Clone ID: LIB150-041-Q1-E1-E6
aaaacagtttatttttgggtttaaatattttaaaaatgtcttctccagcaccaaaatctccagaacaatcagataaaagcaagaaatatgaccggcaattaaggttatggggagatcatggacagaaacttttagaacattccaaagtttgtctgataaatgcaactgcactcggaactgaaattctaaaaagtttaattttacctggtatcgggtcatttaccatagttgatggggaaaaggttacagaagaggatataggttcaaattttttcttagaaagtgatagcattggtacatcgagagctcaagtgtccactcaatgtctgcttgaacttaatccagatgtaagaggagattttatagatgaatctccagaacatgtaatgtctcatacacaagattttttcaac

SEQ ID NO: 2324 - DNA, 371 bp, Diabrotica virgifera
  Clone ID: LIB150-033-Q1-E1-H12
accacgcgtccgccaaaatctccagaacaatcagataaaagcaagaaatatgaccggcaattaaggttatggggagatcatggacagaaacttttagaacattccaaagtttgtctgataaatgcaactgcactcggaactgaaattctaaaaagtttaattttacctggtatcgggtcatttaccatagttgatggggaaaaggttacagaagaggatataggttcaaatttttttcttagaaagtgatagcattggtacatcgagagctcaagtgtccactcaatgtctgcttgaacttaatccagatgtaagaggagattttatagatgaatctccagaacatgtaatgtctcatacacaagattttt

SEQ ID NO: 2325 - DNA, 274 bp, Diabrotica virgifera
  unsure (1)..(274): unsure at all n locations
  Clone ID: pGUT1545
cgtaacactaccattcccaccaagcaaacccagaccttcactacttactctgacaaccaacccggagtacttattcaggtatatgaaggtgaacgtgccatgaccaaggacaacaacctcttgggataattcgaacttaccggcattcctcctgcgccccgtggtgttcctcagattgaagtaaccttcgacattgatgccaacggtatcttgaacgtcacagctattgaaaaatccaccaacaaagatnacaagatcaccatccacaatgata

SEQ ID NO: 2326 - DNA, 259 bp, Diabrotica virgifera
  Clone ID: LIB150-020-Q1-E1-D8
atgcagtagagcgtacttgctgcaggtatatagttaagaattgtctgcatatcacttattacaagatggtcacaaccccatctgtaagcatcgagttaggaatcacatactcctgtgtaagattcatccaacatggcaaagtagaaattagtgctaactcacatggttatacagactcaccaacatatgtggccttcaaacatttggaacgtcacatcggagatgcttgcaagaatcaagtctccatgatccccaaaag

SEQ ID NO: 2327 - DNA, 414 bp, Diabrotica virgifera
  Clone ID: LIB3026-034-Q1-E1-F12
ctaagaggaaaaaacgaatatgatagagcacaaattttgcaatggattggctttgctgaaggtgaaattgttccagcagcatgtgcctgggtattccctatcttgggaattgttaaaaataacagtggtaatgatgagactttccaaagagcaaaggaagaccttaaatcctctttgtctattctcaacagccacttacttgcccacacttacttggtaggagagagaatcactctagctgacattgtagttgcctgcaacctattgaatgcctacaaatatgtacttgatcccaactttagaaaatcttttggtaacgtcaatagatggttcaatacacttattaaccagccacaattcatagctgtacttggagaagttaaactttgcagtgcagttgctcaacctggaact

SEQ ID NO: 2328 - DNA, 223 bp, Diabrotica virgifera
  unsure (1)..(223): unsure at all n locations
  Clone ID: pGUT237
aatcactctagctgacattgtagttgcctgcaacctattgaatgcctacaaatatgtacttgatcccaactttagaaaatcttttggtaacgtcaatagatggttcaatacacttattaaccagccacaattcatagctgtacttggagaagttaaactttgcagtgcagttgctcaacctggaactttaactgctgcagctgcaacaccaggtanaggtaag

SEQ ID NO: 2329 - DNA, 425 bp, Diabrotica virgifera
  unsure (1)..(425): unsure at all n locations
  Clone ID: LIB149-035-Q1-E1-A2
acccacgcgtccgcccacgcgtccgtacagcattaacagcttccatagccgccctttcattggttagcttcaaattgtacataaaattaaccactggaatttgtcaaagtcaagtgtgccttgctggaaaaactgcaattgtgacaggagctaacacaggaattggttatgaaacagctttagacttcgcaaaaagaggtgccaaggtaattttggcctgtagagatgaagtcaaagcaaaagaagctgttgatacgattatcactgagacccacaataagaatgtcgtttatagactagttgatttaacaagttttaattcagtccgaaggtttgccaatgatatanatagtaatgaagacaggctggacatcttactanacaatgcaggagctggaaggttgggaaatanagagactgaagat

SEQ ID NO: 2330 - DNA, 251 bp, Diabrotica virgifera
  Clone ID: pGUT111
attttagcatgtagggatcatcttaaaggaactgtagctgtccaaaatattcaaactttaacgaaaaaccagaacgtagttctaaaaattttagatttagcttcgttatcatccgttaaaaactttgccactgatattctacgaactgaggataaactggatatattagtaaataatgcgggggccttattgcttggtgatcgatagagtgaagatggtctccagtttgagatgcaaattacttactttgg

SEQ ID NO: 2331 - DNA, 437 bp, Diabrotica virgifera
  unsure (1)..(437): unsure at all n locations
  Clone ID: pGUT579
cttgtagatagcggacgtgatataaaatacaaaaatgtttgcctgtgctagactgattgcccctgccaccagaagcgcactcgttgccaacacaaaacaatacttgaggccactgagcagtgtagtaaaccaaagtcaaatacaggtacagaatgtgcaacaacacaagcaacctaccctcctccccgctatccgcagtttccaaactacaccagtcagcagagacattgactctgcagctaaattcattggtgctggtgctgccacagttggagtatctggatcaggatctggtattggaacagtgttcggttcactcatcatcggttacgccagaaaccctagcctanaacaacaactcttctcatacgccatcttattccaccgttccgtacgtcaacaccatgtaactcatatttttaacttaaataaaattc

SEQ ID NO: 2332 - DNA, 393 bp, Diabrotica virgifera
  Clone ID: LIB149-032-Q1-E1-H7
agcgtaattcactacactgttctttggcttgtagatagcggacgtgatataaaatacaaaaatgtttgcctgtgctagactgattgcccctgccaccagaagcgcactcgttgccaacacaaaacaatacttgaggccactgagcagtgtagtaaaccaaagtcaaatacaggtacagaatgtgcaacaacacaagcaacctaccctcctccccgctatccgcagtttccaaactacaccagtcagcagagacattgactctgcagctaaattcattggtgctggtgctgccacagttggagtagctggatcaggagctggtattggaacagtgttcggttcactcatcatcggttacgccagaaaccctagcctaaaacaacaactcctctc

SEQ ID NO: 2333 - DNA, 607 bp, Diabrotica virgifera
  Clone ID: pGUT3338
gttatctcttctagtttttatcaaagaagttatttttatcagaataccgaacaaacaaccagaagaaggcagtgaacatgtctctgaaacaaacagtgtcacttttacatagcaaaaatggaattaacgccgttgcacaaagagccagttcttggtggtctggtgttcaaatgggaccccctgatgtaatcctaggagtaactgaagccttcaaaaaagataacaacccaaacaaaatcaacttgggtgtaggagcttacagagatgataacggaaaaccatatgttttaccatccgtccgtgcagctgaagaaaagataaaagctaaaggtttggacaaggaatatgccccaatttctggtgtagctgaattctgtaaaagaagcatagagctcgctcttggtgaaaactcatcagttttgaaagatggtatgaacgccactgtacaaggtatctctggaaccggttccctcaggataggaggtgcttatttgaacagctttttccctggaaacacaataatctacctgccagccccctcatggtgaaaccacaaccccatcttcaaacactcatggattaagttaagacttacagatattatgat

SEQ ID NO: 2334 - DNA, 347 bp, Diabrotica virgifera
  Clone ID: LIB149-019-Q1-E1-C4
acgacgttgcacaaaaagcaagttcttgggggtcgggggttcaaatgggaccccctgatgtaatcctaggagtaactgaagccttcaaaaaagataacaacccagacaaaatcaacttgggtgtaggagcttacagagatgataacggaaaaccatatgttttaccatccgtccgtgcagctgaagaaaagataaaagctaaaggtttggacaatgaatatgccccaatttctggtgtagctgaattctgtaaaagaaacatatagctcgctcttggtgaaaactcatcagttttgaaagatggtatgaacgccaatgtacaaagtatctctggaaccggttccctc

SEQ ID NO: 2335 - DNA, 389 bp, Diabrotica virgifera
  Clone ID: LIB150-005-Q1-E2-F5
aacccacgcgtccgtaaagaaattgaattattgcttcccaaaattcaaaatgattcccaaattcaagcagccgttatcatttccggaaaaccgggagtcttcattgcaggagcagatgttaatatgctggaaacgtggaatgatgccgatgagggtatgcagaactgcctccgaggacataaacttttacaagatatcgaggacagcaaaaagccattcatttcagctattcaaggatcatgctttggtttaagcgccgaattggctttggccacgcattacagaatcggcgtttaagataagaagacctctatcgcactatcacaaattatgcggggtcttcttccacattttggggggacacacagagatctccggtgacagtgtct

SEQ ID NO: 2336 - DNA, 367 bp, Diabrotica virgifera
  Clone ID: LIB150-008-Q1-E1-F5
cacacgcgtccgtaaagaaattgaattattgcttcccaaaattcaaaatgattcccaaattcaagcagccgttatcatttccggaaaaccgggagtcttcattgcaggagcagatgttaatatgctggaaacgtggaatgatgccgatgagggtatgcagaactgcctccgaggacataaacttttacaagatatcgaggacagcaaaaagccattcatttcagctattcaaggatcatgctttggtttaagcgccgaattggctttggccacgcattacagaatcggcgttaaagataagaagactctatcgcactaccagaaattatgctgggtcttcttccaggttgtggtggcacacaacgac

SEQ ID NO: 2337 - DNA, 415 bp, Diabrotica virgifera
  unsure (1)..(415): unsure at all n locations
  Clone ID: LIB150-044-Q1-E1-B4
aaataatccaattttagggagtgaaattttcaagaatataatctgtaaacatcggcttcaagaatatcttttttaaatanaaaacaataatanaatcaaatatgactgcgcctacagccggtggtgatacanatagaggaagaaccgttgcatataaggacaaaagtaaacccgctgatgtcaggaccagtaatattaacgccgcaaaagctgtttgcgatgctatccgtacaagtcttggccctagaggaatggataaaatgatccaggctggaaatggtgaagtgacaattaccaatgatggagctacaatcttgaaacaaataaacctcattcaccctgctgctaaaatgttggtagaattatcaagggcccaagacattgaagcaagagaacggtacacatctgttgttgt

SEQ ID NO: 2338 - DNA, 422 bp, Diabrotica virgifera
  Clone ID: LIB149-013-Q1-E1-G7
aaataatctaattttagggagtgaaattttcaagaatatagtctgtaaacatcggcttcaggaatatcttttttaaataaaaaacaataataaaatcaaatatgactgcgcctacatccggtggtgatacaaatagaggaattaaccgttgcatataaggacattagtaaacccgctgatgtcaggaccagtaatattaacgccgcagaagctgtttgcgatgctatccgtacaagtcttggccctagaggaatggataaaatgatccagtctggaaatggtgaagtgacaattaccaatgatggagctacaatcttgaaacatataaacctcattcaccctgctgctaaaatgttggtagaattatcaagggcccaatacattgaagcatgagacagttacacatctgttgctgtaattgc

SEQ ID NO: 2339 - DNA, 413 bp, Diabrotica virgifera
  Clone ID: LIB149-026-Q1-E1-E2
aacaacaccacaaaacaagaaggttaaagttttccgtaatttaaggtcttttgacagtatcattggcgcttcctagtactcacaatgaagttaataaactgggaaatactaatcaggcgcttaagatcattaatggaaacccagctaaaccacatcaatttccctatcaggtaggaatgtacgtgtatacttcttccagatccgatttctgtggaggttcgcttatatctcctaactatgttcttactgcagctcattgcgttgacaaagctgtgagggtaaatatggtatttggtgctcacaacataacagatcccgaagaaaaatcccaagttaggttatcttcgacaagttttattgttcacgaaggatgggatggagataacattaacaaaaacgatatagcacttatc

SEQ ID NO: 2340 - DNA, 388 bp, Diabrotica virgifera
  Clone ID: LIB149-021-Q1-E1-F5
acaaaaacaagaaaacaagatgttaaagttttccgtaattttaggtcttttgacagtatcattggcgcttcctagtactcacaatgaagtttataaactgggaaatactaatcaggcgcttaagatcattaatggaaacccagctaaaccacatcaatttccctatcaggtaggaatgtacgtgtatacttcttccagatccgatttctgtggaggttcgcttatatctcctaactatgttcttactgcagctcattgcgttgacaaagctgtgagggtaaatatggtatttggtgctcacaacataacagatcccgaagaaaaatcccaagttaggttatcttcgacaagttttattgttcacgaaggatgggatggagataacatt

SEQ ID NO: 2341 - DNA, 419 bp, Diabrotica virgifera
  Clone ID: LIB150-006-Q1-E1-D6
agttatggtggagtagtcgattctctccataatgccgcagaacgagtatattgagcgccatcgcaagttgtatggtcgcagacttgattatgaagaaagaaaaagaaagaaggaggccagagagccccacaaaagagcgcaagtagcccgaagccttcgtggtattaaagccaagatctttaacaaagaacgcagaaatgaaaagattcagatgaaaaagaaaatcaaggctcatgaagagaagaaaatcaagaaaacaacagaaaaggtttcggagggtgccttgcctgtttatctgttggatcgtgatgtacaatctagagctaaggttttgtctaatatgattaaacagaaacgtaaagaaaaagctggtaaatgggatgttccgattccaaaagtaagaacgcaagcagatgccg

SEQ ID NO: 2342 - DNA, 148 bp, Diabrotica virgifera
  Clone ID: pGUT912
tccgattccaaaagtaagagcgcaagcagatgccgaggtactaaaagttgtcaaatcaggaaaaactaaaaggatagcttggatgataatggtaaccaaagttacatttgtcggataaagattcacgatgaatcctcccaaatttgaa

SEQ ID NO: 2343 - DNA, 412 bp, Diabrotica virgifera
  Clone ID: LIB150-031-Q1-E1-E10
caaaattctttgactatcttaccaactggtacgttagaatgaacaggaaacgtctaaaaggagaaaacggcgaggaagactgcttcgcagctctaacgactttgtttaatatccttcttaatataatcaagatgatggcacctttctcaccgttcctcaccgaaactatgtatcagtatttgaagcaactactagataccaaagcggacagcatccactatttaatgttaccacaaccgaatcaaactttaatacacgtagatatagaacgagctgttgctcgtatgcagagtgtgatagaactgggaagagtaatcagggacagaaaaacaataccaataaagtatcccttaccagaaataatcgtagtacaccgaggatcaacagtatttagatgacattatacaattgc

SEQ ID NO: 2344 - DNA, 399 bp, Diabrotica virgifera
  Clone ID: LIB150-027-Q1-E1-G5
cccacgcgtccgcccacgcgtccgcccacgcgtccgcccacgcgtccggaacttttaccgtatgtatttctcgtattcctgatgttcctgatgcaatattaaatatattgtgaattatttttatacaggacactaatttaaagatgactgaaaagaaacttcaacaaataccgagagttccagaatcggtaaattttcccgatgaagaagtaaaaatccttgcctactggaaacaaattgatgcctttaaatcatgcctgaagcaatcaaaaggaaaaccaaaatacacattttatgatggccctccctttgctactggtttaccacattatggccatatactagctggcactattaaagatgtagtcaccaggtatgctcatcaacaaggctttcatg

SEQ ID NO: 2345 - DNA, 477 bp, Diabrotica virgifera
  Clone ID: LIB150-021-Q1-E1-G11
aaagaattggtggtttgactcaagaagtaaaacaaggagacaagtttcaaatacgagatatcgcagtggaatgcttatttacaccatgccacaccagtggacacatatgttattatttaactgcacctggacaagatcctgctgtttttacaggggatacgttattcatagctggttgtggtagattttttgaaggaacagctgaacagatgtattctgcacttgttgaaaaactgggaaagttacccgataacacacgggtcttctgcggtcatgaatacacattacaaagtctaaaatttgccaaatctgtcgaccagaacaaccaagatgtactcaagataatacaatgggctgaacggcagaggaaaaaagggctaccatcggtgccatctacaattggagaagaaaagacctacaatccgtctatgagggtgactacaagcgtgatccaaaatcatgcgggctgtacatcac

SEQ ID NO: 2346 - DNA, 428 bp, Diabrotica virgifera
  Clone ID: LIB150-006-Q1-E1-B6
aaaagaattggtggtttgactcaagaagtaaaacaaggagacaagtttcaaataggagatatcgcagtggaatgcttatttacaccatgccacaccagtggacacatatgttattatttaactgcacctggacaagatcctgctgtttttacaggggatacgttattcatagctggttgtggtagattttttgaaggaacagctgaacagatgtattctgcacttgttgaaaaactgggaaagttacccgataacacacgggtcttctgcggtcatgaatacacattacaaaatctaaaatttgccaaatctgtcgaccaaaacaaccaagatgtactcaagaaaatagaatgggctgaagggcagaggaaaaaagggctaccaacggtgccatctacaattggagaagaaaagacctacaatccgtt

SEQ ID NO: 2347 - DNA, 404 bp, Diabrotica virgifera
  Clone ID: LIB3026-034-Q1-E1-D8
gtgtttcttaggatttggaaggtacaaaatgaccaactctaaaggttaccgccgaggaaccagggatctatttgcccgcaagtttaaaaaacgtggtgtaattccactttccacatatttgagagtctacaaagttggagatattgtagatatcaagggtaatggtgcagttcaaaagggtatgccccacaaagtgtaccatggtaagaccggacgtgttttcaatgttactgcacatgcattaggtgtaattgtaaacaaaagggttcgaggaagaatcatccccaaaagaatcaatctccgtattgaacatgtaaaccactccaagtgtcgtcaagacttcttgcaaagagtaaaatccaatgaaaagctacgtaaagaagctaaagaaaagaacattaaag

SEQ ID NO: 2348 - DNA, 402 bp, Diabrotica virgifera
  unsure (1)..(402): unsure at all n locations
  Clone ID: LIB150-003-Q1-E2-B2
aggattaggaaggtacaaaatgaccaactctaaaggttaccgccgaggaaccagggatctatttgcccgcaagtttaaaaaacgtggtgtaattccactttccacatatttgagagtctacaaagttggagatattgtagatatcaagggtaatggtgcagttcaaaagggtatgccccacaaagtgtaccatggtaagacaggacgtgttttcaatgttactgcacatgcattaggtgtaattgtaaacaaaagggttcgaggaagaatcatccccaaaagaatcaatctcccgtattgacatgtaaaccactccaagtgtcgtcaagacttcctgcanagagtaaaatccaacgaaaagctacgtaaagaagctaaagaaaagaacgttaaagtagaact

SEQ ID NO: 2349 - DNA, 415 bp, Diabrotica virgifera
  Clone ID: LIB149-007-Q1-E1-H10
gccaaatacaatagaaatgtcaatgacgatagcgccgtcgttttaactaactatttagatgctcaatattatggagaaattggtattggaactcctgctcaaacctttaatgtaattttcgacactggttcatcgaatctctggattccgtctagtaaatgtggatttttggaagttgcttgcttacttcataacaaatacgatgccgataaatcttctacctatgtgaaaaacgacaccagattcgcaattgcatatggttcaggggaagttgcaagacttaattcccaagatgttgttgaatttgggggtttaaaagctaagggttaattaattgccgaagctaaccaagaaacccggttaaccttccctgggggaaaatttcatgggattttaaggattggaaaacctgaaa

SEQ ID NO: 2350 - DNA, 199 bp, Diabrotica virgifera
  unsure (1)..(199): unsure at all n locations
  Clone ID: pGUT816
aaatacgatgccgataaatcttctacctatgtgaaaaacgacaccagattcgcaattgcatatggttcaggggaagttgcaggacttatttcccaagatgttgttgattttgggggtttacaagctaaggatcaattatttgctgaagctacccangaaaccggtttagctttccttgtgggaaaattcgatggaattt

SEQ ID NO: 2351 - DNA, 406 bp, Diabrotica virgifera
  unsure (1)..(406): unsure at all n locations
  Clone ID: LIB3026-019-Q1-E1-H8
agatacagctgtagttgcatgctcaaccgacagccagttctctcacttggcttggatcaacactccaaggaaacaaggcggtttgggcgagatggccattcctttgctctccgacaaatccggagccgtcgccaaggcctatggagtattggacgaagaaactggaattccattcagaggacttttcatcatcgacggaaaaggtaacctcagacaaatcaccatcaacgacctcccagtaggacgttccatcgacgagaccctccgtttagtgcaagccttccagttcacagacgagcacggtgaagtatgcccagtaggatggaaacctggccagaaaaccatgaaacccgaccccactggcagcanagactacttctcaacagtanacannaactaaattccc

SEQ ID NO: 2352 - DNA, 443 bp, Diabrotica virgifera
  unsure (1)..(443): unsure at all n locations
  Clone ID: LIB3026-033-Q1-E1-B9
acgcgtccgcacacacgtccgcccacgcgtccgaaggaaacaaggcggtttgggcgaaatggccattcctttgctctccgacaaatccggagccgtcgccaaggcctatggagtattggacgaagaaactggaattccattcagaggacttttcatcatcgacggaaaaggtaacctaagacagatcaccatcaacgacctcccagtcggacgttccatcgacgagaccctccgtttagtacaagccttccagttcacagacgagcacggtgaagtatgcccagtaggatggaaacctggccagaaaaccatgaaacccgaccccactggcagcaaagactacttctcaacagtaaacaaaaactaaattccctactttatttacgatgtattanggagtatataatcttcatgtattaatttttttaaataaaccgtttttt

SEQ ID NO: 2353 - DNA, 430 bp, Diabrotica virgifera
  Clone ID: LIB149-015-Q1-E1-D12
cacacgcgtccggaaaggtaaaagttgtgctgtgtgtatacctacattttacctgcaaccgtcgaaatgactacctcttggaactatcctgatgctgcactcagagctgaactcaagaaaatcgctgatgctatcaccgctcctggaaaaggtattttggctgccgacgaatctaccgctaccgtaggcaagcgttttgctgacatcggagtcgaaaacaacgaagagaaccgtcgtaaatacagacaacttcttttcaccaccgattcagccattggacaatacatttctggtgtaattttgttccacgaaagtttataccaaaaagccgatgatggtactccattcccagaacttcttaaacagagaggaatcattctcggcattaaagtcgactctggtgtagtacctctcttcggcagcaatgacg

SEQ ID NO: 2354 - DNA, 436 bp, Diabrotica virgifera
  unsure (1)..(436): unsure at all n locations
  Clone ID: LIB149-049-Q1-E1-G12
acccgtccataaaagttgtgctgtgtgtatacctacattttacctgcaaccgtcgaaatgactacctcttggaactatcctgatgctgcactcagagctgaactcaagaaaatcgctgatgctatcaccgctcctggaaaaggtattttggctgccgacgaatctaccgctaccgtaggcaagcgttttgctgacatcggagtcgaaaacaacgaagagaaccgtcgtaaatacagacaacttcttttcaccaccgatccagccattggacaatacatttctggtgtaattttgttccacgaaagtttataccaaaaagccgatgatggtactccattcccagaacttcttaaacagagaggaatcattcccggcattaaagtcgactcctggtgtagtactctcttcggcagcaatgacgaatgcnacacacaag

SEQ ID NO: 2355 - DNA, 415 bp, Diabrotica virgifera
  Clone ID: LIB149-023-Q1-E1-H1
aattttactttcacagatatgatgaatgaatatggatcactagttgtattttgtccattaagtgccgtcctagaacatattgccattgccaaggctttttccaagggtcgatctttagacgccacccaagaaatgttggctctgggaatatgcaacatcatgggctcgttaattcaatcaatgccagtaaccggttcctttacgagaacagcagtaaaccacgcatctggtgcaaagactccaacatgtggaataatcacaggtatcatggtgctactcgctctcggatttttgacctccacttttcaatacattccaaagagtacattagctggtgttataatggtagctatgtactatctgtgtgattttgctgcatttaaactgttgtggaaatcaaaaaaactcgatctca

SEQ ID NO: 2356 - DNA, 437 bp, Diabrotica virgifera
  Clone ID: LIB149-049-Q1-E1-B8
aatcgtgtgcaactaactatatattttagtatctgaggaatataatatatggttgtagaagtatacataggtaaatatagtatacctggaaaatacaattataaattatttttgaagattgttattaattggagcgcaaaaatatatgcaatttagtatactggcggtgagctgataaaaaatgggaaaacaaacggactctgaccgttccttgggtaccaaggtaaaggatgttatacttcagcgactagtcatattacaatggctacctaagtacaccaaaaatgatattctggcagacttaatagctggtctaacggtgggcctgaccatgatgccccaatcgattgcttacgctggcttggctggtcttcctgcccagtatgggttatatacagcgtttattggatcatttacgtatatttttgtgggcacta

SEQ ID NO: 2357 - DNA, 409 bp, Diabrotica virgifera
  Clone ID: LIB150-021-Q1-E1-C5
cccacgcgtccgcccacgcgtccggttattaaacatttatgaagttttatttataaatattccaacaaatagtttcaatataatggcaagtccaagaacaagacgtgttttacaagaattaaaacccagtaatgaaaacgataaatgctttgagtgtggaacacttaatccacaatgggtgtcagtcacatatggaatatggatttgtttagaatgttctgggaaacatcgtgggttaggagtccatttatcatttgtacgatctgttactatggataaatggaaggatatagaactagaaaaaatgaaattaggaggtaacagaaatgctcggatattttttgaagcacaaccagactggcacgatgatatgaccctacaacaaaaatacaattctaaagctgcagct

SEQ ID NO: 2358 - DNA, 449 bp, Diabrotica virgifera
  Clone ID: LIB150-044-Q1-E1-H6
ataggaggtaacagaaatgctcggatattttttgaagcacaaccagactggcacgatgatatgaccctacaacaaaaatacaattctaaagctgcagctctttacagggataagatttccactttagctcaaggaaaaccatgggatgaaaggaaatctcccgctcaaaattacacaagtaatttaattggaggcaactcattacaacattctagctcaaaaaccaatcacacttcttctgccagtacttaccaatcatcgtcttatgatacatatgagggtggttatcagaatatgaactcaccagagtttaaaaaccaaaaggaagcatttttctcaaagaaacaaatggagaatgcaagtagaccaaatgacgttccaccgagccaaggagggaaatacagcggatttggatatacaatgggaactcaactagaagcaatctcaag

SEQ ID NO: 2359 - DNA, 383 bp, Diabrotica virgifera
  Clone ID: LIB149-047-Q1-E1-G4
acgcgtccacgaaatttcaattaacaatgcttccgccatatctttgacgggaactgcagatactgacatgaagagatacgaccttatgcacaacatcaacaccagagggacctttttagtaactaaagaatgtcttccatacctaaaaaaaagtaaccatgcacacgttttgaacatctcaccacctctaaacatgagcccccattggtttaaagggcatgttgcatatactatggctaaatatggtatgtcgatgtgcgttttaggacaacacgaagaatttagaccatataacatcgccgttaatgccttatggccaagaacagccattgatacagcagcgatgcaaatgttatctggaaaagaagcttctgctcagtata

SEQ ID NO: 2360 - DNA, 316 bp, Diabrotica virgifera
  Clone ID: LIB150-030-Q1-E1-C3
catacctaaataatagtaaccatgcacacgttttgaacatctcaccacctctaaacatgagcccccattggtttaaagggcatgttgcatatactatggctaaatatggtatgtcgatgtgcgttttaggacaacacgaagaatttagaccatataacatccccgttaatgccttatggccaagaacagccattgatacagcaaccaatgcaaatgttaactggaaaaaaaacttctgctcagtatagtaagaaaccagaaattatggcagattctgcatacgcaattttaatcaaaggaccccaaatcattcact

SEQ ID NO: 2361 - DNA, 441 bp, Diabrotica virgifera
  Clone ID: LIB150-017-Q1-E1-D5
caaacgcgtccgttgagaaggtctattaagtttgttttgttcttttcattatcaagaaatttatctggggataatggcaggttcggtacctcttccacgtagagtgtatgttggcagattaactgaagaaataacggcagaagacgtaagacaatacttcaaaaaattcggcgaagttactgatgtatatatgccaaaagatttcaaagcattctgttttgtcacctttttagatccagaaattgctcaagctctttgtggagaggatcatatcattaaaggatcatcggtttatgtctctgatgccgcccctaaaaacaattctaggaaaccagttacgaatggtagaggcggagacaataacaatgttggtcattcatttaaaggaaataattttcaaataaaaatgacgggatcaatggaaatgatcgggatcaaggc

SEQ ID NO: 2362 - DNA, 315 bp, Diabrotica virgifera
  Clone ID: LIB150-017-Q1-E1-H9
ggcacacgcgtccgttgagaaggtctattaagtttgttttgttcttgtcattatgaacatatttatctggggataatggcaggttcggtacctcttccacgtagagtgtatgttggcagattaactgatgacataacggcagaagacgtaagacaatacgtcaaaaaatgtcggcaagttactgatgtatatatggcataagatttcaaagcattctgttttgtcaccttttgagatccagatattgctcaagctctttgtggagaggatcatatcattaaaggatcatcagtttatgtctctgatgccgcccct

SEQ ID NO: 2363 - DNA, 450 bp, Diabrotica virgifera
  unsure (1)..(450): unsure at all n locations
  Clone ID: LIB3026-030-Q1-E1-A12
gcgtccgccagaaacaattgactggagagaaaagggggcagttaatcccgtaagggaccaagagcaatgcggatcatgttgggcatttagtgcagctggtgctcttgaaggacaaagatttttaaaggagggcaaactanaagtactgagtactcaacagttagtagattgttcccgtgattacaaaaatgaaggctgcaatggtggttggcctcattgggcatatgactacatcaaagataatggcctctgtctagagtctaagtacaggtatcaaggatatgacggttactactgcaaagagtgtattccggctatcaaaaaaatcaatggctattcatctataaatcaaactgaagaagcacttaaggaggctgtgggtacggctggcccaattgcagtatgtgtcaacgctaatgacgactggcaactgtacagcgggggtatcct

SEQ ID NO: 2364 - DNA, 370 bp, Diabrotica virgifera
  Clone ID: LIB3026-021-Q1-E1-H5
aaagatcaaggacagtgtggatcatgctgggctttcagtaccaccggatccctcgaaggtcaactcgccatccacaaaaatcaacgtgttcctctcagtgaacaagaattggtagactgtgataaggtaaacgatggttgtgacggaggtttgatgacagatgccttcttttatattgaacatcatggtctttcatcagaagaacaatacccctatacaggcgtagatggtcattgcaatcatgtaaaagacaaacaagtctcttcgattaatggttacgtccaacttgatgaaactgaaagtgctctaactgatgctcccgccaaaggtgggtcagtgtcaatagctgtcgaacctgatacatggcaat

SEQ ID NO: 2365 - DNA, 417 bp, Diabrotica virgifera
  Clone ID: LIB149-032-Q1-E1-D11
acttgtgaattatacaaaacatatgtgccagtgactattagtgtctaaaagaaattgtaaagttagaagtatcaacattgtaagaagagttataattctctgtacatagtagtatcaatctaagaaaatatgccagaagaaggaaaaagggcataaattttggttggaggttagggtaccagattgaaaccttaaactttgagtaaacccaaaccccttgtaaaatttgcaaataaacccattccccttcatcaattagaaccacttgtaaatgctggatttactgaatttatattaccattaccataccgtgctaagcaaatggaagaagatttgacagtggaagccaaaaaactgggaattaatataatattttcccatgaaacagaacctttaggtacagcgggaccaattgca

SEQ ID NO: 2366 - DNA, 378 bp, Diabrotica virgifera
  Clone ID: LIB150-020-Q1-E1-E10
agaagtgtcaaaaaaacatgtaaacataaccaatgagatagtgacgacgtttcttatcgagggattattatagaagattaaactgttttttgttgacgtgttatgttataaattaaattattcatctatttgtattgaacttgtgaattatacaaaacatatgtgccagtgactattagtgtctaaaagaaattgtaaagttagaagtatcaacattgtaagaagagttataattctctgtacatagtagtatcaatctaagaaaatatgccagaagaaggaaaaagggcattaattttggttggaggttatggtaccagattgagacctttaactttgagtagacccaaacctcttgtagaatttgcaaataaaccc

SEQ ID NO: 2367 - DNA, 415 bp, Diabrotica virgifera
  Clone ID: LIB150-021-Q1-E1-F1
agaacacatactcagtagtcccctcacccaaagtatcagataccgtagtagaaccatacaatgccacactttcagtacatcaattggtagaaaacacagatgaaacatactgtattgataatgaagctctctatgacatttgcttcagaactttgaaactcacaacacccacatatggagacttaaaccatttggtatccctcacaatgtccggtgtaaccacctgtcttaggttcccaggtcagttgaatgctgatcttagaaaattggctgtcaacatggttcccttcccccgtctccacttcttcatgcccggattcgctccactcacctcaagaggcagccaacaatacagaccgttgaaagttccagagctcacacagcacatgtgtgatgccaataacatgatggcggt

SEQ ID NO: 2368 - DNA, 393 bp, Diabrotica virgifera
  Clone ID: LIB3026-019-Q1-E1-A1
agcagacacggaaggtaccttacagtagctgcagtattcagaggtaggatgtcaatgaaagaagttgacgaacagatgctcaacatccagaacaagaacagcagctacttcgtcgaatggatccccaacaacgttaaaacagccgtttgtgatatcccaccaagaggtctcaagatgtctgccactttcatcggcaactcaaccgccatccaagaattgttcaaacgtatctccgaacaatttacagctatgttcaggaggaaagctttcttgcattggtacaccggagaaggtatggatgaaatggaattcacggaagcagaatccaacatgaacgacttggtatcagaataccaacagtaccaagaagccacagctgacgaagatgccgaa

SEQ ID NO: 2369 - DNA, 418 bp, Diabrotica virgifera
  unsure (1)..(418): unsure at all n locations
  Clone ID: LIB150-003-Q1-E2-A10
acccacgcgtccaggatggtgcataaaaaagactgctgaaaattttctactccaagaactgaatatatttgaatgtaaaattgctgtgttaaaaatgatacaaatactttttttaagtctttttttccaatcatctctagctctctaccctagtagtggaagtgtagttgaattaacaccaagcaattttgacaaattggtgatcaaaggagatgaagtgtgggttgttgaattttttgctccttggtgtggccattgtaagaatttagtaccagaatataccaaagcagccaatgcattaaaaggtattgtgaaagttggagccgtaaatgtagaccagcacaaagaaatcggaggtcagtatggaattagaggatttcctactataanaaatttttggggcagataaacgtaaacc

SEQ ID NO: 2370 - DNA, 230 bp, Diabrotica virgifera
  Clone ID: LIB149-013-Q1-E1-D4
acgcgtacggtgtgggtggttgaatttttggcccctgggggtggcaatggtagaaattaagaacaaaattttccaaagcaaccaatgccattaaaaggaatggtaaaggttggggcgttaatgttaaacaacccaaagaaatccggaggccattttggaattaaaggattcccaacaataaaatttttggggcaaaataaccttaaccctgaaaattttaatgggggtaa

SEQ ID NO: 2371 - DNA, 367 bp, Diabrotica virgifera
  Clone ID: LIB3026-004-Q1-E1-F5
cggacgcgtgggcagtagtagtttcgtgagtacctctacctagcaggagctgcaggaatatttaaaaatgcccaactgtccaaagtgtgagaaaccggtttacttcgccgaacgtaaaacatcccttggtaaggattggcacgcagcatgccttcgctgcgagaaatgcaacaagaccttaacccccggtagccacgcagagcacgaaggaaagccttactgcaacaacccctgctactcagccatgttcggacccggaggttttggacgtggaggagctgaaagttatgtctacaagaagtaaatcgggagtgtcaggagttctagattttaaaaactatttttgtaataaaagtattaaattttt

SEQ ID NO: 2372 - DNA, 401 bp, Diabrotica virgifera
  Clone ID: LIB3026-027-Q1-E1-E11
agggaatatttaaaaatgcccaactgtccaaagtgtgagaaaccggtttacttcgccgaacgtaaaacatcccttggtaaggattggcacgcagcatgccttcgctgtgagaaatgcaacaagaccttaacccccggtagccacgcagagcacgaaggaaagccttactgcaacaacccctgctactcagccatgttcggacccggaggttttggacgtggaggagctgaaagttatgtctacaagaagtaaatcgggagtatcaggagttctagattttaagaccatttttgtaataaaagtattatatttttttcttatataaatttctgaacaggtacaatatgttgacaaagcattccatgtttttgtattcttgttttcgggaataaagttttatt

SEQ ID NO: 2373 - DNA, 426 bp, Diabrotica virgifera
  unsure (1)..(426): unsure at all n locations
  Clone ID: LIB150-021-Q1-E1-H8
acgaatacgtgcaggtagccgaaaatgaagatgaagatccagttgaactacctagtgaggataatgggaccttgttgttaagtactgtcacagcacaattcccgggagcatctggtttaaaatacaaagtatccgctgaaaataagaattttagaggggttcgactttctgatggtatcctccatccaccaccagacggtgaaggatggggtgaaacagttttctgttgcgtatatcccaaagagaataagcgtaagtatagtgaatctgtggaaagtccagcttctaaagtcaaacgtgtagagtctaagttgaaatgtactgatctgattgtgcttggtctgccttggaaggcaactgangaggacttgaaagaatattttgagaagtatggtgaaatagtagtagctcaagttaaaagagata

SEQ ID NO: 2374 - DNA, 448 bp, Diabrotica virgifera
  Clone ID: LIB150-022-Q1-E1-F12
agctattagttttgtaacatttttggaccctgaagttgctcagtcactctgtggtgaagatcatattataaaaggtgtttcggtgcatgtgtcgaatgctgctccgaaatccgatacccgaggtggcaactatcgtggcgatagaaacaatggtttacagaatcgagggggcggcgttggtcctggaggccctgacggtcctggaatgtacaatcaacgatataacggcgcaggtcccaatcaaggcaattggggaaatcaaggcggtcctcgtggcaatattgatatgccaaacttacaagctttgggaataactgggcaaggtcagcaaggtaataaccaaggcaactgcaatccactgggtatgggtttaaatgctttgggagcactgccgatgaatcctgctattgttgctgcagctttgaatcaagctggatggggtttgatt

SEQ ID NO: 2375 - DNA, 388 bp, Diabrotica virgifera
  Clone ID: LIB3026-007-Q1-E1-E1
ggagaccggtggttgcaacattatattcaactttaagcaaaagtatggaaaaacacggtgttgtgcccgatgttatcgatgttgcccccgaacaacaagtggaagtgtcgtatcctagtggtgtaaaggtagactttggtaacgaattaactccaacacaagtcaaagatatcccggcagtaaaatggccggccgataaagattccctttacacactttgcatgaccgatcctgatgccccaagtcgaaaagaacccaagttccgtgaatggcaccattggctcgttggaaatatcccaggaggagaggtctcaaaaggcgaagttctttctgaatatgttgggtctggaccaccaagaaatacaggtcttcatagggatgttttcct

SEQ ID NO: 2376 - DNA, 322 bp, Diabrotica virgifera
  Clone ID: LIB150-029-Q1-E1-H10
agtcgtattatttgctgagaccggtggttgcaagattatattcagctttaagcagaagtatgggtttacacggtgttgtgcccaatgttatcgatgttgcccccgaacaacaagtggaattgtcgtttcctagtggtgtaaaggtagactttggatagtaattaactccatcacaagtcatttttagcccggcagtgaaatggccggccgatcatgattcactttacacactttgcatgaccgatcctgatgccccaggtcgattaagaacccaatttccgtgaatggcaacaatggctcgttggaaaggtcccacgaggag

SEQ ID NO: 2377 - DNA, 484 bp, Diabrotica virgifera
  Clone ID: LIB150-030-Q1-E1-A6
ccgggtggcgcacgcgtccgccaacgcgtccgagcttctgttcattacatcgactacggtaacaaagaaactcttccaaccacccgcctagccagtttacccgccgcctacgtaagtgagagacccttcgcaacagaatacgtccttcccttcatcgtcctgcccaaagacgaggaattctcttcgttggctatcaaataccttaaagaagataccgccgttagcaagctatacatgaatgtagaatacagacaacccggatcccctgcagcagcttcgttacattctgacaagacgtctgatgccgacattgtaaaaaatctcgtcaaagagggattacttatcgtcgacaacatcaaaggaaggcgtaacaataaattgttggaaagttaccgagaagctcatgaaacggccaagatacaccacgctaatatttgggaatatggtgacatcacagaggtcgatgctaaggaatttggacttg

SEQ ID NO: 2378 - DNA, 450 bp, Diabrotica virgifera
  Clone ID: LIB150-029-Q1-E1-A12
tcacaacacactacagagagtcgtaacattctgttcattacatcgactacggtaacaaagaaactcttccaaccacccgcctagccagtttacccgccgcctacgtaagtgagagacccttcgcaacagaatacgtccttcccttcatcgtcctgcccaaagacgaagaattctcttcgttggctatcaaataccttaaagaagataccgccgttagcaagctatacatgaatgtagaatacagacaacccggatcccctgcagcagcttctttacattctgacaagacgtctgatgccgacattgtaaaaaatctcgtcaaagagggattacttatcgtcgacaacatcaaaggaaggcgtaacaataaattgttggaaagttaccgagaagctcaggaaacggccaagaaacaacacgctaatatttgggaatatggtgacatcacag

SEQ ID NO: 2379 - DNA, 562 bp, Diabrotica virgifera
  Clone ID: pGUT2455
aatgccaggtaaagtagataaatgcaaagggtgtcaccaagtggttgatattttggacaacaaatttaacaagatgtcgagggatgaattcctgcatggactcttaaatttctgtggtaaattcagcagcttttcggatggatgcagtaatctcgttatcacttatttcaccgaaatatacaaccatcttcaacaacatttgaattccgaggaagtttgcctcttctctggagaatgcagtgctcagttccatgctcacagagctagagttgaaatcacacccaattctcatattggctacgttaatgtgggagatgataaagatgacgttccgtgccaactttgcgaacagttagttgaccatctcagaaatttattggtagctaataccaccgaagatgaatttaaacgggtaatggaaggtctttgcaaacaaactggtaaattttcagaagagtgcgttgagctgatagaccaatattatggcgaagtatacaccttcttagtagatcatctgaatgcaacggaagtatgtgacgagattggaatttgcaaagcgagt

SEQ ID NO: 2380 - DNA, 427 bp, Diabrotica virgifera
  Clone ID: LIB149-010-Q1-E1-H4
aattttggacaacaaatttaacaagatgtcgagggatgaattcctgcatggactcttaaatttctgtggtaaattcagcagcttttcggatggatgcagtaatctcgttatcacttatttcaccgaaatatacaaccatcttcaacaacatttgaattccgaggaagtttgcctcttctctggagaatgcagtgctcagttccatgctcacagagctagagttgaaatcacacccaattctcatattggctacgttaatgtgggagatgataaagatgacgttccgtgccaactttgcgaacagttagttgaccatctcagaaatttattggtagctaataccaccgaagatgaatttaaacgggtaatggaaggtctttgcaaacaaaccggtaaattttcagaagagtgcgttgagctgatagac

SEQ ID NO: 2381 - DNA, 440 bp, Diabrotica virgifera
  Clone ID: LIB150-019-Q1-E1-B6
ggaagaggtttaaaaagtatatgtgtttttcttaataccctcagtatgtctacctttgtaagagtcggctttggcagagttaaccaaggcttatgtaatgtgttaaacaaaacccaaaatgtaactttaattcgagcaatttctagtaagaatacaagaagtgctgaagagcgatcacccaaaccagccccatggccgtatcaagagaaaggattcaatttgtttaattatttgtatgataagacaactgcgagattagatgaaaattctaagataatagttgttgagggcccaccagccgcaggcaaatcaaagcttgcaaagcaattagcagcagaatttgaaatgttatatttacctgaggctaatttagacatggaatatattaacagctatggctttgatttaagaaagcttgattctgagataccagaaagctg

SEQ ID NO: 2382 - DNA, 404 bp, Diabrotica virgifera
  Clone ID: LIB150-009-Q1-E1-H3
agcagaggtttaaaaagtatatgtgtttttcttaataccctcagtatgtctacctttgtaagagtcggctttggcagagttaaccaaggcttatgtaatgtgttaaacaaaacccaaaatgtaactttaattcgagcaatttctagtaagaatacaagaagtgctgaagagcgatcacccaaaccagccccatggccgtatcaagagaaaggattcaatttgtttaattatttgtatgataagacaactgcgagattagatgaaaattctaagataatagttgttgagggcccaccagccgcaggcaaatcaaagcttgcaaagcaattagcagcagaatttgaaatgttatatttacctgaggctaatttagacatggaatatattaacagctatggctttga

SEQ ID NO: 2383 - DNA, 361 bp, Diabrotica virgifera
  Clone ID: LIB150-025-Q1-E1-B1
gggcccacacacccctatacatgagtcgtagtattattgaataagattttttttctgtttgataaaatgatttccgaaaattaccttaaacgggtaaatattaccgcagatgtgtatgctatatgtgttcaacatgctttaacaactgaaaaacaagaaattatgggtctacgtattggagaggtacatgaaagtgaacgtgtttccaatatttcagcttgtgttattttacatagaagtgataaacagccagacatagtggaaatatcaccagaacagctttgtcatgcttcaatgcatgcagatcagttagctaaaagacttaatacaccgatgatggtacttggatggtatcattccc

SEQ ID NO: 2384 - DNA, 274 bp, Diabrotica virgifera
  Clone ID: LIB150-008-Q1-E1-F8
gtttttgctcttttgatgattaattagctttattgaataagattttttttctgtttgataaaatgatttccgaaaattaccttaaacgggtaaatattaccgcagatgtgtatgctatatgtgttcaacatgctttaacaactgaaaaacaagaaattatgggtctacttattggagaggtaaatgaaagtgaacgtgtttccaatatttcagcttgtgttaatttacatagaagtgataaacagccagacagagtggaaatatcaccagaaca

SEQ ID NO: 2385 - DNA, 373 bp, Diabrotica virgifera
  Clone ID: pGUT1117
ggttgttgaaactgtccatggatatggcggacatcacgatgatcacggttatggtgggcatcatgatgctcatattgtcgatagtggtcacggatatggtggacatcatgattctcatattttcgatactagtcatggttatggtgggcaccatgatagtcatgtcgtctaaactggtcatggttatggtggccatcatgatactcaggttgtcgatactgttcatggttatggtgggcatcatgatgtcgatactggtcgcggatttggcagatttgatacccataatgtgcatgatattgttcaatctatccacggaaatgaagattttcacggtgctgttgacaatgtctttggtggacatggtggtggt

SEQ ID NO: 2386 - DNA, 308 bp, Diabrotica virgifera
  Clone ID: LIB149-023-Q1-E1-B10
tcacggacggtttagtagcggaagctatggtcatggacgatacagccaccacacagaacaacatgtagattcgtatggaggtagacatcatggtgggtatggttctctccatgaagatgaccatcaggttgttgaaactgtccatggatatggcggacatcacgatgttcacggttatggtgggcatcatgatgctcatattgtcgaaagtggtcacggatatggtggacatcatgactctcatattttagaaactactcatggttatggtgggcaccatgatagtcatgttgtcgaaactggtcatg

SEQ ID NO: 2387 - DNA, 373 bp, Diabrotica virgifera
  Clone ID: LIB149-040-Q1-E1-H7
ctcccaagaagggctccaagtcaacggggaagcaaacccaaaagacccagaagaagaaagaggggtctggaggtggcaaagccaaaaagaagaagtggtcaaaaggaaaagtccgtgacaagttgaacaaccaagttctttttgacaaagctacatatgataaactgtacaaggaagtaccctcctacaaattgattaccccatcagtagtctctgaacgtttgaaggtccgtggatccctcgcaaggagggcacttattgaattacaacagaaaggtcttattaaacaagttgtacaacacagagcacaacttatttacactaggaccacagagggagatgatccaccggcatagataataagatacacata

SEQ ID NO: 2388 - DNA, 362 bp, Diabrotica virgifera
  Clone ID: LIB3026-007-Q1-E1-G1
aagacccagaagaagaaagaggggtctggaggtggcaaagccaaaaagaagaagtggtcaaaaggaaaagtccgtgacaagttgaacaaccaagttctttttgacaaagctacatatgataaactgtacaaggaagtaccctcctacaaattgattaccccatcagtagtctctgaacgtttgaaggtccgtggatccctcgcaaggagggcacttattgaattacaacagaaaggtcttattaaacaagttgtacaacacagagcacaacttatttacactaggaccacaaagggagatgattcagcggcatagataataagatacacatatatcgttataaaaaaataaattttaaaatt

SEQ ID NO: 2389 - DNA, 601 bp, Diabrotica virgifera
  unsure (1)..(601): unsure at all n locations
  Clone ID: pGUT3719
tttatttaacatatttacaagatgaaacctatagtaatgtgtttgacgataatagcagcatctatagctattccaacaaacagattaaccaatgatgatgccaacttgtgagattttccatggatcgtcgcgttgaatatttacgcccgtatgccaaggtacgagataacttatcacgaatgtggaggcgtacttgtgagcaaatcttgggttctaacttcatctagttgcgtcaaatctaatgcccaatggaatacatgtacagagatctacgctggtttcgtacaacaaaacgacccgtcgcgtcaatcatttaagatttcaagaattgagcgacatcctggttttaatatgaatgaatctcgcaatccatcttttgacgatattgctttggtaaaactagatcgtgatgtggaactaaacgaaaatgtaaaaatcgtcaaacttccagaagcagatgcagacattacntaaaaatttacctctgctggtttggccttatgcggctattactatggaaaaccaagacatcctacaattacgaagtgtaccatttttagattataaaaactgctatgatcaagtagcagcctacgtagcc

SEQ ID NO: 2390 - DNA, 384 bp, Diabrotica virgifera
  Clone ID: LIB149-034-Q1-E1-D12
agttagaaatatggtgggacttaaagtttttgttttatttgggctattggcaacaacctatggatttaatcaaataaaatctagaaatacccgcaatggcttagatttggatggtggtacagaggctacagatggacaattcccttgggtagtttcacttcaatcaaattttttgtttgttaatacacatgtttgtggaggtgtcatcttaaatgaaaattgggttcttacatctgccgaatgtgaaggtgctgctaacaaagtagtggccggtgctgttaaactgcaaggagccgatcctaataaacagactgttgatattgaaagatgggtggttcatccagactataactcacaagtagttgggccaaacgatatcgcttt

SEQ ID NO: 2391 - DNA, 444 bp, Diabrotica virgifera
  Clone ID: LIB3026-030-Q1-E1-H11
ggccaacgaattatttatcaatatgcttaagtcatcttatacagtagcattgcttatatctgaagaaaatgaaacaattttggaggtagagactgaacaccgagggaagtatataatagccttcgaatcattagatggttcctcgaatatcgactgtctggtatcgataggttcaattttcgccatttacagaaaatccgacaacacagttccagccctcgatgacacactaatgtccggaaggaatgtagtagcagccggatatgcgctttatggcagtgcaactatgctggtcatatcttctggatctggtgtgcatggtttcatgctggatgccaccataggagaatttgttttgactgaacacaacatgcggattccgaaaaaaggaaaaatctactctataaacgaagggtactaccacgaatgggatgatgccataag

SEQ ID NO: 2392 - DNA, 378 bp, Diabrotica virgifera
  Clone ID: LIB3026-001-Q1-E1-C10
aaattatggaggtagagactgaacaccgaggaaagtatatagtagccttcgatccattagatggttcctcgaatatcgactgtctggtatcgataggttcaattttcgccatttacagaaaatccgacaacacagttccagccctcgatgacacactaatgtccggaaggaatgtagtagcagccggatatgcgctttatggcagtgcaactatgctggtcatatcttctggatctggtgtgcatggtttcatgctggatgccaccataggagaatttgttttgactgaacacaacatgcggattccgaaaaaaagaaaaatctactctataaacgaagggtactaccacgaatgggatgatgccataagagaatacg

SEQ ID NO: 2393 - DNA, 381 bp, Diabrotica virgifera
  Clone ID: LIB150-048-Q1-E1-C4
ctcgcgagtcgacacacgcctctacacacacgtcctgctagatttggcttgggaattccccgaaaccaaacccaaaaagataaaatctggattgaaaaaactgtggagttccatcaaaacaacagttgccggtgaacatgttgttgacgagaatgctcagcagcatagagaacaattcgtaccattagttaaagaacttaaaaatgctcttaaagcagacaacatgcaactgtctctgacagttttgcccaacattaacagcacagtgtattatgatcccaaaaatctggccccttatttggactccattgtccttcatgcatttgacttctacacacctttacgtaacgaagaactggctgatttccctgcacctttgta

SEQ ID NO: 2394 - DNA, 349 bp, Diabrotica virgifera
  unsure (1)..(349): unsure at all n locations
  Clone ID: LIB150-013-Q1-E1-C9
tcgaaatcagggtcgaccagcgtcgcgttacaacaagtttatacgatcctcgtgcattagctccacattttggattcgttactcttcanaactttgatttttacactcccgagcgtaaccccanagaagcagattactcatctccattatacanaatttttgacaggaaagatgatgaaaacggtgacttccaagttatgtactggctcaacaacggtatgccagccaataaaatcctttacggtatccgtaccttcggtcgcagctggaaaatgactcaagcttctggtttaactggagtaccgccactaactatcgaagaggctccggtgaagctggtccttacact

SEQ ID NO: 2395 - DNA, 411 bp, Diabrotica virgifera
  Clone ID: LIB150-037-Q1-E1-B7
aggggtctacacattcggcagatagtatttgttgtattccacttgtactaaaaatactaaaatgggaaaaattaaggccggtaccgttgtggatatcctaggagatgaaatgaccaggattatctgggatgccatcaaagaaaaactaatccttccctatttggacattgatctaaaagtatacgatttaggaatagaaaaccgtgataaaactaatgaccaagtaacaatagactgtgctgaagccataaagaaatacaatgttggaatcaaatgtgccactatcacccctgatgaaaacagagtgattgagttcaaattgaagcagatgtggaagagccctaatggtaccataagaaatatcctaggaggtacagtcttcagagaaccaatcatctgcaaaaatatccc

SEQ ID NO: 2396 - DNA, 332 bp, Diabrotica virgifera
  unsure (1)..(332): unsure at all n locations
  Clone ID: pGUT629
ctcgtgccgggagtctacacattcggcagataagtatttgttgtattccacttgtactaaaaatactaaaatgggaaaaattaaggccggtaccgttgtggatatcctaggagatganatgaccaggattatctgggatgccatcaaagaaaaactaatccttccctatttggacattgatctanaagtatacgatttaggaatagaaaaccgtgataaaactaatgaccaagtaacaatagactgtgctgaagccataaagaaatacaatgttggaatcaaatgtgccactatcacccctgatgaaaacagagtgattgagttcaaattga

SEQ ID NO: 2397 - DNA, 429 bp, Diabrotica virgifera
  Clone ID: LIB150-013-Q1-E1-F8
cgatagtgcgaggtccagtgggtagtgtaattttcacatttttccatctttttaaaagactagttaaagttaaattcaatatataaggaaatcaaaaagatatattaaaatgctttctagggcagcaattctttcaggacaggcctcaaaatctctagtagcaaattgcttaagagctacaagcacttcgaccgccaatacccaagtagccaaaactgatgaaagacctggtgaagtagcttttgccagacctgcaagacaagaaccaggaaaagtacgcatgggattcattcctgatgagtggttccaatttttctacaaaaaaactggtgtcacaggaccttacactttcgcagtcaccttgtctacatacctggttagcaaagaaatttatgttttggaacatgaatattacagtggtctctccct

SEQ ID NO: 2398 - DNA, 389 bp, Diabrotica virgifera
  unsure (1)..(389): unsure at all n locations
  Clone ID: LIB149-003-Q1-E1-D4
gggccgagccacgcgtccagttaatttcaatatataaggaaatcaaaaagatatattaaaatgctttccagggcagcaattctttcaagacangcctcaaaatctctagtagcaaattgcttaagagctacaagcacttcgaccgccaatacccaagtagccaaaactgatgaaagacctggtgaagtagcttttgccagacctgcaagacaagaaccaggaaaagtacgcatgggattcattcctgatgagtggttccaatttttctacaaaaaaactggtgtcacaggaccttacactttcgcagtcaccttgtctacatacctggttagcaaagaaatttatgttttggaacaataataatacaattgtctctccctattgattat

SEQ ID NO: 2399 - DNA, 404 bp, Diabrotica virgifera
  Clone ID: LIB149-023-Q1-E1-A9
accacgcgtccgcggacgcgtgggcggacgcgtgggctcacacgtatacagaaaatcaaccagaaggttacgacgtggtttatgaatggagaagtcatttagaaagtatttctaagaaaaaggaaagttcaagaatatgcatggctgaagatggggcaaatttcacactaacattgccttattatggtactcttaacggatctgtattaggagcccacttccccttcaatttcttctttctgccactaaacaccacttctaacggagggcaaatagcgaatataataaacgaatggttaattagacttccaaagatatatactttgaactgggtgctaggtaaccacgatctgcacagaatagcttcaagagtaggcaaagaaaaggttgacgccttaaatatg

SEQ ID NO: 2400 - DNA, 397 bp, Diabrotica virgifera
  Clone ID: LIB149-006-Q1-E1-B5
actaagtctaatgcacctggtgtagctgactttatgtacgactatctaactcacacttatacagaaaatcaaccagaaggttacgacgtggtttatgaatggagaagtcatttagaaagtatttctaagaaaaaggaaagttcaagaatatgcatggctgaagatggggcaaatttcacactaacattgccttattatggtactcttaacggatctgtattaggagcccacttccccttcaatttcttctttctgccactaaacaccacttctaacggagggcaaatagcgaatataataaacgaatggttaattagacttccaaagatatatactttgaactgggtgctaggtaaccacgatctgcacagaatagcttcaagagtaggcaaagaaa

SEQ ID NO: 2401 - DNA, 359 bp, Diabrotica virgifera
  Clone ID: pGUT4266
atccaaattgttaatatttgtatttgctgctgtttttgtcagtgctgaaatcaatagaattccactgaagaagtttgaaaagccgagggatgcacttaacagaaatggactaaaggaaggattattagccaaatacaatagaaatgtcaatgacgatagcgccgtcgttttaactaactatttagatgctcaatattatggagaaattggtattggaactcctgctcaaacctttaatgtaattttcgacactggttcatcgaatctctggattccgtctagtaaatgtggatttttgggaagtgcttgcttacttcataacaaatacgatgccgataaatcttttacctatgtgaaaa

SEQ ID NO: 2402 - DNA, 406 bp, Diabrotica virgifera
  Clone ID: LIB149-016-Q1-E1-B7
cccacgcgtccgaaggattttagttcttttggtgatagctgctcttgctagcagtgaacttatcagaattcctttgaagaaggtacctgctaatggacaaaaaagattgcgtaatgtagccgctaaaggattacgcagtagatttggaggcaatggagtagtacctttagtcaacgaatatgaccttgattattatggagaaatcagtattggaacacctccacaaacattcaaagtcatttttgacaccggatctgccgatctttgggttccttcagcccaatgcgaaaacaacactagaacaccaaatggttgccaaaaccatactaaatatgatgctgacaaatcttcaacataccacgaaaatggccactccttctttattgaatacggatccggatctttg

SEQ ID NO: 2403 - DNA, 549 bp, Diabrotica virgifera
  Clone ID: pGUT2492
aatatccctaagcagatcattttcggtcaaatgcacatttatacttggtcctaagatattgcacaacatctcgtattgcttccttcttatccacgaatcaagcaccaacgtttcctttccaaatttaatctgcaattcaggtactatgtcactctctataaattgtagtatatccctaaacgtggccctctgttgtttcctgtctttcttcgctctgtatttatgagaatctgtagctaactgttttaaagtttctgtgacatctagtgcaaactcttcttcgaagtcctcactttcttctctacctaattcgtatattagtgctaaagattcgcctgcggccattctgacgtctaaatgtgccgattccaacagttctgagagtttttcgagtgagggtaaagctttagaattgttaatcatggttccaatatttcccggagagagtaacgtgaaaagtaaattccaagattggatggcagccgcgtgatgtacttctagatctggactgatggtcggaacggttccatcgccttttaagtaactggc

SEQ ID NO: 2404 - DNA, 598 bp, Diabrotica virgifera
  Clone ID: pGUT2443
ctgaaaccatgttattgagttttacaacattttcatctaaagttaaatgtcaagtgtcgagtataggtggtcaaaacactttaaaaaacagtctaccgtcttgattaagtgctaaattagttgttttatttagtaaatttaagaataagtttatttaattttgtgaccatgccgaaaggaaaacgaaagggaaggtctgatcgcgggcgaaacgacggctccctaaattcatccgacgatgaatcttttatggacaacgcaagtgttgtcagtaactattccgaaaacaaaagcggagaagagtgcgaggacgctgatcttctcgcacaggaacaactggaagaaaaattagtagaaatcctcgatggactcacccagaaatcatcccagggcagaatcaattgcttcgatacgctaaccaaaggttttgtcaagaaatgtatgcctggatttatcagagatcgtcagttcacaatctgtgacagcatagaaaggagtttgaaaaaaggaggaggtcccgaaaaaatagctgctgccgagttagccaccgttatttgtgtccagcttcgaggcgaagatgcacccgaagacatttttt

SEQ ID NO: 2405 - DNA, 356 bp, Diabrotica virgifera
  Clone ID: LIB3026-017-Q1-E1-H11
tgcaaaccttcctgctcatggagaggaaatgtccatacacctagtggagtaccagttgcctcgtgcgatagatctggagtaaacagggttgatgctaatgcaaaatcaggttgtgagggtggcggcagtgcttatatgtgcaacagtcaacaaccatgggcagtaaatagcactttggcatatggttttggtgccgcgtctttcagtaacggggttgatgtatccttatgttgcgcttgtttcttacttagcttcaaagatcaaatttcaaacaagaaaatgattgtacaagttacaaatactggttctgatttgagtcataatcattttgacattgctcttcccggaggtggtgt

SEQ ID NO: 2406 - DNA, 302 bp, Diabrotica virgifera
  unsure (1)..(302): unsure at all n locations
  Clone ID: pGUT925
gcggagtaccagttgcctcatgcgatagatctggagtgaacagggttgatgctaatgcacaatcaggttgtgagggtggcggcagtgcttacatgtgcaacagtcaacaagcatgggcagtaaatagcactttggcatatggttttggtgccgcgtctttcagtaacggaattgatgtatccgtatgttgcgcttgtntcttacttagcttcaaagattcgatttcaaacaagataatgattgttcaagttacaaatactggttctgatttgagtcataatcattttgacattgctcttccc

SEQ ID NO: 2407 - DNA, 426 bp, Diabrotica virgifera
  unsure (1)..(426): unsure at all n locations
  Clone ID: LIB3026-015-Q1-E1-G4
tccttccaataattaaaattaaaaaggaaccatgacaacataaaacccttgggccaactttaaaaaccacattgataataaaattacatggatagtaatacacaacaatgtttatgatgtgactccgttcttaaatgagcacccaggtggtgaagaagttctgctagaacaggctggtaaagaagctagcgaggcattcgaagatgtcggccactccagcgacgccagagagctgatggtcaaatacaaagtaggggaggtcgtcgaagaagaacgtactgccgttaaagccaaaaatgtcgactggggagtatcgagtaacaacgagagttcatcgtcgcagaattccttcaaatcctggttgatcccaatcgctttgggagtgctccgccacatcttgtancgtgcctattttcaatcctgagg

SEQ ID NO: 2408 - DNA, 439 bp, Diabrotica virgifera
  Clone ID: LIB149-009-Q1-E1-G4
ggtaaacaaggttccagtgtatggattattatcaaagacaatgtatacgatgtgactgattttatggaagaacatcctggtggtgccgaattaataatggaatgggcaggtcaaaatgcaacaaatgattttgataacttcggtcattcattagacgccaaacgagatctgaagaaactaaaaattggtgaagttgatgtagaggaacgtaaaaagaaaatcaataaagaaccaaaagtaaaatctaccaaaataactagtacaaacgacaccaaactatacaatgtcagtgaagttgcaaagcacgatgggatacaagatactagaacctggataattataaagaattgtgtatatgatgtaactgaatatatggaagaacatcctggaagtgcagatgtaatcagagagtgggcaagaaaagacgcaacaaaagcct

SEQ ID NO: 2409 - DNA, 395 bp, Diabrotica virgifera
  unsure (1)..(395): unsure at all n locations
  Clone ID: LIB149-037-Q1-E1-E12
aaaaacaaaaaaaaaggaggatggtcccaaacaagtgtgtgtttcgagagctccaagaggcaaaaagaagtctgttactgtagttacaggattgagtagttttgatattgatttgaaagttgcagccaaattctttggtacaaaatttgcatgtggttcatcagtcacaggtgacgatgaaattgttattcaaggagatgttaaagatgacttgtttgatgttattccagaaaagtggcctgaaattgatgaggatctcattgaagatctgggtgaccaaaagagataaactatttatatttttttaagattaccttttaagtcataataacaaattaaactatttgttcgcaaaaaaaaaaannannnannaaaaaaaaaaaaaggggggccgc

SEQ ID NO: 2410 - DNA, 356 bp, Diabrotica virgifera
  Clone ID: LIB149-038-Q1-E1-E12
gacacaaacatatgtttgagtcgaaagctccaaaaggtataattaatgctgttacagtagttacgtgatagaatattttagatatagatttgaaagttgcagccaaagtccctggtataacatgtacaagtggttcatcagtcacaggtgacgatgaacttgttattcagagagatgttaatgatgacttgattgatgttattccagattagtggcctgaaattgatgaagatctcattcaagatctgggtgaccaaaatagataagctatttatatttttttaagattaccctttaagtcataataacagattatactatttgttcgcataaaataatttttaggggatgcgctt

SEQ ID NO: 2411 - DNA, 393 bp, Diabrotica virgifera
  Clone ID: LIB149-048-Q1-E1-F4
ggcaagaataaagctccagaagcgaaaccagatgaaaaggcagaaccacaacaaaaagaggatggacgtgacaatcaactcttctctttccaacaaggcgatcagaaccgcattctaaaaggcgttatgcgtgtaggacatcttgctaaaggtcttctccttcgaggcgatacaaatgttgaattggtggtactatgtgctgataaacccaccctcactcttctcaagaaagtcgtcgaaatccttccatcagctctgaagcaagtggccccagagagcgcctacaccgtggccatcaacgcttccgaggcaggcttgatcatcgctggagacagtttgacggtgttggtacagttcaccagtcccgtaattcgggaacaaccagaagctgca

SEQ ID NO: 2412 - DNA, 379 bp, Diabrotica virgifera
  Clone ID: LIB150-048-Q1-E1-B3
taccacgcgtccgatgcagatgaagacgaaagaatccacgttaaaggaaatgctttagaaaaagtacatggatacaggatacaaagaagatatgacgatgagtatatgggcataggtcccttccacagaggaagaccctatcaaagtggtccattcttcgttggtatgcctcgcagaacagaatctagcgatgataaacacgtgatggctcgccatgctgaaatatatcctaaagaggacgaaattcaatctatcgaatccatagtttcgaacaccgaacgggctctgaagattgtatcagattaaatagcagacgccaagaatcccgtcaagaagttggatccagctgcagcagccgctgcggcagccgcagccaaag

SEQ ID NO: 2413 - DNA, 477 bp, Diabrotica virgifera
  Clone ID: LIB150-010-Q1-E2-B11
gggtgcccccacgcgtccggtactttgttactattcgtggaaatcgtggattatcatttttaaaaagttggatttacatattaatacatggcaatgaaaatccacaagaattcgaaaggcagtctacttaaatttgtatagaaatatcatatatatgccttcaatttcgggatatagatataagcctaacaagaagaaaactaaaatgaacgtacacccgaatgttccattgggagtacgatttttacagaagttgacagatacttgtacttgttgtccaaggtttcattttaacagggaactatgttatcgtatgagcgtgatatttctaacatatatatcgtatatgtgttatcatctatcaagaaaacccatttcagtagtgaaagcagtgttacatagaaactgcagcaatctcgtgccgccagattcgaatgagccaagcaattggtgtgattgggcacctttcgatggcac

SEQ ID NO: 2414 - DNA, 429 bp, Diabrotica virgifera
  Clone ID: LIB150-022-Q1-E1-E8
gatctttgttactattcgtggaaatcgtggattatcatttttaaaaagttggatttacatattaatacatggcaatgaaaatccacaagaattcgaaaggcagtctacttaaatttgtatagaaatatcatatatatgccttcaatttcgggatatagatataagcctaacaagaagaaaactaaaatgaacgtacacccgaatgttccattgggagtacgatttttacagaagttgacagatacttgtacttgttgtccaaggtttcattttaacagggaactatgttatcgtatgagcgtgatatttctaacatatatatcgtatatgtgttatcatctatcaagaaaacccatttcagtagtgaaagcagtgttacatagaaactgcagcaatctcgtgccgccagattcgaatgagccaagcaat

SEQ ID NO: 2415 - DNA, 430 bp, Diabrotica virgifera
  Clone ID: LIB149-043-Q1-E1-E5
ggcaaataaacatgtaggaaaactgtctatgggcgctcacactttcgaaattccacccatactatatgaaaccaatagaaagagacttgtggaacgattgaaaaaagatatagcaaactctgtcgtagttctccaaggtggatctgaggtgtccatctatgactcagacacaacatatctgttcagacaggaagcatacttcaattggtgttttggagtcgctgaacctgactgctatggaatcatagatgtagtaacaggagattcccatttattttttccccgtcttccagtagagtatgcagtatggatgggtcccctcactcctctggatgaatttaaaaagaagtataagtcacatcatgtacactacgtggatgaactgaaacaagtactcgaaaacctaaacagagagactttactgacattg

SEQ ID NO: 2416 - DNA, 373 bp, Diabrotica virgifera
  Clone ID: LIB149-043-Q1-E1-E6
cacgcaaccgaacaaacatacatgtaggaaaactgtctatgggcgctcacactttcgaaattccacccatactatatgaaaccaatagaaagagacttgtggaacgattgaaacaagatatagcaaactctgtcgtacttctccaaggtggatctgaggtgtccatctatgactcagacacaacatatctgttcagacaggaagcatatttcaattggtgttttggagtcgctgaacctgactgctatggaatcatacatgtagtaacaggagattcccatttattttttccccgtcttccagtagagtatgcagtatggaggggtccgctcactcctctgggatgaatttaataagacgtaggagtcacatc

SEQ ID NO: 2417 - DNA, 415 bp, Diabrotica virgifera
  Clone ID: LIB3026-029-Q1-E1-F9
agattatggagaaattggtattggaactcctgctcaaacctttaatgtaattttcgacactggttcatcgaatctctggattccgtctagtaaatgtggatttttggaagttgcttgcttacttcataacaaatacgatgccgataaatcttctacctatgtgaaaaacgacaccagattcgcaattgcatatggttcaggggaagttgcaggacttatttcccaagatgttgttgattttgggggtttacaagctaaggatcaattatttgctgaagctacccaggaacccggtttagctttccttgtgggaaaattcgatggaattttaggaatgggataccctgaaatttccgttaacggaattactccagtatttaattcactggttgaacaaggcgctgtgcaagaacca

SEQ ID NO: 2418 - DNA, 204 bp, Diabrotica virgifera
  Clone ID: LIB3026-022-Q1-E1-C10
gtccgcaagaacacggtttagctttccttgtgggaaaattcgatggaattttaggaatgggataccctgaaatttcccttaacggaattactccagtatttaattcactggttgaacaaggcgctgtgcaagaaccactcttctccttttacttgaacagagaccctgatggagaagttggtggtgaattgttgcttggtggat

SEQ ID NO: 2419 - DNA, 410 bp, Diabrotica virgifera
  Clone ID: LIB150-002-Q1-E1-B6
ggcagtggtcaattggccatttcagttgaaggacctagcaaagctgagatcaacttctctgaccgcaaagatggttcgtgcgatgtttcatacaaagtatcagaacccggtgaataccgcattggcttgaagttcaacgacgagcatgttccagactcaccattcaaagtatacatttcacctgctgtaggagacgctcatttactcgaagtggctcaattcccagaaggttgtatccaagcagacaaaccatctcaatttattgttagaagaaatggagccaagggagacttggacgccaaaattatcggcccctcaggacatgaagacgattgctttgttcaaatcattgatatggaagaatactccatccgattcatgccaagagaaaacggtattcacaagattca

SEQ ID NO: 2420 - DNA, 373 bp, Diabrotica virgifera
  Clone ID: LIB149-015-Q1-E1-G11
cacacgcgtccggacctagtaaagctgaaatacaatgtaatgataacacagatggcacattaaacatttcatacaaaccgactgaacctggatattatattgtaaatcttaaattcgccgatcatcatttggatggatcaccattcactgttaaggtcactggtgaaggttcaaacagacaacgtgagaagatccaaaggcagagggaagctgtaccagtcactgaagtcggtagccagtgtaaattgacattcaaaatgcctggcatcacttcatttgatttaagcgctactgtaacgtcacctggtggtgtaacagaagatgcagaaattaatgaagtcaaagatgggttgtatgctgtccacttcgtacc

SEQ ID NO: 2421 - DNA, 431 bp, Diabrotica virgifera
  Clone ID: LIB150-012-Q1-E1-A12
cagacgcgtgggttgtagtcctattatttatttaagttgttaaaatggctagagttttagttggagtaaagagagtaatcgactatgccgtaaagattcgcgttaagcccgataaaacaggtgtcgtaaccgatggaatcaaacattctatgaatccctttgatgaaattgcagtagaagaagccgttcgtttaaaggaaaaaaaagttgcttcagaaatcatagctgtatcatgtggaccagcacaatcccaagaagttctcaggactgcgttggctatgggggttgataaaggaattcatgttgaaatttcaggacctgaatacgaaactctgcaaccaatacatgtgtcaaaaattttagccaagattgctcagaatgaaaaggctgatctagtgattgtgggaaaacaggctattgatgatgattgt

SEQ ID NO: 2422 - DNA, 417 bp, Diabrotica virgifera
  unsure (1)..(417): unsure at all n locations
  Clone ID: LIB149-035-Q1-E1-F8
aagtccaaacttcatttattttatttatacagtaattgtagtcctattatttatttaagttgttaaaatggctagagttttagttggagtaaaaagagtaatcgactatgccgtaaagattcgcgttaagcccgataaaacaggtgtcgtaaccgatggaatcaaacattctatgaatccctttgatgaaattgcagtagaagaagccgttcgtttaaaggaaaaaaaagttgcttcagaaatcattgctgtatcatgtggaccagcacaatcccaagaagttctcaagactgcgttggctatggnggttgataaaggaattcatgttgaaatttcaggacctgaatacgaaactctgcaaccaatacatgtgtcaaaaaatttaagcaaagattgctcaaaattgaaaagctgatc

SEQ ID NO: 2423 - DNA, 446 bp, Diabrotica virgifera
  Clone ID: LIB150-019-Q1-E1-F4
ggagtagaatgcgttctgaactccttggctgctcaccaactccaggcttctgtaagatgtttggcaattggtggtcgcttcttggaaattggaaaagtagatctttctaacaattctgcgttgggaatgagcatcttcttgaagaacactactttccacggaatccttcttgacgctctctttgattcagacagtcctcagaagagacaagtaatgagattggtaactgaaggaattaagagcggagctgtaaggccacttccaaagactgtatacaatgaacaccaagtagaacaagcctttagatttatggcttcaggtaaacatattggtaaagttttgctccaaataagagaagaagaacctaaaactgccactcgcccagctgttaagactgtcagcgctattcccagaacatacatggatcctgaaaagattacattttg

SEQ ID NO: 2424 - DNA, 241 bp, Diabrotica virgifera
  unsure (1)..(241): unsure at all n locations
  Clone ID: pGUT1914
gaaagctcaccagctcaagataacaatgttcagtttgataagtctgccgatattatgcccaaaaaatcattagttcaaatgaatagtaaaggttcagatagcaaaaaggctccagtatttgttattcatccaattgagggagtagtanatgctctagataacttgtcaaagaacatcgagattcctgtttatggtctgcaatgtactgctgaaactccactcacttcaataactgacttag

SEQ ID NO: 2425 - DNA, 402 bp, Diabrotica virgifera
  Clone ID: LIB149-023-Q1-E1-D3
ttactaaatgaaatattaaaattttacgttggaataaagtatttttagatcaattcgccaacaccaaagtaaccttgcacattgtattatccgtcattttgtgttgtgttagtcacaatcaaccagcaaagcaataatgtcggggttatcacttgaagaacaatggaaaaattttaaattcgcacacaacaaggaatataccgatgaagaggaaccacgcaggttggaaatcttcaaagaaaaccttcagaaaatagaagaacacaacaaaaagtttgaagctggcgaagttacgtaccagatgggagttaataaatttgctgaccttacctctgaagaaatgagtcaatttaggtgttttaaacctagagaaaaataaatagtagtatcataagtcagttt

SEQ ID NO: 2426 - DNA, 224 bp, Diabrotica virgifera
  Clone ID: pGUT059
tcttcttgccgtatgggctgtacctgtgaatgctacgtcagtccaccaacaatgggctcaatctaaggtaaaccattccaagaagtacggacatcttaaacaagagcaagtccgcttccaagttttctctcaaaatctccataaaattgaacagcactatgcaagataacacaatggtgaactgtccttctacttgggggtcaatcagttcgcagatatgactt

SEQ ID NO: 2427 - DNA, 354 bp, Diabrotica virgifera
  Clone ID: LIB149-035-Q1-E1-F1
taatcgactccagactggaatgagaggagctttcggcaagccccaaggtacagttgctcgtgtccgcattggtcaacctattatgagtgtacgctctagtgatcgtttcaaggctgcagttattgaggctctccgtcgtgccaagttcaagttcccaggtcgtcaaaagatctatgtatcaaagaaatggggattcaccaagtatgaacgtgaacaatatgaaaacttaaaacaacaaggtagattagctcctgatggttgcaatgttcaatacaggccagagcacggacctttggcagcatggaagaaggttcaagatgatatctatgcttaagtttattttttcacataaat

SEQ ID NO: 2428 - DNA, 267 bp, Diabrotica virgifera
  Clone ID: LIB3026-010-Q1-E1-G3
atcacgcatctggtggcctacgtgggtgccaaactgggtagacgacctgctaagtgctagcgttagtgtaaaaacaaacgccatcccagcagtcgtttctgcaatggtgtcccacatccaaacgaccgtagtttcgatatgggtacaatgaaggcttcactgcaaggcgttcctctatgtgtagattaagtttctgacgaatatgcagagccaatttctgcatcattagactcaggacgtagctgttgggacaaatattttgtaaag

SEQ ID NO: 2429 - DNA, 421 bp, Diabrotica virgifera
  unsure (1)..(421): unsure at all n locations
  Clone ID: LIB149-039-Q1-E1-G3
aaaagtagtcatagtaattttttataaaaaagtattggattcgttgttgtttagtttttagtatttagtggatcaaaatgagtgaaaaaatcgattgggcaaaatatgctgctgaaaatgaaaaaaagttacaggaaattgaaataacaaagaccaatggagatgaagcgaaaaaagaagatagcaaagaagaagatgacaaaattgatcctgcagaagctagtctgttagctaaaataattagaaaaggtttagtagagaataaaaacgatatagaagttcaaagaaaagatcctcgttcaccattatactcagtaaaaacatttgaagcgctcaatctaaatccaaatctacttaaaggagtgtatgagatgggatttaatgctccttccaagattcangagactgctttaactgcact

SEQ ID NO: 2430 - DNA, 394 bp, Diabrotica virgifera
  Clone ID: LIB150-045-Q1-E1-B11
gtcgacacaagcctctacagtgagtcgtactaactggtgaacaagcaggtaaagggagccaaataagtgagcacatacttattggaacaccaagaaaagttttagattgggctataaaatttacagtatttgatctgatgaaaattcacgtacttgtactagatgaagccgatgtaatgatagctacgcagagacaccaggatcagtgtaataagatacacaaggttttagatgccagtatatgtcacatgtattgtaaataattttatgacacttaatattacgttatacataattatgttattaattacgttaaacaaatgtttttaataaagtaataataaattcagaagaaaattctgaaagtaaaatcatcaaaatctaacaaatgaga

SEQ ID NO: 2431 - DNA, 405 bp, Diabrotica virgifera
  Clone ID: LIB149-009-Q1-E1-D2
aataacatcaagcgataggtaccaccaaatttctcgtagtttactagatttttagcaaaaataatttagaaaagtgatctggttatgctaatcaagaactgagaaggaacaatggtttcaagacttgtgttagcgttggttggacttatttcaaccgtgaatggtttggataatggacttgcccgtacgccaccaatgggctggatggattggcaaagatttacgtgtctgacaaattgtacactatatcctgatgaatgtataagtgaaaaattgttccgagacatggccgatcgtatggcagcggatgggtatcttgctgctggctatgaatacattatgatcgacgattgttggtcttctaaagagagagatagtaaaggaagattggttccagatcctgat

SEQ ID NO: 2432 - DNA, 415 bp, Diabrotica virgifera
  Clone ID: LIB150-049-Q1-E1-E2
agcggacgcgtgggttcaatctaaggcgacaacattccttcatgtcaataactgatcaaagaaactgtacaaataatctaaaagtaaatgcccattgtgaatcggtttattaaaaacaaatttcttaagaacacattatatgttatgctaatcaagaactgagaaggaacaatggtttcaagacttgtgttagcgttggttggacttatttcaaccgtgaatggtttggataatggacttgcccgtacgccaccaatgggctggatggattggcaaagatttaggtgtctgacaaattgtacactatatcctgatgaatgtataagtgaaaaattgttccgagacatggccgatcgtatggcagcgggatgggtatcttgctgctggctatgaatacattatgatcgacgattgt

SEQ ID NO: 2433 - DNA, 430 bp, Diabrotica virgifera
  Clone ID: LIB3026-006-Q1-E1-A6
gtttaatgaaggtgtagtgttcatcggtaaacacgaaataattcctagccatggtgcgtatgaatgtattgagcgatgctctaaaatccataaacaatgctgaaaagcgcggtaaaaggcaggtccttatcaggccttcatcaaaagtagttgttaagtttttaactgtaatgatgaagcatggttacattggcgaatttgaaattgtagacgatcacagaagtggaaagatagtagtaaatttgacaggaaggttaaacaaatgtggagtaatttcccctaggtttgatgtaccaattacacatattgaaaaatggacaaataatcttttaccttcccgtcagtttggatatgttgtgcttaccacaagtggaggtatcatggatcacgaagaagctagaaggaaacacctgggaggaaaaattttggg

SEQ ID NO: 2434 - DNA, 347 bp, Diabrotica virgifera
  Clone ID: LIB3026-001-Q1-E1-B3
aatagtgttcatcggtaaacacgaaataattcctagccatggtgcgaatgaatgtattgagcgatgctctaaaatccataaacaatgctgaaaagcgcggtaaaaggcaggtccttatcaggccttcatcaaaagtagttgttaagtttttaactgtaatgatgaagcatggttacattggcgaatttgaaattgtagacgatcacaggagtggaaagatagtagtaaatttgacaggaaggttaaacaaatgtggagtaatttcccctaggtttgatgtaccaattacacatattgaaaaatgggcaaataatcttttaccttcccgtcagtttggatatgttgtg

SEQ ID NO: 2435 - DNA, 382 bp, Diabrotica virgifera
  unsure (1)..(382): unsure at all n locations
  Clone ID: LIB150-021-Q1-E1-F2
ctcacttctaacatacattcccattgcgcttcaactttttgccaaattggtcatagaggtccagatgcatggagagttgagtatgacaacaaacttaagaattgctgtattggcttccaccgtttggccattgtgggttgcaaatttggtatgcagcccatgaagttgcatcagtatccccattccatgctgatttgtaatggagaactttacaacttccaaaggctangagaacaatacgacttcgattacgaaaccagatgtgacgtagaatgcattttccacttgtacgaaaagttcggcatcgaagaatgtgttaagaatccagacggtgtcttgccttttggccggttcaagttcccaaaaaggaaattttggtaag

SEQ ID NO: 2436 - DNA, 462 bp, Diabrotica virgifera
  unsure (1)..(462): unsure at all n locations
  Clone ID: LIB150-010-Q1-E2-D12
ccaacgcgtccggctcatgtggttgtggtggttaggtctgagtggcaaagaaggtttcaaacgctagtgatctttttaatgttttaagtctaactgattatagaaaataaagtaactgaactaaacaaacatgtgtggaatttgggctgtttttggactcacttctaacatacattcccattgcgcttcaactttttgccaaattggtcatagaggtccagatgcatggagagttgagtatgacaacaaacttaagaattgctgtattggctttcaaccgtttggcattggtgggttcaaaattgggatgcagcccataaagttgcatcagtatccccattccatgctgatttgtaatggagaactttacaacttccaaaggctangagaacaatacgacttcgattacgaaaccagatgtgacgtagaatgcattttccacttgtacgaaaagttcggcat

SEQ ID NO: 2437 - DNA, 413 bp, Diabrotica virgifera
  Clone ID: LIB150-037-Q1-E1-G7
ataatatggcaaattattctgaagatcagatggccgaattccaagaggcctttcaactgttcgacaatcggggtgatggaaaaattcatgttgcccaaattggagatgctttaagagctttaggacagaatcccacagaatctgatgtacagaaatacacccaacaacacaaacctgatgagcgagtctcattcgaagtttatcttcctatttatcagcatatttcaaaaacccggagcgctgacaccgccgaggatttcatcgaaggattacgtcattttgataaagacggaaatggttacatcagttccgcggaacttcgacaccttctgacatcattaggagaaaaacttggcgatgatgatgttgaacaattgcttatgggccacgaagactctcacggaaatgtaaat

SEQ ID NO: 2438 - DNA, 449 bp, Diabrotica virgifera
  Clone ID: LIB149-015-Q1-E1-A2
ctaagtgtaatatgtgtgtctgtttttctgacaaatattcacattcttatcagttattttccataaatatatgtttaaattatgattgtttattattatttcaaattaaatttctttcaatattattatagcaaaatatatttttaatagttttccaatttatcgtaaactccttgtataaactagaaaattttaatatttaaacttcccgctatctctagcgttagaatgttgaactattacaaaatttgtgtagacgtcatttgaattttatttttgacagttgagtaaaatcaaactactaatatggcaaattattctgaagatcagatggccgaattccaagaggccttccaactgttcgacaatcggggtgatggaaaaattcatgttgcccaaattggagatgctttaagagctttaggacagaatcccacagaatctgatgt

SEQ ID NO: 2439 - DNA, 439 bp, Diabrotica virgifera
  Clone ID: LIB149-008-Q1-E1-B4
cccacgcgtccggaaatatggtgggacttaaagtttttgttttatttgggctattggcaacaacctatggatttaatcaaataaaatctagaaatacccgcaatggcttagatttggatggtggtacagaggctacagatggacaattcccttgggtagtttcacttcaatcaaattttttgtttgttaatacacatgtttgtggaggtgtcatcttaaatgaaaattgggttcttacatctgccgaatgtgaaggtgctgctaacaaagtagtggccggtgctgttaaactgcaaggagccgatcctaataaacagactgttgatattgaaagatgggtggttcatccagactataactcacaagtagttgggccaaacgatatcgctttagttaaactaaagcaaccattgaaatttaacgatgccattaaagccgc

SEQ ID NO: 2440 - DNA, 411 bp, Diabrotica virgifera
  Clone ID: LIB149-012-Q1-E1-C11
atttgttttatttgggctattggcaacaacctatggatttaatcaaataaaatctagaaatacccgcaatggcttagatttggatggtggtacagaggctacagatggacaattcccttgggtagtttcacttcaatcaaattttttgtttgttaatacacatgtttgtggaggtgtcatcttaaatgaaaattgggttcttacatctgccgaatgtgaaggtgctgctaacaaagtagtggccggtgctgttaaactgcaaggagccgatcctaataaacagactgttgatattgaaagatgggtggttcatccagactataactcacaagtagttgggccaaacgatatcgctttagttaaactaaagcaaccattgaaatttaacgatgccattaaagccgctaattt

SEQ ID NO: 2441 - DNA, 445 bp, Diabrotica virgifera
  unsure (1)..(445): unsure at all n locations
  Clone ID: LIB150-022-Q1-E1-E11
gtgacagggtaaaacatttctgatcagcttctttctgacgccattgtgattttttatagttcaacaaaatttatttctgtaattctgcattttaagtgccgagttaaacttctacaggtttttgggacttcgttgagcgacagtcgctttttctattttgggcagattagccatgaagcgtggagctgacggtgacatggggtccccgcaaaaaagatcacgtagaggcgatgaggaagttcgtttacttattcccagtatggttgccggttcaattattggcaagggaagatcanacatcaccaaactgagaagccagtacaaagcatccattactgtccctgattgcccaggccccgaacggattttaaccctatcttcagacatggactccgtctgcaacatcgtccaagacgtaataaccaaacttgaagcgcatggcgca

SEQ ID NO: 2442 - DNA, 343 bp, Diabrotica virgifera
  Clone ID: LIB150-033-Q1-E1-A10
accacgcgtccgcttctttctgacgccattgtgattttttatagttcagcaaaatttatttctgtaattctgcattttaagtgccgagttaacttctacaggtttttgggacttcgttgagcgacagtcgctttttctattttgggcagattagccatgaagcgtggagctgacggtgacatggggtccccgcaaaaaagatcacgtagaggcgatgaggaagttcgtttacttattcccagtatggttgccggttcaattattggcaagggaggatcaaacatcaccaaactgagaagccagtacaaagcatccattactgtccccgattgcccaggccccg

SEQ ID NO: 2443 - DNA, 387 bp, Diabrotica virgifera
  unsure (1)..(387): unsure at all n locations
  Clone ID: LIB150-044-Q1-E1-D9
cttgtcccggtattaaatcccttcatggtgccttgatatacacagtcaatgcttgcacttttgttatttcaaacggaggaactcagacatttcacataaaggctgcttcagaggtagaaagacaacaatgggttactgcattggaattagcanaagccaaagctattagaagtatggaatctgaggaagacgaagaaatcgatgaatctggtgattttgaagactggtctggggtagttagaaaattagaatcacaattgaatgatttacaaacgtgtggtgatgtattagctaagcattggaagcatttagcaaagtctttaggtgagatggagaccaattctgaccatgaattgttacaanggaaaaataaagaagtctgtgaaa

SEQ ID NO: 2444 - DNA, 213 bp, Diabrotica virgifera
  unsure (1)..(213): unsure at all n locations
  Clone ID: pGUT055
atgcttgtggacgcataggaagaaattgtaaaagcagctatatatgctaattgttcacaaggatcggtacattttgcagctacatcaacaacatcagcatattcaaggtcttctgtgatgcgctgcatcatacaaagtggttcattaaaattaacaggcattggtatcttggatagatcctttcctatgcaatntntcataatgctccacaaa

SEQ ID NO: 2445 - DNA, 193 bp, Diabrotica virgifera
  Clone ID: pGUT1485
cttttatcatcaagcgaaagcttgccaaaaaacttaaacaaaacagacctattccccaatgggtccgtatgaggacaggaaacacaatcagatacaatgccaagaggcgtcactggcgtaaaaacaagctaaagttgtaaattgtttttatattcaattgacctttatttactttagttaatatcggcacgag

SEQ ID NO: 2446 - DNA, 425 bp, Diabrotica virgifera
  Clone ID: LIB150-026-Q1-E1-C5
ctcgtatgaccttacaacaccctatagtgagtcgtactaaagcgaaagcttgccaaaaaacttaaacaaaacagacctattccccaatgggtccgtatgaggacaggaaacacaatcagatacaatgccaagaggcgtcactggcgtagaaccaagctaaagttgtaaattgtttttatattcaattgacctttatttactttagttaataaacattactccataaaaatcttgtttttatgccatccaatatcaatgtgcataataagcagtgtttgagaacaaatatttaattgctaatcaacaattattaagctcctaaatattcctaaagaggtcattttttccactacaatagcaaatagacaaaagtcacaattaaatgtgtacacttacgatcactgaatagtttacaccttaatttt

SEQ ID NO: 2447 - DNA, 423 bp, Diabrotica virgifera
  Clone ID: LIB149-032-Q1-E1-B12
acatcaacacattctactctaataaagaaatcttccttagagagttgatctcaaactcctcagatgccttggataagatccgttaccaatcactcacaaatccatcctgtctcgactctggaaaagatttgcacattaaaattgttccaaacaagagtgaaggaaccttaaccatcattgatactggtattggtatgacgaaagcagatttagttaacaaccttggtacaatcgcaaaatcaggaacaaaggcattcatggaggccctccaagctggagctgatattagtatgattggtcaatttggtgtaggtttctactcagcctacttagttgctgatcgagtagtggttgtatcataaaataacgatgatgaacagtacatttgggaatcatctgcaggaggtagcttcacaataagac

SEQ ID NO: 2448 - DNA, 372 bp, Diabrotica virgifera
  Clone ID: LIB149-034-Q1-E1-A10
agacatttcaagagaaatgttgcaacaaaataagattcttaaggtcatccgcaaaaatttagttaaaaaatgtctggaactttttgaagagcttactgaggacaaagatggatggaagaaattctatgaacaattctcgaagaacatcaaattaggaattcacgaagattcacaaaacagagccaaacttgctgacttattgcgttaccacacctctgccagtggagatgaagcttgttcactaaaagactatgtcagcagaatgaaggaaaaccaaaaacacatctactatatcactggcgagaacaaagaacaagtagcacattctgcatttgttgaacgtgttaagaagcgtgggttttgaagtagtat

SEQ ID NO: 2449 - DNA, 331 bp, Diabrotica virgifera
  Clone ID: LIB150-047-Q1-E1-C11
atagtgagtcgtattagactggtaggttattttttagtagaagtaaagaataattttatttaatgatagttaattagtattgtgagagaatattttatttttagaaaagaggaatttattttttgtaccttgtgtagcagggattattaattaataattatagatttattattttcgaatttagaagagctaagagattaaaatttttattgtagaataaatattttagataatttttttgtaatgaaatgttagtcgtttttaaatatctctaattttttaggagatacgttagatttagttattagcaatatatttaggattaagtatt

SEQ ID NO: 2450 - DNA, 312 bp, Diabrotica virgifera
  Clone ID: LIB3026-029-Q1-E1-E6
aatttaaaatagctaaaaaattaaaatttttattgtaaaataaatattttaaataatttttttgtaatgaaatgttattcgtttttaaatatatctaattttttaagaagggaattaaatttatttattaacaatatattgatacttaaatatttttatattatcaatattaaatatttttagggatgagcttaaaaataaaattttattaaaatttaatttttaaataacaattaggattaaaaattttcatattttaaaatatgttactatttatttttatatactattatttctatcttctataaattt

SEQ ID NO: 2451 - DNA, 434 bp, Diabrotica virgifera
  unsure (1)..(434): unsure at all n locations
  Clone ID: LIB3026-024-Q1-E1-C12
gagggaagcagcctctccttggggggtggactgtccggcggtggtggatacacggctgtatcgtctggtggtcaaactagcgaaggagcttccgtagacccacagcttctcgaacaagtccgtcaaattctgctcaaagaagaacagagctcttccagcggcggtggccatggtggtggtggtggagacccaggaccatcttcccaatacggtgctccatctcctcaatacggagtacccagctaccaataccgcgtcgttggaatcgatctagagggaatcaaacaagccatccaagttgcccagtacaaccaaatctcacagggaccaagctttggaggataccccagcggacctagttcgataccatccgggtcttacggagccccttactaaggctctagaactgatttcagtgtgaatnacatctttta

SEQ ID NO: 2452 - DNA, 635 bp, Diabrotica virgifera
  unsure (1)..(635): unsure at all n locations
  Clone ID: LIB150-006-Q1-E1-E10
cccacgcgtccgactcgacccagtcaacataagcatcatgaactcttacagtgtggtatttgcgtttgcattggccgctgttgttgtagccgaaccaccttctggctacaactacaaccggcccagcgggggtggcggcatctccttcgggggaagcagcctctccttggggggtggactgtccggcggtggtggatacacggctgtatcgtctggtggtcaaactagcgaaggagcttccgtagacccacagcttctcgaacaagtccgtcaaattctgctcaaagaagaacagagctcttccagcggcggtggtcatggtggtggtggtggatacccaggaccatcttcccaatacggtgctccatctcctcaatacggagtacccagctaccaataccgcgtcgttggaatcgatctagagggaatcaaacaagccatccaagttgcccagtacaaccaaatctcacagggaccaagctttggaggataccccagcggacctagttcgataccatccgggtcttacggagccccttactaaggctctagaactgatttcagtgtgaataccatcttttaccatctcagacgggtcatgatgcattcantaccatcaagttttcaccatacca

SEQ ID NO: 2453 - DNA, 452 bp, Diabrotica virgifera
  Clone ID: LIB150-022-Q1-E1-A11
acggtaatttccaaaattcgagaaaagtttatttagtgttattataataagggaaaacagtaaaaatgagtagatttttcgctggatccgattcagattcggatagctcatccgaagaagagattatccaacgtccccaagtaccagcttatactttcagtgacgatgaggaggaggtaaaacgtgtagtaagatcagcgaaagaaaagcgctatgaagaacttacaaatactattaaacaaatcagaaattttaagaaaattaaggatatgtctagcatgttgaatagttttgaggaattacaaaaggcataccaaaaagctgctcctgttattgtcaaagaagaaaatggccagactccaagattttttattaggtgtttggccgaaatggaagactttattaatgaaatgtgggaagatagagatgggaggaaaaacatgagcaaaaac

SEQ ID NO: 2454 - DNA, 526 bp, Diabrotica virgifera
  Clone ID: LIB150-021-Q1-E1-D10
aaaaggcataccaaaaagctgctcctgttattgtcaaagaagaaaatggccagactccaagattttttattaggtgtttggccgaaatggaagactttattaatgaaatgtgggaagatagagatgggaggaaaaacatgagcaaaaacaatagcaaatcactcacatccaagaaacagaaatttagaaaataattggaagaatttgaagatgacctggctaaatttaagggaaacccaaaacaacctgatgatgaagaagaagaagaaaagcctgaagtagctgaagattccgagaacgaagctccatccaaaaacgcgtttctcaaagctccacccaaacaagttgtagacgacaaagatgaatcgtcagactcggatgactggccatctgactctgaatcgagtctgtcatcatctgatgacgacgaaggcaaataccagagcataagggagcgtttcttgaagagaactgggcccgctcacgaagaagatgaagaaagggaaaggagaaaggaggagaaaag

SEQ ID NO: 2455 - DNA, 434 bp, Diabrotica virgifera
  Clone ID: LIB150-033-Q1-E1-E11
gagagcggaaacgtgctctaaatgaaatccagcaggttaaagacagacacttaaaggaaaaactacaacaaatcagacagactggtcatggtcagaagattctgaagaaaatggatgaagacgatatcaaaaagcttgatgcagaccaaatagcggtgaaagaagcagaagagctacaaaaggaacgtcgcgaacttcaagccaagcttaaatctcaagaaaagaaggtagactatttcgagcgtgccaagcggttggaagaaatccctctacttcaagccaatatgcaagaacgtcaattacaggatcagaacttctgggagcaacaggagaaagagcgaatcgctgcagcaattgaagagcgcaagctggccgtcgcaacgagagaccgtttgctacgcatgaaagtcgacaaagatgaattcatctcgaaa

SEQ ID NO: 2456 - DNA, 375 bp, Diabrotica virgifera
  Clone ID: LIB150-034-Q1-E1-B8
gcttgatgcagaccaaatagcggtgaaagaagcagaagagctacaaaaggaacgtcgcgaacttcaagccaagctcaaatctcaagaaaagaaggtagactatttcgagcgtgccaagcggttggaagaaatccctctacttcaagccaatatgcaagaacgtcaattacaggatcagaacttctgggagcaacaagagaaagagcgaatcgctgcagcaattgaagagcgcaagctggccgtcgcaacgagggaccgtttgctacgcatgaaagtcgacaaagatgaattcatctcgaaattaaagaaggagagaaacattgtctacgaagacaatcttaaggaattcgagaagatgttgagcgaggaaagaaa

SEQ ID NO: 2457 - DNA, 447 bp, Diabrotica virgifera
  Clone ID: LIB150-037-Q1-E1-A11
cacgataccacagctgctggaagcagtttcttcctgtctttgatgggaattcatccagaaattcaagacagggtcatccaggaaatcgatgagatctttggagattctgatagacctgctaccttcgccgacactttagaaatgaagtacttagaaaggtgtatgatggaaactcttcgtatgtatccaccagtacctattattgccagacaacaacttgtagaacagaaccaaccaatttctcaagaaatatatgtccaacagtatggtttgaacaaacaagtagatcagcttatccaatcattggtatatcaccaaaatgtgatctctcaacaagttgagcaattcattcaacaaggacaacgtcttccccaagacttgctttcccaacaagtattagtctaccaacaagttcgccaattgattaaagttttgagcacccaacaa

SEQ ID NO: 2458 - DNA, 254 bp, Diabrotica virgifera
  Clone ID: LIB150-037-Q1-E1-A12
ttgcaactccctgaggtgagtcgtattagatggaagcagtttcttcctgtctttgatgggaattcatccagaaattcaagacaaggtcatccaggaaatcgaggagatctttggagattctgatacacctgcgaccttcgccgagactttagaagtgaagtacttagaaaggtgtatgatggaagctcttcgtacgtatccaccagtagctattattgccatacaacaacttgtagaacagagccatttaattt

SEQ ID NO: 2459 - DNA, 417 bp, Diabrotica virgifera
  Clone ID: LIB150-020-Q1-E1-C6
acttcattctaacagagtccttcatagggacctgaaacctcaaaatattcttcttgatatgaacaacactgctaaactatgtgattttggatttgcaagaaatatgagtactgggacacatgttttaacatctattaaaggtacaccattatatatggcccctgaactgatagatgaacaaccatacgattatacagcagatctgtggtcattgggatgcattatttatgaacttctgatgggctccccaccattttgcactccgtcaattctacatctgataaggcttattaggcatgaacaaattcaatggccaacatttttgtcagacagctgcatctctttcctaaagggattgctgcaaaagaatcctacgaaaagactgaaatgggacgaaattttagatcatccttttgt

SEQ ID NO: 2460 - DNA, 401 bp, Diabrotica virgifera
  unsure (1)..(401): unsure at all n locations
  Clone ID: LIB150-006-Q1-E1-D1
acttcattctaacagagtccttcatagggacctgaaacctcaaaatattcttcttgatatgaacaacactgctaaactatgtgattttggatttgcaagaaatatgagtactgggacacatgttttaacatctattaaaggtacaccattatatatggcccctgaactgatagatgaacaaccatacgattatacagcagatctgtggtcattgggatgcattatttatgaacttctgatgggctccccaccattttgcactccgtcaattctacatctgataaggcttattangcatgaacaaattcaatggccaacatttttgtcagacagctgcatctctttcctaaaaggattgctgcaaaagaatcctacganaagactgaaatgggacgaaattt

SEQ ID NO: 2461 - DNA, 404 bp, Diabrotica virgifera
  Clone ID: LIB150-021-Q1-E1-D6
gtcacctctagggtcgaggtgaaaaaagtaaattataataaaattacgaaaaatttgaataataacaattttttaacgaagtccgtgcttcttattaataccttcaccaaaagcaacaatgcagtgttcagtttttaaagtattatcgtccacaataaagccaactttaaggcacaaccaaagaatattaggaaacttacaaagtcgtttatattcaaacgatggagatgctgacattgtagtgattggttcaggaccaggaggttatgtagctgctatcaaagctgcccaattgggcatgaagaccgtttgtatcgaaaaaaatccaacattgggaggtacgtgtcttaatgttggctgtataccatccaaggctctattgaacaattcacatttctatcata

SEQ ID NO: 2462 - DNA, 391 bp, Diabrotica virgifera
  Clone ID: LIB150-048-Q1-E1-F12
actcgcgggccgatacaagcctctagagtgagtcatatcaagggtcgaggtgaaaaaagtaaattataataaaattacgaaaaatttgaataataacaattttttaacgaagtccgtgcttcttattaataccttcaccaaaagcaacaatgcagtgttcagtttttaaagtattatcgtccacaataaagccaactttaaggcacaaccaaagaatattaggaaacttacaaagtcgtttatattcaaacgatggagatgctgacattgtagtgattggttcaggaccaggaggttatgtagctgctatcaaagctgcccaattgggcatgaagaccgtttgtatcgaaaaaaatccaacattgggaggtacgtgtcttaatgttggctg

SEQ ID NO: 2463 - DNA, 410 bp, Diabrotica virgifera
  Clone ID: LIB149-003-Q1-E1-F6
acccacgcgtccggtaggttttaaaaatgggagcctacaagtatatacaggagttgtatagaaaaaaacaaagtgatgttcttagatttttactgagagtgagagtctggcaatatcgccaattgactaaactccacagaactcccagacccagtcggcctgacaaggctcgcagaatgggttacagggccaagcaaggttttgttatttaccgtattagagtacgacgtggaggacgcaagcgtccagtaccaaaaggtgccacctacggtaaacccaaaagccatggagttaatgaattgaaacctgtccgtaacttacaagctattgctgaggaacgtgtaagaagaaggtgtggtggattaagagtccaaaactcctaatgggtaacccaagaatcaacattcaaa

SEQ ID NO: 2464 - DNA, 195 bp, Diabrotica virgifera
  Clone ID: pGUT701
ggcaccagctttttcgttggatgtctttgtaggtgttaaaaatgggagcctacaagtatatacaggagttgtatagaaaaaaacaaagtgatgtccttagatttttactgagagtgatagtctggcaatatcgccaattgactaaactccacagaactcccacacccagtcggcctgacaaagctcgcacaatgg

SEQ ID NO: 2465 - DNA, 439 bp, Diabrotica virgifera
  Clone ID: LIB150-016-Q1-E1-F5
cacacgcgtccgcatgtcttgggaaaccactgatagggagttacgagaacattttggccaatatggcgaaatcgaaagtataaatgtaaagacagatcccaacactggtagatcaaggggatttgcattcatagtatttaccacaacagaagctattgacaaagttgtagctgcaggtgaccatgtcattaatggcaaaaaagttgaccccaaaaaagccaaagcaaggcatggaaaaatatttgtaggtggtctcacctctgaattgagtgatgatgacatcaagaactatttctcacaatttggatcgatcattgatattgaaatgccatttgacaagcaaaagaaccaaaggaaaggattctgcttcatcacatttgaatctgaacaagtagtgaatgagttactcaagcaacccagacaaaccattaaagacaaa

SEQ ID NO: 2466 - DNA, 313 bp, Diabrotica virgifera
  Clone ID: LIB150-003-Q1-E1-E7
gtataatattagttttttaaattatcggcacacaggcagttctaatggagaacggtgaagatttttcaaaagatgtctcagcagagcatcaaaatggatctcgtgatgctccaaccgatagtggaagtgcacaaacgcccgggcgtgaccatgatagaaaattatttgttggtggcatgtcctgggaaaccactgatatggagttactagaacattttgggcaatatggcgaaatcgaaagtataaatggtgagacagatttcaacactgggagatctaagggatttgcaatcacagtatttatcacaacaga

SEQ ID NO: 2467 - DNA, 421 bp, Diabrotica virgifera
  Clone ID: LIB150-008-Q1-E1-G6
aacagggtatttatgacgcgcacatagcgttgaacggatatccgttcctggattccaaggatgaattccaacatacgtcgctggcggctgatgttatgcaaccgaagcgtaacgaaacattgagtgtgctcactcaagattcgatgacagtcgatgacgtagaaacactacttaaggagactgaacataacggctatccagttgtcgtatcgagagagtctcagtatcttgtgggattcgttgtgaggagagatcttaatttggcaatagccaatgcgaagaggatggtggacggcatatgcggccaatccttggtacttttcacacaaggaaacgccccccaaactctggggccgccgccactaaatctcaagaaaatactcgatatggcgcctaatcacataactggacagacacccat

SEQ ID NO: 2468 - DNA, 380 bp, Diabrotica virgifera
  Clone ID: LIB150-005-Q1-E2-G6
aggacagggtatttatgacgcgcacatagcgttgaacggatatccgttcctggattccaaggatgaattccaacatacgtcgctggcggctgatgttatgcaaccgaagcgtaacgaaacattgagtgtgctcactcaagattcgatgacagtcgatgacgtagaaacactacttaaggagactgaacataacggctatccagttgtcgtatcgagagagtctcagtatcttgtgggattcgttgtgaggagagatcttaatttggcaatagccaatgccaagaagatggtggacgggatatgccggcaatccttgggacttttcaaaaaaggaaacgccccccaaactccgggggcgccggcaataaatcccaagaaaa

SEQ ID NO: 2469 - DNA, 435 bp, Diabrotica virgifera
  Clone ID: LIB150-025-Q1-E1-G1
ctcgcaggtcgccacaagactctatacagacgtcgtactaagcgtccgaacgaaatgaatctgtcggtcgtacagtaggacatcaagttcggcttaattcaaacttcaatccagtaacaggaagaattctgtattgtacaacgggtatacttttacgacatgtccaatcagatagcaccttatcagaatttagccatataattttggacgaagctcacgaaagagatgtcaacactgatctgctaatgaatttgttgaagttttcgttgaataacaatcctcacttaaagttaattgttatgagtgctactatagatactgatatgtttaaaaaatattacgatggtgctccagtgattgaaataccggggattacctacccaattgacaggcattttgcacattcaatcgatggagttgaccttaccaaaacta

SEQ ID NO: 2470 - DNA, 431 bp, Diabrotica virgifera
  unsure (1)..(431): unsure at all n locations
  Clone ID: LIB150-022-Q1-E1-H7
aataccggagataatgcggacttcactgactaaaatagtattagattcaaaagctttcagtaataatatggagacaatgacattcatgaagactctaccaaccccacccgaagaaagtaccgtttctaaagcaatagaagaattaaaggaactggaactactagataataatgaaaacttgaccccacttggtaaaaggctagcagagtttcagctagaaccaaagctggcaaaaacattagttaattcttatatattcaaatgtctctctccaatagtcgatattgtcactcttttctctacggatgttgaattattctcatctggtttaattgacaaagaaaccataaaagaaataaaaagcgagttttctaaggacagcgaccatctagctatgatgaggatgtntgaaaaatttatggagtttgatg

SEQ ID NO: 2471 - DNA, 366 bp, Diabrotica virgifera
  Clone ID: LIB150-012-Q1-E1-H10
cgtaaaacaagaagtttattgtttatcaaaatatttattaccgaattttcaatagaatgtcggtcatagacagggtgagaattctagtattaggcgattccggagttggcaaaacatctttcgttcatttggcagctcataatgaaccccttcgatcacctagttggactgtaggctgttcagtagatgtgaagttacatgaatataaagagggcatgaaggaccaaaagacgttttttgttgaattttgggacataggtggtagccattcacacagaaacgcacggcctgtattttacaatccttttcatggtgccatactagtgcatgatttaacaaaccgaaaatctgaaaagaatttacaca

SEQ ID NO: 2472 - DNA, 397 bp, Diabrotica virgifera
  Clone ID: LIB150-050-Q1-E1-D4
aacggacgcgtgggaaaatatttattaacgaattttcaataaaatgtcgggcaaaaacaaggtgagaattccagtattaagggaatccggagttgggaaaacatctttcgttcatttggcaactcaaaatgaaccccttcgattacctagttggactgtaggctgttcagtaaatgtgaagttacatgaatataaagagggcatgaaggaccaaaagacgttttttgttgaattttgggacatacgtggtagccattcacacagaaacgcacggcctgtattttacaatccttttcatggtgccatactagtgcatgatttaacaaaccgaaaatctgaaaagaatttacacaaatgggttagagaaattagtgtaaataggagagaaagaaaagat

SEQ ID NO: 2473 - DNA, 444 bp, Diabrotica virgifera
  Clone ID: LIB150-024-Q1-E1-E3
cacgcgtctagattggggcggatgatgttacttgtgtatctgtcatttcgttactagtttagtgcagtagatagtattagcagaattaatagtagacttataatactcatttaatagtatactcagacttacatacagtatttataatgattcggttcatcctcatacagaacagagctgggaaatacagattagcgaagtggtatatgaattttgatgatgatgagatacagaaattgattgaagaagttcatgcagtggttactgttcgggatgccaagcatacaaattttgttgagtttcgtaacttcaaaattgtatatagaagatacgctgggctctacttctgcatatgcgtagatgtaaatgaaagtaatctgagttatctagaagcaatacacattttcgtagaagttcttaatgaatatttccataatgtatgtg

SEQ ID NO: 2474 - DNA, 328 bp, Diabrotica virgifera
  Clone ID: LIB150-038-Q1-E1-E2
gccaaccatacaaatttggttgagttccgtaacttcaaaattgtatatagaacatacgctgggctctacttctgcatatgcgtagatgtaaatgacattaatctgagttatctagaagcaatacacagtttcgtagaagttcttaatgaatatttccataatgtatgtgaattagatttggtttttaacttttataaagtatatacagtggtcgatgaaatgttcctagccggagaaatcagagagacttcccaaacaaaagtgttaaagcaactgttgatgttaaactccctagaatagccgtttttgttgatattcggaatggatg

SEQ ID NO: 2475 - DNA, 377 bp, Diabrotica virgifera
  Clone ID: LIB150-028-Q1-E1-B6
ccacgagtgactacccagacttaataaaagttttgattaaatttataaaggggataacaatggagcattatctcgaccccgaagaacaaatacaatgtccttacaacagtgctcatctaatacgtagaaaagtatttaatacgcatctggtaaagtgcagaaaggctaatccagatattaagttggtcccatgtgacttcaatgtcacccattgggtagaagaaccatgcttacagcatcatcacgaaaattgtcctgatcgaaagaaaattgagacaaaattttatgtagatgacaaaactgatcttaacaagtatccagttcgtaatacatatataccttctgatgaaaattgggatgatgaaaatgtcccaaca

SEQ ID NO: 2476 - DNA, 596 bp, Diabrotica virgifera
  Clone ID: pGUT3267
gttggatcaagtgtgcgaattaaggtttcgtgacaaacagaccaactttcaatttgctttttttaattttttattaaaaaaagaaaagttgttgtgaaagtgcagacaagacagaatttaggaccgagttcaagttcagtctcagtcactaactcaactcactactcccacgagtgactacccagacttaataaaagttttgattaaatttataaaggggataacaatggagcattatctcgaccccgaagaacaaatacaatgtccttacaacagtgctcatctaatacgtagaaaagtatttaatacgcatctggtaaagtgcagaaaggctaatccagatattaagttggtcccatgtgacttcaatgtcacccattgggtagaagaaccatgcttacagcatcatcacgaaaattgtcctgatcgaaagaaaattgagacaaaattttatgtagatgacaaaactgatcttaacaagtatccagttcgtaatacatatataccttctgatgaaaattgggatgatgaaaatgtcccaacatataatcctcagaaaacttgcctaagcaaggaagtgattagacacctggatg

SEQ ID NO: 2477 - DNA, 300 bp, Diabrotica virgifera
  unsure (1)..(300): unsure at all n locations
  Clone ID: pGUT1814
tcgtggcgttcaaaccactttactttcatcaaccttgatcagtcgtattctccagttttaacaaaatcgagaaaatggcccccaaattgtactgctcaaaagtcagccctgccgtcagatccactctttaaacgatcaaagctcttggtttggatgttgacttggttcctgtgaatttggctacgggagaacacctcacacctgattacttgaaactaaaccctttgcatacagtgcctacactgcaggacggagatttcgttgtatgggatantcacgctattaatatttatctgatcg

SEQ ID NO: 2478 - DNA, 294 bp, Diabrotica virgifera
  unsure (1)..(294): unsure at all n locations
  Clone ID: pGUT1124
ggcgttcaaaccactttactttcatcaaacttgataattcgtattctccagttttaacaaaatcgagaaaatggcccccaaattgtactgctcataggtcagccctgccgtcagatacactcttttaacgatcaaagctcttggtttggatgttgatttggttcctgtgaatttggctaccggagatcacctcacacctgattacttgagactaaaccctttgcatacagtgcctacactgcatgacggagatttcgtggtatgggatgttcnagcggttaatatttatctgat

SEQ ID NO: 2479 - DNA, 643 bp, Diabrotica virgifera
  unsure (1)..(643): unsure at all n locations
  Clone ID: pGUT3530
catcttggttggtattgttcttcgcagccactgtgtgtgtgtcatccagcgtgcagggagctgatctgacgcttaccctgttttatgaaggattatgccctggttgtcatcaatttattctaacacagctatatccttcatacgctaaattggcagatagcttgaaattggactttgtaccctatggatggagtgactcttcacgtagcgcagatggaaaagtaacatttgaatgccagcatggtgatgaggaatgttatattaacagaatacacgcttgtgttcttgatcaaaatccatcctcgttagactacgttactttcatatatcaacatttgtccaagactgacgaacgcgatcgcaacgaaagacaagaattagaactagcccaaagtttgttgccaagcagcctttcctgggacagcgttagtgattgttatcatggtgaacgtggaactgaacttttattaggatatgagaaaagacaagcagagcttaatcccatattaccttgggtaccaaatataagatttaacggcgtctacgatgaagacgtagaagatcaagctatgatggatcttacagctaccgtttggcacttactagaagataacanaccagacgtttgtaaagatcatgcgac

SEQ ID NO: 2480 - DNA, 417 bp, Diabrotica virgifera
  Clone ID: LIB149-022-Q1-E1-C5
aatggaaaagtaacatttgaatgccagcatggtgatgaggaatgttatattaacagaatacacgcttgtgttcttgatcaaaatccatcctcgttagactacgttactttcatatatcaacatttgtccaagactgacgaacgcgatcgcaacgaaagacaagaattagaactagcccaaagtttgttgccaagcagcctttcctgggacagcgttagtgattgttatcatggtgaacgtggaactgaacttttattaggatatgagaaaagacaagcagagcttaatcccatattaccttgggtaccaaatataagatttaacggcgtctacgatgaagacgtagaagatcaagctatgatggatcttacagctaccgtttgcaacttactaaaagataacaaaccagacgtttgt

SEQ ID NO: 2481 - DNA, 425 bp, Diabrotica virgifera
  Clone ID: LIB149-036-Q1-E1-C5
ctcgtggctcgatacaagcctcaagattgactcgtattatattctttgctgtagttgattttgatgaaggatcagatgtgtttcagatgttaagactgaatactgccccagtatttattcacttcccacctaaaggaaaaccaaagaatgcagataccatggatattcaaaggataggttttggtgcagaaaccattgctaaatggatagcagaaagaactgataaccagatcagagtattcagacctcccaactactctggaacctttgcactgattattctttttgccattgtcgctgcattcttatacctgcgcagaaacaacctaaaatttttgtacaacaagacgatgtggggactaggagctctctttttctgtttcgctatgacttcaggacaaatgtggaaccacattagaggaccc

SEQ ID NO: 2482 - DNA, 452 bp, Diabrotica virgifera
  Clone ID: LIB149-010-Q1-E1-A10
aacggacgctcgggcggacgcgtgggccgtaggtgaatggttagaatttaaagaggtgtattttcggtctttcggaaattaaagaaataaagatgaagtacttatatttattattatttttaaatttagtagctatagttaatgtttatggccaacaaaagagacagccccataccatggctgagcgtgtccagcaactaacggacatggctaataaacgaccagttttgagatttaatgctaataagtttagagatttcgtaaaagcctcaccaaggaactattcagtaatcatcatgttcacagcaatggctcctcaaaggcaatgccaagtgtgtagacatgctagtgaagagtttgccattgtggcaaactcttatagatactcacagagttattcgaataaattattctttgctgtaattgattttgatgaaggatcagatgtgttt

SEQ ID NO: 2483 - DNA, 386 bp, Diabrotica virgifera
  Clone ID: LIB150-020-Q1-E1-F9
actaaacttgcaagtaaaagtccatccggtggttttatttcaagttgtagatgcttacgaacggagaaatgctgactcccatcgagtcattggtaccttattgggtacggcagacaaaggagtcgtagaagttacaaactgcttttgcgtgccccataaagagactgacgatcaggttgaagcagaactatcctatgccatggatgtatatgatttaaatcgaagagttaattcgagcgagtcaattgttggatggtgggctacaggccatgaagtgactaaccacagtgcagttatccatgagtattattcaagggaatgtaataaccctgttcatatcacagttgacacaagtcttcaaaatggtagaatgggtctcaaagcat

SEQ ID NO: 2484 - DNA, 439 bp, Diabrotica virgifera
  Clone ID: LIB150-024-Q1-E1-D11
tcgttggacattacaacaccctaaattgagtcgtattacatccggtggttttatttcaagttgtagatgcttacgaacggagaaatgctgactcccatcgagtcattggtaccttattgggtacggcagacaaaggagtcgtataagttacaaactgcttttgcgtgccccataaagagactgacgatcaggttgaagcagaactatcctatgccatggatgtatatgatttaaatcgaagagttaattcgagcgagtcaattgttggatggtgggctacaggccatgaagtgactaaccacagtgcagttatccatgagtattattcaagggaatgtaataaccctgttcatatcacagttgacacaagtcttcaaaatggtagaatgggtctcaaagcatatgtaagtgttcccttaggagttccaaacggtaaaca

SEQ ID NO: 2485 - DNA, 483 bp, Diabrotica virgifera
  Clone ID: LIB3026-030-Q1-E1-A6
taccggatcgagattcgcggggaactgttagcagctgaaaagcgtgcagcagacagagttacagaggcccgaaaacgcaaagcaaggaggctaaagcaggctaaggaagaggctcaagatgaaatcgaaaagtaccgtaaagaacgagaacgccagttccgtgaatttgaggccaagcatatgggctccagagaagatgtagcagcgaaaatcgaggtagacaccaagaggaggattgaagagatgaataaagctattatcaaccaaaaggaacccgtcattcaagagatcttaaagttggtttatgacatcaaaccagaagtccacaagaactaccgtcaatagttgacaggtgcaatatgtagttaatagggactaaaatcacttaactgtttatagatgtttcattccattttattgtacttcctttctttttgtagccgttttagactatttacagcaaaacttttgagttactacatg

SEQ ID NO: 2486 - DNA, 438 bp, Diabrotica virgifera
  Clone ID: LIB3026-001-Q1-E1-H4
acgtccgatcagaatgatatcgaaaagtaccgtaaagaacgagaacgccagttccgtgaatttgaggccaagcatatgggctccagagaagatgtagcagcgaaaatcgaggtacacaccaagaggaggattgaagagatgaataaagctattatcaaccaaaaggaacccgtcattcaagagatcttaaagttggtttatgacatcaaaccagaagtccacatgaactaccgtcagtagttgacaggtgcaatatgtacttaataaggactaagatcacttaactgtttatagatgtttcattccatttgactgtagatcctttcgttctgtgaccgttttatacgatttacatcaagacttttgagtgacgacatgcacatacttataatatgataaaatgtcccaagtgatctattaaaagtattgggttttaat

SEQ ID NO: 2487 - DNA, 381 bp, Diabrotica virgifera
  Clone ID: LIB150-008-Q1-E1-A8
cagaaaggaaatactccgtctggatcggtggatccatcttggcctccctctccaccttccaacagatgtggatctccaaacaagaatacgacgaatccggcccaggaattgtccaccgcaagtgcttctaagctatttaatcaattcatacctaataagctatttttcatgttgtttgtactgtgtttacatctttgcagttcttaaataatatgcgaccgtggttgtaactgccagacagacttttaagatcttataacaccttataattaattattatttgttatatttacttactataactattttgtaactgggcaggtaaataaatcctatctagtactaaacctgcctattatttcgattaagaacgagaatatg

SEQ ID NO: 2488 - DNA, 388 bp, Diabrotica virgifera
  Clone ID: LIB150-005-Q1-E2-A8
acagagaggaaatactccgtctggatcggtggatccatcttggcctcgctcgccaccttccaacagatgtggatctccatacaacaatacgacgaatccggcccaggaattgtccaccgcaggtgcatctaagctatttaatcaattcatacctaataagctatttttcatgttgtttgtactgtgtttacatcattgcagttcgtaaataacatgcgaccgtggctgtaactgccagacagacttttatgatcttataacaccctataattacttattatttgttatatttacttactataactattttgtaactgggcaggtaaataaatcctatctagtactatgcctgcctattatctcgagtaagaacgagaatatgatgtta

SEQ ID NO: 2489 - DNA, 412 bp, Diabrotica virgifera
  Clone ID: LIB149-041-Q1-E1-D8
aaagaaaaatacaaaatggttaacgtaccaaaacaacgtcgtacgttttgcaaaaaatgtaaagtccacaagccccataaggtaacccaatacaagaaatccaaagaacgtcatgcatcccagggtagaagacgttatgaccgtaaacaacaaggttttggtggacaaactaagccaattttccgtaaaaaggcaaagacaaccaaaaagatcgtattgaggatggaatgcagtgattgtaaatttagaaaacaaattccacttaagagatgcaaacattttgaacttggaggtgacaagaagcgtaaaggacagatgattcagttctaagttattaaaccttgtttttaagttaagacctcacaaaataaaccaaatttgtgtataaaaaaaatgaaagtaacgacagggg

SEQ ID NO: 2490 - DNA, 384 bp, Diabrotica virgifera
  Clone ID: LIB150-003-Q1-E2-D7
agaaaaatacaaaatggttaacgtaccaaaacaacgtcgtacgttttgcaaaaaatgtaaagtccacaagccccataaggtaacccaatacaagaaatccaaagaacgtcatgcatcccagggtagaagacgttatgaccgtaaacaacaaggttttggtggacaaactaagccaattttccgtaaaaaggcaaagacaaccaaaaagatcgtattgaggatggaatgcagtgattgtaaatttagaaaacaaattccacttaagagatgcaaacattttgaacttggaggtgacaagaagcgtaaaggacagatgattcagttctaagttattaaaccttgtttttaagttaagacctcacaaaataaaccaagtttgtatat

SEQ ID NO: 2491 - DNA, 361 bp, Diabrotica virgifera
  unsure (1)..(361): unsure at all n locations
  Clone ID: LIB149-047-Q1-E1-B5
tagcgttaatcgtgtgaactattatcacggtggagataaaccttatttaatctcaggcgctgatgatagattagtaaaaatctgggattatcaaaacaaaacttgtgttcaaactttggaaggacatgctcaaaatgtaaccgctgcatgtttccatccagaacttcctgtagctcttactggaagtgaagatggtactgtcagagtgtggcatgccaacacccataggttagaaagtagcttaaattatggctttgaaagagtatggactattttctgcctaaagggatccantaacgtggcattgggttatgatgaaggtagcattttggttaaagtttgtagagaagaaccagctgtt

SEQ ID NO: 2492 - DNA, 336 bp, Diabrotica virgifera
  Clone ID: LIB150-034-Q1-E1-E12
gattagtaaaaatctgggattatcaaaacaaaacttgtgttcaaactttggaaggacatgctcaaaatgtaaccgctgcatgtttccatccagaacttcctgtagctcttactggaagtgaagatggtactgtcagagtgtggcatgccaacacccataggttagaaagtagcttaaattatggctttgaaagagtatggactattttctgcctaaaggggatcaataacgtggcattgggttaagatgaaggtagcattttggttaaagttggtaaagaagaaccagctgttaatatggatgccagtggaggcaaaattatttgggccagacact

SEQ ID NO: 2493 - DNA, 366 bp, Diabrotica virgifera
  Clone ID: LIB149-041-Q1-E1-C7
agaaaagcacacgagggccaagcacgagctaaatacaattttgtagcccaaactcacttggaactgtcccttgcaaaaggtgaactagttgttattacccgaaaagtcgatgaaaactggtacgaaggaaaaattggtggaagaaaaggtatctttcccgccaattacgtcgaggttctcatcgatccacaaacgccacctacatctaataccaagccggtagcatctccagcagcccactctctactacttaacggatctgcgggcggtaaagaatctatgggtacgcacagctatactcctaacatctcgagctcccaacttgggcccagttatcatgcgaaacccgttcacgttcttaacaat

SEQ ID NO: 2494 - DNA, 374 bp, Diabrotica virgifera
  Clone ID: LIB149-041-Q1-E1-C8
atacaagcctctagaatgagtcataatgagccaagcaccagctaaatacaattttgtagcccaaactcacttggtactgtcccttgcaaaaggtgaactatttgttattacccgaaaagtcgatgaaaactggtacgaatgaaaaattggtggaagaaaaggtatctttcacgccaattacatccaggttctcatcgatccacaaacgccacctacatctaataccaagccggtatcatctccagcagcccactctctactacttaacggatctgcgggcggtaaagaatctatgggtacgcacagctatactcctaacatctcgagctcccaacttgggcccagttatcatgccaaacccgttcacgttccta

SEQ ID NO: 2495 - DNA, 402 bp, Diabrotica virgifera
  Clone ID: pGUT153
ctgaataaattattcattatcttcttcatcatcgtcttcttgactgtcaatctggaagtatctgagttcgtaagagtcctttccagaagctactactcttaaccaatcacgaagattgttcttctttaaatactttttcgtaaggtatttaaggtacctttttgaaaatggaatttcagcggacagggcaattttaacatttttgtctctgcttacggtaactgaatgttgatcactttttccagcaccaaagtttcctgttttgccattgatcttaatcctctctttcaaataatattcaaagtgtgcaacatctaaaagattgtcttcactaggatgggtatagtcaatcacaaatttcaaagcaacctttctttttcttttagatcttttccctctaat

SEQ ID NO: 2496 - DNA, 397 bp, Diabrotica virgifera
  Clone ID: LIB3026-001-Q1-E1-C3
accacgcgtccgcggacgcgtggggttaacttcatcgtgtgcaaaaatgcctacaaaaacagccgttccagttaccaaaccacaggggaagaaaccccaaattagaggtaaaggtctaaagaaaaagaaggttgctttgaaatttgtgattgactgtacccatcctagtgaagacaatcttctagatgttgcaaactttgaaaattatttgaaagagaggattaagatcaatggcaaaacaggaaactttggtgctggaaaaagtggtcaacattcagttaccgtaagcagagacaaaaatgttaaaattgccctgtccgctgaaattccattttcaaaaaggtaccttaaataccttacgaaaaagtatttaaagaagaacaatcttcgtgattgg

SEQ ID NO: 2497 - DNA, 457 bp, Diabrotica virgifera
  Clone ID: LIB149-014-Q1-E1-E6
cttaagtacaacgccaacagaagccctaacagtgctcacaggagttttgccacttcatctagaaattaccagaagaggaagtcaatattggcttcgaaaacataatcctgacaaagtaatcgaaattctgggtgtacatgtacacaccagaaatgagataaacaatgtaatagagaggaagaggcaaaatgaatgggatgcgtctgtgaaagggagaagactctaccaatacataccacgtttgaatgaaattccaccatacttcaatccaaaacctgggttagtgcacttcctaacaggtcacggcccataccctagttatttgcatagattcagcctcaagcaggatgatctatgtgaatgtggacaggtaggaacacccgagcatgcgattttcgactgtgacatttacgaagatgtcggtgatttaagacagcgattacaagcaagacaaata

SEQ ID NO: 2498 - DNA, 379 bp, Diabrotica virgifera
  unsure (1)..(379): unsure at all n locations
  Clone ID: LIB150-050-Q1-E1-F2
aggagctgtccaaatgccaaaaagaccaggcacatcacaaagggatgccctcaaggttcagtatgtggtcccattttttgggatctcatgctggaagagttgcttggcgaaatgactgtgtgtcctgacgtgctanggtgcattgcttatgcggacgatctcctgctaataatagacgctgattcgagaaggcaattagaaggcaaagcaaacgatgtactacagataattagtaattggacatcgaaagttaagctttcgatatcccaaaccaaaaccgtttacagtttgataaaaggtaggctggaaagagatcctataataaggattgatggaaggcctattagaagaactagtacagcgaaatacttaggaatcg

SEQ ID NO: 2499 - DNA, 432 bp, Diabrotica virgifera
  Clone ID: LIB150-022-Q1-E1-F4
gtccgcacacgcaaccgcccacgcgtccggcgttctttgaaaaagttttcaataatactctaaaaaatggcagacgctgatgatctattagattatgaagatgaggaacagacagaacaaaccgcaactgaaacggcaactacagaggtacagaaaaagggtgtcaagggcacatatgtatcaatacacagttctgggtttagagattttctgttaaaaccagcaattctcagagctatagtggactgcgggttcgaacatccttcagaagttcaacatgaatgtattcctcaagctgtcattggcatggatattctgtgccaagctaaatccggtatgggaaaaacggctgtttttgtattagctacactccaagtaatagatcctacagaaaatgttgtatatgttctcgtcatgtgccataccagagag

SEQ ID NO: 2500 - DNA, 426 bp, Diabrotica virgifera
  Clone ID: LIB150-026-Q1-E1-D5
ctcgtgggtcaatacaaccccctagactgactcttattaagttttcaataatactctaaaaaatggcagacgctgatgatctattagattatgaagatgaggaacagacagaacaaaccgcaactgaaacggcaactacagaggtacagaaaaagggtgtcaagggcacatatgtatcaatacacagttctgggtttagagattttctgttaaaaccagcaattctcagagctatagtggactgcgggttcgaacatccttcagaagttcaacatgaatgtattcctcaagctgtcattggcatggatattctgtgccaagctaaatccggtatgggaaaaacggctgtttttgtattagctacactccaagtaatagatcctacagaaaatgttgtatatgttctcgtcatgtgccataccagag

SEQ ID NO: 2501 - DNA, 390 bp, Diabrotica virgifera
  Clone ID: LIB149-032-Q1-E1-G6
acaacaaacctgcaatggaggatatggaaacggaattcttgcacccggtatccaatcgcctggcgtaggggaatacttgtgtacccataacgtgatcaaagctcatgctgcagtatggcatttgtatgacgaaaaatacagacggcgtcaaaacggtcaccttggaataactcttgactgtttttttggtgagccagatagtgacagtcaggaagataaagatgctgccgaaagaatgttgcaatttaattacggttggtacgccaatgcaattgtgaatggcaattacccaaaagtaatgagaaatgtgatagccagaagaagtgctgcgcaaggcttatcaaaatctcgtctaccagactttacttcaaaggaaattcaattcattaa

SEQ ID NO: 2502 - DNA, 392 bp, Diabrotica virgifera
  Clone ID: LIB149-046-Q1-E1-H4
tttagaagaacacagtcccgtcttccagaatttacagatgccgaaaaagctgctttgaaaggtaacgctgactattttgccctaaacacgtacactggaaacctggttaaaagtattcccgatcctcctagattcaatattccatctaggtatcaagatgtgggagttctgacttacactgatccaaaatgggaatctagttctttggattggcttaaggtagctccttggggtattgttgatcttttgaattttatcaaaaataactacaatgatcccgatattatggttacagagaacgggctctgtgataagggaggactagatgatcctcgaagagtcaactaccataaactttatttgagttatattcatgacgcaatgatcaatga

SEQ ID NO: 2503 - DNA, 424 bp, Diabrotica virgifera
  unsure (1)..(424): unsure at all n locations
  Clone ID: LIB150-018-Q1-E1-D1
gtgacaacagaaaaatatagaaaatcatcctctgtgtttccgttttgaacttaacttgtatttagtttaaaaaataatcatgtctagaggaagcagtgcaggttttgaccgacacataacaattttctcgcccgaaggccgactctatcaagtagagtatgcttttaaagccattaaccaagccggccccacttcggtagcagtccgaggagtagatgctgcggcgtgtgtgacccagagaaagatcccggataagctgattgatcccaacacaattacacatctgttccagttaacagaacacactggatgtgtgatgactggcatgattgccgacagcaagtcncaggtgcagagagctagatatgaggctgccgagttcaaatataagtttggatatgagatgccaatcgatgccttgtgt

SEQ ID NO: 2504 - DNA, 397 bp, Diabrotica virgifera
  Clone ID: LIB149-029-Q1-E1-B12
acttggggaaaatcatcctctgtgtttccgttttgaacttaacttgtatttagtttaaaaaataatcatgtctaaaggaagcaatgcaggttttgaccgacacataacaattttctcgccctaaggccgactctatcaagtagagtatgcttttaaagccattaaccaaaccagccccacttcggtagcagtccgaggagtacatgccgcggcgtgtgtgacccagacaaagatcccggataacctgaatgatcccagcacaattacacatctgttccagttaacagatcacactggatgtgtgatgactggcatgattgctgacatcaagtcccaggtgcagacagctagatatgatgctgccgagttcaaatataagtttggatatgagatgcca

SEQ ID NO: 2505 - DNA, 431 bp, Diabrotica virgifera
  Clone ID: LIB150-018-Q1-E1-C7
cacacgcgtccgggcaaaaacttagttgttgatggcaaagtcatttccgtacaccaagaaagagacccagctgctattccatggggcaaagctggtgcagattatgtagtagaatctaccggagtgttcaccacaattgaaaaggccaagaaacatcttgacggtggtgctaagaaagtcatcatctcagctccatctgctgatgctccaatgtatgtatgtggtgttaacttggatgcctacaatccagctgatcccgtaatctctaacgcttcttgcactaccaactgccttgctccactcgccaaagtcatccacgacaacttcgaaatcgttgaaggtttgatgaccaccgtacatgccacaaccgccacacaaaaaactgtcgacggaccctctggaaaattgtggcgtgacggtcgtggtgccgg

SEQ ID NO: 2506 - DNA, 439 bp, Diabrotica virgifera
  Clone ID: LIB150-015-Q1-E1-B2
tcggcggccggtaaggaactttaaaccggaatggtcaaaaaacaaaatcctggcataatggggaaaattggaattaacggttttggccgaattggccgcctggtaccccgtgcagctcttgaaaaaggagttgaagtagtagctgtcaacgatcccttccttgatgtcgactacatggtatacttgttcaaatttgactctacccacggtcgctacaagggatgtgtcaacagtgatggcaaaaacttagttgttgatggcaaagtcatttccgtacaccaagaaagagacccagctgctattccatggggcaaagctggtgcagattatgtagtagaatctaccggagtgttcaccacaattgaaaaggccaagaaacatcttgacggtggtgctaagaaagtcatcatctcagctccatctgctgatgctccaatgt

SEQ ID NO: 2507 - DNA, 377 bp, Diabrotica virgifera
  Clone ID: LIB149-023-Q1-E1-C11
atggcaaaaccttcaaactgactgcacaattcggggacaaattccccaccaaaggattcaaccccggccagaacacctacgcagccccagttgccgacggttcaaacgtaaaggtcgacgttgatgtcaaatctcagaggctacaattgttggaacccttcgataaatgggacggaaaagatttggatgacatgaccattctgattaaagtcaaaggaaagtgcacaaccgatcacatctcagcagctggaccttggttgaaataccgtggtcatcttgataacatctcaaacaatatgttcattacagcaacaaatgccgagaacggtgaactaaacaaaatcaagaaccaaacgaccggtcaatggggcgctgta

SEQ ID NO: 2508 - DNA, 380 bp, Diabrotica virgifera
  Clone ID: LIB150-027-Q1-E1-H3
gtaactccaaaagtctcatgttcagtgagatccaatcaagatgttttcacgtttcacccctggctgctgctgcagctaaggttgcgatgagcaaattggatactgatccaattccatacgagaaattaaacaaaactcttggggtagtcaagaagaggttaggaagaccattaactctttctgaaaaagtcttatactcccacattgatcaaccagagtcccaggatattcaacgaggtacctcttacttaaggttacgtcctgaccgtgttgctatgcaagatgccaccgcccaaatggctatgttgcaattcatctccagtggtctgaagagagtcgccgttcctagcaccatccactgtgaccatcttatcgaagca

SEQ ID NO: 2509 - DNA, 447 bp, Diabrotica virgifera
  Clone ID: LIB3026-030-Q1-E1-E6
ggggccacccacgcgtccgcaaacgcgtccgaattgaggttagttgtgtaaattttcaattttctcgcatttttaaaatatattatcaatttcacaatgactaacacaagcagcaaaggcaactttcaaccagattcagatgttcatattacctacgaagaccagcagaaaattaacagattcgctagattaaacgctaaattagaagacctcaaagatgaaataaagcgcaaagaaaatgacctaaagagtattgaagacgcatgtgacgaaattgctctttttgacgatgacgagcacatcccttatttggtaggcgaagcatttatataccaaaatgtagaaaaaacccaaaagtgcttagaagacaccaaaaataaaatcgaggaaaggattaaagaactgaaagtgaaatctaatgaagtcaaagatacaatgagtgacctg

SEQ ID NO: 2510 - DNA, 405 bp, Diabrotica virgifera
  Clone ID: LIB3026-002-Q1-E1-D8
agttagttgtgtaaattttcaattttctcttttctggcatttttaaaatatattatcaatttcacaatgactaacacaagcagcaaaggcaactttcaaccagattcagatgttcatattacctacgaagaccagcagaaaattaacagattcgctagattaaacgctaaattagaagacctcaaagatgaaataaagcgcaaagaaaatgacctaaagagtattgaagacgcatgtgacgaaattgctctttttgacgatgacgagcacatcccttatttggtaggcgaagcatttatataccaaaatgtagaaaaaacccaaaagtgcttagaagacaccaaaaataaaatcgaggaagggattaaagaactgaaagtgaaatccaatggagtcaaagataca

SEQ ID NO: 2511 - DNA, 406 bp, Diabrotica virgifera
  Clone ID: LIB150-001-Q1-E1-F9
aactgtgaaaggtctggctttggtggattcggggaatttttcagcgctgcctcttgaactaacatttgtctgaacttgagatccaactgcctgcgtttcatttggatgtgttcattccatgttagcctttggtcgatatgtaatgcaaggtatttcacttctgtgctgacggggatgtgtgtattgttaagtatgagtggatgacatgatatattaaaaccgaatgatataatgaaacctaaatttattgtatcatgaggggatgacagatttcccggcgggtgagggtggtaaatgttacttgtactgactttctttcattgattttaattctccattgattgtaccattctgcgagtaggtttaggtgggtttggagatgagaagagcatctactggattctca

SEQ ID NO: 2512 - DNA, 381 bp, Diabrotica virgifera
  Clone ID: LIB150-034-Q1-E1-D2
aataaaccaaatttagaagccttacttattcaaaaaaatgtatatgtggccatgttatcagaaacatggtttaaaccagaaaaattttataacttctcaggatataattgctttaggtctgatcgccctgatgggtacggaggcacagcaattttaattaaaaataaaataattacagaagagataaatttattggataattataattttacttatacttgcatggctgttaaaatttcgtgtatcaagaaaccaatacatataatatccgtatataaagaaccaggtattagagtaacggttgaagaatgggtcaatttttttcaaaacattccttctccattcatcattggaggggacttcaacgctcacaacatggca

SEQ ID NO: 2513 - DNA, 421 bp, Diabrotica virgifera
  Clone ID: LIB149-012-Q1-E1-B7
cacacgcgtccgtggacgcccaagacatcagggtgtgatggtaggaatgggacaaaaagattcctatgtaggtgatgaagctcaaagtaaaagaggtatccttaccttaaaataccccatcgagcacggaatagtcacaaactgggatgatatggagaaaatttggcatcatacattctacaatgaactcagagtagccccagaagaacaccctgttctgttgacagaagctcctctcaaccccaaggccaacagggaaaagatgacacaaataatgtttgaaactttcaacaccccagccatgtatgttgccatccaggctgtactctccttgtatgcatctggtcgtacaactggtattgtgttggattctggtgatggtgtatcccacactgtcccaatctatgaaggttatgccctt

SEQ ID NO: 2514 - DNA, 445 bp, Diabrotica virgifera
  Clone ID: LIB150-017-Q1-E1-E6
cagacgcgtgggtcgtactactggtatcgtattggattctggtgatggtgtatcccacactgtcccaatctatgaaggttatgcacttccccatgcaatccttcgtttggacttggctggcagagatttaactgattacctcatgaaaatcttgactgaacgtggctactctttcaccaccacagcagaaagagaaattgttagggatattaaagaaaaactctgctatgtagctttggacttcgaacaagacatggcaacggctgctagttccagttcccttgaaaagagttacgaacttcctgatggacaggtcatcacaattggtaatgaaaaattccgtggtcaaaaggccctcttcaaacaatcctttttgggaatggaagccaatggtatacatgagactacctacaattccatcatgaagtgtgatgttgatatccgt

SEQ ID NO: 2515 - DNA, 395 bp, Diabrotica virgifera
  Clone ID: LIB150-001-Q1-E1-F10
cccacgcgtccgcccacgcgtccgggagattcgtttgtttctaaacccgtttgtacttcgagtattcgagtctaatagatagaaaagtttggaaactccgtttgtatttaactatttatacataaaatatcgtggaagtatccgtagttctaataaaagattaattttttcgccataacatttctgtcaatatggttgtcgaatacgtgcaggtagccgaaaatgaagatgaagatccagttgaactacctagtgaggataatgggaccttgttgttaagtactgtcacagcacaattcccgggagcatctggtttaaaatacaaagtatccgctgaaaataagaattttagaggggttcgactttctgatggtatcctccatccaccaccagac

SEQ ID NO: 2516 - DNA, 386 bp, Diabrotica virgifera
  Clone ID: LIB150-001-Q1-E1-H2
cccacgcgtccgcccacgcgtccgggagattcgtttgtttctaaacccgtttgtacttcgagtattcgagtctaatagatagaaaagtttggaaactccgtttgtatttaactatttatacataaaatatcgtggaagtatccgtagttctaataaaagattaattttttcgccataacatttctgtcaatatggttgtcgaatacgtgcaggtagccgaaaatgaagatgaagatccagttgaactacctagtgaggataatgggaccttgttgttaagtactgtcacagcacaattcccgggagcatctgggttaaaatacaaagtatccgctgaaaataagaattttagaggggttcgactttctgatggtatcctccatcca

SEQ ID NO: 2517 - DNA, 416 bp, Diabrotica virgifera
  Clone ID: LIB3026-007-Q1-E1-H12
aagaagaattaacatgggtaaagttaagtgtgccgatcttaggactaaagataaaaaagagctaactaaacagctcgatgagttaaaaacagaacttaccagcctccgggttgcgaaagttaccggttggagcccaacaaaacgttcaaaaatccgtgtggtacggaaagctattgcccgtgtatacattgttatgcaccagaaacaaaaagaaaacttgaggaagttgtacaaaaataagaaatacaagcctctcgaccttagacctaagaagacccgttctatccgccgtgctctatccacacatgaacagaggatcaagacacctaaagaaatccgtaagcgctctgcattccctgcaaggaagttcgcattgaaagcttaagttgtattctgttaaataaatactttattat

SEQ ID NO: 2518 - DNA, 433 bp, Diabrotica virgifera
  unsure (1)..(433): unsure at all n locations
  Clone ID: LIB3026-005-Q1-E1-C2
ctttatagtttatttttcaaagaattaacatgggtaaagttaagtgtgccgatcttaggactaaagataaaaaagagctaactaaacagctcgatgagttaaaaacagaacttaccagcctccgggttgcgaaagttaccggtggagctccatcaaaactttcaaaaatccgtgtggtacggaaagctattgcccgtgtatacattgttatgcaccagaaacaaaaagaaaacttgaggaagttgtacaaaaataagaaatacaagcctctcgaacttagacctaagaaagacccgttctatccgccgtgctctatccacacatgaacagaggattaagacacctaaagaaatccgtaagcgctctgcattccctgcnaagaagttcgcattgaaagcttaggttgtattctggtaaataaatactttattat

SEQ ID NO: 2519 - DNA, 581 bp, Diabrotica virgifera
  Clone ID: pGUT3384
attctctaggtctaaaatgttccacaaaaaagcattatacaaattcgttggcaagaaagtagaagctaccaagaaacctcaaaagccccaggttattgaaaaaccaattggtggagagaaaaatggaggaaagagatttgttttggtcaagaaacgtagagcatcctatcctacccaagacaaaattaaggccaggccagctaggagaacatttagccaacacacgaggtctattagaaatacaatcactccaggaacagttctcatccttttagctggttctcacaaaggaaagagggttgtattccttaaacaactgtactctggtctacttttggtaactggaccttttggaattaatgcctgtccattgagacgtattagccaacgttatgtaattgctacatctaccaaaattgacgttagtggagtacagctgccagaaaacctaaatgatgaatattttgcaagaaagaggcagaagagatcaaagaaagaagaaggtgatattttccaatccaaaaaagaaggttacaaagtaagcgaagataggaaagctgaccaaaagaaagtagatacac

SEQ ID NO: 2520 - DNA, 393 bp, Diabrotica virgifera
  Clone ID: LIB150-034-Q1-E1-F12
atgcacgcctctaaagtgagtcgttacatcagcttttctatcgtgatgttgattagtggtccataagcgcggtggggatgcactaccgtatgtgcacaggttacgcaaaccgataaactatgatctgggaaatggagtactcagattctctaggtctaaaatgttccacaggaaagcattatacaaattcgttggcaagacagtaaaagctacgatgaaacctcaaaagccccaggttattgaaaaaccaattggtggagagaaaaatggaggaaagagatttgttttggtcaagaaacgtatagcatcctatcctacccatgacataattaaggctattgccagctaggatgaacatttagccaacacacgaggtctattagagatacaatc

SEQ ID NO: 2521 - DNA, 361 bp, Diabrotica virgifera
  Clone ID: LIB3026-013-Q1-E1-E5
acccacgcgtccgcccacgcgtccgttcattgcaaaacacgtagtcgatcccaatgtccaagctgtagaagaagttgattggagagaaagtgctgttttgggagtcaaagatcaaggacagtgtggatcatgctgggctttcagtaccaccggatccctcgaaggtcaactcgccatccacaaaaatcaacgtgttcctctcagtgaacaagaattggtagactgtgataaggtaaacgatggttgtgacggaggtttgatgacagatgccttcttttaaattgaacatcaaggtctttcaacagaagaacaataccctatacaggcctagatggtcattgcaatcatgtaaaagacaaac

SEQ ID NO: 2522 - DNA, 301 bp, Diabrotica virgifera
  Clone ID: pGUT3869
attgcataacacgtagccgatcccaatgtccaagctgtagaagaagttgattggagagatagtgccggtttgggagtcaaagatcaaggacagtgtggatcatgctgggctttcagtaccaccggatccctcgaaggtcaactcgccatccacaaaaatcaacgtgttcctctcagtgaacaagaattggtagactgtgacacattaagaaatgctggtttgtacggaggtttgatgacagatgcctttaactatgttaaacgccatggtctcttctttcgaatctcaatatgcatacacc

SEQ ID NO: 2523 - DNA, 196 bp, Diabrotica virgifera
  Clone ID: pGUT819
gagagattgtctcaacatttgaccatccagaattggtaaaacttggaacttgtaagcttattgaacaaatcatgattggagaagatatcctgctccgtttcagtggtgttgctcttggggaagcttgcacaattgttatcagatgtgctacacaacagatcattaatgaagctgaacgttcccctcctgatgcttt

SEQ ID NO: 2524 - DNA, 385 bp, Diabrotica virgifera
  Clone ID: LIB150-017-Q1-E1-C8
cattatttcacttcaacaaactgctatttgacatacagcgtctgagatcagattttattcatatgatgatctgattaatattgtcagagctacactcagctcaatgattctttcacatcatttatgatacttggcgaacatggcagtatatgcagtgctgagatagatatgaacaggcgatttacaatccacccagctgtttaagattttagggggtactttggaagattcctttttggattgtggttatttgattggcattttacctgatgtccatcattcaaagagagtagataatgctagcttcctgctatccatctctcctatggtcacatttaagatcatagtatttggttctcacatgaatgtacattcaatggctatt

SEQ ID NO: 2525 - DNA, 422 bp, Diabrotica virgifera
  unsure (1)..(422): unsure at all n locations
  Clone ID: LIB149-028-Q1-E1-E11
acagtgatactttcctaactttgtgctaaaacttgtgataaaaatgtcgttgtcaggaagagctctacatttcgttttcaaaatcccgaatagaaaagaatcgatgagattttatttccaagtgctaggaatgaaattgctaagacacgaagagtttgctgaaggctgcgaggctacttgtaatggaccgtacgatggcagatggagcaaaaccatggtcggctacggagaagaagacaaccatttcgttatcgaactaacatacaactacggcatcactaattacaaaaaaggaaacgatttcgagaaaattacaataaagagtaaagaagctttggaaagagcaaaagaacaaaattggcccgttgagaacggtaatatattagttgctccaggaggttatcgatttcanatagtagatg

SEQ ID NO: 2526 - DNA, 330 bp, Diabrotica virgifera
  unsure (1)..(330): unsure at all n locations
  Clone ID: pGUT405
gtaattagtgatgccgtagttgtatgttagttcgataacgaaatggttgtcttcttctccgtagccgaccatggttttgctccatctgccatcgtacggtccattacaagtagcctcgcagccttcagcaaactcttcgtgtcttagcaatttcattcctaacacttggaaataaaatctcatcgattcttttctattcgggattttgaaaacgaaatgtanagctcttcctgacaacgacatntntatcacaagttttagcacaaagttaggatcactgctcctgtcgtctagtaaatctaaaaaaaaaaaaaaaaaactcgaaggggg

SEQ ID NO: 2527 - DNA, 459 bp, Diabrotica virgifera
  unsure (1)..(459): unsure at all n locations
  Clone ID: LIB150-022-Q1-E1-C11
ccacgcgtcagcccacgcgtccgcccacgcgtccgatttatttcgtgttgtattcaacagtttataaatggaatatatttgttacatttctttgaagctgttatttgcaatggacgtctaaaagtaattttcacttaaattcaaagggtctaaaactacaggaaataggctaaaaatagtacacattcaacaatggatgaagctagtggacttcctcatggacccccaatgaatatccttcctccaaccccagcaaggttggaaagtttgtattcactatgtagaaaaatataccctgatcaaggttaacctttacaagtcacagcattactaaaattttggttgggtggtcaagatcctcttgattatatttctatgtatgctaaccctggaataccacacganaatatacctccacattggcattatattagttttggtttatcagatttgcatggg

SEQ ID NO: 2528 - DNA, 408 bp, Diabrotica virgifera
  Clone ID: LIB150-007-Q1-E1-F9
cccacgcatccgcccacgcgtccgatttatttcgtgttgtattcaacagtttataaatggaatatatttgttacatttctttgaagctgttatttgcaatggacgtctaaaagtaattttcacttaaattcaaagggtctaaaactacaggaaataggctaaaaatagtacacattcaacaatggatgaagctagtggacttcctcatggacccccaatgaatatccttcctccaaccccagcagggttggaaagtttgtattcactatgtagaaaaatataccctgatcaggttaaccctttacaagtcacagcattactaaaattttggttgggtggtccagatcctcttgattatatttctatgtatgctaaccctggaataccacacgaaaatatacctccaca

SEQ ID NO: 2529 - DNA, 154 bp, Diabrotica virgifera
  Clone ID: pGUT2578
gggcttagctcgcaagggcggtccaactcaatcccgccgcggtgctcttgactgagtgtcgaggtgggccggtacgtttactttgaacaaattagagtgcttaaagcaggccaaaacttcgcctgaatactgtgtacaaagggcctcgtgccga

SEQ ID NO: 2530 - DNA, 385 bp, Diabrotica virgifera
  Clone ID: LIB150-003-Q1-E2-A4
aaacagagctccaaccggagacggaaggagcgcttttattagatcaaaaccaatcggaggcggtcacggaggcggaattggaggcggcatcggaggaggcggtatcggaggtggaatcggaggtggaatcggcggtggatccggcggtggtatttcatccagctacggcccacctggcaaatccggtccatactaattttcttactaagttacctctgcagtggttgccttccagtaactgctgcactacagtttgctgcaaaccacttcatccgctatttgtattttacccaacatagtattgtagattttaggacctaaactgagatgcgttcaattggaagattcgaggtaatcgttgtcgaaaggctgacatcaacccccc

SEQ ID NO: 2531 - DNA, 425 bp, Diabrotica virgifera
  Clone ID: LIB149-022-Q1-E1-E6
aggattttctgaagctgccgaagtaactggactcaatccagcccaaatatccgtcattatgaagaacctgatggctcgattgggattccagaagtactaccttcagggaggtgattggggttccgcaatagtagccaacttagcatcattattcccagaaaaagtgctgggagtccattccaatatgtgtatggtcaatagtatgctttctaatctaaaattagcattgggtagttttatgccatccttgattgttgatgctgacaagcaacatctcctttatcccagaatgaaacattttggattccttatattggaaagtggttatatgcatcttcagggtagtaaaccagataccgttggtgtcgctctacgtgatagccctgtaggtcttgcagcttacatcatagagaagtttcacacat

SEQ ID NO: 2532 - DNA, 386 bp, Diabrotica virgifera
  Clone ID: LIB150-030-Q1-E1-G9
gaaaagggaaaatgggttgctgcgctaaagttggagctgttgttgcagtgcttttagctgttttagttgtctatagtacaaaatctttatttcaaacacccaaggtgccagatttgggcgaaaaatggtggaaagtggccaagccggcaaaagtggatactagtatcaaaccgttcaaaattcaaatttcagatgaaattttaaaagacttgaaggacagactagatcgtagtcttccatttcaaccacccctagatggcgtgaaacaacattacggaatgaacactaatctcctgaatactatagtggactattggaagaacaaatatgactggagacaaaaggaaaagtttttcaaccaatatccaaaatttactaccaatatc

SEQ ID NO: 2533 - DNA, 433 bp, Diabrotica virgifera
  unsure (1)..(433): unsure at all n locations
  Clone ID: LIB150-043-Q1-E1-A3
cgaggtccacgtcggataaaattgtatgattttgttagaaagtggtagaataacgctaaccaatttaggagtaacactgcaaagagactctctgaatgttttgttgctgttccgataangangactacggaaaaggtccgatggctgcaataagaaaaaaattggtgattgttggtgacggagcatgtggaaaaacatgtcttttaatagtatttagtaaagatcagttcccagaagtatacgtgcccactgtattcgaaaactatgtggcggatattgaagtagatggaaagcaagtagaactcgccttatgggataccgcaagtcaagaagattatgatcgtctgcggcccctttcatatccagacaccgatgtgattttaatgtgcttctcagtagactcccccgactcattagaaaacatcccagaaaa

SEQ ID NO: 2534 - DNA, 403 bp, Diabrotica virgifera
  Clone ID: LIB150-044-Q1-E1-A9
taaacagacttctaaaatgtatgattttgttagaaagtggtagaataacgctaaccaatttaggagtaacactgcaaagagactctctgaatgttttgttgctgttccgataaggaggactacggaaaaggtccgatggctgcaataagaaaaaaattggtgattgttggtgacggagcatgtggaaaaacatgtcttttaatagtatttagtaaagatcagttcccagaagtatacgtgcccactgtattcgaaaactatgtggcggatattgaagtagatggaaagcacgtagaactcgccttatgggataccgcaggtcaagaagattatgatcgtctgcggcccctttcatatccagacaccgatgtgattttaatgtgccttccagtagactcccccg

SEQ ID NO: 2535 - DNA, 412 bp, Diabrotica virgifera
  Clone ID: LIB149-033-Q1-E1-F6
aggttgagatgtgttatcaaaggaccaagagtttcgaaaaattatcattcctatatctgattaccggcaacctggacaaattgagaaaaatgatgaaaattgcggaaattagaaaagctaaatcatctcaatatcatgctgcacttttgcttggtgatcttgaagagcgtgttaaaattttgaaggcttccaatcaactttctttagcctatttgacagctgctactcacggaatggtagatgaagctgaacagctgaaggaacaaattggagaaaagaaaggttttccagatgtagatccaaatgcaaaatttttgaagccacctcctccaattcaacaagcagaatccaactggcctttgttgacagttagtaggggctttttcgaaaatacggccgcagttgctacagc

SEQ ID NO: 2536 - DNA, 440 bp, Diabrotica virgifera
  Clone ID: LIB150-023-Q1-E1-G12
tacaaaactctacagtgatgcgcattagcctacgcaaggtccatccccactggttacatggaccaaaaattcgcagttagttgccgaccacatcgctgccggttcatttgaatcagctgcgagattgcttcatgatcagttaggagtagtcgattttaaaccatacgaaagcttatttattagtttgtatagcagttccagaacagtttattcttggcagcaaaatataccgccatcatttagctatccgttgagaaattggaaggatgccaatgttaagaaccagttgcctgcttctggcgtgaaattgaatgaactagtcgccaaattacaggcttgctatcaactcactacaggaggcaaattcacggaagccatagaaaaatttcaaactcttcttctctcagtaacgttagtagtagtagagaattaaccagaaa

SEQ ID NO: 2537 - DNA, 430 bp, Diabrotica virgifera
  Clone ID: LIB150-035-Q1-E1-H7
cgctcgactagtagtcggagtagggcagccaaagtaattttttgattattatagttaattggtttattttaaattaggtattaagaaaaaatcaaaatatggctattaatctacaatatgacgccataggcaaaagttttgtccaacaatattatatgcttttcgatgatccaaaccaaaggcctaatttggtaaacatgtataatgtagaacattcatttatgacctttgaaggcaagcaattacaaggatctgcaaagataatggagaaattaaattccttaggattccaaaatataaatagacaacttactgaagtagactctcaacctatgtttgatggtggtgtactgataaatgtattaggtagattgcaagttgataatgattcaccacacgcttatacacaagtttttgttttaaaaccatt

SEQ ID NO: 2538 - DNA, 423 bp, Diabrotica virgifera
  Clone ID: LIB150-035-Q1-E1-H3
tcgactagtagtcggtgtagggcagccaaagtaattttttgattattatagtcaattggtttattttaaattaggtactaagaaaaaatcatgatatggctattaatctacaatatgacgccattcgcaaaatttttgtccaacaatattatatgcttttcgatgatccattccagaggcctaatttggtaaacatgtataatgtagaacattcatttaggacctttgaaggcaggcagttacgaagatcggcaaagataagggagaaattaaattccttaggattccaaaatataactacacaacttacggaagtagactctcaacctatgtttgatcgtggagtactgataaatgtgttaggtagaattccaattgagagatattcacgaaacgggtatacacgaggtttttgttttaaaa

SEQ ID NO: 2539 - DNA, 366 bp, Diabrotica virgifera
  Clone ID: LIB3026-010-Q1-E1-B7
agtagaactccagaaaaaaatccaatcatcaaacatgttgaaccacgcaagattgaaggtattgaaagtaagggaagaccatgtacgtgccgttttggaagatgctcgcaaacgtcttggtgaggtaaccagagattcaggcaaatatacacaaatcctggaaagtctcatcctccaagggctctatcagctcttcgaaaaggacatcaccattagagtacgccctcaggacagagaattggtaaaatctatcatgcctaacgtctcccaaaagtacaaggacataaccggtaaacacgtaaatctaaaaatcgacgacgagagccacctttctcaagaaaccaccggaggaatcgaactgttggc

SEQ ID NO: 2540 - DNA, 432 bp, Diabrotica virgifera
  Clone ID: LIB149-025-Q1-E1-B5
cagaaagttgctgggcgtagtcgggaaaaacattgtttaaatccctttaatttcctctaagtcgaaagaaaaaggctcaaaatggctctcagcgacgcagatgtacaaaagcagatcaagcacatgatggctttcattgagcaagaagccaatgaaaaggccgaggaaattgatgcaaaggctgaagaagaattcaacatcgaaaagggccgtctggtccaacaacagaggctcaagattatggagtactacgagaaaaaagagaagcaagtagaactccagaaaaaaatccaatcatcaaacatgttgaaccaggcaagattgaaggtattgaaagtaagggaagaccatgtacgtgccgttttggaagatgctcgcaaacgtcttggtgaggtaaccagagattcaggcaaatatacacaaatcctggaa

SEQ ID NO: 2541 - DNA, 430 bp, Diabrotica virgifera
  Clone ID: LIB149-025-Q1-E1-A7
cccacgcgtccgaatttagcagataatgaaactcgaagcagaagtgtagattctcttctcaattttgaaacagttaaatattacggagctgagaattacgaagtggatgcttttagggaagctgttcttaaattccaagatgaagaatttaagtcaagtatcactcttaatatcttaaacacagtacaaaatgttataatatgcggagggctattagcgggaagtttgctctgtgtttatatggtagtagaacctaaaactctaaaggcaggcgattatgtattatttgctacatatatagtacaactttacgtgccgcttaattggtttggtacctactacagggccattcaaaagaattttgtagatatggaaaacatgtttgaccttctcagagaagaacaagaaattattgacgctccaggagcta

SEQ ID NO: 2542 - DNA, 418 bp, Diabrotica virgifera
  Clone ID: LIB150-039-Q1-E1-B5
cggacgcgtggggtttctgcctttaatatatggtttggactgatcgtttttactacaatgatactttacatagttctaacgatcgttattaccgaatggagaacaaaatttcagcgtcgtatgaatttagcagataatgaaactcgaagcagaagtgtagattctcttctcaattttgaaacagttaaatattacggagctgagaattacgaagtggatgcttttagggaagctgttcttaaattccaagatgaagaatttaagtcaagtatcactcttaatatcttaaacacagtacaaaatgttataatatgcggagggctattagcgggaagtttgctctgtgtttatatggtagtagaacctaaaactctaaaggcaggcgattatgtattatttgctacatatatagtacaac

SEQ ID NO: 2543 - DNA, 381 bp, Diabrotica virgifera
  Clone ID: LIB150-040-Q1-E1-C9
gttagatcaacatcaatacagtaactgatttttctttatgttttggagccaaaccgcaagtagtgggcagtcccgataagtacttagcctagaaaagaaaaaagaaaattttgaaaaagtggcaatttatttctctacatagtctccttttagcttgatacatttgacctagcaatacttgaacttctttaacccgtctgaaaaataccttttttcgaagtctgcaaaataggcttccatggcggcgatgacttcctcattcgacttaaatttctgcccagcgagtgtctttttcaagtttggaaactaatagtagtcgcacggggccaaatccggagaatacggtggatgaggcaagagttcgtagcccaattcgaccaa

SEQ ID NO: 2544 - DNA, 416 bp, Diabrotica virgifera
  Clone ID: LIB149-004-Q1-E1-A4
aggattgatccatgtttcattcattgtaacataccggcaaaaactccaattaaacatgtccaaaccgcttgtcctggtgtgagaaaacggaggacccatttggaaaacagctttctcatactcaaatgttcatgtatagtagtcaaaatgctaccctttgataaatgtagagtgtcagttatctcttgcaactttacttaacaaatttcagcattttttctatgttttcgggaataattgcatcatttggccttccggagtactcggcattattggtgtctttactatcacgtttgaatacaacaaaccattgtttaatggttgtaatcgatggagcacagtcccggtaacactttttgatccattgctcaatttgggcgatattttttcccatcaaaatgcatatcaacagtgat

SEQ ID NO: 2545 - DNA, 364 bp, Diabrotica virgifera
  Clone ID: LIB149-016-Q1-E1-H10
tccgcttatagtcagttgcaaatattcacaaggaaatattgacgaatggtccggtagaagcagcttttgatgtgtacagcgacttcgtgaattataaaagtggtgtctatcaaaatgttgctggagaatatttaggaggacatgccttcaaaatttaaggttgggaaaagaaaattgaatcccttaatgggtgggtgccaattcaaggaatgaagattggggaaacaagggattgtttaaaatacgtcgcggaaataatgaatcaggcttcgaagactctaatgttgctgcacctgctcaagtccaattttaaacgaaatattagtgttacgtttaatatgttttaatttaaataaaaaaatta

SEQ ID NO: 2546 - DNA, 350 bp, Diabrotica virgifera
  Clone ID: LIB149-022-Q1-E1-G11
tccctgtagtgagtcgtattatatgttcttgagtctgttctacttgtacccatttcgtatgctctgagtttagggcgggtgtagctacgttggattctcgccgcatgttacagacattctgccatgtgacttgaccaatcacatgttcgacgtttcatactttagatgaattagacactagtccatagcgtactccaccctcttgtccccaacctaaaattctgaccgcatgtcttcctaaatattccccagcaacatgtttatagacactacctttataattcatgaagtcgctgtacacatcaaaagctggctcgaccggaccattcgtcaatatttccttttgacta

SEQ ID NO: 2547 - DNA, 376 bp, Diabrotica virgifera
  Clone ID: LIB150-040-Q1-E1-A10
atccgatccagttagggtacatgttcaagattgagaatgagaatcaagtctcacatgcggctcattatctttgtcaccacggggcgttcaagtattcttctatcactaagaaatgtagggttgtttttgacggttctgcggttaacgattcgggaatctcgctaaatgatactttaatgacgggtaataaattacaggataatttatttaatattttgttacggtttagggaacatgttatagtaattgttgctgatatagctaagatgtaccggcaaattttgatttatgatccaaacggggaatttcagggaattctatggagattttcaacgaaaaccgaagtaggagtttataggttgaacatggtcaccta

SEQ ID NO: 2548 - DNA, 323 bp, Diabrotica virgifera
  unsure (1)..(323): unsure at all n locations
  Clone ID: pGUT1705
cctgaagtagaatgttcagctcctgaagatattctgggtgagaaaaattttggtgagagatgtttgtcnagacggctctggtcgttataccgttgctctacctttcagagaattatctcctgtttttccaggaatgtttgagttagctgtaaatcgttttctttccttagaaaaaaggcttttgaaaaatcctagtgtttatcagggatattgtacctttatgaaagattatttggatttgcatcatatggagcttgtgtcagaaacttctcgtccattatcttgttactatattcctcaccatgctgtattaaaacctgata

SEQ ID NO: 2549 - DNA, 418 bp, Diabrotica virgifera
  Clone ID: LIB3026-025-Q1-E1-B6
cacgcatccgcaatgattcgtcgaagaaaggcccaaaagtcaccgataaggtttggtttgatatcaccatcggtggagagcccttaggtcgtattgaaattggattgtttggaaaaacagtgccagggacagtaaagaatttcagagaattagcagcgaaaccagccggtgaaggatacaaaggcagtaaattccacagggttattagagatttcatgattcaaggtggtgacttcactaaaggagatggtactggaggtcgcagtatttacggagaacgcttcgccgacgaacacttcaaactgaaacatttcggtgctggtcggctgtcactgcgcaatgctggaacggacactcacggttcacaatttttcatccccacgacacagacctcatggcccgaccgacgtctcgtcct

SEQ ID NO: 2550 - DNA, 411 bp, Diabrotica virgifera
  Clone ID: LIB149-005-Q1-E1-H11
caggcaaaggtgattcaagtcaagtcaagttgactgtccaagtgaagtgtccagcaatattttatgagctttctgttacttcaccggctcataagggataagattggttacaaagcagcgatgaaagttttattagttactttggcttttgtagccgttttagcctatgtaagaagcgatgattcgtcgaagaaaggcccaaaagtcaccgataaggtttggtttgatatcaccatcggtggagagcccttaggtcgtattgaaattggattgtttggaaaaacagtgccaaggacagtaaagaatttcagagaattagcaactaaaccagccggtgaaggatacaaaggcagtaaattccacagggttattagagatttcatgattcaaggtggtgacttcactaaagga

SEQ ID NO: 2551 - DNA, 409 bp, Diabrotica virgifera
  unsure (1)..(409): unsure at all n locations
  Clone ID: LIB150-016-Q1-E1-D10
atcaccaatgcctgtttcgaacctgccaaccagatggtaaaatgcgatcccagacatggtaaatacatggcttgctgtatgttgtacagaggggatgttgtcccaaaggatgtaaatgctgctattgcaaccattaagaccaaacttaccatccaattcgtacactgttgtccaactggtttcaaagtacgtatcaactatcaaccaccaactgttgtacctggacgtgatttggctaaagtacaacgtgccgtatgcatgttgtccaacactacagctattgctgaagcctgcgcaacattggaccacatattcgatcttatgtacgccacgagagctttcgtccactggtatgtangacagggtatggaagaatgtgaattctctgaaactcgtgaatatttggctg

SEQ ID NO: 2552 - DNA, 347 bp, Diabrotica virgifera
  Clone ID: LIB150-025-Q1-E1-G12
tgattttccactccttcggtggtggtactggatctggtttcacttctttgttgatggaacgtctatctgttgactatggtaaaaaatcaaaactggaattcgccatctacccagctcctcaagtatctactgctgtagtataaccatacaactccatcttgaccacccacaccactcttgaacactcagactgtgcctttatggtacataatgaagccatctatgacatctgcagacgtaatctagacatcgagcgcccaacctacaccaacttgaacagacttattggccaaatcgtatcctcaatcacagcttctctaagattcgatggtgctccaaatgttgac

SEQ ID NO: 2553 - DNA, 384 bp, Diabrotica virgifera
  unsure (1)..(384): unsure at all n locations
  Clone ID: LIB150-038-Q1-E1-A1
atggtactaaaatggcagtagttcaatcanattacattcanaatataccttcttttggatgtgtagaccaacctgacaacggctccaaaacaacaagagaatcattagtagaagtgtcttcatcacgtccacgccaagaagactactcagtatatgagaacagactggcatctttcactaactggcccaacacccaagtgtcaagagaatcattagctcgagctggttttatatatacaggtcaagatgacatcgttatctgccctatttgtaagatagagggataccgttgggtatcaggagacaatccaatggatgatcatcgtgtttggaatcccaactgcccctttcttaatagaagagataacatcgagcacgatcact

SEQ ID NO: 2554 - DNA, 398 bp, Diabrotica virgifera
  unsure (1)..(398): unsure at all n locations
  Clone ID: LIB149-007-Q1-E1-H12
aaaataatgaaataatcaaatccactttaccagaaatagatatattgctgccacacgttccagatttcatggtactaaaatggcagtagttcaatcaaattacattcaaaatataccttcttttggatgtgtagaccaacctgacaacggctccaaaacaacaagagaatcattagtagaagtgtcttcatcacgtccacgccaagaagactactcagtatatgagaacagactggcatctttcactaactggcccaacacccaagtgtcaagagaatcattagctcgagctggttttatatatacaggtcaagatgacatcgttatctgccctatttgtaagatagagggataccgttgggtatcangagacantccaatggatgatcatcgtgttt

SEQ ID NO: 2555 - DNA, 412 bp, Diabrotica virgifera
  unsure (1)..(412): unsure at all n locations
  Clone ID: LIB150-003-Q1-E2-E7
aggtaggacgtgttaggtgttagtagctcttaggctaagtataatattagttttttaatttatcggcacacaggcagttctaatggagaacggtgaagatttttcaaaagatgtctcagcagagcatcaaaatggatcaggtgatgctccagccgatagtggaagtgcagaaacgcccggccgtgacgatgatagaaaattatttgttggtggcatgtcttgggaaaccactgatagggagttacgagaacattttggccaatatggcgaaatcgaaagtataaatgtaaagacagatcccaacactggtagattaaggggatttgcattcatagtatttaccacaacagaagctattgacaaagttgtagctgcanggtgacatgtcattaatggcaaaaaagttgacccc

SEQ ID NO: 2556 - DNA, 405 bp, Diabrotica virgifera
  Clone ID: LIB150-045-Q1-E1-F11
ctcgcaggtcgacacaagcctctacagacactcggggcaaaggtaggacgtgttaggtgttagtagctcttaggctaagtataatattagttttttaatttatcggcacacaggcagttctaatggagaacggtgaagatttttcaaaagatgtctcagcagagcatcaaaatggatcaggtgatgctccagccgatagtggaagtgcagaaacgcccggccgtgacgatgatagaaaattatttgttggtggcatgtcttgggaaaccactgatagggagttacgagaacattttggccaatatggcgaaatcgaaagtataaatgtaaagacagatcccaacactggtagatcaaggggatttgcattcatagtatttaccacaacagaagctattgacaaag

SEQ ID NO: 2557 - DNA, 387 bp, Diabrotica virgifera
  Clone ID: LIB149-005-Q1-E1-B4
aggtcggtagtatcgaaaatatttaccaagatgttttcaaattatactagaactctaggaactcagctaagaagattccaaagcaccttggtaattgcagaacataataatgaagtcttgtcccctatcacacaaaatgctataactgctgcaaaaaagttaggtggtgaagtatcagttctagttgcagggacaaaatgtggaccagcttcatcagccctttcaaaagcaggtggtgtatccaaggttctggtagctgaaaatgaagcatttaaaggtttcactgctgaaaatttgactccattaatattaaatgcacaaaaacagtttaaatttacacatattattgctggtgcctcagcatttggaaaggctcttttgccccga

SEQ ID NO: 2558 - DNA, 398 bp, Diabrotica virgifera
  unsure (1)..(398): unsure at all n locations
  Clone ID: LIB149-022-Q1-E1-E3
accacacgtccggttaggactatctatgctggtaatgcaattcagactttgcaagtcacagaccctattaaaatattaacgattagaggaactaactttgaagctgacccattggatggtggttctgcagccactgaaaatattccagcagatggttgtgccaatgatcttactacttttgttagccaggaattgagcaaatcagacaggcctgaactaacaagtgcaaaagtatttgttnttggaggtccggggttaaaagtcaggaaacaatctcaaacttcaatatgttctacctgataatttaaatgctgcatttggtgcttcccgtgaacctgtaaatgctggatatttaccaaatgatatgcaatttggtcaaccaggaaaaattgttgccc

SEQ ID NO: 2559 - DNA, 424 bp, Diabrotica virgifera
  unsure (1)..(424): unsure at all n locations
  Clone ID: LIB150-033-Q1-E1-F4
aactcattcggtggtggtactggatctggtttcacttctttgttgatggaacgtctatctgttgactatggtaaaaaatcaaaactggaattcgccatctacccagctcctcaagtatctactgctgtagtagaaccatacaactccatcttgaccacccacaccactcttgaacactcagactgtgcctttatggtagataatgaagccatctatgacatctgcagacgtaatctagacatcgagcgcccaacctacaccaacttgaacagacttattggccaaatcgtatcctcaatcacagcttctctaagattcgatggtgctctaaatgttgacttgacagaattccaaactaacttggttccttaccctcgtattcacttcnctcttgtcacctatgcccagtaatttccgctgaaaa

SEQ ID NO: 2560 - DNA, 369 bp, Diabrotica virgifera
  Clone ID: pGUT1489
ctcgtgccgaatcggcacgagaaaaaatcaaaactggaattcgccatctacccagctcctcaagtatctactgctgtagtagaaccatacaactccatcttgaccacccacaccactcttgaacactcagactgtgcctttatggtagataatgaagccatctatgacatctgcagacgtaatctaaacatcgagcgcccaacttacaccaacttgaacagacttattggccaaatcgtatcctcaatcacagcttctctaagattcgatggtgctctaaatgttgaactgacagaattccaaactaacttggttccttaccctcgtattcacttccctcttgtcacctatgccccagtaatttccgct

SEQ ID NO: 2561 - DNA, 358 bp, Diabrotica virgifera
  Clone ID: LIB150-003-Q1-E2-B11
cctgaaacgacaagctgttcaagaaataggaggatttaaagtataagacttacctggcaaagaagctctttacgatccaggaaaaagaaacgggcaaatgaaaatggtcagagacggtagcagcgtagtagcctatacgtgggtagaagatggtgaaaacagtcattgggataaagttggggaggtacttggaggcactgacaaaaatgacagtggcaaaacgatgtatgaaggtcagtattatgattatgtgttttctgtggatgttgaagatggtaagcctccattaaaattaccattcaataaaggagatgatccataccaagcagctcataaatttttagccaagcatatgttg

SEQ ID NO: 2562 - DNA, 367 bp, Diabrotica virgifera
  Clone ID: LIB150-003-Q1-E1-B11
agttaatttaactaaatttacagaagaggtaaatgccctgaaacgacaagctgttcaagaaataggaggagttaaagtatcagacttacctggcaaagaagctctttacgatccaggaaaaagaaacgggcaaatgaaaatggtcagagacggtagcagcgtagtagcctatacgtgggtagaagatggtgaaaacagtcattgggataaagttggggaggtacttggagggactgacaaaaatgacagtggcaaaacgatgtatgaaggtcagtattatgattaagtgttttctgtggatgttgaagatggtaagcctccattaaaattaccattcaataaaggagatgatccataccaagcagct

SEQ ID NO: 2563 - DNA, 386 bp, Diabrotica virgifera
  Clone ID: LIB150-036-Q1-E1-E4
agtgagtcgtattaaagagcacaaggaatgggagttcattcggcggaagaaattaacgaattcggccaggaggatttgaaagtgctgtcagaaatgttagccgacaaaccattcttcttcggagacgaacccactacattggacgtcgtcgttttcgcacacctggctcaaatctacttcatcgacaaagaagtgagctatccattgagagatttcatgacagaatcctgccccaacttggtcggtttggttaaccgtatgaaggagcgatgcttctctgactgggacgacatttgcacaacattggacttgaattcccatttaccaaacccaaagcggaagaatcaatagacaacaaagaggaaagcagagacgaaaacgagagt

SEQ ID NO: 2564 - DNA, 428 bp, Diabrotica virgifera
  unsure (1)..(428): unsure at all n locations
  Clone ID: LIB150-022-Q1-E1-C1
cagacgcgtgggcggccggagagattgctgtacgagacgactcttctattctagagagctggaagctattgcagggaaactgctttttgtcncttgattagtcgagtattagttttatcttgttgtacattgtttgttgtggtgcttatcgcgtgtgttgttgagtgtttatattacttgaaatagaactagcgatggcaactgaggtcgaaaataacgcacccgaaacaaaggaaattaaggaggagataccgtccggcgacaacaaagccgatgaggccggtaaacaagaaaatgccggcgacgcgcctgcctcggcaaaagaaaaagaaccgactcctccaaaagtattggtacacaaaccaaatttcgaaaaagacgtcgtttatttgtatcagttttcgcgtacaccactactaccatccctt

SEQ ID NO: 2565 - DNA, 394 bp, Diabrotica virgifera
  Clone ID: LIB3026-006-Q1-E1-G6
ggattttgcaattttgctactttagggagtatttaaggcaaattttgcggctgtttaggttagcccctgaagtgtaattattttactataagctattttataccaccaattgagaaatggaatctttaaatcccgaggatgttttaaagtttttagacctcattaatacactaaagcacagtagtcgtagaggttgggaactttgtcatgttaataatcatgaacaaattgctggacatatgtatgccatgggaataatgacctttctactgggaaatgaatcaaagttggatagatttaaatgcctacaactagctttggtgcatgatttagccgaatgtatagtaggagatattaccccccacgataatatcacagaggacaaaaagcatca

SEQ ID NO: 2566 - DNA, 289 bp, Diabrotica virgifera
  Clone ID: LIB3026-018-Q1-E1-B10
aggcttgctgagctaacgtgttgtcgataacacaaaaatagttttaatataaaaaatgggtttccaaaatatatggtactctcacccccgtaaatatggacaaggatccagatcatgccgtgcctgctcaaacagacatggtctcatccgtaaatatggattgaacttgtgccgtcaatgcttcagagaatatgctggagacataggattcaagaagctggactaaacatcaagggaattttttatatacaatgttaagttaataatataaaaataaaagataattttt

SEQ ID NO: 2567 - DNA, 382 bp, Diabrotica virgifera
  Clone ID: LIB149-047-Q1-E1-B10
catctctctcggctccccgctccgagtcgcgtcgcgtgaggagaaaggaagggaagccggaaagggttctcgccgacgcggaaggaggagatggccgggaagggaggcaagggcctgctcgcggccaagacgacggccgccaagaccgccgagaaggacaaggggaagaaggcccccatctcccgctcgtcccgcgcggggctccagttccctgtgggccgtatccatcgtcagctgaagcaaaggactcaggccaatggccgtgttggtgctactgcggcggtctactctgctgctatcctggagtacctgacagctgaggtcctggagcttgctggcaacgccagcaaggatctcaaggtgaaacgtatcacccctcgtc

SEQ ID NO: 2568 - DNA, 422 bp, Diabrotica virgifera
  unsure (1)..(422): unsure at all n locations
  Clone ID: LIB3026-031-Q1-E1-G7
aatgtttcataaaatgtataaacattttgtgatcttcaagccaatctttcgagaaaaaatggcttgaagatcacaaaatgtttcataaaatgtataaacagttcgaaccgaagggttgcaaggtttgctctcgcgaatttacaactaccaagcaattgctcgtccacatacaagaaagccatagcgacaactctctcattccattcaaaaaatataaatgtacgacgtgtaatttgactttaccttataaaaaaaatctggatcaacacatggaacatatgcattccagcgaggagaaaaagtctttcctttgcactgactgtggacattcatttgcttctatatcacggttaacggatcatatgaaaatccattaaagaaggacagtatgtaagttcctntttgcgacaaaaaatttaaaa

SEQ ID NO: 2569 - DNA, 425 bp, Diabrotica virgifera
  Clone ID: LIB3026-005-Q1-E1-A11
gggtcgaggcacgcgtccgcgcacgcgtccgcaagatggctacgaatattataaaatccggtggggctgagcccgatgcctttgaaacacaagttgcccaatctttgcttgagctggaaatgaattctgatttaaaagctcagcttagagaattgcatattacaaaagctagagaaatagaattaaataataagaagagcgtaattatctacgttccaatgccaaaattgaaacagttccaaaaaattcaaactaggcgagtacgtgaattggaaaagaagttcagtggcaaacacgtagtagttgtaggtgaacgtaaaattttacctaaaccagcaaggaaaacccgtgctgccaacaaacacaaaagaccaaggtctcgtactttgacttcagtatatgatgctatcttagaagatcttgta

SEQ ID NO: 2570 - DNA, 321 bp, Diabrotica virgifera
  Clone ID: LIB150-008-Q1-E1-A12
cacaatttttaaataattttaaattttaaatcctgaaaaccagatatattaagcatcaaaaatggcttcccgacgatttgtagtaggtggtaactggaaaatgaatggaactaagaagcaaattgaggaaatttgtaattttcttcaagctggacccctagatcccaacactgaagttgtagtcggagtacctgcagtgtacttagaacatgttcgtagcaaactcccagcaaccataggaatagctgctcaaaattgttataaatgaagaaaaaggtgcattcactggagaattatcaactcttatgctgaaagacattg

SEQ ID NO: 2571 - DNA, 343 bp, Diabrotica virgifera
  Clone ID: LIB150-048-Q1-E1-G5
cgatgactctacttgtgcgctatcggtctccggccagtctttagctttagatgacatttaccagcgatttaggggtgcattcccaaacaagtcgacgcgtcgagggagcttcacactggactcggacaccccgtcgcacacgggattcgcaccctctaggacgggtcgttccagggcacttggacgggggccgcacccgaagcatgctctgcaagttacaactcggagcccgaaggggccagatttcaaagttgagctcttgcggcgtcagtcgcggttacggaggcaatcggggtggattcttttcctgggcttagtgaggggcttaggttcagcgggtagc

SEQ ID NO: 2572 - DNA, 409 bp, Diabrotica virgifera
  Clone ID: LIB3026-032-Q1-E1-H12
acgcatccgaagcttcaaaagttgttatcacagatattttagacgtaaaattagagatggctaaacaattgggagcagattataccatcaaaatcgaaaagggtatgtctgaagaagacatcgtcaaaagagtaatccaacttttggggcaagaaccaaataagagcatggactgtactggagtcgaacaatgtgtcagagtttgcgtatctgcaactggagtaaatggatgcgtagtacttgtaggattaggtaaaattgaaatgactctcccattaactaacgccttgatcaaagaagttgatgtcagaggaacattcagatatgttaacgattaccccacctctattgagctagtaagatctggaagagtaaatgtcaaacctttggtgactcaccactataaact

SEQ ID NO: 2573 - DNA, 405 bp, Diabrotica virgifera
  Clone ID: LIB149-003-Q1-E1-D9
agttgttaagtacttatttattgtgtatataatttctagagcagaataactcatttgtagatatattgttaatattctctgattacttttaaatatagtttataattatttattacacagttgcataactgatgttaaaaaatcgaactgttcaagttttaataatatattttttcgcgttcgggagtgtttatcattaatttaaccaacgggactaatttctaataaagatgattaaaaaactgttgtcggttcagagactttccagtcagtacatacaccgaagatggtttttaagataggcatgtctttggctgcaaatatgatgagtagcccgtaaattggccatggttgaagctgacttggaacgtgctgaagaacgtgccgaagccggtgaatccaaaa

SEQ ID NO: 2574 - DNA, 478 bp, Diabrotica virgifera
  unsure (1)..(478): unsure at all n locations
  Clone ID: pGUT3765
ctcgtttctaggattcgaaatctgtaaaattaatttttacaaaaatgagtgcctggagagctgctggattaaactacattaactattccaacattgctgccaaacttctgaggcaggcacttaaacctgaacttagaacagaagcaatgagaagaaatgaaacccatattaaagtaaccaaatggcaagatggaaagccaataagggagtccacattttaaatccataatttaagtccaagtctatgtagtgttaataattgtttagtcaactacaatttatgttacaattttgtaaatatcagttccagatttatattatgtgggtattattcctatttttgatgtaaaaatggaatagtgaaaaagaataaaacaatattattntgtcggagagaacaagctgggctttcaaaaccaccggatccctcgaaagaaaaatnntcttcctcgggggggggcgcgcccccccccccccc

SEQ ID NO: 2575 - DNA, 476 bp, Diabrotica virgifera
  unsure (1)..(476): unsure at all n locations
  Clone ID: LIB149-012-Q1-E1-E8
ccggggccacccaagcgtccggaatatttgtaactgtaggaacaacaaaattcccaaaactaattaatacaattactaacgagcaagtaattcgttcttttatatctttagggtatgattatattcaaattcaaactggaaaagatgccatcaaaccaccagttattgatttaccccacacaataaagcaagaagaaacgtctcttattatagaaatccaagacaagttggtaatcaaatatgattcatacttcgaagatttcgaaccagaaatagtaaagagtgatttggtaattagtcatgcaggtgcagggacttgtttggaagtgctcaagaaaggaaaacatctgttagttgtagttaacgaagacttaatggataatcatcaaatagaattagcagggcagcttcangatagtggctacttanattattgtacttgtgatacactcaatgagatgttaaaacaaaacttt

SEQ ID NO: 2576 - DNA, 306 bp, Diabrotica virgifera
  unsure (1)..(306): unsure at all n locations
  Clone ID: pGUT3215
gaagaacttttcttagtagaagcagagaaagttaagatgtatcaactaaaagggcacagatctgtaggaggaatcagagctagtttatacaatgcagttactttagatgatgttaaattgttagttaaatttatgaaagaattccaggcgcaacatggatcaaagtgatgttattaatttgtgtaaaataaatataattcggaattgtaaaaaaaaaaaaaaaaaaaaaaaaaantcttggggggggggccgggccccaaattccccttataggggggggtttaaaaatccccgggccggggttta

SEQ ID NO: 2577 - DNA, 427 bp, Diabrotica virgifera
  Clone ID: LIB149-006-Q1-E1-H8
gagatatttgtaattttatttaaaatatttacaagatgaaacctattgttttgtgtttgatgataatagcagcatctaaagctattccaacaaacagattaaccaatgatgatgccaacttgggagattttccatggatcgtcgcgttgaatatttacgcccgtatgccatggtacgagataacttatcacgaatgtggaggcgtacttgtaagcaaatcttgggttttaacttcagctagttgcgtcaaatctaatgcccaatggaatacagtgacagagatctacgctggtttcgtacgacaaaacgacccgtcgcgtcaatcatttacgatttcaagaattgagcgacatcctggttttaatatgaatgaatctcgcaatccatcttttgacgatattgctttggtaaaactggatcgtgatgt

SEQ ID NO: 2578 - DNA, 431 bp, Diabrotica virgifera
  Clone ID: LIB150-029-Q1-E1-B2
cccacgcgaccgcttttgtataaaagcagtccagaaagaatccaaccggttgacggtttaaagcagtcgtcagtcgttcagtttttggtttatttagtttaaaagaacgagtaacatggcaaacagagactcagctactaaccaattacttaactacaagaaaaagactcaagggggagagtctgtaacaactggatatggcaaccccgtcggacaattcgcttctttgagcgtcgggcccagaggccccattctattccaagatcaaatcctagtcgatgaactttcccactttaacagggaaaggattcctgaaagagtagtccacgctaaaggagctggtgctttcggataatttgaatgtactaatgatatcacaaaatactcaacaacaaaattaatttcctccatcgggcaaaaagacccaatcg

SEQ ID NO: 2579 - DNA, 380 bp, Diabrotica virgifera
  Clone ID: LIB149-027-Q1-E1-D8
accttacttccggcactgatagtcagtcggaatttcggtccatttgtggtgtcaattttagtgttcatcttccaactcacgtgactgtatctcagtctatgtcggactcgatgttgtccaaatcggtatcgactgctgtgatttgtgctgccagttatatggcatccaacatgacagccatattgaatgacacatgactgtaggcagaagagatgacagttgcaatacattcttcagtgcattcgtcactggcactgatgtaggtaaagcagtatctgtagcattggttgtagcattggtacctgcagtacttaacggcatatatcgtcgaatgttccatccattgtacctcatcactggcctcatcaatggcaccaata

SEQ ID NO: 2580 - DNA, 381 bp, Diabrotica virgifera
  Clone ID: LIB149-027-Q1-E1-H8
aggacgcgtgggttcggcttctggaagctctacaactctaccctaagtctaggcaataaagaacttcaaaacgctacgttagatttggttgttgagaactttggaagatgcggatatggagccttagatcaattccaacaatataaaggtcttactgatgacgttttcgttaatggaaataaactaacagactggacgattattcccttagaatttaaaactagctggaacaaaaatctaggcaactggaaagctgtaggaaacactacaaatactccagcactttataaattttcactaaacataccagaagaaccacaagatacctttgtgtctttaaggacttgggtcaaggggatcacaatagttaatggttttgtg

SEQ ID NO: 2581 - DNA, 443 bp, Diabrotica virgifera
  unsure (1)..(443): unsure at all n locations
  Clone ID: LIB149-010-Q1-E1-B10
aagcaaaaagttgctgtggtaaccggtgggaataaaggaataggatatgccattgtcaaaggcctctgtgaacgatttgatggactcgtttatctgacagctcgagatgtagaaagaggtcaagccgctgtagctcagctagaaaaagaaaataagaaagcagtgtttcaccaactggatattaataaccaagccagtgtagacgaattaagggattttattaaagatagacatggcggattggatctgctaatcaataatgcagcaatagcctttggtagagcagctacagaatctccatttgtccaagcatcaaaaactatagaagccaattactttggaaccctaagagtttgtgaagctttgtttcctttgttaaggaataacgcanaagttgtaaatctttccagcgctgcaggacatctgtctaaaataccgacaga

SEQ ID NO: 2582 - DNA, 379 bp, Diabrotica virgifera
  Clone ID: LIB150-032-Q1-E1-G2
gggtccacgcacgcgtccgaccacaagtccgaaaattggtggtattggaacagtacctgtaggtcgtgttgaaactggtgtattgacacctggtatggttgtagtattcgctccagccaatttgacgactgaagtaaaatccgttgatatgcatcacgaagccctccacgaagcagtacctggtgacaatgttggtttcaacgtcaagaatgtctctgttaaagaactgcgtcgtggttacgtagctggagataccccgaataacccacccagaggagcttcagacttcactgctcaagtcactggtcacaaccaccctggtcaaatctcacacggatatgaccctgtactcgactgtcacacagctcacattgactgc

SEQ ID NO: 2583 - DNA, 369 bp, Diabrotica virgifera
  Clone ID: LIB149-008-Q1-E1-A12
atcccttacaagttcaaatagtggcaaaattaaaggatggtcctttgctgactattaagttttcctacctaataaaattaaaaatcattacagtcatgtctagcacgaactgctcagcatgtaaaataactggcaactcagctagggaagtgttaaccggagagaaccttctgagtgagttggtagaagatgataatggcctagaaagtccaaatccaataacgaaatttcagattaagaagatcggacttacttcttttcaatcgttagtgccacagatcggatacgcataccattgggctcaaagagtatgcggaagagattttcttaataaaaaaatggattcggatgaattaggcagaactaatg

SEQ ID NO: 2584 - DNA, 392 bp, Diabrotica virgifera
  Clone ID: LIB3026-006-Q1-E1-A2
ttgtgaattataatcaaattttaataaaaatcagactgatacgaggtcaattacctaaataccgaagtgaaacttatccacaggtccctaaaacctacatcgcacaaacttatttatagacaaactatttcaaagaaaacaaaatggataagctgaaaagagttttaactgggaatgagtctccagatgaagagagtggaataatgtcacaattagacgatgctaccaccttaagttggtccacaagactaaaaggctttttggcatgtttcataataggcatattactgtcgtttttgggttcgtttgctttatttttaaatagaggtttgccagtttttgcagtattttacaccttaggaaacgtcacgtccctcctcagcacatgcttc

SEQ ID NO: 2585 - DNA, 393 bp, Diabrotica virgifera
  Clone ID: LIB150-032-Q1-E1-C2
gcgtccgaagaaattgccgaaattgctttttcctataaatatggggaacctgtaccatttattgaatatactgaaactgaaaataaaacttggaatgcagtgttcaccacagtttgcgaattaatgcacaaacatgcatgtgcagagtacagaacagttttcagaatacttcaagacgaagggatattcaatccacacaaagtaccacaattggaagaaatgtcttgttttatgaagaaacgtacaggatttactttaagacctgccgctggattacttacagcaagagatttcttggcttcacttgctttcagaattttccaaagtacacaatacgtccgtcacacaaaaacaccattccatacagcagaacctgactgcattcatgaaatc

SEQ ID NO: 2586 - DNA, 415 bp, Diabrotica virgifera
  Clone ID: LIB150-038-Q1-E1-E7
aagaaacatatatcagctctagatataatatcaacttctggacttgttaattactttggcagatgggaaaacttagataaagtagacataactcctattctactccagaaaggaaaatctaaattagctctgtatggactttcccatattagagatgaaagattaggaagattgtttatagaccaaaaagtagaaatgttgtccccaaaggacaaagacgattggtttcatttgctggtttggcatcagaaccgagccacaagaggatcaaagaattttatacctgatgattgtcttccagattttttaaatctagtaatttggggacatgaacacgattgtagaatagagccagagaggaaacttaatgatgtttttatatctcaaccaggcagttcagttgctacttctttaa

SEQ ID NO: 2587 - DNA, 393 bp, Diabrotica virgifera
  Clone ID: LIB150-024-Q1-E1-E4
cagacgcatgggttctgtaccaattggtatctacagtcagttgtggagggaatctccttatgaatgttggacctacaaaagacggcataattgctcctattttccaacaacgtcttaaagatttgggtacttggttgtcaattaacggtgactctatttatagtacaagaccatggacatcacaaaacgattccttgacaaacggagtttggtataccagcaaaggctctgatgtatatgccattagtttgcaatggcctaaagataatatattggatctgggatctgctattgatctgttcaaaaatacaaatacttcagtgcatttgctcggccatgaaagtggtgaagcattaaagtggactttaggtgcatcctcagtaaccattaatt

SEQ ID NO: 2588 - DNA, 330 bp, Diabrotica virgifera
  unsure (1)..(330): unsure at all n locations
  Clone ID: LIB3026-003-Q1-E1-B7
aattaataattatatatttattattttcgaatttaaaagagctaaaaaattaaaatttttattgtaaaataaatattttaaataatttttttgtaatgaaatgttattcgtttttaaatatatctaattttttaagaaataaattaaatttatttattaacaatatatttatatgcgaatatggtgatattattaagggggggggggggggnggatgagcttaatggtaaggtggaagggggatttaatttttaaataaagattaggattaaaaattttcagattttaaaatatgttatgatttatttttatatattagtagttttagtt

SEQ ID NO: 2589 - DNA, 421 bp, Diabrotica virgifera
  unsure (1)..(421): unsure at all n locations
  Clone ID: LIB150-021-Q1-E1-G5
aaaaaacccaacgagaacaatgactgaattaacatacatgagcggcttcggctcagaattacaatccgaagatccaagatgcccgggctccttgccaccagaccaaaacagtccacaaaaatgcccctatggtctgtacgccgagcagttatcgggattagcctttactgctcctagattagaaaataagagaacttgggtccatagaattaaaccgtctgtgttacataaaccatttgaatccatcaagagtagcgacgtgagtcataactgggatgaagaggaaccgaatccaaatcagttactatgggatccttttgaaatgccgccaaactccaaaaaagtagacttcgtanagggattacacactgtagcaagagctggtgattccaaatgcaaaactggccttgctattcatgca

SEQ ID NO: 2590 - DNA, 321 bp, Diabrotica virgifera
  Clone ID: LIB3026-033-Q1-E1-F1
acgcgtccgtaaccataacttgtttgatggagtaatcttgatatgactctctcattaattaacgccttgatcaaagaagttgatgtcataggaacattcacatatgttaacgattaccccacctctattgagctagtaagatctggaagagtaaatgtcaaacctttggtgactcaccactatgaacgagaagactcagttaagggattccataccgctaagactcaagaaggcagaccagtcaagatcctgatggatgccaatcctaactggaaaccatcttagtaatttaattgccgccatacgtattagtttttgttg

SEQ ID NO: 2591 - DNA, 329 bp, Diabrotica virgifera
  Clone ID: pGUT2942
aaaaaaacaacgtccgaaaactgtagcgactatagaaggaggagccttatgagccacaccttgaaaatctttctacgtatcatccacagtagaatcagagataaatgtgaaaaagaccacgatgaaacacaatttggcttcagaaatggactgggaacccgggacgcactctttgcactaaatgtgttattgcagaaatgccgagatcaaaagaaaaacctctttgctgtatttattgactatgagaaggcctttgatctagttcaacatcacaaattaatttaaatacttaaggataaaggagttgatagtccagatgtacgaatcat

SEQ ID NO: 2592 - DNA, 240 bp, Diabrotica virgifera
  Clone ID: LIB149-042-Q1-E1-A2
attattatttattttaaaataataaaatattttttagtaaaagtaaagaaaaattttatttaatgatagttaattagtattgtgagagaatattttatttttataaaagaaaaatttactttttgtaccttgtgtatcagggattattaattaataattagatatttactattttcgaatttaaaagagctaaaaaattaaaatttttaatgtaaaataaatattttaaataattttttt

SEQ ID NO: 2593 - DNA, 428 bp, Diabrotica virgifera
  Clone ID: LIB150-018-Q1-E1-A8
gaccaaagagtatttgtatccaagtttgaaagttcctaccggatctaccacagagctgtctttcaaaggtcaacagttcctcacacatctcttcgaaaggttcgataaagatagagataaagtcttatcgccgtcagaatacgaagaactgttttcaacgtgccccactcccgcgtggggcccagacgtcagctctatggtgccaactaacgagaagggatggattacgtatcacgggtacatgtgtcaatgggcgttgatgactttggtggatctacccaggacttttgagtatttggcttacctgaggtacaatatttatgaaaacgagacacaggtgacagcggtacaagtaacaagagataagaagacagatttagccaagaaacaatccagtagaaacgtgtaccagtgtcacgtaattggtc

SEQ ID NO: 2594 - DNA, 412 bp, Diabrotica virgifera
  Clone ID: LIB150-026-Q1-E1-A10
gtcgttggtcgacccaaaagtgaatcgtgagacgctgtaggtcgtgttgaaactggagtattgaaacctggtatggttgtagtattcgctccagccaatttgacgactgaagtaaaatccgttggaatgcagcacgacgcgctccaggaagcagtacctggtgacaatgttggtttcaacgtcaagaatgtctctgttaaagaattgcgtcggggttacgtagctggtgacaccatgaacatgccagccagaggagcttcagacttcactgcccaagtcattgttctcaaccaccctggtcaaatctcaaacggatatacccctgtactcgactgtcacacagctcacattgcctgcaaattcgcagaaatcaaagaataggttgaccgtcgttctggtaagaccactgaag

SEQ ID NO: 2595 - DNA, 428 bp, Diabrotica virgifera
  Clone ID: LIB3026-008-Q1-E1-C5
acaagaagcaagcaaaggtttatgtatgttttggtgttgcgaataaaaaaaaatattgaaatttagcattattgtttaatgaatgacggtaaaatatcacgtccgtttttttagacttaatcaaatagcatggcaaacagttcaaataacgttgattcgtttaatttcaaagttgtcttgttaggggaaggctgtgttggtaaaacaagtttggtcatacgatacattgaagataaatttaatcccaagcatatatccactattcaggcttcgtttttaacgaaaaaattgaatttagacggcaatcgcgtaaatctttccatatgggatacagcaggtcaagagaaattccatgccctaggtccgatttactatagatcatcgaatggagccgttctggtctacgacatcaccgacgaagactcctt

SEQ ID NO: 2596 - DNA, 427 bp, Diabrotica virgifera
  Clone ID: LIB150-036-Q1-E1-D4
gacgcgcgggtcgatgcaagactctagatagagtcgtaatattgtcaactttttcgtttcggtaaaatttatactaactagccgtcagaaaagttactaattctccagttatttaattgagaatttgactttattcgtcactagcgcaataactcagtatggtgattattaattcatttaaacaccccgagtctcctattaggtatcaacaggacgatgttcaagtctacttagacaagaaagatttgggcctgggaactttatttgttagtgaaagcacattatgctggcaacaagaagagaacaatggttttgctattgaatattcaagtatttccttgcatgccatatctaaagatttaaacattcattctacagaatgtgtatacctcgtgacagatggacatattactatgccaggtgacag

SEQ ID NO: 2597 - DNA, 168 bp, Diabrotica virgifera
  Clone ID: LIB150-005-Q1-E1-G4
tcaaaaatagcaaaaactccttggctcatatcgttgatgactggatacagagctataaactgaatctaaaagctggactgatatctcttatggagttctttataaaagcttctgggtgtaaaggtcgtattacccagcagatgcaaggctctatgggacatgctggga

SEQ ID NO: 2598 - DNA, 434 bp, Diabrotica virgifera
  Clone ID: LIB150-045-Q1-E1-B4
cccacgcgtccggttggttttaagatatacgtaatcggaggatttgatggtatggactatttcaattcatgtagatgttttgatgctgttactaaaacctggaaagaggtagctccaatgcactctagaagatgttatgttagtacttctgttctgaaaggtacaatttacgctatgggtggatacgacggacatagtcgaaaaaatagtgctgagaaatatgatcatagaactaaccaatggtcccttatagctccaatgaacatgcagcggtcagatgcaagtgcttgtaaccttgacggcaaaatctatataactggtggctttaatggccaagaatgcatgcattcggcagaagtgtatgatcctgaactaaaccaatggtcgttaataagtccaatgcggtcacgtcgttctggagtaagctgtattgc

SEQ ID NO: 2599 - DNA, 433 bp, Diabrotica virgifera
  unsure (1)..(433): unsure at all n locations
  Clone ID: LIB149-013-Q1-E1-E2
ccgaaaaacacagatganacatactgtattgataatggaactccccaagacatttggctcaaaaacttggaactcaaaaaaccaaataggggaactaaccaattggacccccacatgtcgggtgtacacctggcctaggtcccaggtcagttgaatgctgatcttagaaaattggctgtcaacatggttcncttcncccgtctccacttcttcatgcccggattcgctccactcacctcaagaggcagccaacaatacagagcgttgacagttccagagctcacacagcaaatgtttgatgccaagaacatgatggcggcttgtgatcccagacacggaaggtaccttacagtagctgcagtattcagaggtaggatgtcaatgaaagaagttgacgaacagatgctcaacatccagaacaagaacagcagct

SEQ ID NO: 2600 - DNA, 303 bp, Diabrotica virgifera
  Clone ID: pGUT3909
aatatatttattaattaaatttgtcttgcaaatcagataacggttaagttattcactctagtggacccggccacaaagcacatagttcgaggtgttgaaaaatgtatacaatgagccgggatgaaacaatggaaagctgaaaatgcaactctggtttcctcactgtgaagtcatcatggtgacgaactcttcgtaattgacttgaccatcaccatcgatatcggcctcccgaatcatttcgtcgacttcttcgtctgtcaatttttcacccaaagtggtcatgacgtggcgcaattctgctgc

SEQ ID NO: 2601 - DNA, 534 bp, Diabrotica virgifera
  Clone ID: pGUT2888
ccgcacgagccacttcaagctttgaaccgtagggatccagaagcctgttcctgaggtattaaaagccaaacttgaaccagaatccgaacccttttcattggattaccccggggcaaaattcgccaactccttcctaaaaggtctcaaaggaaaaccaaacgtcatcgatcaagcctacgtccattcagacgtacccgaatcctttcatgtctccccacctctagacttaggcaacaacggactcgagaagaacttgggtcttgcaaaactcagcgatttccaacaagatttgctcaccagagcacttccagaacttaagaagaacatcgaagctggtgtcaagttcgccaaccactagaataacatctaatgttaaatttatgtttattttttgttctttttgtattattttttcagtaaagtaaagggttttctagtcgttcgtgtaacggacaattttttatagccaaaattaacaactgtataagaagtagaaatctgtcatctgcatttctgaaataaataattgttttt

SEQ ID NO: 2602 - DNA, 357 bp, Diabrotica virgifera
  Clone ID: LIB149-019-Q1-E1-E3
acacatgaattattttacacttacacccttcaaaaactcatttataaactaaaaatgggtgcatctgtaattcctttcatagttttcactgtattatggggaggagttggagctgttctacccatttttgtacctaaaggacccaatagaggaattatccaagttattcttatgataacaggtgtgtcgtgctggttgttctggctgtgttgttacgtagctcaaatgaatcctctgatcggtcctaaactagaacaaaacatcgtgctgattatggcaaaacaatggaaatatgcattaccatcgtcagcttgaatgaaggtgtgagtgaccattccatctggatagtgtgtataa

SEQ ID NO: 2603 - DNA, 372 bp, Diabrotica virgifera
  Clone ID: LIB150-039-Q1-E1-C12
gagccaagcgtctaaagagagtcgtataatctaatatttttttttactttcattttttatttagttaataatttaaacgatttgaacttgaagtataaaccaaaatattttaagactaacggaactaattgaaaattcaattgacaatgataagagatttatttccttctttcgaccctacatctaatttgaatttaccagtaaactgattaagaacagtagtaggtcgattaattattccagcgagattttgattaatcccctctcgttaaaattatttatgagtaaagattattagaacattacataaagaatttaaagttttaattggaaattagaaatcccagggaagaacattactttttatctcac

SEQ ID NO: 2604 - DNA, 335 bp, Diabrotica virgifera
  Clone ID: LIB150-034-Q1-E1-G1
accacacgtccgcccaagcgtccgatagagtgttctgtgtgatctagtaacagttattgaatagattttataaatcacattgagggaaatcgttcatatccaagctcggctgtgcggtaaccaatttggacccatattctgggaaagcatcactgatgaatactgcatcgaccccaccggtgcctatcatgagcacactgaccgccaacgtgaaataatcagtgtctactacaacgaggtctaccggagacagtatgtactcggcgccatcatcgtcgacttggaatgcggtaccatgcactcagtatagtcgggtcacttcggacaaatcttca

SEQ ID NO: 2605 - DNA, 422 bp, Diabrotica virgifera
  Clone ID: LIB3026-007-Q1-E1-H10
acccacgcgtccgtatgactgctggagggattctggtgttaaagtatgtgtacccgaagttatgaagacgtttagggaaaatatttctaaagttatcaagctggttttatccgttgtacctaaaattggcgagactgattggcataagacaattacagagttaaaggaagtgcagcaaagcagtgtgatgttgccacattagttgcccccaagttgaaggatccattctacattcctacctgcctaagtattttaaattaatgacattatttttctactactgttacatatacataaccaagatagatgaagactaattttacaatcttgaaataacattccgtactttcataaaatatatagcacacaatatttgtttgttatagcactgtattttgtcataataaaaaagtatcaatagg

SEQ ID NO: 2606 - DNA, 370 bp, Diabrotica virgifera
  Clone ID: LIB3026-027-Q1-E1-E8
aattttatttagtttaaaataataaaatattttttagtaaaagtaaagaaaaattttatttaatgatagttaattagtattgtgagagaatatttgatttttataaaagagaaggttattttttgtaccttgtgtagcagggattattaattagtaattagatatttattagtttcgaagttaaaagagctaaaaaattaacatttttattgtaggataaatagtgtaaagaatttttttgtaatgaaatgtgattcgtttttaaatatatctaattttttaagaaataaattaagtttatttagtaacaatagagttataattaaatatttttatatgattaatatgaaggatttttacggatgagctt

SEQ ID NO: 2607 - DNA, 407 bp, Diabrotica virgifera
  Clone ID: LIB3026-027-Q1-E1-F10
agggagccgggtgctaagttcttccttccagaaatttctaacgtgttcgaaaccaccacgtttttgtaataattgtataataaatttctcacaatcactaaaatgtcaggagcagctaaaagattgatcccactttttgatagaatcctcattaaaaagtttgaagcagtgtcgaaaactaaaggtggtattgttcttccggaaaaagcacaagataaagttttacaaggtactgttgttgcagtgggacaaggagctagactacaagatggttcatttgccgctcctactattaaagtcggtgataaagtactcctccctgaatatggtggcaccaaagtaaatgtagaagataatgcagagtaccaaatattcagagaatctgatattatagccaaagtagaata

SEQ ID NO: 2608 - DNA, 421 bp, Diabrotica virgifera
  Clone ID: LIB150-043-Q1-E1-A10
acacttgctgttagaacaatgggttgtattagagtagataaaatcactgaatatctttgtgagccactgaggaaatgtctaaaagatgaagatccttatgtaagaaaaacagcagctgtttgtgttgccaaattatatgacatttcgtcaggtttggtagaggatcaaggctttttagaacagctaaaagaattgttgagtgattccaaccctatggtagttgctaacgctgtcgcagctttgtccgagataaatgaaagcagtcctactggtcaacctctagttgaactcagtacaaacactattaataaacttcttaccgctctaaacgaatgtaccgaatggggccaagtgttcatcctcgattcactttcaaattacacccctcgtgatgagcgcgaggcccaaagtatttgtgaac

SEQ ID NO: 2609 - DNA, 430 bp, Diabrotica virgifera
  unsure (1)..(430): unsure at all n locations
  Clone ID: LIB150-009-Q1-E1-C2
gaaatgggcacacggcttgtttatggaagcattatatgattatttatggtggatatgaagaacactctgatgctttcgctcgaattatatattacttggatttagatactatgcattggacatatgtccctataggtggaccggaaccaactccacgagattttcatacgactgtcgtaatcaatgacagaatgtatttgtttggaggaagaggtaccttacatgatcactttgttggcggaagacaagtgttgtattgtaatgaattgtggtatttggatcttaatacttttacatggcaccactgtaaagtcacgggcaccgtaccagttgggagaagaagccattctgcgtntgtttatgatgaaaaaatgtacatttttggaggatataactcagagaaagatcgacactattataatatatacga

SEQ ID NO: 2610 - DNA, 405 bp, Diabrotica virgifera
  unsure (1)..(405): unsure at all n locations
  Clone ID: LIB149-020-Q1-E1-A10
gttacattgaaatgggtaaacatttaaacgcaacaggtcgtcctattgtttactcatgtagttggcctgcttatcaggaaccaaataaaatgcaatctaactacacagctttggctgaaacttgtaacctttggagaaattgggacgacattgatgatagctgggaaagtgtcacatctatcatagagtggttttccgacaatcaagatcgaattggaccattttcagcacctggtcactggaatgatcccgatatgcttgtgattggaaattttggattgagttttgaacagagcaaaggacagatgtcagtttggtcggtaatggcggcaccgttgataatgtcagtggatttaagaactattgagcctaaatttagagcaattctcctcaacanagatgcta

SEQ ID NO: 2611 - DNA, 302 bp, Diabrotica virgifera
  unsure (1)..(302): unsure at all n locations
  Clone ID: LIB3026-007-Q1-E1-B1
ggtcaccacctcgtaaaacagtcttttagtcggaggttgaaaataaactcaaatgaaacgtagatactcgttattcaaaaccaggtaacccaggcgtcatatgagaaggcccgtttagatcaagaattgaaaatcatcggagcctttggtctcagaaacaaacgtgaagtatggagagtaaaatacactctagccaaaatccgtaaagccgccagagaactgcttactctagaagagaaagaacccaaaaggttgtttgaangtaatgcactcctacgtcgtttggttcgtattggagtact

SEQ ID NO: 2612 - DNA, 296 bp, Diabrotica virgifera
  unsure (1)..(296): unsure at all n locations
  Clone ID: LIB150-016-Q1-E1-D3
atcggtaatgcctgctgggagttgtactgcctggaacatggcatcaaacctgacggtcagatgccatcagacaagactgttggaggaggagatgacagtttcaacacattcttcagtgaaactggtgccggcanacatgtacctagagcagtatttgtagatttggaaccaacagtaatagatgaagtacgtaccggcacataccgtcaattgttccacccagaacaactcatcactggcaaagaagatgccgccaataactatgctagaagtcactatacaattggtaaagaaat

SEQ ID NO: 2613 - DNA, 440 bp, Diabrotica virgifera
  Clone ID: LIB150-014-Q1-E1-B10
gaagagagcagattttgagaaaggaatacgcggatccactgctgaggtaccagaagatgccaagactcaaaaatacgaaaagaacgtagcgtccaaaactgttgttgaaggcctttcctacggtcagtctgccggtttaaaagacgatttggatgtagatgaagatgtcggagaaaagaagagaatggcattcttagacttactgattgaagcctcccagaatggtgtcgtcatcaacgacgaagaaattaaagagcaagtcgataccattatgttcgaaggacacgataccacagctgctggaagcagtttcttcctgtctttgatgggaattcatccagaaattcaagacagggtcatccaggaaatcgatgagatctttggagattctgatagacctgctaccttcgccgacactttagaaatgaagtacttagaaa

SEQ ID NO: 2614 - DNA, 448 bp, Diabrotica virgifera
  Clone ID: LIB150-024-Q1-E1-A12
gactcgcgggtcgatacaagactctagactgaatcggaaaaatatgttacggatgccggccaagccacacactttgaaactctgtttggctgtgccgaaaaagccggaattttgaaccgagctgttcatcgtgtggatcatgttggttttggagttgtgttgggtgaagataagaagaagtttaaaactagatcaggtgataccgttaagttgtcggccttgctagatgaaggattgagtcgagcgttggataagctaaaagagaaggaaagagataaggtattaactcctgaagaattaaggaaagctcaagaatccgtagcatacggatgcataaagtacgctgacttgtcgcacaacagaaaccatgaatacgtattctctttcgacaagatgttggacgataagggtaacactgccgtctatcttctgtacgcattcacccgca

SEQ ID NO: 2615 - DNA, 338 bp, Diabrotica virgifera
  Clone ID: LIB3026-010-Q1-E1-H12
aacatgcgtccgcggattcttggggtcagcatgtctccacacagggaagaaattcacgtaactacgaggccatgtataccactgtcaacgacgtttcgggaaacaccgtaagcatcctacaggtcctggtaatgctggtggtatgcatcaccggaaaatcaccgtcgacgtgtagcatccaggatagctcggagagttgggtataacgaactagcacgtaaggaaaaactccaatcggtgcccagctattaacctatacaagttatggacactacttgttgaacaacctaggttagcatacttggaatatccttcgggaaacgacccattcattgaca

SEQ ID NO: 2616 - DNA, 450 bp, Diabrotica virgifera
  Clone ID: LIB3026-011-Q1-E1-C1
cgtccgattcttcgcaacatggtcgtactctatccggaagtgatcgaaggtttccattgcaatttcccggtggttacaagtgctcgccattatataaaactgttcttggccagtctgttcccatctttgtctagttggtatgttcgtccagaacacaggaataaagtgttaccaatgaagcagggtttcgaacgaacattaagggaaactggatatcttcacgaacaggccactaagcccgatacattaggtgttgctatgaatgagtctccaattggtttggcagcatatattttagaaaaatttgtgagcgccacaaaccatcaaaaagccttactggaagaaggtggccttgcggagagttacacctacgattctttgttggataacataatgttctattggcttaatagtgctgccactacttcttttagattatatgcagaaacc

SEQ ID NO: 2617 - DNA, 366 bp, Diabrotica virgifera
  Clone ID: pGUT3113
tttaaaaatacagatgtaaaaatttgatttttcagatcattttgtttaataaattaattaaaaaatgcatatttttgcattgtcctgttatttaagtacacctagatattagtgaccgctgatttctggtttttcgtcggccgcgtaatgtttaataaacctagctgaaggatctgtgactccctcgcaccatctcggcatccaatagtaaggcaaaaagttttgggctagtttggggtagctcttttcgaagacttccctataatagtacgcctcttttgtagtcggggtgcagtgtgggtacttatgtttggctctttctaaatcaaacggctctggcattcttttgtcgattatttcttgaat

SEQ ID NO: 2618 - DNA, 380 bp, Diabrotica virgifera
  Clone ID: LIB149-023-Q1-E1-B3
ttaattttatttgtagtttttagtggaagattattttcttgattagtattttcaaccccaatttttatttgtcttccttttttaataaaaattataactttgatttttattatagttggagtttgattaggttatgagttagctaaatttaaaatttcttataatttattaaggttaaataatatttctagagtattattttttagaataatatgaaatataccttttttatctactttaggaattaattattatccaatttattttggtatattttataaaaaattttttgatataggatgatttgaatattatggaagttcaagtgtaataaaacaatttaattaatagaatattttacagttattttctcttaatca

SEQ ID NO: 2619 - DNA, 488 bp, Diabrotica virgifera
  Clone ID: pGUT3435
agacagttagctttatgatgaacacaacatatcaagaggatattgacgttaaatttggtgctgattgtaataattctctgcatatataacgaaacatcaatttgttatggactcgataatcgcgaagttaattttaaagtacaattaacggctaaacatataccagaacatactcaacgggacaccttatacgttgaagaaaaaaatattaacgagaaactaacagtgaatgtggaatatgtcagtagttgtcaatgctcgaactataaagacgacggaaataaattttgtggccatggtacctatagatgtggacgctggtactgtcaggagggatggtctgggtcaaattgttcagaaaattgtgaaaattttgattttcgaagctgtcgttcatatgaagacttgatcccccatcaaaaaatttgttttgaaaacggagactgcaaatgtggccattgggaatgtgaactaccttattcagggaa

SEQ ID NO: 2620 - DNA, 413 bp, Diabrotica virgifera
  unsure (1)..(413): unsure at all n locations
  Clone ID: LIB149-036-Q1-E1-H3
aggcttcgtctgttcagtttacaaagtaatttgggaaacgaacaacattatcctgaagattatggaccataactgcgagacggagatgagtttgattttatagtaataggagcatgatcagcaggatcggtggtcgcgaataaactaagtgaaaatgctggttggcgagtgttagtgctacaggccggaggatacccttcctttctcagtgacataccagcattcctgttcagtttgcaaggcaccgatgaagactggcaatataaaaccgaaccttcggaaacatcatgcttggctttcanagatggacaatgtcgttggccaaaggggaaagtgttgggaggttaccagcacattaacgcgatgttgtatatgagaggagataaacgagactacgatcattgggcggaact

SEQ ID NO: 2621 - DNA, 443 bp, Diabrotica virgifera
  Clone ID: LIB150-016-Q1-E1-F12
cccacgcgtccgagtagatcctttttcgttttcgaagcaatctgtgattaatcgtgatgttaaacctggtgtacaggaagacagtaaatggctgatacatagtgataggaatattccgaagaatgtggaacagtgggaggaaaggatgtacatccacgaccaatatacagggtactactgttggccgaaaaccttagaattatacgatacgccttccacgcaaaaaacggccgcgaaaaggctggacgatctgacggagatagaataggatgtttatacgttttttaacaataaggaaaatatagaaaagcttattaagtttctatcgttagatgaaaagaagggacgggatcatttcaacgcctatagattcctggcctttaagaatttatttacgatattcgaagactctctcttaccgaacttcgtacctcatctacaac

SEQ ID NO: 2622 - DNA, 416 bp, Diabrotica virgifera
  unsure (1)..(416): unsure at all n locations
  Clone ID: LIB149-019-Q1-E1-A10
agttcgattgatgtgtgtgtgagctactgtaaataatttatagaataagagaaaatgtcgttatccaccgctcgcccattagtgagcgtatacaatgagaagtccgaggaagtaaagggttcaaatatttcacttccagcagttttcaaggctccaatcagacccgatgtagtcaatttcgttcaccaacaggtttctatgaaccatcgtcaaccctacagcgttagtgacaaagctggacatcaaacatctgctgaatcatggggtaccggacgtgctgttgctcgtattccccgtgtaaganganggtggtaccaacggttctggtcagggagctttcggtaacatgtgtanaggtgggcgcatgttttgcacaaccaagccatggcggcgctggcacagacgtgtaaacatca

SEQ ID NO: 2623 - DNA, 441 bp, Diabrotica virgifera
  Clone ID: LIB150-047-Q1-E1-H11
gtgcacacgtaatttaagtatttatttaagaattgtctgcaaataattaattataagatggctaaagccccagctgtaggtattgatttaggaaccacatactcctgtgtaggagttttccaacatggcaaagttgaaattattgccaatgaccaaggtaacagaaccacaccatcatatgtggcaatcacagacacaggacgtctcaaccgagatactggcaagaaccaagttaccaatgaacccaattaacacaattttggaggcaaaacctctaattgggcgtcgctttgataacagtgcgtgtacactcagacatgaaacattggccatttgaagtagtaaatgatgcaggtaaaccaaagattaaagttgcatacaagggcgaagacaaatcctttctaccaggaagaagtcagttccatgggccttacaaaaatg

SEQ ID NO: 2624 - DNA, 455 bp, Diabrotica virgifera
  unsure (1)..(455): unsure at all n locations
  Clone ID: LIB149-016-Q1-E1-G10
cacactttggatattaaatattttattctaaatctcaagaatggcttcaaaagacagattgatgatttttccatctagaggagcccaaatgatgatgaaatccaggctaaagggagcccaaaagggacatagtttattaaagaagaaagctgatgctttacaaatgagatttagaatgattttgaacaaaattattgagaccaaaactctcatgggtgaagtaatgaaagaagctgccttttctttagctgaagcaaagtttgcaactggtgacttcaatcaagttgttcttcanaatgtcactaagtctcaaataaaaataagaactaagaaagacaacgttgctggtgttactttacaagtgtntgaatgctaccaagatggtacagatacatatgagttggctggtttggctangggaagtcaacaattgacaaaactcaagaagaattatc

SEQ ID NO: 2625 - DNA, 440 bp, Diabrotica virgifera
  Clone ID: LIB150-014-Q1-E1-G9
ggaaaaagtgttgtttgtgctgatcgcattgttgtgtcaaggcagtttaggccaactcattcgttgcccacgtggcgaaatttggaacaattgtgcgtcgtgtgatcctgaggctacttgtcaaaacagaatcccggaagctccaggtatctgtccagctgtttgtcaacaacgttgtgaatgtgactctaaaaatgggttaatccgtgatcaaatctctggagcatgtgtgcctatagacaaatgtccaggttgttcacggggagaaatatggaatgaatgtgcctcgtgtaatcctgaacctacctgccaaaacaggacaagccaaatcccaaaaatttgtccagatgtatgttatccacgatgcgagtgcgatgctaatgctggatttataagagatgcaatttctggacaatgtattcctcgggaacaatgccctg

SEQ ID NO: 2626 - DNA, 393 bp, Diabrotica virgifera
  Clone ID: LIB149-031-Q1-E1-F3
acaaaaaacgtctgtttttaaaaatttaatttaatttatttattttctaattatgtctctctgcgaggctgaaaaaacgtttgtgctacatggagtagaggaaaattttagagtagatggaagagaacgagaggattacagacctatggaattagaaactgacattgtctctcacgcatttggttcagcaaggctgagactagcaaatactgatgttctggtagcggttaagattgaagttgatgtaccttttccggaaacacctaacttaggaaagctggaattcttcgttgattgttctgcaaatgctacaccagattttgaaggcagaggtggtgaagatcttgctatagctatctcaaacactttaagttcagcgtactcttctccgct

SEQ ID NO: 2627 - DNA, 349 bp, Diabrotica virgifera
  Clone ID: LIB150-032-Q1-E1-A4
ggcgacaacaccagaattctcaaaggcgtgatgcgcgtaggacatctctcacagggactgattctccgcggcgacatcaacgtccagctggtcgtcctctgcgccgacaaacccaccttaaccctcttaaagaacgtggtggaactgctgcctcacgctttgaaacagatcgctcctgaagaggcctacagagtggccatcaacgctcgcgaagcaagtttgaacgtgaccggcaaggatggcaacgttttggtacagttcacgagtcctgtcatcagagaacagcaagaagctgcaagcggtgggttcgaccgggatgttctgtcacgcggcaagtgtctccaggcgc

SEQ ID NO: 2628 - DNA, 326 bp, Diabrotica virgifera
  Clone ID: LIB149-049-Q1-E1-H4
gacgattcaggtgaaaaggaacaagctttgtgggatttcaagaaagggatctgtaatgtacttgttgcaacaggtgttgctgcgagaggattggatatagaaggtatagagcatgtcatcaactttgatttgccgaagtcaaaagatgaatatgttcatcgtatcggaagaacagggcgtgtcggaaataacggtaaagctaccagttttttcgactcttccagcgattctgctctggcacctgctctagctgttattctgaaacaagctggacaagaattccagactgggttggtgacatgagttctcagtcatcgtatcatgac

SEQ ID NO: 2629 - DNA, 417 bp, Diabrotica virgifera
  Clone ID: LIB150-005-Q1-E2-F8
aggtttttgctcttttgatgattaattagctttattgaataagattttttttctgtttgataaaatgatttccgaaaattaccttaaacgggtaaatattaccgcagatgtgtatgctatatgtgttcaacatgctttaacaactgaaaaacaagaaattatgggtctacttattggagaggtaaatgaaagtgaacgtgtttccaatatttcagcttgtgttattttacatagaagtgataaacagccagacagagtggaaatatcaccagaacagctttgtcatgcttcaatgcatgcagatcagttagctaaaaaacttaatagaccgatgagggtacttggatggtatcattcccacccacatattactgtttggccaagtcatgttgatataagaactcaagctacatatca

SEQ ID NO: 2630 - DNA, 319 bp, Diabrotica virgifera
  Clone ID: LIB150-034-Q1-E1-B4
acttgactgactataacattcagaaagagtccactcttcacttggtactgagattgagaggaggtatgcagatcttcgtcaagacactaacggggaagaccatcacgttggaagttgaaccatctgagaccattgagaatgtcaacagctagatccaagataaggatcagtatcccagcagatcagtaaagattgatttttgcaggtaaacagttgcagcatggaagaacattgtctgattataacatccagatagagtccacgcttcacttgggacttagattgacaggatgtccgcacatatttcgtcgagagatag

SEQ ID NO: 2631 - DNA, 416 bp, Diabrotica virgifera
  unsure (1)..(416): unsure at all n locations
  Clone ID: LIB149-013-Q1-E1-E9
aggactgtcagctgaaagctgccctaactttttataattgcatggtggaaatataaaaatatacaatatttaatagcatggctgcagctctaggccgaattactaatttaacaaaaacacaagttggacaatttctccccgcgatatgtaacaatcaaattgtcttttactctggaccgcccccaggtactcctccaccacaaactaagacgaagtttgggccccttgctgatgaagacagaatttttaccaacctctatggcagacatgattggaggcttaaaggttccatgaaaaggggagactggtacaaaacgaaggagattctattgaagggatcagattggattattaatgaggtaaaagtatctggtttgagacgtacangaagggctggtttcccatccggtatgaaa

SEQ ID NO: 2632 - DNA, 210 bp, Diabrotica virgifera
  unsure (1)..(210): unsure at all n locations
  Clone ID: pGUT1233
atttagtgcttacttggtacagcagtttcagtgctgtgctttagaataatttattttttaacatttatatagaaatcanatactaaccaatcaacatgtgtgaagaagaagttgccgctttagtcgtaaacaatggatccggtatgtgcanagctggtnttgctggggatgatgcacctcgtgctgtattcccttcaattgttggacgcc

SEQ ID NO: 2633 - DNA, 420 bp, Diabrotica virgifera
  Clone ID: LIB150-044-Q1-E1-D11
aataaattaattagtaattttaaaaaaattataaaaaatataggataaccattgaaatgcggaaggtgagtaattgtaaaattgtaaatagtgaaagtatagatattgcagaacaagaaaaagagttaggtaattttatatatagtgcagaaaatgaatcagatcctgttgaaagtgaagaagcccaagatatttgtataaatgaaacggatggtgccgattttgacgatgatcttgagaacgttaatattgcaattttttttcatagagttgacagtgatcaaattatatatcagaagaagaaacgaaaacttaagcttgtggggaagtatgtgatgggggacttactcggggaaggggcctacggcaaagtgaaggagatgttggactctgaaacgttatgtagaagggctgtaaaaa

SEQ ID NO: 2634 - DNA, 420 bp, Diabrotica virgifera
  Clone ID: LIB150-032-Q1-E1-H4
gcccaggtacgacgtacgagtccgaaaaatagacaatcaaatcaaacaacatgaaaggattaaatgtaatttgtgtaattattttatcagttttcgtgatcaataccacgtgttataacaaatataccaaagaagctaatttggaaacaaacgatgtgaacaaaaataaggatgatgttgatgaaccagtggatttacgtcctataactctgaagcacctggatcggccttttcgtatggccaaattgaatcttttatggtccaaagcagttttgagactatctgatatcaaattaaaatccatctttggagacctcaaacttcatgataaagaagaaataacttggaagcatcttcgagcagaaggcaaggacaaagatggtaccatagaagcccaattaagaaaaaaattgctacaga

SEQ ID NO: 2635 - DNA, 274 bp, Diabrotica virgifera
  Clone ID: LIB150-035-Q1-E1-E8
gtcaaaaaaaaccaaaaaccgttacgggctgaattcccaacaaaaaaaaagtaaaaaccaagcaaaaaacacacacctttggacttcccccaaaacatcaaaaaaatatcaaaacccaaaaccttcaaaaaaaaagccccaaaaaagttattcacccgcaaagccaatcccaaggcaacttgggaaacttgcccccgggccaaggaaggtacccggccgtcatgaaaacccagtaaccgcaaaacactttggttaaaaggctgacgagtaaaaa

SEQ ID NO: 2636 - DNA, 385 bp, Diabrotica virgifera
  Clone ID: LIB149-031-Q1-E1-H3
gacccaagcctctattttaagtcatattacattgccaggtgctgatattaataaagatgacacgatatcattagtatcacaacacgcggatattatcagtcctaatgtctcggaaattattttaaaggacgtaacggacggcgaaaagtttccagttagtataaatacatcacgtgctggacattcggatctatatgctaatgcttcatctaaccagaccgatgtaagcgacgtatacgttcgctttactgtatacaaaaacgatggattagatacattctcagctattataggttggatatacttcgttgcttgggctgtttcgttttatccgcaaatatatatcaactggaaaaggaaaagtgttgttggcttgaacttcgaa

SEQ ID NO: 2637 - DNA, 390 bp, Diabrotica virgifera
  Clone ID: LIB150-039-Q1-E1-D8
actagctttaaatatattatctgaaactggttatttaatacttaagggtataagaggattaattttatttgtagtttttagtggaagattattttcttgattagtattttctactcctatttttatttgtcttccttttttaataaaaattataactttgatttttattatagttggagtttgattaggttatgagttagctaaatttaaaatttcttataatttattaaggttaaataatatttctagagtattattttttagaataatatgaaatataccttttttatctactttaggaattaattattatccaatttattttggtatattttagaaaaaattttttgatatatgatgatgtgaatattatggaagttcaggtgtaat

SEQ ID NO: 2638 - DNA, 361 bp, Diabrotica virgifera
  unsure (1)..(361): unsure at all n locations
  Clone ID: pGUT1148
tagatttcaaccgatgatgcttagatatttttgttccaatccagctagtccgaatatctacgtgcctatggtgttatcaacgtttagccattattcggggttgcatcttttagccaatatgtatgtcctccatagtttttgtacaggagccgttcacagtttaggaaaagaacaatttctgggtttttacttaacagccggagtagtatcaagttttgccagttatacatataaagtgctgacaaggcaacctgggctttcattaggcgcgtctggagccataatgggaatcttaggctacgtttgtactcagtatccaaatacnagactangatttatnttattacctgtgtttcacttt

SEQ ID NO: 2639 - DNA, 377 bp, Diabrotica virgifera
  Clone ID: LIB150-048-Q1-E1-H10
agctgaatttaagtttttttaaggttccgtaatatgtaattctaaattaatctgcgccatctacaagataattgtgaaagtatccgaaatagcagaattagtaggaggatatcttgcaggaagtttagctgtaatgaccgatgcggctcatttattttcagacttgataggatttctaatatctttattggctatatgggttgggaagaaaccacctacaaaacgaatgacttttgggtattacagagccgaggttataggtgctcttcttagtgtcttaacaatatggttattgacggcagttttatcagcgatggcaatcgagaggatatataccaaagattacgaaatacaagctaatacgatgatgaatatat

SEQ ID NO: 2640 - DNA, 400 bp, Diabrotica virgifera
  Clone ID: LIB3026-002-Q1-E1-D7
acccacgcgtccggtttcgatcatatctactttagaaaaagaattgaatgttaaatttccagcagatctcaccagtgccgaagctcaaaagttcttgaatgacctttgtattaagcacaatgttgattgcacgccccctagaactgccaacaggttgctggacaagctgattggagatttcattgaagaaaaatcaattaatcccactttcattatcgaacatcctcaagtaatgagtccattggccaagtggcatagatctattccgggattgacagaaagattcgaactttttgtaatgaaaaaagaaatatgcaatgcttacaccgaattaaacgatcctgttgtgcaaagagaaaggttcgaacagcaagcagctcttaaagccgaaggtgatgat

SEQ ID NO: 2641 - DNA, 437 bp, Diabrotica virgifera
  unsure (1)..(437): unsure at all n locations
  Clone ID: LIB149-028-Q1-E1-G5
atcttcccaaatttagcacgtcggtttggtgtgaagatgttgcgtaaagaagtttctgatttctttagcaaagttgttacggatacagttaattatagagaaaagaatcaagttcatcgcaatgattttatgcaactgttgattgatattaagaataataaagaaggagaacatactccaggcgatggaacttcacttactctggacgaaatgatagctcaaagcttcgtattctttattgctggttttgaaaccagttcaactaccatgactttcgctttgtacgaacttggcaaaaatcaatctgtccaggatacactcagggacganattaatcacgtacttaaaaaatataatggacaaattacttacgatgccataaatgagatgaaatatatgaatcaagttattgatgagacactaaggatgtatccacc

SEQ ID NO: 2642 - DNA, 335 bp, Diabrotica virgifera
  unsure (1)..(335): unsure at all n locations
  Clone ID: pGUT938
cgtcgacggtgtcatcgcatgctccttcgtagatatgttgaggaactgtggtgtcttcacaccggaagatgcccaagaatacatcgacatcggtgctatcaactcattattcgtccttggtagatccatcggatttatcggccattacatggaccanaagagactcaaacaaggattgtacaggcacccatgggatgacatttcatacgttctacctgaacaatacaacaatgataattagagtatagcatttaactaggtagaaatcttgtaattattgaccgatagatgtctaggcacgtaccgtggcaccttacgcaatcggctcagtgtgt

SEQ ID NO: 2643 - DNA, 612 bp, Diabrotica virgifera
  unsure (1)..(612): unsure at all n locations
  Clone ID: pGUT3139
agccaaagttggtgtaccaatcgaaaacgtaagcgatgtaatcatttggggaaaccactcatccacccaattccctgatgcttcccatgctgtcgttgttgttgacaacaaatcggtacccgctgtagaagctgtcaaggatggtgaatggctcacaaatgtattcgtttccaccgtacaaaagagaggtgctgccgtcattgctgcaagaaaaatgtcttccgctatgtctgctgccaaagcagcagctgaccatatgcgcgattggttcttaggcacacctgacaacaaattcgtgtctatgggagtattaagtgacggtagctatggcgcaccaaaggacgtcgtcttctccttccctgttaatattaaaaatggcaaatggcaaattgtccaaggtctccaaaacgacgacttcgccaaaggactgttggccgtcactggaaaggaactggaagaggagaaaaccgaagcgatcaccatcatcggagcatgactagctaacaaactntagaacgttaaacannaagaaataagtaattttgcctgaagtatacttgtatgcttgcaagtagtgagcacagaagtagataagcattatagataaaattc

SEQ ID NO: 2644 - DNA, 347 bp, Diabrotica virgifera
  Clone ID: LIB150-036-Q1-E1-G6
cccacgcgtccggtcatcttgaggacggtgtggagtgttatactacaaacgcccagtcatctattagaagaaattattttagtggacgattccagtacagatgagtctcttaagggtttgctcgactattatctagaaacaagactggcaaattataagatcaaaatggtacgtctcaaacaccgtctaggactgattcgcgcccgtcttcagggcgccagagtggcccaaggtgacgttttgatcttcctggatgcacattgcgaggcgaccacaagttgggcggaaccaatgctctctaaaatagaagaagacagaacggctgtcctggttcctaacattgatgt

SEQ ID NO: 2645 - DNA, 404 bp, Diabrotica virgifera
  unsure (1)..(404): unsure at all n locations
  Clone ID: LIB3026-017-Q1-E1-G11
accacgcgtccgcccacgcgtccggaaaagtacgatgctgctgcaaaagaaaaaggaatttatatcgtcagtgcttgtggtgtcaactgtgttcccacggatttgggttcggcatatctgcagcaaaaatttgatggcgtattgaattcagtggttgcctacgtggaattatggactgaaggtaaaagtagcggatccgttggcggttatgggacttggcaaagccttgtttatgaattccagacaatgggttcattaagtaaactaaaagcaaagctgattccaccttcagactctgcgtttaaaccaacgttgccagttaagatccgtccattctattcggaggtaactaagggttgggtgatgccatttgcangacacgatagaaagataatgcaagagac

SEQ ID NO: 2646 - DNA, 477 bp, Diabrotica virgifera
  Clone ID: LIB3026-009-Q1-E1-E3
ttccgaggtccacccaggcgtccggatcgagcaatagcagagttatgccgattgctgatactcagaacgtactcacctttaaaaaccttcgattttttttatcgccttacttctgactataaattagaaatggaacaggttaaaatacttcattctcacaccatgcaagtaatcacttcaagaaaagaggaattaaagaaaaaacataaagacgatcaaaaagaagaaaccgatgatgttgggattaagaagaagaaagcatttttagatttactgttaaaaaccactaatgaaggaagaacacttaccgatacagaaattccggaaaaagttgatacatttttaattgccggaaatgacactaacgcagctgccaaaagtttccgtttacaatgtttgtcaattaacaaggatgttcaggaccagattgctcaagaaaaaagcaaatttttggagaaaattaacaccgaaatgtta

SEQ ID NO: 2647 - DNA, 405 bp, Diabrotica virgifera
  Clone ID: LIB150-010-Q1-E2-C8
tccgagatgtcccgggtccacccacgaatccgcaatttacagcttgtaatgataaatccaaaaatttggttacagtgaagcgcttagttgacgaggcagtaacaaataatgcaaaagttgtattcttacccgagggctgtgattatattgcaaacaataaggacgaatctaggagcctagcagaaagtttggacggcgaactggtagatgaatataagaaaattgcacacaaaaataaaatttggctctcagttggcggttttcatgaaaaaattgataacaatactatgtacaacactcacttgttaatagatgatactgggaacatatcgtctttgtacagaaaaacacatttgtttgatgtgagtattccagaaaaaaatatattattgcaagaatctgatt

SEQ ID NO: 2648 - DNA, 398 bp, Diabrotica virgifera
  Clone ID: LIB150-028-Q1-E1-D2
aggatgcgacaatccaaggcttccaaggaacttatcgagaagagagctgctcttatggagaaattccaagcctacagagaggagaggatcgaggagtacttggaccaaaaatcaaggcgtttgcagcttagaaataacattgacactgatgaattaaatgcagagaacgttgaggaggaaatcgtagaattctttattaaagaagaagtaattccagtcgactagcaccatcttgaaagtccggtcctttccctgcgtgtgctttgttacaacacattcagggagatttaaagtgaaaacgttaaatattataatataaaaaatatttgtattttggacattgacataaatatttgttaatcaagtgtctcgttcaattaatagtgttttaaaatttt

SEQ ID NO: 2649 - DNA, 327 bp, Diabrotica virgifera
  Clone ID: LIB150-001-Q1-E1-H6
atccgcagatttgttaaatgacaaagaaattaacaaaatagcaacaaagttaggaaaaagtcctgcacaggttcttctacgttggccccttcaacaaaatattgccattattccaaaagcacgctccaagaaacatattgacgataatattgatataaactttgttattcctgaagatgatatgaagatattaaacggtttgccacaaacaaaatatgcttgggacccagataccatagcttaattaaatttatacttttacggattatactaacgtagttcttagttttattttttaaaattaatccaactttttccataaaataa

SEQ ID NO: 2650 - DNA, 320 bp, Diabrotica virgifera
  Clone ID: pGUT2792
actcgctctcacatatttctctctaatcactgcgtaatcgtacgtttcactcatcgacctcggcgtgactttaactcttaggatttacaaaagtattgtacacgctgttcaaacaactggtgatggacatccattcaaagaatatctggaactcgatatatcgctaccgcatgaaaaagtcaaacagatcacagaagtggccattgcacatatcaatgccgctatcgtggaacttacaagattattcttggtcgaagatttggttgattccatcaaattcgcagtattgttatggactcttacctattggggagcgtggt

SEQ ID NO: 2651 - DNA, 357 bp, Diabrotica virgifera
  Clone ID: LIB149-014-Q1-E1-F6
cttatgtgcagcttggcccaaaatctgcccaacagtatgatattgaccgatgccaagattcacgctaccaagatccaaggcatcaagggatcgggatccaagaagatgtttttccgccattaagattcaactcatctggtaggactcctccatatcatagatccctcggtgtccataatcattgccatcgagaacgactattccatgtcaggcatcatctgaaaggtctatgacatctgccgactggccattagatacggtgccatcaccattatggacgaagtgcatgccgtctgtatgtatggacgccaaggtgccgacgtcggcaaccatcttgacatcggcgaaaacctcaac

SEQ ID NO: 2652 - DNA, 392 bp, Diabrotica virgifera
  Clone ID: LIB149-021-Q1-E1-A8
accacgcgtccgaagagggatcatctgaagcaataaccacaggaaaaccattagcaatcaacaggttcccagggtggtttcttaaatccgtaaccaacttgaggacttggttcgaaatggggcatatctccaaggcgatctgttgctctttgacgtattttgctaatagaggatgttttagtatcgaatatccatgcccaattcgggtggagtttaacaagatggcgtcaaataagttcaggtctgtttctccgtaccagtttgtttcgccagcgtggaagaagaatttggctccaagatttttgagttctatcaattggggcacaaaggctgttagtggttgaccattaatcgatttgaaaatcgcctgaaaagttttccagactttgttt

SEQ ID NO: 2653 - DNA, 425 bp, Diabrotica virgifera
  Clone ID: LIB149-031-Q1-E1-A2
aaacaacttgtgctaattttggagatttgattgaagttatatcagcatttagatatcaaaattcttccaattttgtgcggatgttggtcaaggatatcagatgggacatgcagaatggtttaccaacgttggttaccactttgtttcagttgaacttacatggttatccattggtactacctgatatgatacgaggcaatggatatggggggaacgtaccaactgctgaattaattgtaagatggactcaggccaatacgtttatgccatcaatgcagtttacttatttaccatgggagtttaattcagatgagttcaccacgttagaaatcgtgaaaaaatatgtaagccttcatgaacaatattccgatgttataatcaaagcaatggtaaggagcgtcagtgacagtagtcctgtaaatcct

SEQ ID NO: 2654 - DNA, 263 bp, Diabrotica virgifera
  Clone ID: LIB3026-006-Q1-E1-E8
gcccgaattttttcaggcgataaaaatgggtctttctagcacaatttacaattccatttttaaaagaacctcaacaatggctttagctgttgttgtttctgcatttttcttcgagagaactttcgatttagcaacagacaccttttttgaaagatataatgaagggaaattatggaaacacatcaaggacaaatatgagcaggaataagtgataattattttgtgttagtataatttattgtaaataaaagaaacttctgccc

SEQ ID NO: 2655 - DNA, 428 bp, Diabrotica virgifera
  Clone ID: LIB150-025-Q1-E1-D9
ctcgcgggtcgacacaagcgtctacagtgaatctaattaggacgaacatggaattgaccctactggaacttaccatggagattctgatcttcagttagaacgtataaatgtatattataatgaggcaactggaggaaaatatgtaccaagggcagtattagttgacttagaaccaggtactatggactcagtgagatccggaccttttggtcaaattttcagaccggataattttgtttttggccaaagtggagcaggaaataattgggctaagggtcattatactgaaggagctgaattagttgattccgttttggatgttgtaagaaaagaagcagaaggctgtgactgtatgcaaggatttcagttaacgcactctttgggaagtggtactggttccggactgggtactttaataatatcaaaaa

SEQ ID NO: 2656 - DNA, 228 bp, Diabrotica virgifera
  Clone ID: LIB150-034-Q1-E1-B7
acaaatcatgtttgaaaccttcaacacacccgccatgtatgtagccatccaagccgtactctccttgtacgcttctggtcgtaccactggtattgtattggactccggagatggtgtcacccacaccgtcccaatctacgaaggttacgctcttccccacgccatcctccgtttggacttggccggtcgttactttgacgactacctcatgaagattctttactgaaa

SEQ ID NO: 2657 - DNA, 383 bp, Diabrotica virgifera
  Clone ID: LIB150-035-Q1-E1-G9
cttgaaagggtttagtacaagccttgcaacagcatcaacagatactttcacaagctccaatacctcacaaaggaagaatgccccgtgctaaggctgacgctaggcccagaggccgcatgactgcttatgctttctttgtacaaacatgcagagaagagcacaaaaagaaacatcccgaagagaacgtcgtcttcgctgaattctcgaagaaatgcgccgaaaggtggaagaccatgttggacaaggaaaagaaacgtttccacgaaatggccgaaaacgacaagaaacgttacgacaccgaaatgcagagctacactcctcccaagggagagaagcaacgcggcaaaaagaggaagcaaataaaagatcccaacgcacccaaa

SEQ ID NO: 2658 - DNA, 327 bp, Diabrotica virgifera
  Clone ID: LIB3026-023-Q1-E1-G8
cacgcgtcaggaattgctagccacattatccggcatgatgcggcccaccatggaccaaatccacttcaccatacgtatgaacaaagaagacatggacaactttgtgttctgcctggccaccagggggacagcaacgagtctagtcaaagacatggccgatttgagcgtgtattgtcccgagcgtaaatcgggcgacaaattcaatttgccatccagtttcaacgtgatgagcgaaatcggggaagccgcttctgccatactggatcacaaggtgtccactgtcatgaataagtatcccgaatacatagattatatcgacatttccga

SEQ ID NO: 2659 - DNA, 422 bp, Diabrotica virgifera
  unsure (1)..(422): unsure at all n locations
  Clone ID: LIB149-042-Q1-E1-F6
agtagtgattaaaaaatgtctgagtacgataaagttcgaatcggaaaactggtattaaaaggagaaaaacaaaaatcgaagaaacgcaaacacaaacctaaacaacaagaggaagaaacgccaaaagtggatgttgatagtgcaaaacatggaaactggtggtccatacagaaaaaagatgagatggttggtcctatagctatcgaattcggtgcccatacatacgtaagagctctagacaacgggctttttactctaggagccccccacagggacggacaaggaccctctccggaagaaatcttaacagccataccaataaacgaaagaaaaatagctttcaagtcggggttacataagttnttacgagtagagaaaaatggaagtgttactgggagatccgatgccataggagccatgga

SEQ ID NO: 2660 - DNA, 424 bp, Diabrotica virgifera
  Clone ID: LIB149-005-Q1-E1-C8
agcccacgcgtccgggagccgcagccataggtggcgctttcacctcagaaattttgcgcgaaatggccaaaaacaacaaacgacctgtgatcttcgctctgagcaatcctacgcataaagcagaatgtacagctgaagaatgttacagagaaacaaatggtactgccatctttgccagcggtagtccattcgatccagtaactttaaatggaaagacgttttacccaggacaaggtaacaactcatacatattccccggagtaggattggccacagttactgctggtatccaaaaaatcagcgaagaacacttcttggttgcagcagaggcactcgccaatttggtaacggaagacaaccttgaaaatggaaggatatacccacactagagagcatcgttgcctgttcactaagaatcgcaaca

SEQ ID NO: 2661 - DNA, 462 bp, Diabrotica virgifera
  Clone ID: LIB150-031-Q1-E1-D5
cgcgggtcgacacaagcctctatagtaagtcgtattagtacgtattaaagtcagattatcgaaatattattttgagagaaattgttcatatagagactggccaatgtggatatcaaataggggcatttatctgggaagttatgtctgacaaggatggaattgaccctactggaacttaacaaggagattctgatcttcaattagaacgtataaatgtatattagaatgaggcaacttggaggaaaatatgtatgaagggcagtattagtctgacttaaaatcaggtactatggatacagtgagatccggatcttttggtcaactttacagaccggattatttagttttatggccaatgtgaaacaggatataaatggactaacggtcattatactgaatgagctgaattagttgataccgttttggaagttgtaagaatttacacagattgccgtaactgta

SEQ ID NO: 2662 - DNA, 406 bp, Diabrotica virgifera
  Clone ID: LIB149-026-Q1-E1-B1
aacaacgcgtccggttggaataaaacaaaccgacatatttatgtttcgtagacattaagaaagcatttgacagggtcacattaaaggacgttatccatttgttatagtcaaaagagacacctctaggaataattaaaacgatctaaaacatctaccagaacatcacaataaaagtaaaagtataagatgaactaactgacccaattgaaaccggcaataggataagacagggggattccttgagtcctttattgttcaacctgatcatggacgaaataataaaaaaagtaagaactaaaaaaggataccaaatggatggatccaaaaggataatctctcaaaatgaagatgatttacaacgtatgcttcataaatttaacaaaattgccagaaaatttaacaatgt

SEQ ID NO: 2663 - DNA, 413 bp, Diabrotica virgifera
  Clone ID: LIB149-033-Q1-E1-D8
cccacgcgtccgcccacgcgtccgaaataaaagaagcaaattcgttgagtattgattacaaagcaaaactctctgcaagatatgatggaggactttacaacattacttacgacgataataatctcaaacaaatcgccatatttagtcaattatatccaacttttgctagacgagtatttccatgttttgacgagccgaattttaaatcagtatttcatatttttattagttatcctgggacgttcgaaattattggaaatactcctattgtcggaaaggttcatacttcagatgggataactactcaatttgacgaaacaccgataatgtcaacacaatcattaggattcttcatttccaactttgcacaaataacaacaacagatcaagagtacacatatagcatctttact

SEQ ID NO: 2664 - DNA, 426 bp, Diabrotica virgifera
  Clone ID: pGUT2946
atgaaactttactcagaatctcatgatctcgacacaatatcgagagtacacagcgaattatatgagttaaaggatataatggtcaaaaatattgataacatttcaatgagaggggaaaggctagaactacttgtcaacaaagcagacgatcttaatcaaggctcggtgacgtttagaactacgagcagaaacctaaccagatcgttattctggaaaaatatgaagatgtacattattattggcgtcgctgttactgtgatcgtctattttattgtctccatttcttgcggaggcttattatggcaaggatgtatttcgaaaaaataattaccaacaaatatattagtgaacttaagatacatcatataattttagggaaaatactttctatttgtaatgtttaaatcatgattttattgaatttta

SEQ ID NO: 2665 - DNA, 404 bp, Diabrotica virgifera
  Clone ID: LIB150-034-Q1-E1-C6
ggttacacccggtttttccaaataattttcttacattattatttttgagtaaaactaatagcacaaaatggggttacttacagatcccactaccggccaaggcaaatatgtaaaatggcttttgaaatattacagcaagctatgttttttgctttatatctctggtgtcatttggttttgtaccttagcttaccctacaatgaatgccagcacatatttctctgaaaacgctctattgccaggcttagttaaatcccaatttcacgaagacagagaagcattaagatacaacgaagaattacaagacgaaatgaagaaatatgaagattccataccatatccctggattatagcaaaattcaaacagattggtttagatgcatacatacataattttactctta

SEQ ID NO: 2666 - DNA, 402 bp, Diabrotica virgifera
  Clone ID: LIB150-037-Q1-E1-B11
agtcactggtctgagtgtctgtgtccgagaagaaaagtattttatttttttttaaagaaagtcaagtcattaagataaaatttgttaatgattgtctataaatctggcattcattgttgaccactttcttatttaaacattgtacaatgtctagagaaatgcagttattccgattatggaaagggaggttagcacaagttcgtcttattcacgttgccgcaacttcaaacgccgctgcagctgaagcaaaacgagccgagaagccagctagaccaaaaacgtttgccatttatcgttggaatccagacaaacctgacactaaaccttatatgcaagagtacacagttgatttgaattcttgtggacctatggttctagatgctctcattaaaattaaaaacg

SEQ ID NO: 2667 - DNA, 449 bp, Diabrotica virgifera
  Clone ID: LIB3026-004-Q1-E1-C3
gaaattttatcttttagttatttaaatatttatatttatataattttttatatttctattggtttgacagttgcttatagatttcgtttaacttattattctttaacgggtagatttaattatctagctttaaatatattatctgaaactggttatttaatacttaagggtataagaggattaattttatttgtagtttttagtggaagattattttcttgattagtattttctactcctatttttatttgtcttccttttttaataaaaattataactttgatttttattatagttggagtttgattaggttatgagttagctaaatttaaaatttcttataatttattaaggttaaataatatttctagagtattattttttagaataatatgaaatataccttttttatctactttaggaattaattattatccaatttattttgg

SEQ ID NO: 2668 - DNA, 331 bp, Diabrotica virgifera
  Clone ID: LIB150-021-Q1-E1-D3
atttattttaagttattaatttaaatagttttattttattcggtttcatatatatttgttttgttaatttaatgtttaaatcactttattttccgtcctatcatgacatcgaaacacttctgcttaaaatggaacaaattcgaatccaacattttgagtgccattgagagtctccagatcacagaggatctcgcagatgttacactgacttgcgaagggattaatatcatggctcacatgtttatcctgtcggcgtgtagcccctatttacggacaatatttacagaaaatccctgccctcatcgaatagtaatctttaaagatgtacctc

SEQ ID NO: 2669 - DNA, 418 bp, Diabrotica virgifera
  Clone ID: LIB149-023-Q1-E1-G4
acccacacgtccgcacacagatccagttccaacatgagggaaatcgtacatttgcaagctggacaatgcggaaaccaagtgggagctaagttttgggaagtaatatctgctgagcatggaatcgatcctagcggaatatacataggagatagcgacttgcagttggaacgtatcaatgtatactacaatgaagcgtcagttgcttcttcaacaaatggaggtaaatacgtaccaagagcgatcctgttggatttggaacccggtacgatggacgcagtacgttctggaatgtacggcaaactattcagacctgataacttcgtgttcggccaatccggcgctggaaacaattgggccaaaggtcactacacagaaggtgctgagctagtggacgctgttctagatgtcgtacgaaaag

SEQ ID NO: 2670 - DNA, 439 bp, Diabrotica virgifera
  Clone ID: LIB150-044-Q1-E1-F5
cccacgcgtccgacaaaatgaaaattccaagtgttgaagaacgcattcacgttttggatgaccaatcaaacgtatggacggtgatccgggaaatcgtaagcaacaacaatcaggaagatgccttttacgtcttggatgtcggagatatcgtcagaaaacatcaggaatggcgcgaaaaactacctcgagtcacgccgcactacgctgtcaaatgcaacgacagccttacagttcttgaaaccctcaacgccttgggaactaacttcgactgcgcttcaaagggcgagattaacaaagtactcagcatgggtgtggagcccgaaagaatcatctttgccaatcctgccaaaccttccagtcatatcagacatgctgcagccactggcgttaacactatgacattcgacagtgacactgaattgcacaaagttaagaatct

SEQ ID NO: 2671 - DNA, 420 bp, Diabrotica virgifera
  Clone ID: LIB3026-026-Q1-E1-C6
attaggtattacttctacttatactaatttatatagatcattctaactaaatttaattaatggctttaacaaaaccaaagtcggagatgtcctccgaggagctccaagctcgcgaggaggaagaattcaacactggaccactgtccgtcttgacacaatcagtaaaaaacaacactcaggtactcataaactgccggaacaacaaaaaactactcggtagagttaaagccttcgacagacattgcaacatggtgctggaaaatgttaaggaaatgtggacggagctacccagggctggtaagggtcgcaagaaggcgaaaccggtcaacaaggatagatttatttcgaagatgtttttaaggggcgatgccgtgatactaattgttagaaatccacttgctaccgtgaatgcatgagata

SEQ ID NO: 2672 - DNA, 357 bp, Diabrotica virgifera
  Clone ID: LIB150-003-Q1-E2-G6
cgggccgacccaagcgtccaatcacgcctccgatcaaagcatccagtatagtctactgtgatttctattaaacattatataatacattttataggacatcgtgcaggacctcgttgacatctgcgctggccaatgtggtaccaaatttggggacatcatctgggaagtcaactctgacgaacacagcatcgactacaatggagactatgatggcgactctgacctccacattgtctactacaatgtcgactacagcgaagcctccgtaggccactacatcctcctcgacatcgtcgtcgatatgataccctcaatcatgtctgcactcttgtcagatctcttcagacaagtcatcat

SEQ ID NO: 2673 - DNA, 405 bp, Diabrotica virgifera
  Clone ID: LIB150-010-Q1-E2-C5
gataatgtttccgctccataagtgagtacaggcaatacacactggtcaaagattttccttttcaggcatatgggtaagtccgatttaaatacatagctcagtttatcaatcgctaaacgctaggctataaataatcctatgcgacgtgggagctcgcacgtctggttatctcttcccaaccgaatttcatgtcccaagtacttataagatgcagtctgttcaatatctattccatcaacaacaatattacgatttagcaccaaattagtcattatttgtgtcttgttgatattaatctttagtccgacctctaaggaagcgtgatataacttgttcaacattattattgcatcatccatacgatcgactataaggacgatgtcatctgcgaatctcaaatgactg

SEQ ID NO: 2674 - DNA, 440 bp, Diabrotica virgifera
  Clone ID: LIB150-016-Q1-E1-A8
cccacgcgtccggaacgattggaacaacgagacacctcagtttggttatgagattcaggacgtagatgcttttctaaataaggcaacgatcgaaaaacctgcaaatataccatttgtgttagcttttccaagcgttctatatcaaacgagagttgggggatatcaagcagaaatatctctaccactaggcatggttgttaacgccgttttcaagaatcaacattggctttatgtccaaacgcctcacgcaagagaaggctatgtcagttatgctgcttgcttgcctttaggtataattcctccaccggaagatgataaactcgctcgatgctgggaaaaaagcaccgacgtcttctcgaaagcttcaggaaacctaacagatatcgaaaaactcagttctaagtccgattgcgaaggtggaggatgaagtataagatgtc

SEQ ID NO: 2675 - DNA, 215 bp, Diabrotica virgifera
  Clone ID: LIB149-038-Q1-E1-H12
aacaatgcaccacgtcatggatcgatgggattcgaccccacagggagatcccagagacaccgtggaaaggtaaaggctttcccaaaagatgatccctcaagacctgtccacttgacgggcttcataggttacaaagctggtatgagccacgtggtaggagaggcagacagacctggatcaaagatcaacaggagcgaagttgtaaacgctgtaac

SEQ ID NO: 2676 - DNA, 432 bp, Diabrotica virgifera
  unsure (1)..(432): unsure at all n locations
  Clone ID: LIB149-016-Q1-E1-H2
taccggtcaagacatgcgtgcccaatgatcagtcataaattctggaacattaccattttaaagtgcatatttgagtgaagacagggtgttaagaagcattttagtttttcttgtatttatttccgtcaatttaactggtaataaaagtggttctgggtggatgatcacgaaaccatatttatttgatttacgtcgtgtctgtgagttttgaaggaggccatctttgcaatctctattagaggtcttcagcttgcgctttcattgtctggtgaaaaaccagtatttattacacacacatttcaccaaatggctttaaaacgaattaataaggaattacaagacctcggcagagaccctccagcacaatgttcagcaggtcctgtangagacgatttatttcattggcaagccacaattatgggaacaccagat

SEQ ID NO: 2677 - DNA, 418 bp, Diabrotica virgifera
  Clone ID: LIB149-026-Q1-E1-E1
tcagtcggaggaattccctttaagtccggaatttaatccaaagaattaaatggtgaaaatttaacctttaagtaattaaagaattaaaattaaaaaaatttttaaaattccaatgggttggaaagttggctatagaattcggtttaactaataatctttaacgggtagatttaattatctagctttaaatatattatctgaaactggttatttaatacttaagggtataagaggattaattttatttgtagtttttagtggaagattattttcttgattagtattttctactcctatttttatttgtcttccttttttaataaaaattataactttgatttttattatagttggagtttgattaggttatgagttagctaaatttaaaatttcttataatttattaagggtaaataat

SEQ ID NO: 2678 - DNA, 376 bp, Diabrotica virgifera
  unsure (1)..(376): unsure at all n locations
  Clone ID: LIB149-011-Q1-E1-F1
aaaagcacaacgatcccagcgctaacaggtatatgaagtccttcgtatgtgagataccttttattacgaaagaggtggaatttgcaattttaaaagtccatggacagagttttatgttgcatcaaattataaaaatgagtgggttgtctgttagcaattattagaggtttagctactgaagatattataaaggagtcgttcanatctgacaaggttattattcctatagcacctgtattgggacatgtcctcgaatatgtacattatgacaggtataacaacagatatggtgctgatggagtacatgaaacattaacttgggatgaggttgaagataaagttcagaagtttaatgaagaatacatttttccaacga

SEQ ID NO: 2679 - DNA, 356 bp, Diabrotica virgifera
  unsure (1)..(356): unsure at all n locations
  Clone ID: LIB149-024-Q1-E1-G4
caaccaatgagccaaaacttcaacgaactggtcaacgaatttggaacccttggaatccaacaaggtcctggctcctaaggaaaccagaaaacccgaattatccattacggaaatcactaaattaggagaatcgtctcaaatgttgaatggccttttagcaagtttgaatttacctgctgcaatcgaggttaccggtantggagatgaagtacctccgtccattttggaaaaatctaactccattattactttaggaggtctangtgagctagaacgcatggtcaccgagctacaagaactgttgaagagaaaccaagacattttagatgaaacagacagaatgttaaatgaagaaa

SEQ ID NO: 2680 - DNA, 438 bp, Diabrotica virgifera
  Clone ID: LIB149-026-Q1-E1-D10
cacacgcgtccacaattatgcggaagatgtgtatgattgctttcttgtgttatttattttgttccattccgatctaaaatgttgaactttgaaaaaataaatgtctttataagaattggtgattcgctgcacacttctgcaattctatattgactaagcagtatcataaaggaaaagtcatatgctggtatatctgccaagacgcagttcctctacgccgcagtatttatcaccagatatcttgactcagtcatggtattcagatcagattacaacactttagtggaagtgactttggtgcttgtttcagtatgcacgtttttactatcgttcaaaatgaggatcacatacgaaagaaaatatgatttcttttggtccgaaattcaggttaccggggcattgatattagcaatgttcgttaataacaatttagaagct

SEQ ID NO: 2681 - DNA, 406 bp, Diabrotica virgifera
  Clone ID: LIB149-021-Q1-E1-H4
cgtctggaacttttcaatgagggttactgtattaattgcttgtattgtgctgattgctaatcagtgtgagtcagcagttttaggtaataattaccgcattgttggaggtaacgataccactatcgagcagcatccatggatagtgtcaatccagttcttaagggtacacttttgtggcggagctcttgtagatgaagaaacagttataaccgctgcgcattgttttaatgatgtatctggtaggataaccatattagcgggaactgctgatttgactcaagaaggtacgtccattaaagttaaaagtattttgattcacgagaactacaatcctgatgttggttctttagatcatgacattgcaatattaaagctatccgagaagattacattttctgacaaaata

SEQ ID NO: 2682 - DNA, 227 bp, Diabrotica virgifera
  Clone ID: LIB150-005-Q1-E1-A1
gatggtgtcacccacaccgtcccaatctacgaaggttacgctcttccccacgcaatcctccgtttggacttggccggtcgtgacttgaccgactacctcatgaagattcttactgaaagaggttactcattcaccaccaccgctgaaagggaaattgtccgtgacatcaaagaaaaactctgctatgtcgccctcgacttcgaacaggaaatggccaccgctgctgc

SEQ ID NO: 2683 - DNA, 394 bp, Diabrotica virgifera
  Clone ID: LIB149-020-Q1-E1-C4
taagtcaccttaaaatatacacatctaattgggtgctaggaaatcacgatcaacacaggatagcaacaaaagtcggtacagaaaaagtggatggtctaaatatgttgatggctttcctccctggcattcaaatcacgtacaacggagaagaaattggaatggaaaacggagaagtaaactgcgaaacacaaggtctagatcacgctgagaattgctcagattaatacaggatctccagagatttccaaaggacaccattccaatgggacagcagtgagtttgcaggacttaccagtggaaataaaacatggttgcctgtcagttcgaaaaagactaaatgcaatgtggctgatcaaattaatgacgaaagaagccaattgaatacatattaaaa

SEQ ID NO: 2684 - DNA, 323 bp, Diabrotica virgifera
  Clone ID: LIB3026-009-Q1-E1-H10
cacccacccgtccgaccacgcgtccgactggacagtaggactacaagttacgactctaaattacagatactacgcagagttgttaatacaaaagcccaaattaggtgtgaacaacaagaaaaccagtataacgaactacgaaagagagatgaaatactaatgcatgatacaacgaaaattttggaaaccattcaagagatggatactcaaaagaagaattctttaagattaccatacgaccaactttccaatgactttggatcgatcttttcaacgcttcttcctggcgcaaacgctagactggtactgccgccaggaaagac

SEQ ID NO: 2685 - DNA, 418 bp, Diabrotica virgifera
  Clone ID: LIB150-050-Q1-E1-B1
agaaaaataccgaatacaaagataaaatgtgtacggttaataatgataaaggtgaaatagagatttatagattaccagtaaatgctgaagaatatgttattcatgactggacaattaaatacacgaagtctcatatacttcactcaatttgtgcaaatgctgaaacttgtagctctaaacctgaagaacgatgtctcttatgcgtgtacaacaatgaactagagctaccccatttacctgaaatggtgtttccgaataataagttaaatcttagccataagtcaggattttcagtagaattcaatgccttggatgctttaaagactgtcagtaatggaaaacagtcaataaaagttgctcattctgatgtatggaaagattcaagggcgccagaaaatttagaagaaaaaatcaaacc

SEQ ID NO: 2686 - DNA, 318 bp, Diabrotica virgifera
  Clone ID: LIB3026-020-Q1-E1-G7
gattaataaaaagcaaaaatactttataactcgtctttaaatttataattattactgtattaaaataatatgactgaaacgacgagtatctatcatgaaaaacaaataagggaactatgtgccctacatgctttaaataatttatttcaagccaaaggtacattttccaaagctgaattagatttaatatgtacttctctatcaccaaatcattggataaatccgcacaaatctatgctgggacttggaaattatgatattaatgtgattatgaaggctttacaagatagaggctatgaagtaatctggtttgataaa

SEQ ID NO: 2687 - DNA, 425 bp, Diabrotica virgifera
  Clone ID: LIB150-018-Q1-E1-C5
ttcccggggacacccacgcatccgcagaattgctcttctacaaactgccattgacaacagctctgattcagaagagttcatagacgatctgatgaagattgtcagaactacactcagctcaaacattctttcacaacataatgaatatttggccaacctggcagtatatgctgtgctgagattgaaaggtacaggtgaattacaatccatccaactgattaagaaaactggtggtactttggaagattcctttttggatgaaggttttttattgctcaatatatctggtgtacatcaaccaatgatagtagaagatgcaatgctcctgatatccattactcctatggtcatagataagatcaaagtatttggatctcacattaatgtacattcaatggctaatactgcagacctggaatctgcag

SEQ ID NO: 2688 - DNA, 413 bp, Diabrotica virgifera
  Clone ID: LIB150-034-Q1-E1-F9
gatttattagccattgcaaatatcgtaggtgatgttctgatttacaaatattcaaatgagacaaacgagttggttaacacaatagaactccacacgaaagcttgtagagatattgagttcagttgtgatggaaaactcttattttctacatcaaaagataagtcgataatgattacagatgtgagcagtggacaactggttaagttttacgaaaattcccatgatgtacctgtatattgtttgactgtcatagatgaaaacttatttgccacaggggatgatgatggtatgataaaactttgggatatgagagagaaatctgataaacaaatatacaaaacaaagaaaaatgaggattatattagtgatatggtaacaaatgatgccaaaaattacctagtctgttccagtgg

SEQ ID NO: 2689 - DNA, 512 bp, Diabrotica virgifera
  Clone ID: pGUT2610
ttgatcccaaaccgatggaaggtgactggaacggagctggagctcacaccaacttctcaactcaggttatgagagaaccaaatggcattggggcaattgaaaaggccattgaaaaacttagcaaaaaccacgctaggcacatcaaagcctacgatcccaaaggaggaaaagacaacgaacgtcgtcttactggcaaacacgaaacatcttctatccatgactttagtgctggtgttgcaaatcgtggagccagtatcagaattccccgtggctgtgccgaagacaagaaaggatacctggaagacagaagacctgcctcaaattgcgatccttactcagtatctgaagctatcatcagaacatgctgtttaaatgaatgaatgtagaatgtacacctaattgtattatacttccttacacattttataaattaatgttatatattgcatgttataatataggtattgctttaattaaattttccaaattagtgtaaaactaaaatccatcag

SEQ ID NO: 2690 - DNA, 309 bp, Diabrotica virgifera
  Clone ID: LIB3026-007-Q1-E1-F7
aaattggagtaaaacttattgatctctattttgttagataacgaggagggaagagagagataaggcttttaaatattttgctttatgttaaatccactttgtggaaggctttatttggaaaagaatcacacacattagaacactccaatgatgatcaaaacacttactatttaatggaaaaagaacctttagtaaatctttatatttctgtacctagagacaaaagtagtttgaactgtgctgtgatgatagcgggaattgtagaggcagtactcatagggacaggctttccagcgaaagttactgctc

SEQ ID NO: 2691 - DNA, 345 bp, Diabrotica virgifera
  Clone ID: LIB150-025-Q1-E1-C10
catcatatgatggattaggttgattttgaagtggtttattaatcagttaatttttcgtagaaagaggttcagaatgggatctgataattactcgatttttaccagtcggaatatgcttagtatccgttatgcagtggacagcattaaggaaaagacagttcgaaggaattgcaagtaaatgggagatcaactgttattgtatacttcctttaagaacagtatctagatgttgggggtatatagccgatgtaacactacccgaagtactgaggcctcccgtttacataatgtactccaacgcattcggtgttaacatcgcagaagctgaaaacgaggatttaacgt

SEQ ID NO: 2692 - DNA, 386 bp, Diabrotica virgifera
  Clone ID: LIB3026-002-Q1-E1-A3
agtcatttatgaacaagccaggagatggaagacctaaatatcttgttgtaaatgctgatgaaggagaaccaggaacatgcaaagatagagaaatcatgagacatgatccgcataagcttgtggagggatgtttgatagctggcagggctatgggagctaaagctgcatatatttatattagaggagagttttataatgaagcttcaaatatgcaggttgctattgctgaggcataccaagctggatttttaggtaagaacgcatgtggttctggctatgattttgatgtatttatgcacagaggtgctggtgcatatatctgtggagaagaaactgctttaattgaatcaattgaaggtaaacacagaaaaccaagattgaaacct

SEQ ID NO: 2693 - DNA, 238 bp, Diabrotica virgifera
  unsure (1)..(238): unsure at all n locations
  Clone ID: pGUT335
tttaaataaatttaagctttttagcttaaaaataaaattctttataaatgaaataaagacagtttttttttcatccaaccattcattcaagatttcaataaaaagactaatgattaagctaccttagcacggtcaaattaatgcggtcattcaaattaatcagtggaggtgcgagactttatatttgatactanctctcattccttatttatgtccatgggggggccggtttccattt

SEQ ID NO: 2694 - DNA, 401 bp, Diabrotica virgifera
  Clone ID: LIB149-006-Q1-E1-D11
agacggatacaaactctgccaagaactgatttcgttggtgggcgaacgggccgacatcgagaggaactacgccaaatcgctgaaggcctggtcgaaaaagtggaacgatgccatcgagaagggaccagagtacggtaccacggaggcggcttggaagggagcactcgtcgaggccgacaggagatgcgatcttcattctcggatccgagacagtttaactaacgacgtgataaataaagttaaacagtggcagaaggacagttatcataagtcgatgatgaatattaaagagaaaaaagatatggacgataattttaagaaagctcaaaaaccttggacgaaactgctacagaaagtagaaaaaaccaagaatgactatcacacggcctgcaaaacagaaa

SEQ ID NO: 2695 - DNA, 413 bp, Diabrotica virgifera
  Clone ID: LIB150-021-Q1-E1-D8
acgtcgtacgtaatttgcaggggttgattactgatctttatttgataatttgtttatttattttgcaacataagcaaaatgcgttcgcctcaaacctataacatgtcagaaggatcactccagacaatcatgtctggaggtgaatttccaaatcccattatgcaagttttgggtagcaaaaagataaacgccggattgggtgataaagaaagaattcgtattttactgtcagatggaaaatacactatttcttttgccatgctaacagcccaaattaatgatcgacttggtccaaatggtgtggaaacttttagcattatacaaatagatagatatgttacgagtatcatcaacaattctgggaaaggagaagcacgagtacttttaatcctcgatatgcatgttgttgtccc

SEQ ID NO: 2696 - DNA, 77 bp, Diabrotica virgifera
  Clone ID: LIB150-014-Q1-E1-C11
catgaacatgctcttcttgctttcacccttggtgtaaaacaacttagtgttggtgttaacaggatggaatgtcgcaa

SEQ ID NO: 2697 - DNA, 406 bp, Diabrotica virgifera
  Clone ID: LIB149-028-Q1-E1-G1
gccaattatctgaaacaggttatttaatacttaagggtataagaggattaattttatttgtagtttttagtggaagattattttcttgattagtattttctactcctatttttatttgtcttccttttttaataaaaattataactttgatttttattatagttggagtttgattaggttatgagttagctaaatttaaaatttcttataatttattaaggttaaataatatttctagagtattattttttagaataatatgaaatataccttttttatctactttaggaattaattattatccaatttattttggtatattttataaaaaattttttgatataggatgatttgaatattatggaagttcaagtgtaataaaacaatttaataatagaataatttt

SEQ ID NO: 2698 - DNA, 417 bp, Diabrotica virgifera
  Clone ID: LIB149-044-Q1-E1-D1
ctctaaactaactcgtatcacgcgtccgcccacgcgtccgcggacgcgtgggcggacgcgtgggttgtagcggtaatagtagcttgagcagcttcggtgtgcatgtcctgctgtgtgcatgattcacatttatatgtgactctgttctacgaaggattatgtccatattgccataattttatagtggatcaattatacactggatatcattcattatgagacagctttaaattggatgtagtaccgtatggatgggagacttataaaaaactagccgattggacaattcaatatacttgtcaacatggtgaagacgaatgcacccttaatagaatacacgcttgtgtcattgaccaaaatccaactcattcagatcttataagctttatgcaatgccatttatctcaagctatcgca

SEQ ID NO: 2699 - DNA, 476 bp, Diabrotica virgifera
  Clone ID: LIB3026-012-Q1-E1-F12
cggggcgccccacgcgtccggatgtatatgccaatgttcaaaaatattcgacaaatcctgagagcctctcatcgcatgcagttgctggagcagcagcgggatttttcactagtgttatttctagtccgatggagctagttaagtcaaggatgcaggttgcaggagcccaagcaggcaaaagtccattggattgtttattaagaatttataaacaacggaaattgcttggagtatttcaaggatatggtataacattgataagagacgttccagcctttacaacctattttgtatcttacgagtatttagccagaaccgaggaaggacaggtcccttcatcggcaacaatattattcgctggtggaatggcaggtgtgatatcttggataataccctacccactagacgtccttaagtcaaaaattcaagtagacacctcaaaacaattttctggagtgtatgattgcttcaagcaa

SEQ ID NO: 2700 - DNA, 426 bp, Diabrotica virgifera
  Clone ID: LIB150-023-Q1-E1-H8
aacatgcgtccggacattctcatgtttttcaaataaaaaataacataagattactccattttcaccatacaatgaccaaaataagtgaagtgtggaaagaggagtactgaactgttttctaaagtcgcatttgataataacttaagaaaattggaagaaatatgccagcagctactctaggtagcataccacatcctaataatgaagactgtggcattagggatgtttgggcccataacctgtaggatgaattcagaaccatcagacaaatagtacaaacatatcagtatgttgctatggacacagaacttcctgatgtaattgcaatgcctattgggtaatttagaagttctgcagattaccaaatacacatgctgaagtgcaatgtcaatttactgacgataatacagcttgggctcacatttc

SEQ ID NO: 2701 - DNA, 383 bp, Diabrotica virgifera
  Clone ID: LIB149-019-Q1-E1-B10
agacgatgcttactacttcttacatttcctggatgagcaacctgtctcatttttaagccttgatactgaaggaagagttatccgactagattccatgtcaaaagtccttagctccggactcagactgggttgggtcactggaccaaagatgttgatccagaatatagagatacacatttcaagctgcatccttcactccagtgtgctttcacaggtcattcttcaaaacctgttcgaaaaatggggcaacagtggtcttcttgcttacttttcaagagttgcttcattctatagagtaaggcgtgactacactgtctcatgcatggagaaacatctcaaaggactctgcgaatgggaactaccatcaggcggcatgttcatct

SEQ ID NO: 2702 - DNA, 376 bp, Diabrotica virgifera
  Clone ID: LIB149-028-Q1-E1-D8
acccacgcgtccgggatataatctgcaaagcagcatctgcgtggagtcgcaaacaagatctcaagatagagtccactgacgtatatccaccagtggctcacgaattaagattaaatgttgtgtgaactgccgtcagcgacacagatgcatatactcaaagctgtcaagatccacactgcctctccccaatggtttagggacatgaatgatctgggatcgtcgagagtgtaggggaaggtgctccagttgtaataccaactgatcatgtagttccattgtgtgtacctcaatgtggcgacagtgaattcagcattgcactcaaatacaaacttgtgccagaacattcttataacccatagacatggcaggatgccat

SEQ ID NO: 2703 - DNA, 424 bp, Diabrotica virgifera
  Clone ID: pGUT2739
gttaataaaatattttaggttaattaaaggattccgccaccgtttttttaaccggttaataaaaaccaggccttttggaataaattataaggcctcgcctgcccactgattaattggaagggccgcggaatttggaccgggctaaggtaccataatcattagttttttaatggaaagctgaattgaagggtggaatgaaaaaaaaactgctttaattaaattaaaaaaaaatttatttttaaagtaaaaaggctaaatttttttaaaaggaaagaaagaccctatagaggtttataaaatattaataaagttttttaagattaaaattatttatataataaattaattaattggggggataaaaaataaaattaactttttttatattattatattaaataaaaattttttggatccatttttt

SEQ ID NO: 2704 - DNA, 248 bp, Diabrotica virgifera
  Clone ID: LIB150-027-Q1-E1-E11
actactttactctttgtggtctaggaggtatcctctcatgtggtatcactcacacagctgtagtaccacttgatttagtaaaatgccgtatccaagtagatcctgctaaatacaagagtgtatttaatggttttaaagtaacccttgctgaacatggtacaagaggtttagctaaaggttgggctccaaccttctttggttattcagctcaaggtctttgcaaattcggtctttatgaagttttcaaa

SEQ ID NO: 2705 - DNA, 424 bp, Diabrotica virgifera
  Clone ID: LIB149-048-Q1-E1-G7
cccacgcgtccggaatttcgaaattaaaatattttgtactttaggaataaaaatatagattattatactattacattcgtgtttttgattataatatataatataaaacatggcatcagcagttccagaacattgtcctggagttgaaagcgaaaatgctggaagggcttcagcttgcgctggttgtccgaatcaaaatatttgtgccagctctgatccaaagaagccagatccaggtattgacttagtgaaggaaagattggcagatgtagataacaaaattttaattctttctggtaagggtggagttgggaaaagcacagttacagctatattaagtaggacaatagcaagtagtcatagcgagaagaatgtggctgtgttggacattgatatttgtggtccctcccaaccaaagagtgtt

SEQ ID NO: 2706 - DNA, 403 bp, Diabrotica virgifera
  Clone ID: LIB150-006-Q1-E1-F5
acacgaactgtagactcatggatctttttacaggtttcttgcttattctattcaaaaaccacgttcttcgtatcgtaaggggtacgtcaaggatactgtacactgtacggacacaaagtgacgaaagtcgaaacggaaacgtatttgcttctaaggattccgaaataacagatgaagatatcgatagtatattggaaaagggagaaatgaagaccgctcagctagctcagaagatggaaaccatgggcgaatcgtcacttcgcaacttcacagtcgaaacacccactgaatcagtctaccaattcgaaggagaagattatcgttagaagcagaaaaccatcggcttgagcaactggataaaacctcccaaaagaaaaaggaaagccaactatgccgtccatgc

SEQ ID NO: 2707 - DNA, 434 bp, Diabrotica virgifera
  unsure (1)..(434): unsure at all n locations
  Clone ID: LIB150-022-Q1-E1-D8
cacacgcgtccgcccacgcgtccgagcacattctgcatttgttgaacgtgttaagaagcgtggttttgaagtagtatacatgactgaacccattgatgaatatgtagttcaacaactcaaggaatatgatggtaaaactcttgtctctgtcaccaaggaaggtctcgaattacctgaagatgaagaagagaagaagaaacgtgaagatgataaggccaaatatgaaggtctttgcaaagttatgaagagcatccttgataacaaagttgaaaaggttgtggtatctaaccgtttagtagaatctccatgctgtattgtaacctcacaatatggatggactgctaacatggaacgtatcatgaaagcccaagctctccgtgacacatcaactatgggttacatggcagccaaganacacctagaaatcaaccctg

SEQ ID NO: 2708 - DNA, 411 bp, Diabrotica virgifera
  Clone ID: LIB3026-035-Q1-E1-A11
acaaactttaattttcggagtaaccatgacacttatgcgcaagttttctgcttctaacttttggacggactgcaataaatataattgtactgttgcaaactacataggtgaaacctgcagatatatattagcagcacataaaggaaaaccaaccataacacatggagtaaaaaaaatgtttggtaatggactcaaaaaagatgtttggaaagacttcgtagaaactttcaacatacctgaactttttgaattttatggatcgacagaaggaaacaccaatttaattaacttggataacaccattggctcagttggttttctgccattctatttgggaccaatattttcaatttgcctaattaaatgtgacgatgaaaccaaagaaccacttatagatgcaaacggactatg

SEQ ID NO: 2709 - DNA, 406 bp, Diabrotica virgifera
  Clone ID: LIB149-047-Q1-E1-D2
acccacgcgtccgataactttctaccatctgtgaggttattaacatcacaaactacaaatgatggagaaactcattttggatttgaaaaagtgaaagaacaggaaaaagaaaaaaaagtctttgaggtgtttgaaaatgttgctgtggactatgatataatgaatgatacaatgtctctgggaatccatagactatggaaagattattttatgtgtagcttatctcctacaaataacacaaagttattggatgtcgcaggaggaacaggtgatataacttttagatttctagattttgtaaaaaatcaaaatttacaaaattgccatgcaacagtatatgatattaatccacacatgttagaagtgggaaaattgcgaagtagtagatataattataatgcaaata

SEQ ID NO: 2710 - DNA, 387 bp, Diabrotica virgifera
  Clone ID: LIB150-039-Q1-E1-C10
agataacatctcgacatttagatatttatctaagtatcgcttagaaataaaaaacggtggaaatggtacctatcaggcagtcgacttaattgatcagctagtgaaagttttgttttggtgaatgattgattattgatagtctggtgtgtgttgacagaaattatttatttataatggatcgaagtctgcgaaatgttatgctactaaggctagcatttatgctggtttttacggcctttcaaactatgtctaatatacagcaaactataacagacagtatagtaaaagatgatccaacatatgacggagacgcatactacagtcaggctatcatatatggattcttctcgctatttaactggtcagcgccatcagttgttagtataa

SEQ ID NO: 2711 - DNA, 421 bp, Diabrotica virgifera
  Clone ID: LIB3026-016-Q1-E1-H6
aattaaacatttaccattgacttgtacttatttaaatatttgtaatctttctttatgtggttttccttttatgtctggattttattctaaagatttaattgttgaaattttatcttttagttatttaaatatttatatttatataattttttatatttctattggtttgacagttgcttatagatttcgtttaacttattattctttaacgggtagatttaattatctagctttaaatatattatctgaaactggttatttaatacttaagggtataagaggattaattttatttgtagtttttagtggaagattattttcttgattagtattttctactcctatttttatttgtcttccttttttaataaaaattataactttgatttttattatagttggagtttgattacgttatgag

SEQ ID NO: 2712 - DNA, 387 bp, Diabrotica virgifera
  Clone ID: LIB150-027-Q1-E1-B1
cggacgcgtggggaattaatgcgtatgttggccgaagatgaacttagagatgccgtacttctcattttcgccaacaaacaagatttgcccaatgcaatgaacgctgcagaaatcaccgacaaactcggtctccattcactacgcaaccgcaactggtacattcaagctacctgtgcaactagcggagatggtctctatgaaggtctggactggttgtccaatcaattaaagaacgccaatcgctagaacataggaaaagagaggagtgcgcaaaaaagtgtgcgagtgcagatggtttttttcttgtactcttgtcgtgtctactacctcgcgcgcgcgcgaaacgtttcgtataccatatgttgcaatttttgtgtccgatgggga

SEQ ID NO: 2713 - DNA, 244 bp, Diabrotica virgifera
  Clone ID: LIB3026-019-Q1-E1-B3
acgcacgcgtcaacccacgagtccggcagatcctgatgatttgggagttggtggtcacgaattgagcaaaacaacaggaaatgctggtggaagattggcctgcggagtcattggcttggccaagatttaaaatatttttgtaggggaccagtaaaagagtaattatataagtttatttttaatttaaaaagtgtcattcagtttttatcaataaaaagttggtttagagaaaaacaacaaataa

SEQ ID NO: 2714 - DNA, 258 bp, Diabrotica virgifera
  Clone ID: LIB149-038-Q1-E1-E3
aggtccattttccaccgctgtggatgctgatacatggcagttatgcggaggtggaccttgcagcagcactgcctgtcgaagcaacctcagtcacggtgtccatgctgttggatacacaacagatgcatgcattgtcaagaactcatggggaaatagctggggtgaacaatgttacatcagagttgcccgtggtgaacacttgagtgggactaacctcatgaactcttaccctcaattgtaaaaggcttgagtgcttat

SEQ ID NO: 2715 - DNA, 382 bp, Diabrotica virgifera
  Clone ID: LIB149-020-Q1-E1-D8
gtcgtctggttcgcctaattattgtagtctagttattttgctggtagttactgtttttagtcaagcaaaatgtgacgaagacggtaccatagttgaactgaagcaaggaaaaatcagggggcacgtactaaaaagtgaaaatggacaggactattatgcatttcaagaaattccatatgctgctcctccagtaggaaaaaatagatttcagctccctaaagaaccagagccatgggacaatattctagatacaacaaaaaatacaaaaatttgttatcaaactttaagcaggtttgactttcttaaaatagaagaggattgtctgtatataaatgtttacagtccacagaaacctggtagcgatgacttactcccagttcct

SEQ ID NO: 2716 - DNA, 425 bp, Diabrotica virgifera
  Clone ID: LIB150-006-Q1-E1-G5
aattttgggttatggtgccacgtaatttagaagtaatttattaaaaaaatatgggaaactctgaaagtgtagatgttcccggtggcggaacagatggatatcacgttcttaaagtccaagaaaattctcctgccagtcttgcaggacttcaaccattctttgattttattatatctattaacggcacccggctagatcgagaaaatgatacacttaggacgatactaaaaaacggcgtaggaaagcaacttccactaaccatctacagttataaaactcaaagtgtgaggactgtgacagtagtaccaagtgacacatggggaggccaaggctatttaggagtaagcataaaattctgttcctttgatgttgccaaagaaatcgtatggcacattctggaagtacatccaaactcaccagcatct

SEQ ID NO: 2717 - DNA, 421 bp, Diabrotica virgifera
  Clone ID: LIB150-037-Q1-E1-F3
aaaggctgtaattatagctatgcacaatttaaacccagacggtccttatgtcaatgtaaacggagccactaatacggagagagtgtgtattctagatgctggtgcacagtatggcaaagttattgatagaaaagttagagaattatgtgtggagtctcagatcatacccttggacaccccagccttcaacataaaagaagctggttacaaagctatcattatttctggaggacccaattctgtgtatgctgaagatgctcctagatacgatgcagatattttcagaataggtttacctgtgctgggaatttgttatggaatgcagatgatgaacaaagaatttggggggacagtcattagaaaagaaacgagagaagatggaatttataatatcgaagttaattcaaaatgtttgttgttc

SEQ ID NO: 2718 - DNA, 411 bp, Diabrotica virgifera
  unsure (1)..(411): unsure at all n locations
  Clone ID: LIB149-019-Q1-E1-A12
acggacgcgtggggaaattttgagcttaaaaccagttcacagtttagacttatctaacaatactttaactgtgttacctaaaaattttacttcattaacacatttaacaacattggatttgagtaaaaacgatcttaaagagttaccagaagattttggtaatttaacaaaattgagacatttagatttatacagaaatcaattgcagcatctgccattaagttttagcaagcttaaaaatcttaaatggcttgatttaaaagataatcctttagttcctgctgttgctaaggtggcaggtttgtgtattaatacaaaagaatgccagaactgtgcaaagaatattgtagcctttttcaacanattagagaaccaagtatcagctgatctggaaatgagaaacaaagatcg

SEQ ID NO: 2719 - DNA, 398 bp, Diabrotica virgifera
  Clone ID: LIB3026-027-Q1-E1-C10
aggaacaattaaacagcgatgttttactctaccaaaattttaccattattccaaacataatgtgcgagctctcatatttattccaaatacaatcaaaccaactttgtacatcaggtgtatcgggaaagaatatttgcttaggagataatggtagccctttggtattgaatggcgtacaaattggcatcgcttcctatggtaccgtatttggatgttcgttgggattccctggtgtgtttaccagagtaacaagttatttaggatggttaatgctttaaggatttgaacatcatgatcctgatcgactactatatataatggttcataatgaatggctattattttacctgtagattatattaataattaagattttagtttaatacctgagaataaaa

SEQ ID NO: 2720 - DNA, 377 bp, Diabrotica virgifera
  Clone ID: LIB150-025-Q1-E1-E2
tgaacacgcgtccgcccacgcgtccggaaatatttacacaatgtatctaatggctccaacttacccgaatacaaatcgcctaaggaagtttacgagatttacaataaatatcgaatctacgagtaaccgaacggacgccccccaaaatgtaggtagctttcagctatatggagataaagttgcaagtttcaatgaagaatgtattaatacaatatcagaagtaaatacttccccgaaaagtgaagtattctttatgtggtctgctcctcctccaggttcaggatgtgtcacattcagagccatggtattggaaaattctgatgtttggttttcagaagatggcaacttaactaaaaccatttgtgaacaaaaagatg

SEQ ID NO: 2721 - DNA, 232 bp, Diabrotica virgifera
  Clone ID: pGUT3991
cgccccaaaccaaatattaccaattattaaccttttttcccacgggtgaacttgcttgggttaactgacccttcatcttggccaataataatttcgccgtacctggggaaaaaatccagaccatcttaaaacccgccaatgtagaggtagaaccttactggcctggtcttttcggcaaagcacttgagggagtaaacatcaaggatctaatcaccaacattggatctggagt

SEQ ID NO: 2722 - DNA, 441 bp, Diabrotica virgifera
  Clone ID: LIB3026-015-Q1-E1-G1
aaagaatgaaaataagtcatccaagaactcaacataacaaacaaagattttgggaattatatcaacaatctgttgaaaaaaaagaggctccaggtataattgtaaggattgcagaaaaatttgatattggaccttgtttggtagcaaaaattattttaaacaaatattttgaaaagaaaagtgatgaaaatgcagaacctgtttcgaatatcaatgtttatttaagagatacctcattaatatctgatccagtattggcttatgaaatgtttttgtgtaccttgtatgataatgtttatagtcctataacagacgccatgaaaagctctttaggtcaacaatatgaaattaaattgtatagagaagctacacagcttggtttaggtttccgcgatgaagaacaactgaagaagtatgggtatgacaaaactcctgattgta

SEQ ID NO: 2723 - DNA, 432 bp, Diabrotica virgifera
  Clone ID: LIB150-015-Q1-E1-B9
acgcgtccgcagcccctgcagcagcggaagaagcaccagccgaaggagaagctcctgcagagggagctgctgaggaggaaagaccagaagccgaagaagaatacttagatcccgacaaattgatattgtttaaacactggattaggcctaaatttctaccatacaaatacctctacatctacagacaaaactactacgatgacgtcatggattacctagataagagaacaagaggaatcgatagggaaataccaaaggctcaaacatgggctgagagggtactaagaacattttccaacagaaccacccaaaataacacgtacaccagaaggatcagaaacgacttggaaatggtagaaaagaccaggaccagcggccaattttactactaccatggtaagaattcctttaacagacagttctcaaaactgc

SEQ ID NO: 2724 - DNA, 435 bp, Diabrotica virgifera
  Clone ID: LIB150-009-Q1-E1-A6
aggacgcgtgggttcgtatttttttcttaacaaaagggcaaaatgagcttttttggaaaattgttcggggggaaaaaggaagagatagcccctagtcctggggaggctattcaaaaactcagagagactgaagaaatgttaataaaaaaacaggattttttagaaaagaagatagaagaatttaccatggtagcaaagaaaaatgcgtcgaaaaataaaagagttgcactccaagccctcaaaaagaagaaacgattggaaaagacccaactacaaatagatggaacccttacaactattgaaatgcagagggaagccctcgaaggagctagcacaaatactgctgtattagattctatgaaaaatgctgcagatgcccttaagaaagctcataagaatttgaatgtagatgatgttcacgatatcatggatgac

SEQ ID NO: 2725 - DNA, 435 bp, Diabrotica virgifera
  Clone ID: LIB149-044-Q1-E1-C6
aggaaaatcttgagaaaatgccggttagggtggaaataacgcctcccctaccggcaaactccaaacaaccaggtgttaccaaatctttattgtacaatggctcaaaattccaaggattccagaaatcgaaaggcaatagttacgaggtggaagttattttacagcatgtagatgaagaaaactcatatctttgtggatatttacaaatcaatggacttacagatgagtaccccaaactgaccacgttttttgatggtgaaattataagccaaaaatatccttttcttaccagaaagtgggatgcagacgaagatgtggaccgaaaacattggagcaaattctcactattcagtcaatatgccaaaacctttaattcagattcttttgattacaaagcccttgctgatacggactacgtctttatgagatggaaag

SEQ ID NO: 2726 - DNA, 185 bp, Diabrotica virgifera
  Clone ID: LIB150-035-Q1-E1-B11
accacgcgtccgcgaatttaagaaattgagtaatattaagactgattcctcacgtttcgctactgctaatttgccttgcaacaaacacaaaaaccgtttggtacatatcctgcccttcgagaccactaaggtgtgtcctacaccgttgagaaacatcgaaagttccgattatatcaatgcgaact

SEQ ID NO: 2727 - DNA, 425 bp, Diabrotica virgifera
  Clone ID: LIB149-046-Q1-E1-H11
gtccaccgacgcgtccgaagacgcatgggaaacgctcgtacgtgatccaaacttttctcgtccagcaagcatcgactggagagatacagctgttttggctgtcaaagatcaggcagcctgtggttcttgttgggcatttagtactacaggtgcactggaaggtcaacttgctattcacaaaaatcagacaatcccattaagtgaacaagaattattggactgtgataatgagaataacgcatgctctggaggtaatgctgacgtcgcatttgagtacattgaagcaaatggtattagttcagaaagtcaatacgagtatacacaaaagaaaggtgaatgtagaaaagtggataataaaccagtgtctagcatttcaggatggttgggagtaccttcagatgaagatgcacttatagaaactgttg

SEQ ID NO: 2728 - DNA, 334 bp, Diabrotica virgifera
  unsure (1)..(334): unsure at all n locations
  Clone ID: pGUT4211
gccaggcagcgctaagggctctggaagcgcctaagatgagctctaagctggttcttgagtgcaagagagctctggatgacgttgctataaccaacagggttaggttggtatgggtaccgggacacacaggtgtggaaggtaacgaacgggctgacgccctggcaagacggngctcatcctctctgcctgtgggacccgaacctgtgattggagtgcccttcagtactggtcgtggtagtctcagggagcttctctgcggaggttccaggactcctgggcgagttgtgaggtaacgaaacaggctccacatagtggggccatccaaaagtcttac

SEQ ID NO: 2729 - DNA, 393 bp, Diabrotica virgifera
  Clone ID: LIB149-014-Q1-E1-C4
cacaaatctctgatcgcagcaaaggatatggccaaagcaggaattcacgtcagagttatggatccattcaccatcaaacccatcgacaaacaaggaatcatcaacaacgcccaccaagccggtaacagaatattggtggttgaggaccattacccagaaggtggtatcggagaggcagttttatctgctttagctgaagagagaaatattattgttaaacacgtagccattccaagagttcctagatccggtagaccagcagatttgttgaactactataagattgatgctaagaatattgtaaaccatgttgatgaattactcaagaagtagatttttaagttaataaatgcacatttttctaacaaattaacttaaaaaaggcggccgctc

SEQ ID NO: 2730 - DNA, 431 bp, Diabrotica virgifera
  Clone ID: LIB3026-017-Q1-E1-D1
aggtgtcaagggcacatatgtatcaatacacagttctgggtttagagattttctgttaaaaccagcaattctcagagctatagtggactgcgggttcgaacatccttcagaagttcaacatgaatgtattcctcaagctgtcattggcatggatattctgtgccaagctaaatccggtatgggaaaaacggctgtttttgtattagctacactccaagtaatagatcctacagaaaatgttgtatatgttctcgtcatgtgccataccagagagttagccttccagataagcaaagagtacgaacgtttcagtaaatatatgcccaatattaaagtaggggtcttctttggtggcttgcctatccagaaagatgaggaaacgttaaaaaataattgcccgcatatcgttgtgggtactccaggaagaattt

SEQ ID NO: 2731 - DNA, 383 bp, Diabrotica virgifera
  Clone ID: LIB149-025-Q1-E1-B11
ataatgagtcgtattattaaccaaattaagaaataaagacattatatttcctcccgacttctctgaaaaaaatactggaaaacaggagctattaattaggtggctactagaccatgacatctctcagcgtctcatgtctcaggggcttctctcaactctaaacatacctccccccgttttacaagaatgcgaaattctcgaaatatttagacacaccttttataatcctcacttgaaaaggtgtaaatatctgataacatcctgtttcaagcaatctgtctcacacgttcaacatataacctatgataaagatccttctgcgcaaaacgttgtctaacctttactcctgcaagagttcgttcaagacatatgtatttcaatat

SEQ ID NO: 2732 - DNA, 321 bp, Diabrotica virgifera
  Clone ID: LIB149-042-Q1-E1-H3
agcccacgcgtccggaagaacagaacgccaaaacagcattagacgatggcaaatacagtgggattccacaacaaaaggcagatggacacatcgtcttataccacagctaaatctctggctgaatcgcaaacatggtgaggtcaattactatttgacgcagatgctctcaaggcatggctgctttcgagcatacttataccgctttaaacatgacgactctccagagtgcccatcctgtctcggaataagtgaagacgtggaacacgtgttcttcgtgtgtcctcgtttcaacttgctgcgaaattatcatcaaccaacaaa

SEQ ID NO: 2733 - DNA, 455 bp, Diabrotica virgifera
  Clone ID: LIB150-013-Q1-E1-H7
gcttattagctgtgtttttctgtctagtgagcagtgatcaaccacaaaagacaacatgtgtgacgacgatgttgcggctcttgtcgttgacaatggatccggtatgtgcaaagctggattcgccggagatgacgcaccccgtgccgtcttcccctcaatcgtcggtcgcccaaggcatcaaggtgtcatggttggtatgggacaaaaagactcatacgtaggagatgaagcccaaagcaaaagaggtatcctcacattgaaataccccattgaacacggtatcatcaccaactgggatgatatggaaaaaatctggcatcacaccttctacaatgaactccgtgtagctccagaagaacaaccagtcctcctcactgaagctccactcaaccccaaggcaaacagagaaaagatgacccaaatcatgtttgaaaccttcaacacacccgccatgt

SEQ ID NO: 2734 - DNA, 450 bp, Diabrotica virgifera
  unsure (1)..(450): unsure at all n locations
  Clone ID: LIB150-013-Q1-E1-E3
tagacgaccaaagaggttgtgtcacaagaccaaaattgatgtccagatttactaagattaaaaactttggcgcaagcgcttcaatgttatcaaatgcccacttccaagcatttaaattccctgactccatggaagttcacttccagtgcaccatccaaatctgcagatatcaatgtccagatcagtgttcaaattcctcaggacaacatctccacggcttgcttgatttggtgcatggtccacctgatactggttatggtgctcctccaccgctacctatcgaagcatatttacatcctgggcgaccaagggatgaaaggagatcaaagagagctctcgctgtcgacccggaaaaggaagtgggggtgaataggattattaaggttgtatctacaggagatttgacatttacacttgacgaanacagcaatagcacaactccacccacta

SEQ ID NO: 2735 - DNA, 520 bp, Diabrotica virgifera
  unsure (1)..(520): unsure at all n locations
  Clone ID: pGUT2573
ccttccttgatgtcgactacatggtatacttgttcaaatttgactctacccacggtcgctacaagggatgtgtcaacagtgatggcaaaaacttagttgttgatggcaaagtcatttccgtacaccaagaaagagacccagctgctattccatggggcaaagctggtgcagattatgtagtagaatctaccggagtgttcaccacaattgaaaaggccaagaaacatcttgacggtggtgctaagaaagtcatcatctcagctccatctgctgatgctccaatgtatgtatgtggtgttaacttggatgcctacaatccagctgatcccgtaatctctaacgcttcttgcactaccaactgccttgctccactcgccaaagtcatccacgacaacttcgaaatcgttgaaggtttgatgaccaccgtacatgccacaaccgncacacaaaaaactgtcgacggaccctctggaaaattgtggcgtgacggtcgtggtgccggacaaaacatcatcccagc

SEQ ID NO: 2736 - DNA, 387 bp, Diabrotica virgifera
  Clone ID: LIB150-038-Q1-E1-F1
aaatgagagatgatttgaacggaggttaacaataatggacaaattataccaataaacattgaaaacaaaaagttattaaaagttataaaattaccttcaaaattgtttcttattaaaaataaattttgcaaattgaaatgggttgtgatggtggtaccattccaagacgagacgaacttgttaaagttaaaaagaagcccgaagctaaagataagaatgcagaactagcattcaagtggagatgttgttttataactcaagaagttctccaacaaccaattgttgtttgccacctgggaaaattgtacagtaaaatgtctctaattgaagccttgctcgatagaagttcattgccagagtcgatcaagtacattaagagtttaaaag

SEQ ID NO: 2737 - DNA, 338 bp, Diabrotica virgifera
  Clone ID: LIB149-047-Q1-E1-E10
aatcggtacgtattttgcaaatttctatgtcaacaatgctctagacggagctactctaactaattgctcccactttcaatatgtatccagattgagtcttagagtcatctggatcagtatcaaaacttgcatcgatataaccctttacgatgaaccttttgtcacctccataatcgagaaacatatccttattccactaaggataattttgacctatgtccagtgatctactcctagatcactattgtactccctttgccaaacatagggcagggtatacaataggtctggtacacagcatgtcatactttatagaacctatggctgaggcataggcc

SEQ ID NO: 2738 - DNA, 318 bp, Diabrotica virgifera
  Clone ID: LIB149-014-Q1-E1-G2
cggacgcgtgggcggacgcgtgggaacgatataagcatccttcgtcttgcaacacctttaacctttggaaacggagtcagtccaatcgcactagcaactgctggaacgcaaataaaagacggtttagaagcatatgccaccggatggggtcgtttgggagagcatatgccagcttctcatcagctacaagtcgttatgttacctgtaatttctaccgagacatgtgctgaatattatccccctggatgggttaccaggaggatgttctgtgctggttattacgagcaaggaggaaaagatacttgtgagggtgattct

SEQ ID NO: 2739 - DNA, 410 bp, Diabrotica virgifera
  Clone ID: pGUT2671
gactagaggcgttgttagttacttcgttgggtcgacatttttgtgtttagtgtaccgattaatcttcaaatattacaatggctgaccaactcaccgaagaacaaattgctgaattcaaagaagctttctcactattcgataaagatggtgatggtacaattacgactaaagaattaggaacagtaatgagatctctaggacaaaatccaacagaggctgaattacaggatatgatcaatgaagtagatgccgatggtaacggcacgatcgatttcccagaatttttaacgatgatggcacgtaaaatgaaagataccgattgtgaggaagaaattcgtgaagcattccgagtgttcgacaaaaacggcaatgggtttatctcatctacagaattgcgccacgttatgacc

SEQ ID NO: 2740 - DNA, 445 bp, Diabrotica virgifera
  Clone ID: LIB150-013-Q1-E1-B1
aaaaaataaccagtccaaaattaaatggcaaatattacaatagaaaaaacaaaatatgaatgtgctccagtctcaaaacgttgccagagagatgatgttttacgtaagaccggtctgactgttggaaaggtagatttatattatggaagaggcgtccgaaatgatggatctcttgtacccccgattagacaaactgcaagtatttttaaacagcccgtaactgtctataagctacaagagagtaaagtaaaaaatgattataaaaacgggaatcaagagaaaccaaagcaactaatttgggagaaaagattggaaggtttaagggcttgtgatatggatggctttgagttcgaagctatggaactgccaaaaggtttaaaaccagtgggacctaatgtaactgaagacaccattatccagagtgttgctacagcactccatgttt

SEQ ID NO: 2741 - DNA, 403 bp, Diabrotica virgifera
  Clone ID: LIB150-050-Q1-E1-B9
aacaaacaaaagtttgaaacagaacgagaaaatgtgacgcttgtggatgtaaacaaacttggtctgttgactgccgaagaaacttatcgaatgatgcaaaaacaaaaggaaaacaaaaagtgccttcgaattcctcgtcgtccagaatgggatctaacgatggaagcggaacatttgcagaaattggaatatgaacaattcattttgtggcgtcaacagctggccgaagcttctgaacaacaaggacttttgtttacaccttttgaaaaaaatttggaattctggcgccaattgtggcgtgtacttgaaagaagtgatgtgattgttcaaattgtcgatgctcgtaatccaaacatgttttactgcgaagacattcacacatattccaatgaaattcaaccgg

SEQ ID NO: 2742 - DNA, 353 bp, Diabrotica virgifera
  Clone ID: LIB150-050-Q1-E1-G5
aggacaaacttacggcagtgcgagaacgtgggagtaccactgatattgctttgtggaaattcgacacagctgaatactaagtaaccatcattgctgcccctggacacagacatttcattacgaacatgatcactggtacatcacagactgactgtgctgtactcagtgttgcagctggtactggtgaatttgaatcacgtacttcaaagaatggacattcacgtgaacatgcgcttcttgctttcacccttggtgtcaaacaacttattgttggtgtcaacaacatgggctcgactgaaccagcacacagtgaatcacgtttcaacgaaatcaagacagtagtatcctcatag

SEQ ID NO: 2743 - DNA, 264 bp, Diabrotica virgifera
  Clone ID: pGUT4355
aaactatcgaacaattcagagaacctgtcaggcgtgccaaagttatcgtttggaacggaccctgctggtgtattcgagtgggataaatttgctacaggaactaaagccattatggatgaagttgtgaatgtcactggcaaaggagccatcactattattggtgaggcgatacagcaacctgcgcaggcaaatggaagaccccgagacaagtatctcacgtttcaacccgaggtggggccagtctcgaacttgtggagggaaaag

SEQ ID NO: 2744 - DNA, 450 bp, Diabrotica virgifera
  Clone ID: LIB150-030-Q1-E1-C11
acgtggtgtaccacaaattgaagtaactttcgacatcgacgctaacggtattgtacatgtatcagccagagacaagggaactggaaaagaacaacaaattgtaatccaatcttctggtggtttgagtaaagatgaaatcgaaaatatggttaaaaatgctgaacaatacgcacaacaggataaggtcaagagagatagagttgaagcagtaaatcaagctgaaggtattttacatgaaactgagacaaagatggaagaatacaaagatcagttaccaaaggaagaatgtgacaagttaaaagaagaaattaccaaagtcagagatttattaactaaaaaagatgagacagatcccgaagaaatccgcaaagctacaaccaccttacaacaatcgtcacttaaattgttcgaaatggcttacaaaaagatggctgccgaaagagaatcatc

SEQ ID NO: 2745 - DNA, 206 bp, Diabrotica virgifera
  Clone ID: LIB150-001-Q1-E1-B8
cttcttgaagcctgaaaatattagagacattaataaaagaaaaccagatcatccagagtatgattgtcgaactttgtatgtccccgagaagtatttaactaccttaacacgggttatgaaacagtggtgggagttaaagagtcgacacatggatacagttttgtttttcaaagttggaaaattttaggaactttaccacatggatg

SEQ ID NO: 2746 - DNA, 444 bp, Diabrotica virgifera
  Clone ID: LIB3026-006-Q1-E1-H10
gttaaagcatgcgacgtaaaagaagacgtagactgctccaacataataccattcccagatcctgattgtaaggatggtaaaaatacatattacccatacccatacgattgtaaaaaattctacgaatgtcttgattccatacgttacattctatcatgtccaggggatttcctgtggaacgaaaaactcaataaatgcgacgacaaagacacagttgattgttctcacattatccctgaacctgactcaacttctgtcgccccccaaccttcaactgatgtcaccgaaccttcaactgctgttcccaatccttcaactgttaacccagatttacattgtgacatagaccttgaatatttcgccgatccttacaattgtcagggatactatcaatgccttaacggaattaagcagcacgaattttgtaacgaaggtcttctgtgg

SEQ ID NO: 2747 - DNA, 405 bp, Diabrotica virgifera
  Clone ID: LIB3026-019-Q1-E1-D4
aaaaacaattgtggtgtgaaataacatttggtttgcccttgtcgttcaaaaaattggatcttactgcaattttaaaggagactgccggcaaatctgttctttgggaaacgccccaaattaaaagagccattacttatgtgaaggatgataaattaatgcttagaacggatggtattaatattgttgaaatgtttaaatacaatacccttttagacttgccacaactttattgtaatgatatccataaagtggcagaaacatacggcattgaagcagcatctaaagtaatagtaaaggaggttaaagacgtatttaatgtgtacggaattaaagtagatcctcgtcatttgtccctagtagccgactacatgacatttaatggtacatttgaaccactcagcagaa

SEQ ID NO: 2748 - DNA, 439 bp, Diabrotica virgifera
  Clone ID: LIB149-025-Q1-E1-F7
cccacgcgtccgcccacgcgtccgcgcaaatggtaataaagtacattagagctctgcaagctttagaatttctagatgaggaagacaaagtgaaaccttccgatatcggtattgttacgccgtatgccagacaggtgtatacattgaaagccctccttaaaggaaatcaaatcgaaggtgtcgatgtcggaacaactgaaacgtttcagggacgggagaaaagaattattattatatctactgtaagagcccaaaaagatttgttgctgtacgataaactttataagttaggcttcgttaaaaatgaaaagagattcaatgttgcacttaccagagctatgagtaaattaataatcatcggatgcgcgcaagttttggctacggacagaaaatggttgaaatacatggatctatgtgatacgctatccaatttccgggg

SEQ ID NO: 2749 - DNA, 447 bp, Diabrotica virgifera
  Clone ID: LIB150-019-Q1-E1-E3
gccaaatttatcagttctgctatatcatcttacagaaatatttagccgaaaatagcgaacagtggacaaaaatttagctgcttatagtgttatttactttattttaagactgttttattaatttcgaaggagcaacatgaatgtgacactaaaaaatcttcagcaacaaacgtttattgtagatatagaagcgacaaaaacggttaaacaacttaaacagaagattgaaacggaaaagggaaaagattatccttctgaaaaccagagactgatctatgcaggcaaaatacttacagatgaaacagttttgtcagaatataacatcgatgaaaagaaatttattgtagttatggttacaaagccaaagcaaccagagaaaacagatagtggagatggaaactctactccagccagtaataaccctgctactccagcaacacaaccagc

SEQ ID NO: 2750 - DNA, 360 bp, Diabrotica virgifera
  Clone ID: LIB150-050-Q1-E1-G6
cggacgcgtgggatggcatctcctaccggacaaggaaaaattctctctgggacacaaatttccaaggaaattaacgaacaactgaaaaatgtcgtaaacgaaattaaaacaaggttaccaaattttcaaccaggcttagctattgttcaagtaggagatagagaagactcaaatgtatatattcgcatgaaaatacagtctgcttcaaatataggaatcaaggctcaacatatcaaattgccaagaagcataacagaattagaagtattaaacaaaatagaagagttaaacaatgatccaaatattcacggtatcatcgtgcagatgccattagaatctgacaataaaattaattccaaa

SEQ ID NO: 2751 - DNA, 413 bp, Diabrotica virgifera
  Clone ID: LIB149-023-Q1-E1-E5
acccacgcgtccgagaagattcccattttctcagctgctggtctgccacataacgatattgctgcccaaatttgtaggcaagccggtcttgtcaaaatcccaggcaaatcagttttggatgaccacgaagacaactttgccatcgtgttcgctgctatgggtgttaacatggagactgctagattcttcaaacaagatttcgaagaaaatggttctatggaaaacgtatgtttgttcttgaacttggctaacgatccaaccatcgaaagaatcatcaccccacgtcttgctctaacagccgctgaattcttggcttaccagtgcgaaaaacacgtgttagtcattttaactgacatgtcttcatacgctgaagctttgcgtgaggtatctgccgccagagaggaagtacccgg

SEQ ID NO: 2752 - DNA, 457 bp, Diabrotica virgifera
  Clone ID: LIB3026-024-Q1-E1-E10
ccggggtcacccacgacgtccgcacacgcgtccgcccacgcgtccgcggacgcgtgggattggtgggtgtcaaagcacatcaagaaacctatcagatctacagtgacttgcttggattggcatcctaacaatgtgctacttgctgccggatcttctgatttcaaagtcagagttttttctgcttacattaaggatatcgaaaagactcccgaaccgactgcgtggggttcgaaaatgcctctgggacaattgatggctgaatttgtcaattccaacgttggagggggttgggttcacagccttagtttttctccagatggaaacaaaatttgttgggtttcccacgattcttcgataaacgtggcagatgcaagtaaagggaatgctgtccataaacttcgtaccgagtttttaccatttcttagttgcacttggatcggcaataaatcagtagtgg

SEQ ID NO: 2753 - DNA, 184 bp, Diabrotica virgifera
  Clone ID: pGUT2298
gcaaacagagctccaaccggagacggaaggagcgcttttattagatcaaaaccaatcggtggcgggttcgctcgtcatcgtataacttggtgactctgaataactttaagctgatcgcacggtctcgcaccggcgacgcatctttcaaatgtctgccttatcaactgtcgatggtaggttctgc

SEQ ID NO: 2754 - DNA, 429 bp, Diabrotica virgifera
  Clone ID: LIB150-032-Q1-E1-A5
gtacgcatcagaacgataggaacaacgaggaatggtgggaatagtacttgatactatgtggatggaacctgatactgaaagtgaactggacaaagttgccgctgaaagaaaattgcaatttatattcggatggtatgctaatcccatcatcaacggcgactatccagcacaaatgaagcaattcatcgcgaaaagaagtatcgcgcaaggtttcaaacagtctcgtctaccgcaattcacaccagaagaagttaagtacatcaaaggatctatcgacttcttgggagtgaaccaatacacatcgatgttagtacgaaacatggatgataagtataaaaccgaagtagcgtgggaagctgactcagaaacgtatctttaccaaccagacaactgggaatcgactgcaactgattggttgaaagtcactcc

SEQ ID NO: 2755 - DNA, 394 bp, Diabrotica virgifera
  unsure (1)..(394): unsure at all n locations
  Clone ID: LIB3026-023-Q1-E1-E12
cctccggatttcgtcacaggtcatccccgcaatgatgttatgcanaacaaaacctttttgaccgtacaaaaaacaaaacagtcacaatcaagataagccaacttggaaaactattgcaacggatgcaagctgggaaactaagtttatttggagtagaccagacccattaacacctaccagtcaagcagaaattcgatgggagattccagatgacacacaacctggatcttaccaaatccaacatttcggcaactataagacgctttttagcggcatctatgcgtatagtggtgtctcgagaatattttctgtgaaagaaaattgtcaatccaagtgattcattatttttagatataatttttgaattttggtttaataaatttgttagtttttt

SEQ ID NO: 2756 - DNA, 305 bp, Diabrotica virgifera
  Clone ID: pGUT667
ctcttattcaaaatttataataccaaaatatttgaagaatttgacggtactatattgatctttcacaaccagcatcttctggccaatcacaaacatttagtgaaggattgaagtgtaaacctcctggacagttgtaaaggtatggtgctccattcgaacattgacagaatttggtacaatctggaagtgctgcatatactgggaacttgccatcaactgctgggcaaacaacattattttgcaaacactcttccgaatcaactggtaattcgttgcggctttcttcacttgttgaactactttga

SEQ ID NO: 2757 - DNA, 383 bp, Diabrotica virgifera
  Clone ID: LIB149-036-Q1-E1-C8
tacaagcctcaagattgagtcatgatattgcgctccagcgaaagttcaagtttgtggagctcaagatgcacaaaaattgcaagatttggctgctgaaagatgttctatgacatacagagctcctgaactattccatgttgagagctactgtgtaattgatcagagagttgatatttggagtttgggttgtgtgttgtatgcgatgttgtacttcaaatccccctatgatattgtgtatgagaaaggggattctgtaaatttggctgtgatatcaggaactatttcctttccacaagacgcacattttagtgaagatgttcacgatttaatccgctttattttgaaagtaaatcgatccgaaagacccttcattgatgatgtta

SEQ ID NO: 2758 - DNA, 425 bp, Diabrotica virgifera
  Clone ID: LIB3026-020-Q1-E1-G11
gcgtccgaaaaaaacttaaaggaaaaacattggcaaatgtaactttacatatatccgaaaaaggagtcatagtaacggacgcagaaggaaacgatgttctcaaaatatctatttatagcatatccaactgttccactgactcatcccaccgacaactattttcgttcatatcatcagacagaaaccaagtaaacacttgccacgcttttctttgtcccaagcgaaaagtggcccaaaatttgacgttagccgttgccagtgccttcagcacagcctacctcgattggagccaatatacgatgtctatcgagggaatgagtaataccgttcagtctaaagaatacgagaaaaacaatctaagtcaaatcagtaagtctgaagttataatagaagaaaagcttatcgattttgatagtgagcctact

SEQ ID NO: 2759 - DNA, 415 bp, Diabrotica virgifera
  Clone ID: LIB3026-032-Q1-E1-A10
tcgcggggccccccacgcgtccgcacacgcgtccggaatattttgatctgcacagtgcgacatgttttttgccgtattttctctctttattttccaagcatttgctgcccctagccaccatttgggtatcatagatggtgagaatgccacactgggcgagtttccctatatagtcgccgtggaagattgcgatggtttatgttttgtaaaatgcggtggcgttttgttaaccgaaagttggattctcactgctggccattgtaacaaaaaggaaatgttcgacgatcttcaggctcacgttggaattacaaatgtcgatgatacagaccatcaattcaggcatgtagtaaaaattattgttcatccaaaattcgacgaatatgcttcaatcagttcgcacgacatagcagtcatg

SEQ ID NO: 2760 - DNA, 589 bp, Diabrotica virgifera
  Clone ID: pGUT3285
caaaaacgaaaatgttgccaaaaatattgaagcccgaaacaaactagacattgtagcaatagatatgttaagcgatctaattatgaccactaaaaggaacaaacatattctggtaatggtggatgtgttttcaaaatacgtaaaattatatagttgccgcaccacaaagggtgaagaaatattaagaaaaatcgacaattgtatagccatagtaggaacaccaaaaaagattctactggacaatgcaacgtatttccgaaatgatcgtttcaagggacaacttcgagaacgaggaatagagacaaattttgtcagcatcaggcatccacagagtaatccgtcggaacgattcatacaggaagtgacgaaatttcttcgcattgcaacagatggtcaacatcgccactgggacaggaaaatggcggaaatagaaaggtatctaaatacaattccgagcacagtaacaaaagagaccccagaatacatcatgaagggtgtactgccgataaggccatgggaagaccaagagccaaaagaatatcaacaggtgattgaaaccgtacagagaagattacggcgaagcaacgaa

SEQ ID NO: 2761 - DNA, 140 bp, Diabrotica virgifera
  Clone ID: LIB149-005-Q1-E1-G11
gtgcgacgcagtagcgtgtaactgtcttaggttcccaggtcagttgaatgctgatcttacaatattggttgtcaacatggttcacttcccccgtcttcaattcttcatgcgcggattcgctccactcacctcaagaggca

SEQ ID NO: 2762 - DNA, 390 bp, Diabrotica virgifera
  Clone ID: LIB149-011-Q1-E1-A1
caaacatcacgattttcctgctgttcctggttcaagattaccagacgtaaagaggatagcaccggaattctacgacaacctaccgcagcaccacagctggagtgcagtgttatacgacttcgtgatggatccagatgtaggaccttacgccagaatcaggcgacaagccaaaggcctatcaacgtagttcccatcgacacaacaccaaattacctataattttattgctcgcgtctcattatgattgtctgtgacagaatgagacgaggacagtaacatcttttgcatatgtgtggttaaaagtagcctttagttgactgtacataaccagtgacgtatgtcctttttagatatagtttatctataatataatacttaatttaaaaatgt

SEQ ID NO: 2763 - DNA, 389 bp, Diabrotica virgifera
  Clone ID: LIB150-036-Q1-E1-C5
tacccacgcgtccgcgaggtattaccattgatattgctttgtggaaattcgaaacagctaaatactatgtaaccatcattgatgcccctggacacagagatttcattaagaacatgatcactggtacatcacaagctgactgtgctgtactcattgttgcagctggtactggtgaatttgaagcaggtatttcaaagaatggacaaacacgtgaacatgctcttcttgctttcacccttggtgtaaaacaacttattgttggtgtcaacaaaatggactcgactgaaccagcatacagtgaatcacgtttcgaggaaatcaagaaggaagtatcctcatacatcaagaaaattggttacaacccagctgccgttgctttcgtaccaatt

SEQ ID NO: 2764 - DNA, 344 bp, Diabrotica virgifera
  Clone ID: LIB150-004-Q1-E1-F10
agattcggccagttctcattttcttggctggtgccacgttgatgtgtgaatattttcaatttagtttcatatatcatttgtaggtttaacaggaaaattcgtcaatatgttccggaccggttttctgctggtattctttttgaatgctgtttttgccgctgaagatatcaaaaccgaagatggagttttggtcctcaccaaagacaatttccaaggagtcctcaacgataatgagttcgtcttagtagaattttatgctccatggtgtggtcactgtaaagccctagcccctgaatatgctaaggctgcccagcaactagaacaacagggatctaacatcaaac

SEQ ID NO: 2765 - DNA, 434 bp, Diabrotica virgifera
  Clone ID: LIB150-046-Q1-E1-A11
acccacgcgtccgcccacgcgtccgaaatattccaactctgatgtcattatctacgtcggttgcggagaaagaggtaacgaaatgtctgaagtattgagagatttccctgaattgactgttgaaattgacgggcacactgaatctattatgaaacgtaccgcattggtcgccaacacatctaacatgcctgtagctgctcgtgaagcttctatctatactggtattactctttctgaatacttccgtgatatgggttacaacgtatctatgatggctgactcgacatcacgttgggccgaagctttgagagaaatttcaggtcgtttggctgaaatgcctgccgattccggttatccggcttacttaagtgcccgtttggcttccttctacgaacgtgctggtcgcgttaaatgtttaggtaatccagacagag

SEQ ID NO: 2766 - DNA, 359 bp, Diabrotica virgifera
  Clone ID: LIB150-049-Q1-E1-E9
agagtcgtgatattgttgaatttttgtatgaagcagctctgaaaacactaaaaatggtgttagaaagtactatgatttgtgtcgataatagcgactatatgagaggtggagatttcctacccagcagacttcaagctcaacaagatgcagtaaatttagtatgtcattctaaaacaagatcaaacccagagaataatgttggtttgttaacgttggcaaaggtagaagtcctagcaacactgaccagtgatgtgggccgtattttatctaaattacatcaagttcaaccaaatggggaaataaacttgcatagtggtatcagaatagctcagcgagctctaaagcatcgccagggaaag

SEQ ID NO: 2767 - DNA, 401 bp, Diabrotica virgifera
  unsure (1)..(401): unsure at all n locations
  Clone ID: LIB149-048-Q1-E1-E8
gttttgtacttgtgtgccaaataaaagaataaatatgttcaaaaaacagaaaaaaccttcaaaactaaatagtgtacaaagtgacaaacgcattgatcctgtgccaagacctccagtatctccagtttcaccagttacaagaagtacactacagttttattgtcagctagcacatggtagtccaacggcatttgtgtcaggtttttccaatataaaagaactttacgaacgaattggtgaatgcttcaaccttcctgcctcagatatactattttgcactctaaacacttacaaaattgatatgactaaattattaggagggcaaataggactggaagattttatttttgcacattgtanaggcaggccgaaagaagttgaactaacaaaatccgaaagtg

SEQ ID NO: 2768 - DNA, 432 bp, Diabrotica virgifera
  Clone ID: LIB150-032-Q1-E1-G5
tacttctgaagccaaagacaaaccaatgggctgtgctattctcgtcacaacatattctatgatcacccacacgcagcgtagatcatgggaagctgagcaaacaatgaaatggttgcaggaacaagagtggggaataatgctcttggatgaagtccacacaatacctgccaagatgttcaggagagtgttgacgatagtgcaaagtcactgcaaattgggactaacagccactttgctgagagaagatgataagattgctgatctgaatttcttgatcgggccaaaattgtatgaggcgaattggttggagttgcaaaagagaggttatattgccagagtccaatgcgcagaagtctggtgtcccatgacaccggaattttatcgggaatatcttgtgtgcagaacaagtaaaagactgttgttgtacgttat

SEQ ID NO: 2769 - DNA, 412 bp, Diabrotica virgifera
  Clone ID: LIB149-040-Q1-E1-F4
acccacgcgtccgcccacgcgtccggcagcagccagcgattagatttaatatagtctaattagtgttgctctattcaacaatgcggtgggagattgtttgctttgtcggcgttttagccattgtacttgcagaagataattatttgttcgaaacaaagtatattgatgtgcctttagatcactttagcttcgcacaggacacgaagtttcaattaagatacttaatcaatgacacctatcacgaagatagaggcccaattttcttttatacgggaaatgaaggtgatattaaaaattttgcgaagaacacagggttcatgtacgacatagccccgacattcagtgctttactggtatttgttgaacacagatattatggcgagtcattgccatttggcaatcaatcttactc

SEQ ID NO: 2770 - DNA, 459 bp, Diabrotica virgifera
  unsure (1)..(459): unsure at all n locations
  Clone ID: LIB149-029-Q1-E1-F4
acccaagcgtccgcccacgcgtccgggaaatagtggtattgttgttgttagttttgtttcagctgtgcttagganaaccggtggaaaataacggtgatgagcttgttggagtagctgtgtgttatagacatggagatcgagcacctgtatcgtctttccctaatgatccctatattgacgctaagtattggccagacggcatcggagaattggtgaataaaggaaaagtgcatcaatttcaattgggtcaatggcttcgacgtcgttacaagaacttcctgtctactcggtanntacctacagagctatatgttcgctctacagacgtagatagaaccctcatttctgaacaaccaacttagctgggttgtaatatcccgatggaagcccatatcctgttgaatggcctcaagagttaccttggaacccggtacctatccatacagtagaatacaaaaa

SEQ ID NO: 2771 - DNA, 384 bp, Diabrotica virgifera
  Clone ID: LIB149-022-Q1-E1-B7
agttgaattcaaagtcgtcgagaccgatcccgctccgtactgtatagtggctccagataccgtcattcattgtgatggagatccaatcaagcgcgaagaggaggaagaagctcttaacgcagttggatacgacgacatcggaggttgtagaaaacagctcgctcaaatcaaagaaatggtggagttaccactgagacatcctagtcttttcaaggctattggagttaaaccaccaagaggtatcttactttacggtccaccgggtactggtaagacactcattgcacgtgccgtagctaacgaaactggagcgttcttcttcttgattaacggtcctgagattatgagcaaattggccggtgaatccgaaagcaatcttcgtaa

SEQ ID NO: 2772 - DNA, 388 bp, Diabrotica virgifera
  Clone ID: LIB149-022-Q1-E1-B8
aaatttgtgtttcatatatttcatttactaaccaattgtcacggattgtctctaaatcacttgttatgaaaatatagcattatggactctgttactgatgaacaagctccaagtaattcccaagaagatagaggtagcaatacagagacaggggttcaagtacacactaaagactccgccagatactgttgggtatgttttgcaacagacgaggaagacagaaccgctgcatgggttcaaccctgtaattgtaggggcactacaaaatgggtacaccaagcttgtttacaaaggtgggtagacgaaaaacataaaggtggcaatcttggaaaagttacatgtccacaatgccaaacagaatatataatagtttttccgaacatgggtg

SEQ ID NO: 2773 - DNA, 427 bp, Diabrotica virgifera
  Clone ID: LIB3026-030-Q1-E1-F6
tcgcgcgggccaccacgcgtccgaagtcgacagaattgttggtttagatccagctggtcctctattcagagaagagagaacagacaaccgtattgacgctagtgatgcagagaatgtccaaattattcacacgaatggaggaaagatgggatatttggctccatgcggagactctgacttctatccaaatggaggaaaatcacaaccaggttgtggatttgatttaggtggcggttgtgctcactctaggtcatacgcaatatatgccgaatcattgactagcacaggatttgttggacagcagtgcaatagttatgaggaatatcagaagggtaaatgtaccggaccaaaagctagcatgggaatgttccatattgataaaatggcctctggttcctactaccttaagacacacagcaaatctcca

SEQ ID NO: 2774 - DNA, 341 bp, Diabrotica virgifera
  unsure (1)..(341): unsure at all n locations
  Clone ID: LIB3026-022-Q1-E1-H12
tccgcacacgcgaccgcccacgcgtccgcccacgcgtccgaaaaatttcaaacaaatgtcattgactgatagcgaccgacgactcgtactggacgctcacaattatttgagaaataaagtagctacaggacaggaacccataggacctcaaccacaagcgtcaaatatgaaagctctgagttatagcaaggaactggaatatatagctcaatgccacacaaactcctgcaagtggggccacgacgcatgtagaagaactcctgaatggggatgggtangacaaaaccttttcttaagatcttacanaggaggttccataactacaagagatatgttaaatt

SEQ ID NO: 2775 - DNA, 316 bp, Diabrotica virgifera
  Clone ID: LIB150-036-Q1-E1-C11
caactcctatagtgagtcgtattaaagtttgtaaacgcaccgttggaacatcgctccttaaaaatggcaaaagaatctgcaagcaaaaaagggaatggtgctgtcactacatatctcctactttataatggaatacaaactttaggctggtcatatcttctatttcaagtaattatatattatttattcggatcgacgaaatctctctacgatacagtccaatggacagttaatatattccaaaatttggcagtgttggaggtgttgcatgcagcaataggaatagtgaaatcaaatcccatcattacggctgttc

SEQ ID NO: 2776 - DNA, 361 bp, Diabrotica virgifera
  Clone ID: LIB149-042-Q1-E1-D5
agcttcgtatgaaaaatgtttacgttagtttatggattttataagcatatggtacagaaagatgaatattgtgtattaattttgggccttgacaatgcaggtaaaacgacctacttagaagctgcaaaaactaaacttactaaaaactacaaagcaattcaccctacgagaattacaacaactgtaggattaaacataggcaaagtagatgtaggacgaataagattaaatttttgggatctaggaggacaaaacgaattgcagagtctttgggataagtattatgaagaatcccatgctgtaatttatatagtggattcttcagatagagaaagaatggatgaatctaaagatatatttt

SEQ ID NO: 2777 - DNA, 400 bp, Diabrotica virgifera
  unsure (1)..(400): unsure at all n locations
  Clone ID: LIB150-039-Q1-E1-E10
accatattttgttgctgtagtcggcaagtgaaattttaaaataatatgtaaatcatacataaagtatattatttacattaagaattttgttcccgccgttaattaaatattgaaataaaatggcagtgggttcaacanaagtcgtccaagtgacgaatatagctccccaagctacaaaagataagatgcagatattatttggatacttgggtaaaatagaagatattcgtttatatcctactatcagagatgtttcctgtcctgttcagtcacgtatttgttacatcaaatttgttgatagtacaactgtaggaattgctcaacatatgacaaacactgtttttatagacagagctttgattgtgattcctatatcaagtggagaaattccagatgaata

SEQ ID NO: 2778 - DNA, 419 bp, Diabrotica virgifera
  Clone ID: LIB150-037-Q1-E1-G11
accacgcgtccgcccacgcgtccggttaaaacaagaagcaatatatcaaaagtggctggacattgagaaaattggtatatccttccttcctaatatgggcgaccagacaacgcaagatagatcatggaaggataaaagcatagacctgcttgaaaaaaatagaggcttggtcgtcctatttttctgtttgccagccagctttattttcgatctgctacttaatctacgcaagcagatataccgctatctgttcagtggtgaccaagaccacgaccaacgtgtaaggagagtacaacaacaggtgcagcaatggaacaaactacccaagcaagatagaaaattactatgtacctcgagaccaaactggcagagcttatcgctaactttcttcaaagaaggactgtgtcatcaagttaacg

SEQ ID NO: 2779 - DNA, 409 bp, Diabrotica virgifera
  Clone ID: LIB3026-002-Q1-E1-D5
agacagaaacaaccttaggagtgcttgtttctccacatggaaaaggcaagattggatcatgtgggaaaatagtaccaggaatgatggctaaagtaatagacgacaatggtgtccctctacctgcttatggagaaggtgaagtgtgctttaaaggtcctttgataatgaaagggtatataggagatccaaaatctactcatagcaccatagataaagacgggtggttgcatacaggtgatgtagcatattatgatagtgatggttatttcttcatagttgataggataaaagaacttattaaatataaagccttccaagttgctccggcagaattagaggctttattgttaacaaattctgctattcaggatgctgcagttattggtttaccaaatgaagaagctggtga

SEQ ID NO: 2780 - DNA, 383 bp, Diabrotica virgifera
  Clone ID: LIB150-044-Q1-E1-A5
acccacgcgtccgcccacgcgtccggagaaatcatggcaactatacgtgaacacatgggacctcttcctcagattcagcaactccctgatggtgaatatcaagaagtgcccccaaatataaaattcggtcatccaaagttttataaactgaaagagattttactagagcattttggtgaaactggagattctagtagggttattgtgtttttcgagtatagggaatctgtaatggaagctttcgtactactgattcagtcgaaaccagtgttgaaacccaggatatttattggacaggcgaatggagtcagccagaaaacacaaatcagtgtagtgaaagccttcagagagggccgctgcaacgtgctcctatccacaagcat

SEQ ID NO: 2781 - DNA, 438 bp, Diabrotica virgifera
  Clone ID: LIB3026-012-Q1-E1-D7
cccacgcgtccgagaaaaagaagagctagaatcaataggtgcctcgatgaactaaaagaacttatggttactgccctccagagtgaaggtgaaaacgtttctaagttagaaaaagcagatatcttagaattaacagtgcgtcacctccacaaactaagaaaacaacagagattatccaccaatccagtgatagatgctgacagattcagagctgggtacacacactgtgccaatgaagtctccaggtgccttgcttcaactcctggtgttgatatccaacttggaaccaaactgatgacccaccttggacatcgcctcaatgaaatggataaagtatctcctctagttattcaagtaagttcacaatatacacctcctggttcaccaaacctagaaactgaagtgcctcaccattacacaatgcctttgacaccagcc

SEQ ID NO: 2782 - DNA, 409 bp, Diabrotica virgifera
  Clone ID: LIB149-042-Q1-E1-B9
actttattttgttttaaacttgtaataatggctggggaagtaatagttgatgctttgccatatatagatcaaggttatgatgagccaggagttagagaagcggcttttgctatggtggaagaagagtgtagaagatttaggccaaccaaaaactacctggaacatcttcctccacttaacatatcatcttttgaaactcctattatgcacaatgagttcgaaaggttgcagaatcgattacctatggaaaccttgtctatgaaacgttatgaacttccaccacctccaagtggaaaactaaatgaagtgggtgcctggaatgaatgtgtagacaactcacaagctcagctagaacatcaagctgttagaattttaaacctgcatcttatgttagactactgttgtcctg

SEQ ID NO: 2783 - DNA, 430 bp, Diabrotica virgifera
  Clone ID: LIB3026-012-Q1-E1-H7
cgaaaaagttcttgcatctgatcggtatgccgctattaataaacagtacgcagatgtgtatgcctatttatcaaaatattcaggtaacaacgttaccaacgttgaacaggcctttccagtgtttgatagttttaaaagtgaatctactgttggtcttcgtctcccagtgtgggcatcaaaagtgtatcccaaaccattaacagaactgattggacatatgtacaacgcttgggtttataccactaagcaacaacgactgtacgctggagctttgttagattctatccttaactactttgacaataaaataaacggttcagtatcccaaaaattcaaaatgtacagcggacatgacctcaacattgcctctatattaagcgcgtttggtgcatttaatcaccctaacccccaagactttgcgagcagtata

SEQ ID NO: 2784 - DNA, 361 bp, Diabrotica virgifera
  Clone ID: LIB150-014-Q1-E1-B5
ggagccgaaaccacttttaactactgaaccttcttggcaaaaacttcaacaatattatgatagtaaaggcaataaattagtcatcaaagaccttttcgcaagtgatcctgcaagattcgataaattaagtttaaaaattgctactcctaatgatggcgacatactcattgatttctcaaaaaaccgcattgatgaagaaggtttgaagctattgcttgacttggctcgttcaaggaaagtataacctgcacgatatgctatgtttaatggatccaaaatcaacttcaccgaaaacagagctgtattacacatccctttaagaaatagatcagatcgacctattatagttgatggtaaaaat

SEQ ID NO: 2785 - DNA, 329 bp, Diabrotica virgifera
  Clone ID: LIB150-024-Q1-E1-H10
tacaactccctaaactgagtcgtattacggcgaggaagtcatcatgagattggaaaaccagcgacagtatacgttcgataggaggctctttgaaaatgagatgtgccgccttggattccaaggtcactcttggagaatctcgaaggttaatgaaaattacaaattttgtccaacttatccgccttaccttctcgtcccgtcttgtattaacgatgacatgttggaaagcgtcgccaagttccgcagttcaagaagaataccagctgtagtatggagacacttcagaaacggagcagttattgttcgttccagtcagccagaagtcggtt

SEQ ID NO: 2786 - DNA, 394 bp, Diabrotica virgifera
  Clone ID: LIB150-010-Q1-E2-G2
gtgaaaacaaaatcagatagggaaagtttcgcaactgacacaactttgtgcaaaatttgctttaaaaacgaacttggtgttgttttcttgccttgtggacatattgttgcttgtgtagattgtgctgctgcactaaaaacatgtgctgtatgccgaaaacctttagaggccacagtcagagcgttcctatcataaatttttattctgttaatagtttttcacatttcatgtttcacacatacttagatctagtcaagattgttagagttttggcaaagaaattaaataaaaattcttttcataaaaatcatttctttaatattacattagagaaaaattatatttttatactgagtacaaatttgaacaagttattaattttaagttacaaaat

SEQ ID NO: 2787 - DNA, 349 bp, Diabrotica virgifera
  Clone ID: LIB150-033-Q1-E1-B2
cgggtaacaagccttcgttaatttaaaaccctaattccggcaatccaccatggccaccatggaaaacttcattatacaattcgcagacattgtaggtttcaccaagatgtctggtagcaaaagcgccgaagaactagtagatatcctcaacaacttgttccaaaggtttgactccttgtgtaagatacacaattgtgagaaaatatctactttgggtgattgttattactgcgttagcggttgtcctgaagctagatcggatcatgctcagtgctgcgtcgagatggggctgagtatgatccaagccattaaacagttcgaccatgagaagaacgaaagggtcaatatg

SEQ ID NO: 2788 - DNA, 407 bp, Diabrotica virgifera
  Clone ID: LIB149-020-Q1-E1-D12
cagaaattataaataaaactgacgttactttctgggagatagaaggtatgggctacgatttcattccctcaaccttagaccgcaaagtcattgacacttggattaaagtaggtgatgagaatgccctgccaatggcaagaaggttgattaaggatgaaggccttttgattggggctagcagtggagctatgatgtgggcggctattcaagcagcgaaagctaaaaattatggccctggtaaaagggttgtagttatgttaccagatagtattaggaactacttaacaaagttcgtatgtgaccaatggatggaagagcgaaatcttcagccttgtgtaaatacaaacaaccacccgtggtggaatttaaatgtctcccaattaaatcttcctgtaccacaaactgta

SEQ ID NO: 2789 - DNA, 323 bp, Diabrotica virgifera
  Clone ID: LIB150-003-Q1-E1-D11
accacgcgtccgcccacgcgtccgggttgttggaaatcagatcatggcgaccgttttgccaggtattcaactaattattggattaaggcactccacatcaagtgacaagaaacaacaaaatcctccaccatctaaaagcgatcacgaccatgttctggaacattctttacatcaacttctaagggaagtgcaccacaaaaatacgcaccatcctttcccccatcctgcaactgggccgttgggtccatccaagaagagaatgcttgcaggtcctatggcagctgaccggtacgaacttcttgaaatgacgaaaaaccaaacac

SEQ ID NO: 2790 - DNA, 287 bp, Diabrotica virgifera
  Clone ID: LIB150-027-Q1-E1-F8
ctcccgggtcgacgcgaagacccacgcgaaggtctgccagaacgagctgctgcgaggcgactgatggcgaagccgcacaccgtggtcgtctacggcatcccgaactgcgacaccgtgaagaaggcccgcgtgtggctggacgatcacggcgtcgagttcgaattccacgatttcaagaagctcggcgtgagcgccccgctgattgaagactggctgaaggacgtgtcgctcgacgcgctcgtgaacaagcgcggcaccacgtggcgcggcctggacgacgcgatgaa

SEQ ID NO: 2791 - DNA, 288 bp, Diabrotica virgifera
  unsure (1)..(288): unsure at all n locations
  Clone ID: pGUT1685
tcactttaagtgatagttataaaatcaaaagggtanaccaaaattatcaaaatgggtcnatatgcacgtgaacccgaaaatgctgcaaaaacctgcaaagctaaaggttcaaacttgagagtacattttaagaacacatgtgagactgcaaatgcaatcaaaaagatgcccctcaaaagagctgtagcctatttaaagaatgtagtaatccagaaggaatgattccatttagaagattcaatggtggagttggtaggtgttctcaagctaaacagtttggtactactc

SEQ ID NO: 2792 - DNA, 413 bp, Diabrotica virgifera
  Clone ID: LIB150-038-Q1-E1-F5
cccacgcgtccgggaaattgctatgtggaatcctactgcagcacccaataatacaacagatccattcaaaaccctatttattgctagaatcaattatgacacttcggaatcaaaacttcgcagagaatttgaagtttatggacctattaaaaagatcgttttgattcataacagcataaatggtaaaccgagagggtatgcatttattgaatatgaacatgaaagggacatgcactctgcttacaaacacgccgacggtaagaaaattgacggcagaagggtattagtagatgtggaaagggcaaggacagtcaagggatggttacccaggaggttaggtggaggtctgggtggtacaagaagaggtggaccggacgttaatatcaaacactcgggtcgtgaagacaacgaaa

SEQ ID NO: 2793 - DNA, 404 bp, Diabrotica virgifera
  Clone ID: LIB150-035-Q1-E1-E12
cggacgcgtggggttagcgaaggacgttacgtaatttgttgaacggcaatcatcatggctaaggtacccaatgtcaagttcaacaacggagaagtttttcccgcctatggtctaggcacatggaagtcaaagcctggtgatgttactcaagctgtgaaggatgccctcgacatcggctaccgtcacatcgattgcgcccatgtctacggaaacgaaccagaagtaggtgctgccttgaaggccaaacttgccgatggcacagtcaaacgtgaagacatctacatcaccagcaaactctggaacaccttccacagacctgacttggtagaacaagccgttagaacacattgaagaacttgggtcttgagtacttggacttgtacttgattcaacgggccttttgc

SEQ ID NO: 2794 - DNA, 385 bp, Diabrotica virgifera
  Clone ID: LIB3026-005-Q1-E1-D8
gtcaagttagggagtacgaaaacgtggccacgacagtattcagccccctagagtatggttgtgtcggcttgagcgaagaaacagccattgaacgattcggtgaagacaacatcgatgtctaccacggatattacaagccgactgagttctttattccacagaaaagtattgccaattgttacttagaggtagtcgcccatagagagggtaatcgtcaagttgtaggattgcacttcattggaccaaacgctggggagattattcagggatttgccacagcaatcatattaactttaacagtaaaggatttaatggaaactgtaggcattcatccagtcatagcagaagaactcacgagactcaatgtcatgaaacgattaggcaa

SEQ ID NO: 2795 - DNA, 361 bp, Diabrotica virgifera
  Clone ID: LIB149-019-Q1-E1-F2
acttggggtgtgtctcaccccgaactactaactgcttgtggaggagaacttacaggaaaatatggacccatcgatcctactatagatgcgacttatgaatttctcaacgatctatttatagaaattcacgaaacatttgctgacagatatattcatattggtggtgacgaagtaggttttgaatgttggggaaatacctccaaaattgttgactacatgaaagaaaaagatatacgaacttttgaagatttggaaagtttttacattaaaaaagttagtgatatgatagatagtttagaatatcaatctattgtgtgggaagaagtatttacaaatggcgttgagctacctaaggatacag

SEQ ID NO: 2796 - DNA, 203 bp, Diabrotica virgifera
  Clone ID: LIB150-008-Q1-E1-B10
aatttacaggagacaaaacaaaatactgaattattaagtgtctagctatggatgggaaactacctgcatgtgttatagacgtgggtacggggtatacaaaattaagatttgctgcaaataaagagccacagttcataataccttcagcaatagcaatcaaagaaactgcaaaagtaagtgatacaacaagtcgtagattaaat

SEQ ID NO: 2797 - DNA, 423 bp, Diabrotica virgifera
  Clone ID: LIB150-037-Q1-E1-C9
cggacgcgtggggagatgtggaggaacattgataagcactagattcgttgttactgctgcacattgttgttatacaagagatgctgggaaaccgagtgtagtacgtgttggagaactcgatttagcatcagatcaggatggttcggtgtatgcggactatttaatttcacgagtaattgtacatccaggatattcagctccatataaatataatgatatcgctcttctagaaacacaacagccagtagtttttacaaattttacacgacctgcttgtctcaatcttaaccataacgtagctcaaagtcaagctatcgctacaggatggggaaaaactgattttgctggtgatgctagtgatagactattaaaagtcactttaaatctatacgacaatcagagatgtcagagaacatttccccc

SEQ ID NO: 2798 - DNA, 382 bp, Diabrotica virgifera
  Clone ID: LIB149-032-Q1-E1-A1
aaggacgcgtggggccgattggtccagcgctgaattccaagctatgttggcccgtcagatggctaacaagcccaaacaatcctttattgcaaaacacgtagccgatcccaatgtccaagctgtagaagaagttgattggagagatagtgccgttttgggagtcaaagatcaaggacagtgtggatcatgctgggctttcagtaccaccggatccctcgaaggtcaactcgccatccacaaaaatcaacgtgttcctctcagtgaacaagaattggtagactgtgacacatcaagaaatgctggttgtaacggaggtttgatgacagatgcctttaactatgttaaacgccatggtctctcttccgaatctcaatatgcatac

SEQ ID NO: 2799 - DNA, 449 bp, Diabrotica virgifera
  unsure (1)..(449): unsure at all n locations
  Clone ID: LIB150-019-Q1-E1-G5
gtacgaattggctaagaagtattctagggggaacttgcaatgctataaccacgttttgataaaagaagctgataagttgtttgcagatcagaaacatgagctcagtgcccaaagatatgcagagactgagagtagcttagaggaaatatgcctgaagttcattgaagctaaccagcataatgctttgaagctgtttttgagatgcaaattggacacactaaaaccccaagataagacccaaatcactatgatagtcatttgggtcatggaactgtatttggtaaaactggaacagatgcgtctagcagggttagaacaaacggcaacatatgcagacttgcagaaggagttcgatgtatttttagccttagacgaaatctcaaattgtatcaaaaacaataagggtactgtttataatctaatgagcagtcatggggataanaataacg

SEQ ID NO: 2800 - DNA, 424 bp, Diabrotica virgifera
  Clone ID: LIB149-031-Q1-E1-H7
aatccaaatagatataagaagctcaaagcaagtggtacaaaaaatctcttgaccggcgaaactgaaaaggaaatagtcgaagatggaaaaataatatcccactggcatccaaactttacattgaatctggtgactgatcaaactttgtggaattacggtggagtgccagtccctctagatcagtttattcgattcacagatgatggaaagcaatataaaccagtgttatttgcaaacgacttttggaacatggctcgtgattataaacctttaaacgagacttattcacttcaaattacattccagccactgagcttgttcaaatggcagctgtacgccgcacaacacatgagacagagttggaatgtctggggccatgaacagacacagtccgacgaagaacaagatacgcttaaagaaacct

SEQ ID NO: 2801 - DNA, 355 bp, Diabrotica virgifera
  Clone ID: pGUT2568
cccaagaggatgcatacttgggccaaatatatttgtcgaaacactaaagaatttgagtggaaagaactttattcaggtcggaaaaccttctgaaacttgtgtcaatttcatcaaagaaatgtatcatgtaatcgaccccaaaagagtactattcgttggagattcaattgaatcagatatgagtacaggagctataggaggtttccaaaagatgctagtgttaactggttcaacaaaaatagaagaaattacagattggaagtttcctgaagaatataaaccagaattctatgtagaaagtttggatgttttaaacaaaattattaaatccatttttccagatttgtaacctcac

SEQ ID NO: 2802 - DNA, 393 bp, Diabrotica virgifera
  Clone ID: LIB150-002-Q1-E1-G10
cccacgcgtccgataaatcacaaataatgattccaatttaatcaaaagtttaaatttcaaaaaattgcaattaactttaattccaaaaaaatcaaaatgggtaaaagaaaagattcatattaagcatccttgtcattgggcacgtacattctggtatatctactactactggacatttaatttacaaatgtggtggtatcgataaacgtaccatcgattaagttcgacttagattcccaagaaatgggtaaaggttcattcaaatatgcctgggtactccacaaacttaaggcccacagataacgtggtattaccattgatattgctttgtcgaaattcgacccagctaaatactatgtaaccatcatttgatcccctggacacacagatttc

SEQ ID NO: 2803 - DNA, 424 bp, Diabrotica virgifera
  unsure (1)..(424): unsure at all n locations
  Clone ID: LIB149-045-Q1-E1-D3
tcgtacgaattctattccatacaacgcaagaagcttaggggtttgccttttaggaagttttaaagatacgaatcctcctaatgtacaactgaaagcattggaagactttttgtcttgtgcagcagctgatcacaaaattattgcagattatcaccttatcggacatcggcaagctgataaaacagaatgtcncggggatcgagtgcatgcagttatcgaaaaatggcctcattttgaagccaatccacaagatgcttcnccaaaaaaactgtaaacatagcgaagttaccttttctcttatggaataaacacctctctatcgcaatgtntttagattacaattattaatacatgtaaatatttaaaagactgtatatatatatactcgtactttaaaaatgtgtgaaaatatatcactatcttt

SEQ ID NO: 2804 - DNA, 234 bp, Diabrotica virgifera
  Clone ID: LIB3026-022-Q1-E1-A7
tccggacagcaatcatggccgtcggtaaaaataagggtttgtcaaaaggtggcaaaaagggagttaaaaagaaggttgttgatcccttcacaagaaaagactggtacgatgtgaaagctccatcaatgtttgccacccgccaggtcggcaagactttggttaaccgtacccaaggaaccaaaattgcctctgaaggtttgaaattcaaatttttcgacttgtctttacccaatt

SEQ ID NO: 2805 - DNA, 251 bp, Diabrotica virgifera
  Clone ID: LIB150-015-Q1-E1-F11
atattttacttgtttggccaataattttagttacgtaaaacaaattattttaaataaaatgggtcaaaaagtaacaattgcagcttcaactttaaatcaatgggctttagattttgaaggaaatctaaacaggattttacagtcaattttagaagccaaagaagttggacctacatttaaaaaaggacccaaattagaaataagtgggtacatttgttaggacaatttctatgaaactgatactttcctgc

SEQ ID NO: 2806 - DNA, 203 bp, Diabrotica virgifera
  Clone ID: LIB3026-011-Q1-E1-F7
atctatgatactccatagataacttcgaatggactcaaggattcaatggcaaactgggcatctactatgtaaaccaatctgacccttcactgccaagaattgctaaggattcttcgaaatactacgctaatgtgattaaaactaaatgtttggtagattcttgtgtagataactgatagtaataataaataaattattatatt

SEQ ID NO: 2807 - DNA, 420 bp, Diabrotica virgifera
  Clone ID: LIB149-035-Q1-E1-B7
agcggacgcgtggcaaatccacaagtcatcaacacgaagacaaaagttaaaaattttgtttgtaattgcaagtaatcatggcttcagagagatatagtttttctttaactactttcagcccctctggaaagttggttcagattgaatatgctttagccgctgtagcggcgggtgctccatcagtaggaattaaagcatcaaatggtgtggttattgcaacagagaacaagcacaaatcaattctgtatgatgaacacagtgtccataaagtagaaatgatcacaaaacacattggtatggtttattctggtatgggtcctgactatcgccttcttgtgagacaagcacgcaagatggctcaacaagtattacctagtatacaatgaacccattcctacagtacagttggtgcaaagagta

SEQ ID NO: 2808 - DNA, 341 bp, Diabrotica virgifera
  Clone ID: LIB150-005-Q1-E1-H7
caaacatctagtcaacaatactacgatcagttctcatcaaatgtggctgaagacagaactcacgaaggatatctttacaaacgaggtgctttgctcaaaggatggaaacaacgctggtttgtactggattcgatcaaacatcagctgagatactacgacgctatggaagattcccattgtaaaggttacatagatctggctgaagtaatatcagtaaatccagcaccaccagcgcctggtcctccgaaaaagacagatgataagtctttctttgatttacgtactagtcgccgaacgtacaatttttgtgctacagatgctacatccgcacaagaatggat

SEQ ID NO: 2809 - DNA, 433 bp, Diabrotica virgifera
  Clone ID: LIB150-016-Q1-E1-H7
gaagtggaagaggaaaaatgggttgctgcgctaaagttggagctgttgttgcagtgcttttagctgttttagttgtctatagtacaaaatctttatttcaaacacccaaggtgccagatttgggcgaaaaatggtggaaagtggccaagccggcaaaagtggatactagtatcaaaccgttcaaaattcaaatttcagatgaaattttaaaagacttgaagggcagactagatcgtagtcttccatttcaaccacccctagatggcgtgaaacaacattacggaatgaacactaatctcctgaatactataatggactattggaagaacaaatatgactggagacaaagggaaaagtttttcaaccagtatccacagtttactaccaatatccaaggacttaacatccatttccttcatgtcaagcctactga

SEQ ID NO: 2810 - DNA, 371 bp, Diabrotica virgifera
  Clone ID: LIB149-047-Q1-E1-D10
agcaggatcctacgcatcctcaaggcccatgggctggcaccagagatcccggaggagctctactttctgatcaagaaggcggtggcgatcaggaagcacctggagatgaacaggaaggacaaggactctaagttcaggctcatccttgtggagagcatgatccaccgcctcgctcgctactacaagcgcaccatgaagctcccgcccacctgcaagtacgagtctaccaccgccagcactctggtggcttaagggagatccagatctggtgtgctcttagctgattaaagcttgattgttctggaaaccattcttatgttatgccttatgatagtttggagccaaacagatgctgcaaattttctatgttt

SEQ ID NO: 2811 - DNA, 386 bp, Diabrotica virgifera
  Clone ID: LIB149-033-Q1-E1-H10
gtcgacgacgcgtcaggggacataaagtttttgttttatttgggctattggcaacaacctatggatttaatcaaataaaatctagaaatacccgcaatggcttaaatttggatggtggtacagaggctacagatggacaattcccttgggtagtttcacttcaatcaaattttttgtttgttaatacacatgtttgtggaggtgtcatcttaaatgaaaattgggttcttacatctgccgaatgtgaaggtgctgctaacaaagtagtgggcggtgctgttaaactgcaaggagccgatcctaataaacagactgttgatattgaaagatgggtggttcatccaaactataactcacaagtattttggcccaatgaaaacccttta

SEQ ID NO: 2812 - DNA, 420 bp, Diabrotica virgifera
  Clone ID: LIB150-039-Q1-E1-F8
ccgggccgacccacgagtccacccacgcgtctgcggacgcgtgggcgcgaacaggcgagaaaagacctcaaaggactcgaagacactgtcgccaaagaactacagactctgcacaacctgagaaaattgttcgtgcaagatttgcaggcacgtatgaagaaaaatctttcgtcggaagacaatgaggaagacggcggctctctggctcaaaaacagaagatatcgttcctcgaaaacaatctcgatcaattgacaaaagtccacaagcagttggtacgagacaacgcggatctgcgctgtgaacttcccaaactcgaaaagagactacgagctacgatggaaagagtcaaagcactgggaaccgcactgaaggaagccaaagaaaggcgccatgagagaccgggaaagataccaatacga

SEQ ID NO: 2813 - DNA, 405 bp, Diabrotica virgifera
  Clone ID: LIB149-035-Q1-E1-H5
aggaaaatcacaatgttcgtaattttacgctagaagctctttcaaatgaagtacataagaagtttgaatcttcacatttctttaaagtgggatcttgtattgttacattattacagaataatttattaacagatccagaacaacgtttagcagcaattactctgttatatgaactatatcgtggagaacccattgggaatactccttttgctaatgtatttattcatctactgaatcctccagaacaacaaagcagtgtaggagctccaaagttagaatatcctggacagttgcctagaataactgccccagaaaaacattttatagttcaacttttggctgattaaactaaaggatgctctactaaaaaagactgctgcacaaattgttaactcagatgtgcca

SEQ ID NO: 2814 - DNA, 279 bp, Diabrotica virgifera
  Clone ID: pGUT2318
gtcgagacaggatggatttgtgagtgattggtaacggatcttatccaaggcatctgaggagtttgagatcaactctctaaggaagatttctttattagagtagaatgtgttgatgatcaaactcatcagctgagcgatttcagcctggaaggcgaaggtctcgacatctgcgctttgagtttcttcaggcattttggactagttttttcacaaaatattcacaagtcacaatgtaaaaaccgctttgaaataattttctgctttggaaattcgcttccg

SEQ ID NO: 2815 - DNA, 418 bp, Diabrotica virgifera
  Clone ID: LIB149-004-Q1-E1-F2
cacgcgtcaaaactggtgcattgaaacctggtatggttgtagtattcgctccagccaatttgacgactgaagtaaaatccgttgaaatgcatcacgaagccctccaggaagcagtacctggtgacaatgttggtttcaacgtcaagaatgtctctgttaaagaattgcgtcgtggttacgtagctggagacaccaagaacaacccacccagaggagcttcagacttcactgcccaagtcattgttctcaaccaccctggtcaaatctcaaacggatatacccctgtactcgactgtcacacagctcacattgcctgcaaattcgctgaaatcaaagaaaaggttgaccgtcgttctggtaagaccactgaagaaaatcgcaaagccatcaaatctggtgatgccccattgtcaacttg

SEQ ID NO: 2816 - DNA, 384 bp, Diabrotica virgifera
  Clone ID: LIB149-037-Q1-E1-D1
aaggccagcaaggagaagtatttactcctgaaacttctccataacgtccataggtacgtctaagatatttcaagaatccatgatgggaagcacacggctcaggaaaaattcctcgttggtaaacaatatcagagacaaacaaccagacatcaaaatacagaaaatgactgatacaaattcctacttgaagtatgttagcttactaattttaactctccaaaatgctgtgtttggtttaagtatgagatatgccagaacacgagaaggtgatatgtttttatcctcaacagctgtactgttgatggaagttgtcaaactgatcacctgtttgatgattgtctacatagacgccggtggattattaaaaatgtttcgtttaataga

SEQ ID NO: 2817 - DNA, 382 bp, Diabrotica virgifera
  Clone ID: LIB150-010-Q1-E2-H3
acaaaagacccaaaaaagccatagaattttataaattagttaattttatttaagaatattagaatatttaagaaactttgtgtagtaaaataataaaaatgttacgcgaactacaactattaagacctctaaggatactatttgttcagtcaagtggatttaaacactttccatcaccccccaaatttgaccacattcagctaccagaaaaacccagacttaagtttatagataaagttccacaattgcctccatcgatacgaccgcccaaaatgcagaagaaattaaagctaatgcgtggtcctgaacaagtacacactttcttgttgcacaagcaatacggaattatggcaaccggaagtggtcgtttaaagtggggtca

SEQ ID NO: 2818 - DNA, 436 bp, Diabrotica virgifera
  Clone ID: LIB150-017-Q1-E1-A3
cacacgcgtccgggccaataagtttcatcggatattagacaaaaattgaaggatgctaatttggcacaagtgcccttggtattgtttgcaaaaggagcccattttaatcttgaagaccaagctgaattgggttatgacgttctgggtatagactggactgttgatccaagtactgtaagaacccgactgaagaataaaaatattacagtacaagggaatcttgatccgtgtgccttatatgctcctaaagaagaattggagaacatgataaaagagatgataagatcttttggaactgatagatatattgttaatttgggtcatggcatttacccagacgcacccgtcgaaagtgttcaaacttttattgaagcagttcattccattaacataataacaactaaatattaatggaatgaactgcttcaataaatat

SEQ ID NO: 2819 - DNA, 405 bp, Diabrotica virgifera
  Clone ID: LIB150-007-Q1-E1-C11
acggacgagtgggtcgtggagagaggtgtggtgttgactaattttaatgttgataatagaaataaataagtagatagttgtttttcttagtattaattaaaatggatagtgaaggtagaaaagtaattgtatgtgataatggtactgggttcgttaagtgtgggtatgccggcagtaacttccctgcttatatattcccttcaatggtaggaaggcccataattagagcagtcaacaaaataggtgatattgaagttaaggatctcatggtaggagatgaagcttcggctcttagatcacttttagaagtcaattacccaatggaaaatggcgtcgtccgaaattgggaagatatgtgccatgtctgggactatacgtttggtcctaaaaagatggactttaatc

SEQ ID NO: 2820 - DNA, 379 bp, Diabrotica virgifera
  Clone ID: LIB149-040-Q1-E1-B3
acacatccatcccgatctcgtcgaaacagctcttaaagaatccttacagaagcttcagctggactatgttgatttgtacttggtgcattctcccatatacatgaaatttgttgaagctggaaagccaatggaacccctacctactgaccatctggctgtttggaagaaaatggaagagcaagtagatgcgaaaagaaccagaaccatcggtctctccaacttcaacgtaaaccagatcgacagaatagtgaagaattgtagaattcaaccagccaacactcaagtggaactgcacgtttactaccagcagaaaaaacttagagattattgcaagaagcacaacatcgtcgtcgtttcttacggctcactaggatcacct

SEQ ID NO: 2821 - DNA, 239 bp, Diabrotica virgifera
  Clone ID: LIB3026-007-Q1-E1-H8
cccacgcgtccgcccaagcgtccgcgcaaaaatttagttaaaaaatgtctggaactttttgaagagcttactgacgacaaagatggatggaagaaattctatgaacaattctcgaagaacatcaaattaggaattcacgaagattcacaaaacagagccaaacttgctgacttattgcgttaccacacctctgccagtggacatgaagcttgttcactaaaagactatgtcagcagaat

SEQ ID NO: 2822 - DNA, 401 bp, Diabrotica virgifera
  Clone ID: LIB3026-012-Q1-E1-D5
caaggatctgagactgttggagaaattaaggaccgtattgcatctttggaatcgcttaaagcatccgaaatcagtctttatgctgctggagttccagtttctgaggaaaggttggtagccgattttgagaacacagacattgaattgactgttggcttgcctggtggtaaagttcacggatctttagctcgtgcaggtaaagtaaagggacaaactccaaaagtagaaaagcaagaaaagaaaaagaagaagactggtagagctaagaggcgtattcaatataacagaagatttgttaatgtagttgcatctttcggacgcaggaggggaccaaactccaactcagccccagcctcataaattcctttaatctttatatattgagcaacatgtattgcatt

SEQ ID NO: 2823 - DNA, 422 bp, Diabrotica virgifera
  unsure (1)..(422): unsure at all n locations
  Clone ID: LIB150-047-Q1-E1-F11
agaattcgtcctggtggaagggatcgtgagggccgtgatgatcaaagaggagataatatgggacgaggacgaatgggaggacgcatgggacgcggtgctgaggacaaatttatggagaaggttcagcagatggctggcccctcctttgatgtaccgcctgtagatgtgacagaacgcaagtttagcggcagaaacagattgtatatagggaacataggatctgaagttacagaagaggacatcactgaactatttaaaccttacggggaaaccgcagaggtgtttataaacaaggataaaaattttggattcatcaaggtagattaccacgccaatgcagaaaaggctaagagagagctcgatggaactgtcttgaagtctcgcagtctcaaaataagatatgctccanataatgctacagt

SEQ ID NO: 2824 - DNA, 414 bp, Diabrotica virgifera
  Clone ID: LIB150-014-Q1-E1-B11
aaaagagtgaggaaacaggttaattataatgacggaggaatgacaactgacacacgagaagatacgacatggcaagaaaatctctctgattaccattctgacttttctgcgggatcggatgaggataaggaagacgatgatttcgatgagaagaacgacgccgatttaagcagaaggagtcgaagaaagatggaaaggaaagacgagaaggatcgtcctttaccaccgttactagccagagttggcggcaatattgaagtactcggttttaatgccaggcagcgtaaagcgttccttaatgctattatgcgctacggaatgccaccacaagacgctttcaattcacagtggctggtgagagatcttcgaggaaaatctgagaagatattcaaggcttacgtgtctctctttatg

SEQ ID NO: 2825 - DNA, 425 bp, Diabrotica virgifera
  Clone ID: LIB149-016-Q1-E1-C8
acacatttacactgtcaacatggcgtcaattctaaagttttctcgatcttttgcaaaattacctaaatacgaaactgcattaaaagcctgtagacaaaatattattagaggagcagccacccagccagattcacaaactgttgttctaaatgtaccaccaacaaaagtcagcactttgaaaaatggtatcagagttgctactgaagattggggttcccagactgccacagtaggtatttggattgatgctggcagtaggtatgaggatgataaaaataatggagttgctcacttcatggaacacatggcatttaagggtaccagtaaaagaacccaaagtcagttagaaattgaaattgaagacctaggtgcccaattgaatgcctacacaagcagagagcagacagtatattattccaaatgtt

SEQ ID NO: 2826 - DNA, 428 bp, Diabrotica virgifera
  Clone ID: LIB150-035-Q1-E1-F2
accacgcgtccgggtttttttcggccatttatttgaggatttctagttctaggtgactgataggcgcgaagtggttgggatataagccggtaatttaaaaaataaaaagataataatcagaaaaaaaagtatcaacgcattaccagttatggccgataatgaagacttgggtttaggtgaggatcacatagattccttcgaagacgctaacggaatgcacgacgagaatctgttaaatgacacagatggggatggaactgctgcagatgatccagagttggaagccatcaaggcacgggtactagaaatggaacaacacgccgagaaactgaaacagttacaaaatgaagtggataaacagatgcatatgggaagtccaccaggacttacaagcacattgaataagtcactggaggaaaaaatggaaa

SEQ ID NO: 2827 - DNA, 434 bp, Diabrotica virgifera
  Clone ID: LIB3026-016-Q1-E1-G7
ccaacgcgtccgcccacgcgtccgtccacgcacaatatggcaaaagagtgaatacagtaactaggccttatacattcatagagtttgacacatatatccagaaagccaaaaaacagtttgcagattcgagatcgagaaggaatttaaatgtgataaataatcagctacacgatgtccaaaggattatggtacaaaatatagatgatgtgctgcagcgaggaactgttctatcagagttggacaccaaaacgcagaatctatccatgttaacggacaaatacaagaaggattcgacatacttgaacacaaaatcgatgtacgtaacggcagctgtaggcggactagtctttctttccttcattttatacttctggattttgtaaagcttcaccaagtaaaaaaactctccatacctattcatattctccggcaat

SEQ ID NO: 2828 - DNA, 373 bp, Diabrotica virgifera
  Clone ID: LIB3026-033-Q1-E1-F2
acgcgtccgccaacgcgtccgcccacgcgtccggtttaaattatttctctatttcaaatattttaggtattgatttttgatcttatagtttaattttactaagattttgagtttgtactttaataattttagctagaggaaaattatataaatatggaatttattcaaatttatttttattagtattaatttttttaatattaagtttatatttagtattttcttcattaaatattttcattttttatttattttttgaaattagattagtaccagttttattagtaattattggttgaggttatcaaccagaacgtttagaggctggaatttatttattagtttatactttattaatatcattacctataat

SEQ ID NO: 2829 - DNA, 314 bp, Diabrotica virgifera
  Clone ID: LIB150-006-Q1-E1-E12
ccgggtcgactacgcgtccgctttatttgatgcattgcctgataaaggtgttttaaacagacctggtgctatagtaaccacacggatcccttggctcgccaaatctctagctaaaggcatactcataccagctatagctcccttactagcagaatatgctacctgacccatttgaccgtcatatgctgctacactagctgtatttacgatgactcttctacagccgtattgatctgggtcaatttgcccgagaggtcatacggacattccaaaaatcttgaatgtgccaatggtgtttacctgtaattatttgg

SEQ ID NO: 2830 - DNA, 423 bp, Diabrotica virgifera
  Clone ID: LIB150-038-Q1-E1-H7
aagagaattagaaaatgaattagacggtgaacaaaggcggcacgcggatgcccaaaagaacttgagaaagtctgaacgtcgtatcaaggaacttagcttccaagctgaagaagaccgcaagaaccacgagaggatgcaagacctcgtcgacaaactccaacaaaagatcaagacctacaagagacagatagaagaagccgaagaaatcgccgctttgaacttggccaaattccgtaaagcccaacaagagctcgaagaagccgaagaaagagccgacctcgccgaacaggccatcgccaaattccgtgccaagggacgttcaggatctgcagctagaggagccagtccagcgccccaaagacagcgccccaccttgggaatgggagacgctctaggtggtccattccccccaaggttcgactt

SEQ ID NO: 2831 - DNA, 408 bp, Diabrotica virgifera
  Clone ID: LIB150-024-Q1-E1-D7
aaaattattcttagacattacaatatttcatataaagtatttatttaaaagatgtatttgtgactggaaaaggaaattagagccctatacttacagttaaacgcttataaatttgtagcaagtattttatctttacaaaagaaagtttatttcttaacattgtagttttatatttttattacaaatggcaactggaactactttgcaaaaagccattgagttagtcaccaaagccaccgaagaagacagaaacaagaattatgaagaagcccttcgtctatatgaacatggagtagagtactttctacatgccattaaatatgaagctcagggtgacaaagctaaggagagcattagggccaaatgtgtacagtatctagaaagggcagaaaaaattaaagaatctgt

SEQ ID NO: 2832 - DNA, 422 bp, Diabrotica virgifera
  Clone ID: LIB150-023-Q1-E1-B7
acgcaatgtcagttggtgtttactcacaaacaaaatcagtttagaaaagaaatgtgtgctttggttgccgatgttcttccaactctctatgagtattacactggtggtggaatccagacgggactcaatgccgacaaaccgtacttcaccttaaacaacaaaaacatatccatctacagcggcgccgttcattacttcagaatacccaaacgctattggaggaaccggttacgaaagctgagggctgccggttttgacgcagtcgaaacgtatgtaccatggaacctacacgaaccccaacccggttggtacgacttcggagcgggaggttcagatatgcaggagtttttgaatgtgacggagtttttgaagatcgcacaagaggaagatttgttggcgatagtgagacccggaccgtatat

SEQ ID NO: 2833 - DNA, 415 bp, Diabrotica virgifera
  unsure (1)..(415): unsure at all n locations
  Clone ID: LIB149-005-Q1-E1-E4
agcggacgcgtgggcggacgcgtggggttttgaaagataaaggaaatcaagcactttccgcaaataagatagatgaggcacttaaatattacactgaagcaattaacgtagatccacagaatgccgtcttatattcgaatagatccgctgcttatgctaaagcgaatcaatatgatctagccctaaaagatgctgaaaaagctgttgaaatcaagccggactggtcgaaggcttattctangaaaggtgctgctttgtcctatttaggtagacacgatgaagctattactacgtatgagaaaggattggaaatagatccaagcaatgctcagcttaatgaaggactaaatgaggtcagagctcaaaaagctaagaaaagccgctctttcccaaatcccttctctgctcccgatgt

SEQ ID NO: 2834 - DNA, 405 bp, Diabrotica virgifera
  Clone ID: LIB149-030-Q1-E1-B8
aacgaaatttcatcatttgttgcccaatttgtttcaatattgttctgattttatttaaaagcggcacttaaacatagtatataaccatggttgagaacagtacattaactatagatgaaaaatttcacctaatatccagaaacctgcaggaaatattaggtgaagatagaattaaagcagtattgaaagaacgtgatttgaagttgtattggggcacagctacaacgggtaaacctcacattgcctacttcgttccaatgtccaaggtagcagactttctcagagctggtgtagaagttactattctttttgctgatcttcatgcgtatttggataatatgaaggcaccctgggaacttctagcgcttagagttcagtattacgaacattgcattaaagctatgc

SEQ ID NO: 2835 - DNA, 376 bp, Diabrotica virgifera
  Clone ID: LIB149-012-Q1-E1-A9
atcgcaatagaagtttctaaagtgccataccataagacagaacaatatttaacacaattttatttaccggtactcgtaatgacgtatactgaaaattacctgaagaataaattgttaaaagaactggatgcttcttatgtgcaagtagtagaccaatcaaatggatgtggcggaaagttcgcttgtgtaatcgtttctgaaaagtttaagggaaaaccattactggcacggcatcggttggttaattctgttttggaagaagaattaaagaccatacacgctttttcccaaaaaacgttaacaccagaacagtggcaggaacaacagcagaaataaaatgaccaataattatcccctcgatctctccaacttcaaa

SEQ ID NO: 2836 - DNA, 435 bp, Diabrotica virgifera
  Clone ID: LIB150-022-Q1-E1-G6
cacacgcgtccgcctatttctagtatacagagaaagcttcctgccgttgtttgatcagttttgtagtcactttgttaatctcttaaccccaaatcgcagctgggcagataggcaatggggaatatgcgtatttgacgacgtcatagaattcactggtccagcatgctcaaaataccaaggctatttccttcaacctctggccttatatatgaaggacaaaaccaccgaagtcagacaagcagtggcttacggatggggagtgctagcgcagtttgggggtgaacagtttgcaggagaattagctaaagctgtacccatgttagtcgaagttataaacgaacctgaatcgaaagaccctagaaatattaacgctacggagaatgctatatcggctgttactaaaattatgaagtataataactcacagattaacct

SEQ ID NO: 2837 - DNA, 651 bp, Diabrotica virgifera
  unsure (1)..(651): unsure at all n locations
  Clone ID: LIB150-021-Q1-E1-A9
caaaatctatttgatttttctctaatctattttaaatgttttatgtacagtttaagtaatttacactttttgaatgtttatctaaattaaatccgtcatttatgcaatgaaagtgtaattacaaaatgtcaggaatgtcaccatcagagaggagattgcagaaggaattgatgtctctcatcaaagaacccccaccaggagtctcagtagatactgacataaccgaaaagaatttactacattgggttataaacatggacggagccgccggtaccctgtatgagggtgaacactttcaacttcaatttanatttagtaataaatatccatttgattctcccgaggtaaccttcgtaagaacaaacattccaattcaaccaaaaggttaaaataatggggcatatntgcttatcaattttaacggatgattggtcgcctgccttgtccgttcaatcagtttgcctgtcaatagtatctatgctaagtaactgttaagaaaaacaacgaccaccgggataactccttttatataaaaacttgcagtaaaaatcctaagaaaaccaaatggtggtatcatgatgattccgtgtaatggctggtcacagtgaatggaacttaaaagttatgtgattataataatatattattgtt

SEQ ID NO: 2838 - DNA, 289 bp, Diabrotica virgifera
  Clone ID: LIB150-018-Q1-E1-E4
gggctactttctttcgaaggggaagaatacttcatccagaaaaagatccagaacctagcaagtatgaaagatggtttactcaaaatctggaccattttaaccctaacgatgagcggacctggcaacagaggtactatgtgaacgaagaacttgctagtggcaaaggcgatctcgcctttcttcaaattggtggagagggagaagcaacagctgcgtggatgaccaacggatcatggatcacgtacgctcgcaaatataaaccaattttgttccaactcgagcacagata

SEQ ID NO: 2839 - DNA, 455 bp, Diabrotica virgifera
  Clone ID: LIB149-016-Q1-E1-A10
cccacgcgtccgcggacgcgtggggtcgacgtgactgactaaaaatggcgggaacagcaacagatttgcaaactttgaaggacctggctacacgcatcaggatacatagcgtagaatccactacacttgcaggttccggccatcccactacatcctcctcaattgccgacattctctcagtcctcttcttcagaaccatgcgctacaaagtttcagctcccagagacccatccagcgaccgtttcgttctttccaaaggtcacgctgctccagctctttacggagcatgggtcgagaacggcgttgtaaccgctgctgacttaaagaagctgagacaattgggatgtgacctcgaaggtcatcctacacctcgtttgaacttcatcgatgttggtactggatccctaggacaaggtctcgctgtagctgctggtaagggctatcttggcaaatac

SEQ ID NO: 2840 - DNA, 425 bp, Diabrotica virgifera
  Clone ID: LIB149-041-Q1-E1-G10
caccacgcgtccgattactaccaatattggcgctgtttcagttccaaagaggaagatcgatagtcggtttccaagtcgaaaacgagttcgccagtctctccatagacgatccagtatacctcaatacactcaaaaagttatttattgacaacggtataaccgaactgctatacacagctgatgctccagattatatccatggaattataccgggagtgttgcagactgctaacgtgggaagtatgtcacaaattataaatgggattaaaactatgcacaagcgacagcccaacaaaccaaatatggttatggagacatatacagggtggttcgaccattggggtgaaactcatcatactacatcagcagagggttatttaccttatctaaaagcaattttagatttcccgtcatcaaataatatg

SEQ ID NO: 2841 - DNA, 373 bp, Diabrotica virgifera
  Clone ID: LIB149-032-Q1-E1-E10
agcggctttacgtatatcaagaaaggtgatgaagatgatcttaaaaatgcagtttatgtgaaaggtccagtatctgtagctattatggttacttccaactttagtcgatacaaatcaggaatatttgacgatgacgcttgtattaccgattatgtgaaccatggggtactagttgtaggctacggaacgcagaatggaaaagattattggatcgtaaaaaattcttggggagatcagtttggaaataatggatatatatggatgagaagaaatacagacaatcagtgtaatattgctagttttgcaacttatccaaatatttaaatttttagttggataatttttgctactctatgtagcattaggtttttat

SEQ ID NO: 2842 - DNA, 350 bp, Diabrotica virgifera
  Clone ID: LIB149-004-Q1-E1-E6
atcagttagactgtgaaaaagtagataacataaactagcgactagcgtcaatatgtgcggaacagcgatgggttgtgccgaagggattgtgaaattgtttgtgtttggagcgaatatcatttatgctctcggtggtcttgctttaatcgtcgtaagagtactatacaaactagacatagatgattttactgaagctataccagaagaatacagctcaatatgcgtacctccaatactgaccattgtagtaggctcattactatttgtcatcgcattctttggatgcagtggacccattaaagaatacccatgtttgcttacaccgtacggtgtaaaattgttggaaatat

SEQ ID NO: 2843 - DNA, 433 bp, Diabrotica virgifera
  Clone ID: LIB149-032-Q1-E1-F12
ctcgcgggccaatacaagcctctagaataaatcatattagtccggccggaaaagtttttagaaaatgaatgtcacggtaaatgtattaaaaagattgccagttgggtctgccggaataaaatcacagtttttccaaaggttgttacatatttcttctgctaaaatggttaaagtaggtgacagtattcccagcgtagatcactttgaagattcacctaccatcaaagtaaatttggctcaactttcttctggaaagaaggtgatactatttgctgttcccggagcatttacaccaggatgttctaagactcatttacccggatatgtaaacaaggctgatgacttaaagagtcaaggagtaagcgagatagtctgtgtatcagtaaacgatcctttcgtaatggctgcatggggcaaagaacacaaaacttca

SEQ ID NO: 2844 - DNA, 423 bp, Diabrotica virgifera
  Clone ID: LIB150-037-Q1-E1-H2
attaggtccttcatgatcaattcagaagcatgacgccctctgcgtgttagccttgaacattctcaacgaaaaaaattacattttcctatggttctggtttattattttagctatactgtccggtttggctattgtgtattcggcagctgttgtattactacctagtacaagagaaacgattttgaagaggagattcagattcaaggtacccaatgctgttgagactattgtcagaaaaacacaggttggtgatttccttttgattcacttactgggacaaaacacaaaccaattggtatttggcgaaattttggacgaattcgtaagaagactgaatttcggtagtaacagcaacttaccgtctgctcccagcacgttagaactgaatcgaatgtatccagaaatagttaagtacaaggagac

SEQ ID NO: 2845 - DNA, 438 bp, Diabrotica virgifera
  Clone ID: LIB150-018-Q1-E1-A11
tacagaatcaggaagtagaaccagactggttggctggtgatagtaatctacaggatttacaagaacaggatatcagagacagaggttgtggagtatcttcaccgcatgcccaaaggagaatagtaggaggcgaggaagctggatttggtacattcccatggcaggcctatataagaataggatcttcaaggtgtggtggttctctagtcagcagacgtcacgtcgttacggccggtcattgtgttgctcgagcaaccccacgacaagttcacgtcacgttgggagactacgtcatcaattcagcagtggagccacttccagcctacacgtttggagtttcgaccatacaggtccaccccttcttcaaattcaccccgcaagcagacagattcgatgttgcagttcttcggctggaccgtgccgcacataatttactca

SEQ ID NO: 2846 - DNA, 413 bp, Diabrotica virgifera
  Clone ID: LIB3026-001-Q1-E1-E6
accacgcgtccgcccacgcgtccggatcaaactttagactcagtttttgtaggaccaatacctgaaggcaaacacatgttcgtctttcaagcggaccctccaaatgtctcacgtattccagaaaatgatgctcttggtgttacagttgtactattaacgtgttcttatagaagtcaggagttcattcgtgtaggatattttattaataatgaatatactgatccagaacttaaagaaaatttacctagtcctccacaatttgataaggtaacccgaaatattctagcatccgaaccaagagttacccgctttaaaatcaactgggaagaaaccaaccccacagaaaataacacaaactctgaccaaagtggagcatcagcacccacgacatcagaagctggaccctctgctcc

SEQ ID NO: 2847 - DNA, 400 bp, Diabrotica virgifera
  Clone ID: LIB149-024-Q1-E1-E9
acccacgcgtccgcccacgcgtccggaggttccatgctttcattcatggccgctttctggaccttgggtaacttatttgtagctggattagcttggttgattattccagctgatattggtttcaagaaccagtattttgtgtataattcttggagaatatttcttctcatttgctcattcccatcctttatagtggcggctttactgtgcttcttgccagaaagtcccaagttcttacttacacaaggtaagagtgaagaagctcttgcaatctttaagtacatttaccatgtaaacaccgggaatgatcccgaagactatccagttaaacatctcatctacgaacaagaagagctcactcttgaacaaaaagccaaaattgcaaagagaggcaaatata

SEQ ID NO: 2848 - DNA, 427 bp, Diabrotica virgifera
  Clone ID: LIB149-048-Q1-E1-D6
agttgtctttcgatgtcggttttaaggagagtgctattcaaacggctttttttgccgaaatttaaccccaaagtgaccacaaatggtttcgcaactgactcgaattccagtgggtttattactacttctgataccgtggaagtaccgaagtgttctttgaatgaatatgtgtttcaaaatgtgcatctttgggaaaattgcatagctacagaatgtgctgtgactggaaggaattacacctactcacagcttaagacaaaatccaaaaattttggagcagctcttcggaagaagttcaaacttgagaaaaacgataccatcgccattttattgccaaacgttccagagttccccatcgtaacattgggtgcaataagggcaggactgatttgcaccactgtaaacccaatctacacagcagattaaa

SEQ ID NO: 2849 - DNA, 449 bp, Diabrotica virgifera
  Clone ID: LIB3026-015-Q1-E1-G2
cacgcgtctgcaacgcgtcgggtaaaactacagaaaataacacacacgtagaaaatggctggggaaactccacctacgctgtttccaaagtgggtgtaactgcactgaccattatccaacagagactattcgatgaagaacagcccaatcgtaatatttcgatcaatgcagttcatccgggatacgtcaaaactgatatgacaagccataacggtcttttaagtatcgaggaaggagccaaaagctccttgtttgctgcattggatgctgatttgaaggggaagtatatctggaaagattgtacattagttgattggtacagcaaggaaatgccaaatccaccatactaaattcgtcacactatacacaatgatattcactgtagtacctattattaaaacaaattgtactagattgcatttaatattttctaataaaaatatattttg

SEQ ID NO: 2850 - DNA, 404 bp, Diabrotica virgifera
  Clone ID: LIB150-042-Q1-E1-F2
aatcactaccaaatgccatggacctcattttaacaggaaaagcgttaagagcagataaagcgaaaaagatgggcgtattagatcttctagtcgaccctttgggccccggattggatactcccgaagcatataccgctaaatatctcgaaacagtggctattggtgtagctaaggatttggcatccggaaaattggtacctaaaagagagaaaagcctaacagataaaatcttagcgtatgcattgcaattcaattttgtcaaagaccaagtatttaataaagcaaagaaacaagttatgaaacaaactcacggattatatccagcaactttaaaagcactggaagttctacgaatcagtttagacaaatgtgaaaccgtcggattcaaagaagaagctcgggct

SEQ ID NO: 2851 - DNA, 449 bp, Diabrotica virgifera
  Clone ID: LIB150-023-Q1-E1-E1
gggtctatcccacgcggccgaattgttatgccaaaggcgctagacaataccagtggttgatcgagttcggggcatagtgggatcgggccaaacctctgatgtggttgccaaatttcgcttagtccttgggagtggcgcatttgtatctcgagcagagcgcaaaggccgatttactactgcgagaagctcttccaaaattccccggtgtactactaccgttgctatataagtgcagcgtgcaaactgacactagagtctcaagccagcaaatttttgtcactgctgaatgacgccataatgcaacccacagcactgactcaaataatactcctatatgctaatagaagctatcacatatggtaagacagcgatctgctgccttggttggcacagacagtgcatcacgcattggccatagtacacaaaatcgatgctgtgctgaaagacta

SEQ ID NO: 2852 - DNA, 350 bp, Diabrotica virgifera
  Clone ID: LIB149-041-Q1-E1-E2
ggaaattattatgaagcattagattattgccaagttcataacatgagactagcatctatcgattctaaagaagaaaatgatagattgtacagacacatcagggacatcagtgccggtactgatttctggtcttctggtacacgtttattagatggaagaaactgggtttggttacctaaaggtttgcctgttggttacaccaactggggtcctggtcaaccagataacaacaatgatcattgcattcgtttgcatttggataagaacaatggtctgttttgggatgacatcaactgcaataatgttaacagagtaatctgtgagaggtctgctggaggaaatggggcaaa

SEQ ID NO: 2853 - DNA, 543 bp, Diabrotica virgifera
  unsure (1)..(543): unsure at all n locations
  Clone ID: pGUT3354
taaatatacagtatttttaatatcaccccaattagctcattacttattaaaatggctgaaataaatattgacatagacaattttgaaccaaaaaaggctcaaaaacgtggagtgtccaccagcgaagacatggaagtggaaattgtgaatggtatagaaggaaccaataacaaagttagagcaccaagaacgaaaaaggcaagatccaaatcattttccgaaaccaaagatgacatgaaaaaaatagctgtaccttcacatagatactcaccattaaaagaaaattggttaaaaatattcacacctgtagttgagcacttgcaactccaaatccgatttaatttaaaaaccagaaacgtagaaattagggcatgtaaggaaaccccagatatttctaatttacaaaaagctgcagatttcgttaaagcttttatttatggttntgaagttgaagatgcccttgccttaattcgtctagatgatctgtttgtggaaacctttgaaattaaggatgtcaaaacattaaagggagaccaccagtct

SEQ ID NO: 2854 - DNA, 414 bp, Diabrotica virgifera
  Clone ID: LIB149-028-Q1-E1-C2
acaaatattgtgatatcagtactgctgtgtttagttttttgaaatatttatttttttaatatactaatcaatcaacatgtgtgaagaagaagttgctgctttagtcgtagacaatggatccggtatgtgcaaagctggttttgccggggatgatgcacccagagctgtattcccttcaattgttggacgtccaagacatcagggtgtgatggtaggaatgggccaaaaagattcctatgttggcgatgaagctcaaagcaaaagaggtatccttacattaaagtaccccatcgagcatggaatagtcacaaactgggatgatatggagaaaatttggcatcatacattctacaatgaactcagagtagccccagaagaacaccccgttctgttgacggaagctcctctcaaccc

SEQ ID NO: 2855 - DNA, 401 bp, Diabrotica virgifera
  Clone ID: LIB150-040-Q1-E1-A11
accccctcttttatttaaggcacagttgtttgctttaactggggttcaaccagaaaggcagaaagttatgattaaaggagttactctcaaggatagcgactggaataactttaaattgaaggatggagtgactattttgttaatgggcagcaaagaagaagatgtgcctaaagaaccggttgaaaaaactgtttttatggaagacatgaatgaaagtgaacttgccacagctcttgagttgccagcgggtttaacaaacttaggaaatacttgttacatgaatgcaactgtacaatgtttaaaagctgttcctgagttaagagaagctcttcagagttatcaggaagctatcaagctaactggtagtaatgttgtaccagctcaatcaataacagcagcac

SEQ ID NO: 2856 - DNA, 430 bp, Diabrotica virgifera
  Clone ID: LIB150-018-Q1-E1-E7
cccacgcgtccggtcaaaggtaatgcgaaaggcaaatcagtggttgaaaaggtttttagtgcagataaaaagtttagtgacttagatatacataaatacatagtttctaatttggaaaaacatcattttacaactctgacgaatgtgcaagaaaaatctatacctgcgatactacaaggacagaatgttttggttagatctcagactggttctggtaaaacgttagcatatgctgttccagtattgcaagctctacaaaatattaatcctaggatacaaaggactgatggagtgcaagtcataattgtcgttcctactaaggaattggctttacaatcctacgaactgtttaaaaagatcaataccttccagtggattgtcgtcggaaatttatgtgggggagaaaatagaaatacagaaaaaactcgtc

SEQ ID NO: 2857 - DNA, 401 bp, Diabrotica virgifera
  unsure (1)..(401): unsure at all n locations
  Clone ID: LIB149-033-Q1-E1-G2
aaaccccaaaatttgtcgaatccaaccaaattaccagttccaaaagttttcaacggtttggccataattattaattgtatatgcgggccaaaggccaatagtagcataaaaaagtgacaccttatgaattatggtacanaaagaaagtcaataatatttctacactcaagagttttggttctagagtatcagtgcatgtcncaaaagagaagagattaaaatgggatgcaaaaaatatgtttggtttctttattggctacagtgangatgtaaaaggttacaaaatatttgtcccagacaaaaataaagttgaaattcatcgagatgtcatatttttgcccgagaaaaccatagaaatacaaaatggggagacagacatgaataaaaacatacagatgata

SEQ ID NO: 2858 - DNA, 277 bp, Diabrotica virgifera
  Clone ID: pGUT3545
gatttaagcaccatggaaatggattcgataaaggaatgggagtcacaatttgatgaagaatacgacttcgtgggaagactgttgaagccaggtgagcagccgaccaactattcagatgaagaagacgcagacgaatcagcagccggcggagataaagcagacaaggagaaaaaagaagattaaataatccgcaagagaagaaaaaaaataaaaaaggctgacgcggttataaacaccgatctaaactaaaagtaaaatatttcaaaaaaaaaacaaa

SEQ ID NO: 2859 - DNA, 367 bp, Diabrotica virgifera
  Clone ID: pGUT199
acacggacaagtcattcttaacggagctcacgctgaattccctgttcgcaaagcagaacttgcagcttacagaagctacgaaaacatccatctaaaatccactgccggcgttcatattgtgtgcacaccgtcattgcaagcatgtggagtttacgtctcaggcttctaccacggccaagttaaaggtcgtcttggtaaaggcaacaacgaacctttcgatgacctcactgttgccaacggtagaattgtcacatcagatgtcgagtttgtcaactcctacaaaatcagtaactgccaaccagccgttgtacctccttctgcagcatccaatccagcttgtgaaaaactcttcggatgggaatctcct

SEQ ID NO: 2860 - DNA, 408 bp, Diabrotica virgifera
  Clone ID: LIB150-050-Q1-E1-A2
cccacgcgtccgcggacgcgtggcggacgcgtgggcagacgcgtggggtgacgacgatgtagcggcgcgtgacatcaacaaaggctccggaatgtgcaaagcaggtttcgccggtgatgacgcacctcgtgctgtctttccatccatcgtaggtcgtctcagacaccaaggtgtcatggtgggtatgggtcaaaaagactcctacgttagagacgaagcccaaagcataagaagtagccacaccttaatataccccactgaacacggaattatcactaactggtgacgatatggacaagatctggcatcacaccttctacaaagaacatagagtagcccccgaagaacatcccattcttttgactgaagctccacttaacccaaaagccaacagagaaaagatgactc

SEQ ID NO: 2861 - DNA, 332 bp, Diabrotica virgifera
  Clone ID: pGUT3715
gggagtcaaagatcaaggacagtgtggatcatgctgggctttcagtaccaccggagctatcgaaggtcaactcgctattcacaaaaacgaacgtgttcctctcagtgaacaagaattggtagactgtgataaggtaaaccttggttgtgacggaggtttgatgacagatgccttcttttatgttgaacatcatggtctttcatcagaagaacaatacccctatacaggcgtaggtggtcattgcaaccatgtaaaaaacaaacaagtctcttcgatcaatggttacgtcgaacttgatgaaactgaaagtgctctagctgatgctctcgcta

SEQ ID NO: 2862 - DNA, 360 bp, Diabrotica virgifera
  Clone ID: LIB3026-026-Q1-E1-G3
caagcgtccgaccaaaccttaacaataaaattttggtccaccaccattgtaacaattattttttaaaagattcaaaatgagtactatgccaatgacttcttcatcacttctaccattggaattggtatataactgtattggctcagaacttcaaataatcatgataaatgaaatggaaattgatggcacattatcaaggtttgatgattttgtaaagaagttgctggatgatgttacagagtatgaaaatacaccataagggaggcgtataacaacactggatgaaattttgctcaatggaattaacaaatcactgcatgtacctgaaggagatatgccagaataacataatgaacacat

SEQ ID NO: 2863 - DNA, 324 bp, Diabrotica virgifera
  Clone ID: LIB150-041-Q1-E1-F9
agcctctaaagttagtcgtactacgagtccagacacttactcagagtcgctgtaccaccaaatcaagataccatagatcatgtgtgacgatgatgtagcggctcttgtcgtcgacaatggctccggaatgtgcatagtcggtttcgccggtgatgacacccctcgtgctgtctttccatcgagcgtatgtcgtcccagtctccaatgtgtcatggtgggtatgggtcaaatagattcctaattaagagatgaagctcagttcaaaagaggtatcctcaggttaaaatactccattgaacacagaattaacactaactgggacga

SEQ ID NO: 2864 - DNA, 395 bp, Diabrotica virgifera
  Clone ID: LIB150-007-Q1-E1-B11
acccacgcatccggcaaaaagtgaacatcctactcccgttctattcatgcgtattttgtattttgtattttgatgaatctaaaaaaatattaaagttaatgaattttggtaattaaacgtgtttaatgaaagtatgaactgtatggattagtagcattttggtatttaatagtcgttgagaatatgaatgaagcctcatcagtaggtggtcctacgggacctttaaccataagcaaggagcttatcgttaaggaaggatggttacaaaaaagaggagagcactggaaaaactggagaccaagatatttcatcctgctcaactatggagcattggtcggtttcaaaagtaaactagaagactactaccatgtcgaaccattaaacaattttactgt

SEQ ID NO: 2865 - DNA, 305 bp, Diabrotica virgifera
  unsure (1)..(305): unsure at all n locations
  Clone ID: pGUT1273
gcctataggaactccgtggaaaaatctgaaggcaatgctgacacttggtgtagcataggtgtcctttaccagcaacaaaaccagcccatggatgctttacaggcctacatatgtgccgtacagttagataagtgccattccgcagcttgggccaatttgggaatattatacgagcattctctgcaagcaagagatgcgtatgcctgctatntgaactctagcagaggaactatctataagcaaacaaacgacggatcagttaacacgaataaacttccgaaaatcaactttccaaatntgggcat

SEQ ID NO: 2866 - DNA, 377 bp, Diabrotica virgifera
  Clone ID: LIB149-027-Q1-E1-E3
aacgtagacaaataaatattagaaattgatcagaataatgttttaataattaatagcagtttataagaagataaaacttgcaaacgtcagtaaaacacatcagaaaaatgtcgcaaacagtgtccctaattctgaacgaagatgtcgaacatggtggaaaagaatacgacgaggatgatatcgaaaatgattttgcctacagaaacaatgtattgaacgctacaaaacaaataaggttagcatttattcgcaaagtttatggccttttgtccatgcaaatattactaacctttattatagccagcatatgtttgtttacaccacctataaaaagctttgttcacacaaatgactggatgaagatgttttcctttaat

SEQ ID NO: 2867 - DNA, 461 bp, Diabrotica virgifera
  Clone ID: LIB3026-032-Q1-E1-G10
acgcacgcatccgaagatcaaaggtctatttcatattatttaaatgtttaatattgtacaaaagctgcttaatattaagttattttgatttttgatcatcgtaaatgtatttctaagttttaatttctattacaaatttaaacaacaaatcttgtgtggttccttaaaattcgcaaacatttatttctatataacactttgttattttttattaacaatgacaacagatcctaactgcattttttgcaagatcatagcaggagatgctccagcggatatattgtttcaaaatgaagagttagttgtatttagagatattaaaccagagtctaaacatcacttcctagttgtgccaaagaaccatattctgaatgtaaatagtttacaaacaaatgaggacaggcttttagttgaaaggatgttggaaattggtaagaagattttagcggaacacaatggtg

SEQ ID NO: 2868 - DNA, 391 bp, Diabrotica virgifera
  Clone ID: LIB150-021-Q1-E1-C7
gccggctttaagacataatttagaaaagtgttaaaaaaattttccacaatttttgcgacaagtgataaacccgatattcagtgcggaacgaaaaatttccatcctaaccttataccagaggccagctagtgttacagccctacggggcctcggatataagcgccaaagaatctaacctcagctttacgaattaaacgaggaaatagacgactgataaatggagcaattcgaacagctattgacatgcgctatttgcttagaccgttacagaaatccaaagcttttaccatgccaacacagcttttgtttggaaccatgcttagaacgcactgtagattacgttagaagacagatcaaatgcccagaatgccgcgcagaacacaggatacca

SEQ ID NO: 2869 - DNA, 422 bp, Diabrotica virgifera
  Clone ID: LIB3026-005-Q1-E1-G11
cccacgcgtccgcccacgcgtccgcggacgcgtgggtacaattccatcatgaagtgtgatgttgatatccgtaaagacttatatgccaatactgtactctctggaggtaccaccatgtaccctggtattgctgacagaatgcagaaagaaataacctccttggcacccagcacaatgaaaatcaaaattattgctccaccagaaaggaaatactctgtttggattggtggttcaattttagcttctctttctactttccaacagatgtggatttccaaacaggaatatgatgaatctggaccatccattgttcacaggaagtgcttttaatttttatctatgtttaagtatattctttatatatcttggttttttatatcccccatcttggggcaagaactgccctatgtatatgagtgatc

SEQ ID NO: 2870 - DNA, 372 bp, Diabrotica virgifera
  Clone ID: LIB149-040-Q1-E1-G3
aaagaggacaagtagagtttggactgcaatataactacaaagcaggagcgttggagatccaaatcaaacagtgtaaagatctagcacctgtcgatacgaaaagaaataggtcggatccttacgttaaagtgtatctgttacctgataaatccaaaagcggcaaacgaaagacgaaagtgaaaaagcacacgctcaatccagtattcgacgaatgtctcaagttccacatttctttaaacggtttagaatcaagaactttgtggttaacggtatggcattcggatatgttcggacggaacgatttcctaagggaggtcatgatgactttagagaataaagttttcgatgatcctacgcccaagtggtataacc

SEQ ID NO: 2871 - DNA, 384 bp, Diabrotica virgifera
  Clone ID: LIB149-040-Q1-E1-H3
ctgctgtaggcctttcgactttatatttaaaatctactcaatatactaatacagtaaagatgctgttcacaaaagttttgggaactgtaaggaattccgtaaagaacgaggtctgcagtcgaaatattggaattctagctccttgtcttcaaaaggcttcagatcccattcaacaattatttgttgataaaattagagaatacagacaaaaaagtaacagtggaaaaagccttgtagaacctactgccgaattagaaaaagaactaaaaactgaactcgataaagtcgcaaaacaatatggaggtggccaaggagtagatatgaccaaattcccatctttcaaatttcaagatcctgtcattgaccctattaacttagaaaagt

SEQ ID NO: 2872 - DNA, 375 bp, Diabrotica virgifera
  Clone ID: LIB149-041-Q1-E1-A9
attttgtaattcatccgaaatacaacaagaaaacctataactctgacatagctctactcaaattcgcaaaagaagtggagggaagcaatgtttcaattgctcttgtacctttccacgatacaagcgatgtgtccgatcataaaggggttgctatgactggttggggtgctcttgaatagggcgaaaattttaccgaagtgctccaaatgggatatccttcctcaatctcgagaagttcctgccaaatggcgtacccgaccaaaatcatatcgttaaacatgttttgtgctggggtttacgacgtccaaaatattacagcttgcgatggagattttggaggacctgccacctttacaaattgtttacaagggataa

SEQ ID NO: 2873 - DNA, 419 bp, Diabrotica virgifera
  Clone ID: LIB150-035-Q1-E1-B2
cctgccaccaacttatctagatttacaaaagatgatactggaaaggctctaaaaattaattttgatcatggtaccacaaccttgggattcatgtatcagggaggagttgtacttgcagtagattccagagctactggaggccagtttattggttcacaaacaatgaagaaaattgtagaaatcaatgattttctgttaggtactctggctggaggcgcagcagattgtgtctattgggacagagttttggccaagcagtgtagaatgtatgaactcagaaatagagaacggatttcagtagcggctgcttctaaattaatggcaaatatggtttacaattataaaggaatgggattgtcaatgggtatgatgttagctggatgggacaaaaggggaccacaattgtattacgtggactc

SEQ ID NO: 2874 - DNA, 369 bp, Diabrotica virgifera
  Clone ID: LIB149-041-Q1-E1-F2
ctttacccacagttcatgtatcacttaagaagatctcaatttcttcaagtattcactaattctccggacgagacttcattctacagacacatgttgatgagggaagatcttactcaatctttgataatgattcaacctaatttgtatagttatagtttcaatggtccatcatagcctgtattactagatactagctccattcaacctgacagaatattacttatggatactttcttccaaatattaattttccatggagagactatcgcccaatggcgtagtttaaaatatcaagacatgccagaatatgaaaactttagacagctactacaggctccagtagatgatgcacaataaattttgcaaact

SEQ ID NO: 2875 - DNA, 422 bp, Diabrotica virgifera
  Clone ID: LIB149-008-Q1-E1-D7
cagaatctccatttgtccaagcatcaaaaactatagaagccaattactttggaaccctaagagtttgtgaagctttgtttcctttgttaaggaataacgcaaaagttgtaaatctttccagcgctgcaggacatctgtctaaaataccgacagagaagctcagaaatgaattttcgagaaaggatttaaccataccagaactcagtaaattacttgaaaagtttgtaaaagctacagaaaataacacacacgtaaaagatggctggggaaactccacctacgcggtttcaaaagtgggtgtaactgcactgacaataatcaaaaagagaattattcgatgaagaacagcccaatcgtaatatttcgatcaatgcagttcatccgggatacgtcaaaactgatatgacaagcaataacggtct

SEQ ID NO: 2876 - DNA, 436 bp, Diabrotica virgifera
  Clone ID: LIB150-006-Q1-E1-H6
acggacgcgtgggataccctttgcttaccacctgacaatctcaacatgaattctggtagatgcctcgttgcaggatggggaaaaggatccgaggaagaaggtatcaaagttttaaaaaaagttgaattaccaattgtaccgttccataaatgtgaagaacaactcagaaaaacgaggttgggagctggttttattttgaacgagtcattcatgtgtgcaggtggagagaaaaacaaagatgcctgcaaaggagatggaggaagtcctttgatgtgtttacttcctggacaaacgagatatttccatatgggaatcgtttcttggggtatcgggtgcgggaccgaaaatgttcccggtgtatacgccagtactataaaattgaaaccttggataatggaagaactgaagaaaagaaatttagagttataggtttttg

SEQ ID NO: 2877 - DNA, 419 bp, Diabrotica virgifera
  Clone ID: LIB149-003-Q1-E1-D12
acccacgcgtccggatttctgaagttatcatagtgccatatccattacgtatgaaagcattagggaaaacacggtatttccaattgagagaacaatggagaataacagatctcttatttaacccaatgatcatgatgatggtcctacctcttctcttagtcatggttctgccaaagatgatgaatgacccagaaacaaagaaggaaatggagcaaattcaaaacatggccaaatttgaaatgtctgataggttctcaaattacttggctggatcgactacaccagcgcagactgacaaggataaaaaccaagctgttaataaaaagagtcaaaagactaggaaacgaatagaaaaataaattatagtttattatttttaaatagcaaattgcattagatatacaatttaagtttgtaag

SEQ ID NO: 2878 - DNA, 385 bp, Diabrotica virgifera
  Clone ID: LIB149-032-Q1-E1-B8
acaaccctctacactgacgtcgtattaagtctttccaattttcacttaactaaatattttccaaaatggctttcggtgattatcctgccgaatataatcctaaagtccacggaccctatgaccctgcacgtttttacggaaagcctgatactccttttggacaagtaaaagttggtgaaattggctcctggttggctcgccgtcacaagtctccagcaactctcgccggtgcattcagcacggcttattggccatggcaacacatgtatgttcaacctaaaaagtctggcaacacagcattcatacatgtagcagttggatccacgattttcttctagacacttaattacactagactcatctaacacataaacgacaaatacca

SEQ ID NO: 2879 - DNA, 442 bp, Diabrotica virgifera
  Clone ID: LIB3026-020-Q1-E1-H11
gggccgagcacgcgtccggaaacatcctgcagatagacagtcactgaggtcagaggccaagggaaaggatataagaaatgatgctaccattcctaatctagaatcattaagaaaagtatttgttaaagacttagggccacagattggatggaatacagtatttcttcttgaatatgctgggcccttatttatatatgctgcagtgtcttttagaccatggatcctgtatggagatactgctagcaatgccaccttcaccacaaccgccaagctagctctaggctgttggtccatccattacctaaaaagaatcctagaaacattatttgttcatcgtttttcacatggaactatgccaattagaaacctattcaaaaattgtggatattattggggattttgcctttatgtagcgtaccatattaatcatccactatttaca

SEQ ID NO: 2880 - DNA, 445 bp, Diabrotica virgifera
  Clone ID: LIB150-016-Q1-E1-A7
gacgaggtgaaaaaagtaaattataataaaattacgaaaaatttgaataataacaattttttaacgaagtccgtgcttcttattaataccttcaccaaaagcaacaatgcagtgttcagtttttaaagtattatcgtccacaataaagccaactttaaggcacaaccaaagaatattaggaaacttacaaagtcgtttatattcaaacgatggagatgctgacattgtagtgattggttcaggaccaggaggttatgtagctgctatcaaagctgcccaattgggcatgaagaccgtttgtatcgaaaaaaatccaacattgggaggtacgtgtcttaatgttggctgtataccatccaaggctctattgaacaattcacatttctatcatatggcccattctggtgaccttactgagagaggcattgaaactagcggtgttaac

SEQ ID NO: 2881 - DNA, 645 bp, Diabrotica virgifera
  unsure (1)..(645): unsure at all n locations
  Clone ID: pGUT3347
gtaccccgtaacttcgtgtttagctgtatttaaagcctgtcggatcttcgacaaggtgttgtcccaatcgcggtgctcatctatatacgaccgaattgcggtaccaattgttttattggttcgctccacaaaattgcattggggcgaataaacggcactgtaccatatcttacggacgttatacctctcacagagatttctcaaaggggggccggtaaagttgtgggcattgtcacacattacgtattcaggaacgccaaatataaggaagacgttatcttctagatacgaagcgatatttgtggcggttgcattccttagtgggtgtaggagagtgtattttgaaaaccaatccgcaatcaccaagagccatgtgtaacctttcctggacctagttaacggacctatcaaatctacggcaatcacttgccacggacggtcggccgttttctcgcgacccatcattcccataagacccgtatttggtgctttttgtgcaccacatattaagcaggacctaacatattggagaatgtcacgcctcattttcggccaatagtatcgctcttgtactcgggacaaaattttataaaaacctaagtgagcacacctangcggatcgtgacatgacttattcacctcggg

SEQ ID NO: 2882 - DNA, 380 bp, Diabrotica virgifera
  Clone ID: LIB150-046-Q1-E1-H3
agacgtaatcactatgctagtgctgatattaaggataaattggtcgcgttgacgaatcaaaggaatgctgtactgcagaggtgggaagaaagatgggagaacttgcaactcatcctcgaggtataccaattcgccagagatgcggccgtcgccgaagcatggttgatcgcacaagaaccttacttgatgagccaagaactaggacacaccattgacgacgttgaaaacttgataaagaaacacgaagcgttcgaaaaatcggcagcggcgcaagaagagagattcagtgctttggagagactgacgacgttagaaactggtggaggttcgttaaaacataatacagcaccgttgcatgtagatttagtttgcaatttttg

SEQ ID NO: 2883 - DNA, 465 bp, Diabrotica virgifera
  Clone ID: LIB150-013-Q1-E1-E6
gatattgacaaaaaggatggttatgtccaggttcccatgaaattttcattcgcagtcgacgaacaacgcaatcataatattttggaagggtgtagaaatttagttggagtaagccagccatctttatgttttctaaagtcgtcttcggcagctgcagaaaagtacatcgcatatcccagaagttgtagagagattcaagaaattggtaataataaatctggaatatatgagattaagcccaggactagcagtaaaccttttgctgtcctttgcgacatggaaattcaaggcgggggatggacacatattcagaaaaggttcgatggatctcaggatttttaccgagagtggagagattacaagtttggctttggaaatctagatggagagttctggattggattagagaacattcaccatatgacatgttttgaagccagtgaactgttaatagaacttattgat

SEQ ID NO: 2884 - DNA, 480 bp, Diabrotica virgifera
  Clone ID: pGUT3147
gttctattccatgaaattctgtccttttgcccaacgagctgcattagtcctgaaagcgaaaaacgttcctcatgatgttgtatatattaatttattcaaaaaaccagagtggtacagcaaaatcaatgaaaaaacattagtaccagccattcttgatggtgataaaattgtggtagaaagcctggatattgctgattatctagatgaaaagtaccctgaaaacccactctatcctgcagatcctgcagccaagcagcaggttaaggatattattaacaaggcaggtggtccacaaggggtttttataaaaatcgtattaggaaaagaagaacattcagcagaagaatgggctacattgttgcttgaagctcttcaacctttggaagaagaactttcgcagaggggaacacctttctttggaggagataaacctggaatggctgattacatgatttgggcctttgcagagagagcaggatg

SEQ ID NO: 2885 - DNA, 298 bp, Diabrotica virgifera
  Clone ID: LIB150-005-Q1-E1-E4
cctccgaaaatccgacccatggggagacgtagaagtgagctccaacttcaccatcaccgaaaagaagaccaagaaggtcaagaagacgaccaaacaacgcagaggaagtaacgagcaaaccgaagttaccattcaagagctcaaaaatggcaaccagggtggagaatacaccaaggctatgaacaaggactggcacggccaacatttctgctgctggcaatgtgaccaaagccttactgggcaacgctatgttctccgcgacgaacatccatactgcgtctcctgctacgaatcaatc

SEQ ID NO: 2886 - DNA, 430 bp, Diabrotica virgifera
  Clone ID: LIB150-019-Q1-E1-D11
gttaatgtatgattattgaataatgattgttgccaccaggacaccgcaagattggttttccgttgatggcgtccagatgaaagaagctgatatcggacaaccttgtacagaatgttcgaaatgcaaagatgggtacgaaccgcacaaatggagaaatacatgcaaacattgcaagtgctccagagacggacacgagatagtggcggagcatggggctcgatcgcgactcggcttcgtaacaacgcatgatgggctagacgctagatccttacgatacaccttcgtgcctccaggtcttaccagtgctagacatgtagaccaatattagtccactctgccttctgacgaagttcaaaactcgggtccatatgtgataccaatcgttcgcaatgaattgttagacaattacctaagcaagatttgtcgttgt

SEQ ID NO: 2887 - DNA, 428 bp, Diabrotica virgifera
  Clone ID: LIB150-014-Q1-E1-G1
acttagcacaccgcgtttgtgtagattttttcttgaaaaaagaaaaccacctcgaaaatccgaccatgggagacgtagaagtgagctccaacttcaccatcaccgaaaagaagaccaagaaggtcaagaagacgaccaaacaacgcagaggaagtaacgagcaaaccgaagttaccattcaagagctcaaaaatggcaaccagggtggagaatacaccaaggctatgaacaaggactggcacggccaacatttctgctgctggcaatgtgacgaaagccttactggccaacgctatgttctccgcgacgaacatccatactgcgtctcctgctacgaatcagtcttcgccaatgcttgcgaaaaatgtagcaaagtcatcggtatcgactctaaggatttgtcctacaaagacaagcattggcatgaa

SEQ ID NO: 2888 - DNA, 363 bp, Diabrotica virgifera
  Clone ID: LIB150-004-Q1-E1-G10
acagcgaatattttcctttcctcatcagttcaatattaacaataaattgttttgttgaaattgaaatcacaaattactttataaaatggtaactctcgaagacgttgaaatgaaaaatgcagacagtcctccaggattagaagctggtgatacaaagaaagaatacgacctacaaagtgttataaaaattcgttgacaatgcagaacaattagaaaatcagtcacaagttaagaaaaccgtttcatcttacgagttttacgttgcttgcccaacactagaaggaagcttaatggactggtgctgagaagcctcattactcaaatatatcctgtagctgaacgtgatgccctccttagtttcgt

SEQ ID NO: 2889 - DNA, 409 bp, Diabrotica virgifera
  Clone ID: LIB3026-029-Q1-E1-A11
agaaaacaaccgccattaggtacttcatcataaaggtggtatgcaaatctttgtcaaaactttaactggaaagaccaccacccttgaagtataaccttcagatactattgaaaacgtcaaaggtaaaattcaagacaaagaaggtataccaccagatcaacaaaggttaatctttgctggaaagcagttggaagatagccgtactctctcagactacaacattcaaaaagaatctactctccatttggtacttcgtcttacaggtggtatgcaaatctttgttaaaactttaactggaaagaccaccacccttgaagtacaaccttcagatactattgaaaacgtcaaaggtaaaattcacgacaaggaaggtataccaccagattatcaaagattaatctttgctgga

SEQ ID NO: 2890 - DNA, 378 bp, Diabrotica virgifera
  Clone ID: LIB149-046-Q1-E1-C6
atagaagttgaaccatctgatactattgagaatgtgaaagctaagatccaagataaggaaggtatcccaccagaccagcaaagattgatatttgcaggaaaacagcttgaagatggtagaaccttgtctgactataacatccagaaagagtccactcttcacttggtgcttagattgagaggaggtatgcagattttcgtcaagacactaactggaaagaccatcaccttagaagtagaaccttcagataccatcgagaatgtgaaagctaaaattcaagataaggaaggtatcccaccagaccagcaaagattgatctttgcaggaaaacagctagaagatggtaaaactttgtctgattataacatccagaaagag

SEQ ID NO: 2891 - DNA, 356 bp, Diabrotica virgifera
  Clone ID: LIB150-003-Q1-E1-A11
aagaaaatatggatacagactggaatttcttaacaacagaagaattaaagaaccccgaacagacgattcgatcgctttatacagatatttggacaacgagtttgatggcacaatagtcattggccatccaggaaaaacatttgatgtctcttttgataccgcatggggcctttcatggttattgtcgtcaagatgtgatacgagcctaactccaggatgccgtggccataacttgtacgatcgttacaaatcttcaacttttaaaaagaatggtacccaatattttatacaagatggagcttttaatttcactggagtttattcatacgatgatattcacatcgcccactcaaatg

SEQ ID NO: 2892 - DNA, 429 bp, Diabrotica virgifera
  Clone ID: LIB149-046-Q1-E1-C12
accacgcatccgattaatttatacaacgaaggtgatgcaactaacttcaacaaagtcttggaaaattgtactctggataagtgttggagggagtgcaaggagtcttcgaattatttaagtagaagagaagcagtgaaagaattcaacaggttgaacaaatacaagaaacgtggtctaaacatcgtcccaaccaaatatggcatcgcttttggtgtcacttttctcaaccaagctggcgctctcgtactgatttactccgatggatctgtcttaatatcacatggtggtatcgagatgggccaaagactctacacgaaaatgatccaagttgccagtaaagctctaggaatcccggttgaaaagattcatacaatggaatcaagtactgacaaggttcctaatacctcaaccactgctgcaagtactgga

SEQ ID NO: 2893 - DNA, 427 bp, Diabrotica virgifera
  Clone ID: LIB149-035-Q1-E1-G2
ccgacccacgcgtccatttatggagaagcatagaagcgtcagtgccattatgttgattccccgttgcaatacatgcaacaaagactttacgacacaagatgaatacgaaacccacaaaagacttcatgatttcttggaacgccagaaacagcacgagcagaagatgctaatacaacaacaagatggccctcaatcgaagatggcacctaacaaaccaaagtttccctgtaaatactgtaacgccgccttcagcaggtctgatacacttggtggtcatattagacagtaccataaggagcacgttcagactgaattcagatgcaaccagtgcgacagagtattcgagaagcaaaattccttgaccatccatttaaaaactcaagacaggcaaagaagcttcccaaatccagcatcccaaagcaaacca

SEQ ID NO: 2894 - DNA, 565 bp, Diabrotica virgifera
  Clone ID: pGUT2453
aggccgcggtggattagttttcatcattacaatacaagtgcagttcacttcaaaaaagtattgtaccagaaacacttcttttatatttagtacatagctgttatttttagacacaacacacaaaaatgcctgcttctccgagttctacgaatgtgggttcaggtggaagatccccctcaaaggctgtcgctcccaggtcttctatgggaagcagtgtaaggcagaggaagacgactaccacagctactactgccaggagaaatacaggtgcaggaactggaggaatgtggcgtttttacactgacgattctcctggcatcaaagtaggtccagtaccagtcttagtaatgtctcttctattcatcgcatccgtattcatgttgcacatctggggaaaatacacgagaagcagctcatagatgaaattccagcgtttcatcattccatcttccacctatttaatgcatttttgaactgtatattttatattggtataagtataaaatgaagtgtttctgaattatatatatcataaaatttaatggaaaaatacactccttttcat

SEQ ID NO: 2895 - DNA, 296 bp, Diabrotica virgifera
  Clone ID: LIB150-034-Q1-E1-E3
actacatcgccatcggccggcatttatttttgcttttcacatctcagtttgttccatcgtttctactatatccagattacattagacatttcatcctaacaacagacgcatcgggcgatgagttgttcagcagttttaggtcaagattaaacggcatagacctacctagagcatacgcatcaggaagtgttaatcagggagaatgtagtaagccgacaatcattaaggaaatactaacgatgcattggggacttaagcatttcagatgttagttatagggcagcaccatcgttttt

SEQ ID NO: 2896 - DNA, 435 bp, Diabrotica virgifera
  Clone ID: LIB150-041-Q1-E1-E2
aaagagaccaactacagaagaaatgatgctaggaacatttgccgacgatactgcaatcctagcctcacacacagaccctatctatgcctcgcatctccttcaagcgtatctagacagagtacaagtttggtttttggaatggaaaattaaagtcaatgaaggaaaatctattcatgttacatttacaacacgaagaggaacttgtcctcctgtaagtttaaacaatcaccaaataacatcagtcaacgaggtaaaatatcttggtattcatttggacagaagtctcacatggaggaaacatatctggaccaagagaaagcaactaggtctccaattcagaaatatgtattggtgaatgggccgctcatcaagactatctctggataataaattgctgctctataaggcaatacttatgccaatctggacatatgg

SEQ ID NO: 2897 - DNA, 418 bp, Diabrotica virgifera
  Clone ID: LIB149-016-Q1-E1-E8
agctcttgcccgatgtcactccactctcattgggtattgaaactgccggaggtgttatgactgccctcatcaaacgtaacactaccattcccaccaagcaaacccagaccttcactacttactctgacaaccaacccggagtacttattcaggtatatgaaggtgaacgtgccatgaccaaggacaacaacctcttgggaaaattcgaacttactggcattcctcctgcgccccgtggtgtccctcagattgaagtaaccttcgacattgatgccaacggtatcttgaacgtcacagctattgaaaaatccaccaacaaagaaaacaagatcaccatcaccaatgataaaggtcgtctcagcaaagaagacattgaaagaatggtcaacgatgcagaaaaataccgtaacgaagatga

SEQ ID NO: 2898 - DNA, 435 bp, Diabrotica virgifera
  Clone ID: LIB150-018-Q1-E1-A12
ggaagaagtgactaaaaacacagctaggaatataacaaatggcattttactacaagtttgtgatttgcaaaaagtggagaagtgcgacaaatctaaagaaaaagaaaaagacgcttcacctgaaaaaatggcgaaaaaggatatcaaaggtgcaccaaatgccgttaccatgttcgcctcggagttcattggcacgggtcttctgatgtttataggctgcatgggctgtgttcctgaatttgataatcctgcagcagttcatcacatggcatcgttaacattcggattagtaatcctgcttatcattcagacatttggtcacatctcaggggctcacttaaaccctgcagtcacatttgcagcagttttcatgaagctcgtgtcgccaatgatgtccatagtatatattgcagctcaattcttaagtgctactct

SEQ ID NO: 2899 - DNA, 411 bp, Diabrotica virgifera
  unsure (1)..(411): unsure at all n locations
  Clone ID: LIB150-048-Q1-E1-H11
cccacgcgtccgccacgcgtccgcgagaacttagatctagaatcgaaagagaaaaagccgaccttagtgtacaagtaatccaattatcagaacgtctagaagaagctgagggtggtgcagaaagtcagtttgaaattaacaaaaaacgtgacacagaattgctgaagcttcgcaaactattagaagatgtacacatagagtcagaagaaactgctctcatcctcaagaagaaacatcaagaaatcgttgtcgacttccaagaacagattgattccttagctaaagcaaaatcaagagccgaaaaagaaaagggcaaattccaagccgaaatctaccagctcatcgcccaggtcgaaagcgtaaccaaagaacgcctgatttccatcanacaatgtgagaaactagaaatca

SEQ ID NO: 2900 - DNA, 377 bp, Diabrotica virgifera
  Clone ID: LIB150-027-Q1-E1-G3
agtttatgtaagaggtgtttatacgacagatactccgcaagattttcggttcgtaataatttttgcagtattacagaccgtgcattaaaaggtactagtccactcccaataaacaaatcaaatctaaccatggaaagagatcgggttggaaattggggaaatggagagcacctcgttcctggaggagtatccggtctggagaggctgacaacccccgctttaaataagggtctggcattcaccttcgaagagagacaacagcttggaatccatgggttgttacctcccgtagtaaaatcacaggaacaacaaatcgaacattgtaaaaaatgtttggacagattagacgataatttaaacaaatatatgtacctgat

SEQ ID NO: 2901 - DNA, 454 bp, Diabrotica virgifera
  Clone ID: LIB150-019-Q1-E1-E2
cccacgcgaccgcttacatggtacagcagtttcagtgctgtgctttagaataatttattttttaacatttatatagaaatcaaatactaaccaatcaacatgtgtgaagaagaagttgccgctttagtcgtagacaatggatccggtatgtgcaaagctggttttgctggggatgatgcacctcgtgctgtattcccttcaattgttggacgcccaagacatcatggtgtgatggtaggaatgggacaaaaagattcctatgtaggtgatgaagctcaaagtaaaagaggtatccttaccttaaaataccccatcgagcacggaatagtcacaaactgggatgatatggagaaaatttggcatcatacattctacaatgaactcagagtagccccagaagaacaccctgttctgttgacagaagctcgtctcaaccccaaaggcaacatggaaa

SEQ ID NO: 2902 - DNA, 436 bp, Diabrotica virgifera
  Clone ID: LIB150-023-Q1-E1-F3
tcgcgggtcatcacacgcgtccaaagacacttgggcaaagttggactatgttgggtgctgtggcatgagcaacttccagccttgtggctggaaattccatcgaaaaatgttggttccggatcacttaaaattgtctcttcatacgatgttcaatacagagacttcgctgccaacgctgctgccgcgtaaggcacatggaaaagttgtagcggtcattggtgccgtctttgacgtacaattctatgaacaacgacccccaattcgaaatgcattgggactacaacaccgtcaacctatgctggtccctgaatttgcataacatttgtgagagaatacagtccgtactattgctatggatagtactgaaggtactgtccgtagtcaacatgttaacgacacaggatacacaatccgtatccctgttggtgaagcaacc

SEQ ID NO: 2903 - DNA, 398 bp, Diabrotica virgifera
  Clone ID: LIB150-035-Q1-E1-C11
aaaataatcaaaatattattcacattaaaaggtatgtgcgtatttaactaatacattatcatagttcattgttgaagactcttgttaacatctaatatcaattgaaatgaatgccgatccccgcagacctgaaaaagtatcaagatatgttccaaaagctaccaatgggactggccaagaagacctcacccctgattacatgaatatcttgggtatgatctttagcatgtgtggtcttatgatgcgtttaaaatggtgtgcttgggtagctctatattgctcctgcatcagcttcgccaattagaattacagacgacaccaaacagatcctgagttcgtttatgttatctatatctgcaatcgttatgtcgtacttacagaatcgacaacctatgact

SEQ ID NO: 2904 - DNA, 458 bp, Diabrotica virgifera
  Clone ID: LIB150-001-Q1-E1-G2
aaaagagtgaggaaacaggttaattataatgacggaggaatgacaactgacacacgagaagatacgacatggcaagaaaatctctctgattaccattctgacttttctgcgggatcggatgaggataaggaagacgatgatttcgatgagaagaacgacgccgatttaagcagaaggagtcgaagaaagatggaaaggaaagacgagaaggatcgtcctttaccaccgttactagccagagttggcggcaatattgaagtactcggttttaatgccaggcagcgtaaagcgttccttaatgctattatgcgctacggaatgccaccacaagacgctttcaattcacagtggctggtgagagatcttcgaggaaaatctgagaagatattcaaggcttacgtgtctctctttatgaggcatctttgcgaacctggtgcagataatgctgatacgtttgc

SEQ ID NO: 2905 - DNA, 411 bp, Diabrotica virgifera
  Clone ID: LIB149-022-Q1-E1-D12
accacacgtccgcccacgcgtccgcccacgcgtccgcaaaaacagtcttacatcgttctcaaaaatatttattttaatgaatggttttcttgattgatattgacaatatatcatggatttcaatttggctgtatttcaagaaccccgaggggtaatgagaattgtgcagttcattttctcaatctgtggatttgctacaataactggttatacaggatatattaatgttgtttgcggaacactcactaagcacacattcgtttacccatttgaagtgattatccaaaatatttcatcaaaatgcagtatagatattgtgggagacttttcatcagatgccaaattttttgttactaccggggtgttgtctatgttatattcactagctattatggttgtatatacgaaact

SEQ ID NO: 2906 - DNA, 347 bp, Diabrotica virgifera
  Clone ID: LIB3026-023-Q1-E1-F7
acgcgtcagcaagaataatcatcttttaattttccctataatcctttcaggatggcaatcagaccagtttaccgtcctcaaatcatcaaaaagaggacaaagaagttcatcaggcatcagtccgagagatatggtaaacttaagagaaactggcgtaaaccaaagggtattgacaacagagtcagaaggcgtttcaagggacaatatttgatgccaaatattggttatggttccaattctaagactaggcatatgctaccaacaggtttcagaaaagttttggtacacaacgtagatgaacctgaagttctccttatgcaaaaccgtacatattgtgcagaaattgc

SEQ ID NO: 2907 - DNA, 448 bp, Diabrotica virgifera
  unsure (1)..(448): unsure at all n locations
  Clone ID: LIB150-040-Q1-E1-H8
ctcgtgggtcgatacaagcctctacagtcactcgtgttacaataagatttttgataatgtaggttaatctgtttttattgttcttaggattctctgttatatttaagtacgaaccattatacgaagctttaggtttcgttaaagttaggcctgtactggtaggactctttgtagtattgcagtatgttatgatgccgtataatacagttcttaacttcctaatgacttgtttatctagaaagtttgaattccaagctgatgactttgctgtgaatctaggcaaatctgaggctttagaaagagcacttgtacaactgaataaagataatttaggttttccaattaatgattacctttactctgcttggcatcactcacatcctccattactagaaagaatagccgtcttgagagagagtgcgaganaatcccaatagactgagtttta

SEQ ID NO: 2908 - DNA, 432 bp, Diabrotica virgifera
  Clone ID: LIB149-049-Q1-E1-E1
ggtcgacgacgcgtctacacacgacatctgctacgcgtccgcggacgcgtgggcggacgcgtgggtttggctatggcaactaactttgtaaccgtggagcagctggtagtagaagcgaattacattttcaaagaacaatttggcgaagaagcagacatagctgtgtatgctccaggtagagtgaacttgatcggtgaacataccgactataacgatggatttgttatgcctatggcacttcctttggtgactgtaatggttggcaaaaaagttgagggatctgtagtaaccgtatatacaactagtacattttgcgaccaagaaacatcatttgacatgcctagtccatgtgcgccaattagagccataactccagtgggacccagatgggtaatgtacataaaaagggtgattgtaaactatataggcgat

SEQ ID NO: 2909 - DNA, 376 bp, Diabrotica virgifera
  Clone ID: LIB150-048-Q1-E1-D1
cccacgcgtccgcttttaataaatatttaaatcaacacatgagagttcacactggagaaaaactttataagtgtgaactttgttttaagcagtttagtgattcgagtagtttaaaaaaacatttgacagtgcacactgcagaaaaaccttataagtgcgaaatttgttttaagcaatttgttcaatcaagtgatttgaaaaaacatttgagagtacacactggagaaaagcctcacaagtgtgaaatttgtttcaagcaatttactcaagcagagaatttaaaatgccacttaagaattcacactggagaaaagccttacaggtgtgaaatttgttttaaacagtttagtgattcgagtagtttaaaaaaacattt

SEQ ID NO: 2910 - DNA, 398 bp, Diabrotica virgifera
  Clone ID: LIB150-036-Q1-E1-F5
ggtcgatacaagcctctacacagacgtcgtagtatttcgtctgtatcagtttgttatcgtgtttcatcagttcgtgttaacagttcagtgaagatgaaggccgtagtcagtgcattgtgtaccgaaaacgggatttccgccatcagcggaaaaatcaccaaacgcaaggatatcgagaacgaggagattcagatgtacctctccaaactcaaggatctcgttccgttcatgcccaagaacaagaaactatcaaaattggaagttattcaatacgttattgactatatttgtgatttacaaagtgctctggaaacgcatcctgccgtcaatgcttttgatgcagctgctgccttaggacagaagaagtcacaagcagcagtcagccccaggcagcctct

SEQ ID NO: 2911 - DNA, 395 bp, Diabrotica virgifera
  Clone ID: LIB150-043-Q1-E1-D9
aacgaataatcatcttttaattttccctataatcctttcaggatggcaatcagaccagtttaccgtcctcaaatcatcaaaaagaggacaaagaagttcatcaggcatcagtccgatagatatggtaaacttaagagaaactggcgtaaaccaaagggtattgacaacagagtcagaaggcgtttcaagggacaatatttgatgccaaatattggttatggttccaattctaagactaggcatatgctaccaacaggtttcagaaaagttttggtacacaatgtaaaagaacttgaagttctccttatgcaaaaccgtaaatattgtgcagaaattgcacatggagtttcgtcaaagaaacgcaaggatattgtagaacgtgctcagcaattgag

SEQ ID NO: 2912 - DNA, 414 bp, Diabrotica virgifera
  unsure (1)..(414): unsure at all n locations
  Clone ID: LIB149-028-Q1-E1-G9
aggctgacagaattttgaacatggatttcgaagttgaagtggataagattttaaaagtaattcccagggagaggagaacgtttttgttttcggctacaatgacacaaaaggttaagaaattacagagggcctgtctgcaggatcctgttagagttgaggtctccactaaatatcaaactgtagagaagctgcagcagtattatattttcattcctgtcaaatttaaggacgtctacttggtgaacattttgaatgagttggctggtaatagttttatgattttctgttctacctgtaataataccatcagaacagcactaatgttaagaaatctgggattaactgctgtccctctgcatggtcaaatgtcncagaataaaagattggctgcgttaacaaagttcaaggcgaaaa

SEQ ID NO: 2913 - DNA, 370 bp, Diabrotica virgifera
  Clone ID: LIB150-040-Q1-E1-C6
caaacatataattaagttttgataaaaatctttaaccaattttccactctgttgaaaatatgtccaaaagaaactacgatagcgcttttagcgatacaaaatttacaactaaagatactggacgtcaaactaacaaaaaacatactttagatagtgatgaggaagatgacgagattgaagaggataatgtcttaaatactgatgatatcgagggagaggaagacggaatagctagacaagatggagaacaaaaaatgacagcatttaacatgaatgaggaaatggaagaaggtcattttgataaggacggtcattttatttggaacaatgaaaaagaaataaaagacagttggcttgacaacatcgactg

SEQ ID NO: 2914 - DNA, 251 bp, Diabrotica virgifera
  Clone ID: pGUT2636
gcagaatccaacatgaacgacttggtatcagaataccaacagtaccaagaagccacagctgacgaagatgccgaattcgacgaagaccaggaagccgaagtcgacgagaactaaatttcatacgttaattttggatctgaaatcaaagctttataacttttatatttgtctcctctccttttattttttatttaagcatgttttttgtacagtctctacattcccgtttgtaaatttcgaatacactactt

SEQ ID NO: 2915 - DNA, 421 bp, Diabrotica virgifera
  Clone ID: LIB150-034-Q1-E1-D4
acggcgttcattttctttttaatcgatataagagcggtaacgccgaagtgccgaagtttctttttgtttgtaaacgtaaatcagtcaaaatacagaccttaaagatggcgagaggtgggatgcgtggccggggcggcatgaaccggaatgttggcggccggcctccatttaaagttaaaatgtttttgccgaggcatccatttgacctggcactttgcgaaacttcgtttcctcgtaccaaagcagctccagacgacacagcttttactcaagctttattaaaaaggaacgccgatctgtcacctacacctggagaacaaaccgctattttgaacttggttactaaaattcagacagttttggacaatttggtagttgcaccaggaaaacttcgatgcatgtcaacttgatgaagtccgac

SEQ ID NO: 2916 - DNA, 428 bp, Diabrotica virgifera
  Clone ID: LIB149-005-Q1-E1-D6
aaaacgaatccattttctggagtttataataaaataaaattataaaagatggaaaacgacgcaggtgaaaccgttgacttgtactgcccaaggaaatgctctgccagcaacagaattatccacgctaaagatcatgcctccatccaacttagcattgctgatgtagatccccaaaccggcagaatgaccgaaagctctaaaagctatgcattgtgtggcgctattaggagaatgggtgaatcagatgactgcattgttaggttaacgaaaacagatggaatcttagcaaagaacttctaattccaatgtttgtgactatggatgaagaaaatatattgaatatgtatatttactttattcattacataaacagttatttattagtttttataaaccggcacaaatataaaaataaaaagggcggccgc

SEQ ID NO: 2917 - DNA, 399 bp, Diabrotica virgifera
  Clone ID: LIB149-033-Q1-E1-E7
tgtgcataatgagagtgcatactctggtgatgagagggagagttcagtgccagttgttcctgaaaatccagcactgggtattcctactggaaaatacaaacttgtaagatggggtatatatactactggccgcacactaaatgatgaaatcattcatatagctgcgtttacacctgaatcacagttttcacagtatgtcatgccatatggagatttgaatcctacctacagcataagacatggtatcagagtattaaacacaatcagctacagaatgttgaaagatgtcaacacccataaattcttgaagaccaatagtgaaatttcagctctccaagacttcttgaaatggttggaaactgtgaaacgaaatgacgttgatggaattatattgattta

SEQ ID NO: 2918 - DNA, 580 bp, Diabrotica virgifera
  unsure (1)..(580): unsure at all n locations
  Clone ID: pGUT3263
tccaattgtagccgtgtatataaggtaaacaatattcagaagatcaatatgtctgtcgttaacgtatcatttaatacgactagcgaccattccaaatgggctgtaacttcaaattccagcagttcgtggagttgtgtaggagatatcaatcgtgcgcaacatcaactggaaaggggtggtggaactgtgtgcctacaaaatcaaaaattatctacaaatttccacaagttaattagtgccgtagaagagtgcccaagaaaggagtcctttgatattccgacagtgattaatgtataaaattttatataatatatatattctatagagaataattccgtcttattttgcaaactatttagcaacatttttcagcaagtttccctctgggggtatactagggttccatattttattaataaattaccaatatttgttaactctaaaaattttaactgagaaaataaacctttttttattttaaaaaaaaaaaanaaaaaaaaaacaaannnaaaaaaaaaaaaaaaaaaaaaaaaaaannnnngggggggggggggccccccccccccccccccctaagggg

SEQ ID NO: 2919 - DNA, 611 bp, Diabrotica virgifera
  unsure (1)..(611): unsure at all n locations
  Clone ID: pGUT3730
ggtctatgccaaaagttggaggatatatagcagacttcggcagatctctgaataaaaaatacggtttacaacttaataagttgaaatttgtaggtcattccctgggtgctcatatctgtggatgtgctggagctgctttggatggacaagtcgacagaattgttggtttagatccagctggtcctctattcagagaagagagaacagacaaccgtattgacgctagtgatgcagagaatgtccaaattattcacacgaatggaggaaagatgggatatttggctccatgcggagactctgacttctatccaaatggaggagaatcacaaccaggttgtggatttgatttaggtggcggttgtgctcactctatgtcatacgcaatatatgccgaatcattgactagcacaggatttgttggacagcagtgcaatagttatgaggaatatcagaagggtaatgtaccggaccaaaagctagcatgggaatgttccatattgantaaatggcctctggttcctactaccttaaaacacacagcanatctccattccatataggataaagatgtgtaggtactacatagttaaataaacaatanaatctaacgt

SEQ ID NO: 2920 - DNA, 396 bp, Diabrotica virgifera
  Clone ID: LIB149-046-Q1-E1-D5
acccacgcgtccgcccacgcgtccgaaaaggcgtacgatacagttcctgtaaacaaactctggaacgtgttacgacagacgaatattagtgtcaccttaataaaagccttaagaaatttgtatgaagggtcaacatcacaaataagaactggaaacagattatcgcaaagcttcctggttaataaaggtctacgtcaggggtgttgtgtatcaccgaccttatttaaaatatatgttgcagaagcattgaaagagtggaaacgataatgcagaggcatgggcgtagaccttggagagatttgcttatatacattgcagtttgctgatgaccaggttgttatagcaaacgatcaagataatttagagtacatggcaaggaaatttcaagaaggatat

SEQ ID NO: 2921 - DNA, 327 bp, Diabrotica virgifera
  unsure (1)..(327): unsure at all n locations
  Clone ID: pGUT1301
gtttaatagttaaaattgcagcaaagaaaacatgctgattaaagaataccgtgtgaccctacccctcacagtcgaagagtaccaagtggctcaactattcagcgtggcagaggcttccaaagacaacactggcggcggagaagggatannaatattgannaatgancccttcaccaatttccccttactcgggggtaaatacaacagcggacagtacacttacaaaatctaccatttggccagcanagtaccggcgttcataaggctcctgnnncacgaagggagtttggagatacacaaaaatgcttggtatgcttacccatattg

SEQ ID NO: 2922 - DNA, 405 bp, Diabrotica virgifera
  Clone ID: LIB3026-028-Q1-E1-G9
agctcggtatatgatagccatcatgacggaatgtacagctactattcgaaccacaaagttcatgaccaacagacttttggctagaatacaaatggttgttgatgttttacatcctggtcaaccatcagttaagaaaactgaaataagggaaaagttagccaaaatttataaagtactcccagatgtagtattcgtctttggctttaggacaaacttcggaggtggtaaatccactggatttgctttaatttatgatacattagatttcgccaaaaaattcgaacctaaacataggttagcaaggcatggtctctatgagaagaaacaacacacaagaaaacaacgtaaagaacgtaaaaacagaatgaagaaagttacgggcaccaaaaaaagtaaagttggtgc

SEQ ID NO: 2923 - DNA, 423 bp, Diabrotica virgifera
  Clone ID: LIB150-014-Q1-E1-G8
accaaatgtgtgcatttgaaacagcatggaacaaaaagagaaaatcaccttggtgtgccctttttacgggagaaaatttaaaggtactggaataccttagagatttgaaatattactggcaagatggctatggacatgagttatcatataaacaagcttgcccagcatttagagacatgtccaatttccttcaaacaaaaactcgattcccaagagtcaacgtgtactttacccactctggaactttgctaaagatgatagctcatgtaggattgtacaaagatgaagagcacctaacggctaaaaattacgataccgcacgtgacaggaagtggagaaccggtcttctagatacttttggaacaaatttacccttcgtagcctttgaatgtggaagagatactaaaatcctcacagtgcacc

SEQ ID NO: 2924 - DNA, 391 bp, Diabrotica virgifera
  Clone ID: LIB150-002-Q1-E1-E11
gttaaattttgttaatttcaagaattaaaatatttaacataaaaatggtttctatattaaattcaatagatactggtcatgaagatatgatacatgatgcagaagtagattattacggtttaaggttagccacttgttcctcagataacagcatcaaagtttatgatataaaaagtggagcttccacactactggatgatctaaaaggccactatggacctgtttggcaaatagcttggagtcatcctaagtttggcaacttattagcttcgtgttcttatgataggaaagtaataatttggaaagaacagcaaagaaaatggataaaatattatgagtatgcaaatcatgattccagtgttaactctgttcagtttgcacctgctgagct

SEQ ID NO: 2925 - DNA, 401 bp, Diabrotica virgifera
  Clone ID: LIB149-024-Q1-E1-F9
aacaaacgttatataacattacgagaaccccataaatgttggatctttggacaagaacgataacaacgttggaaccggcttagttggagcacccgcttgtggtgacgtaatgaaactgcagattaaagttgacgacaatgggaaaatcgttgaagcgaaattcaaaacatttggttgtggttctgctatagctagcagttcatatacaacagaatgggtgaaaggcaaaactgtagaccaggcgcttaaattaagaaatactgacatcgcaaaggagctgtccttgcctccagtgaagttacattgttctatgttggcagaagatgccattaaggctgctttatcagactacaagattaagaatcagaagaaggaagcttaaggggacagaactggaaaca

SEQ ID NO: 2926 - DNA, 336 bp, Diabrotica virgifera
  Clone ID: LIB150-049-Q1-E1-E3
aggtttcgtgtaaaacttcacgtactgcgtttagaaggggaattaccaatggagctgaatggtatccgttaactggaggtatgcaagactacaattacgtctggtacggatgtatggaagtaaccctagaagtatcgtgttgtaaatatcctcctgcgcatgaattacccaaatactgggaagataataaacaggcacttataaagtttttggcagaagcacatcgaggtgttcatggcttcgtcatggatgaaagtggaaacccgttaggaaaagcttctttgaagattaaagctatggacgttggtttccaaaccaccaaatatggagagtttt

SEQ ID NO: 2927 - DNA, 450 bp, Diabrotica virgifera
  Clone ID: LIB150-029-Q1-E1-C3
atttgaagtacatttgtatgtcttaagcaatttgtaggcttttctgatgacattttggatattacgtttgtaggcgaggaagattcacacttagctattgccaccaactcgtcagatataaaactttactgtaacgctaccatgaattgtcaaatactaaagggtcacacagatatagtcatgtcattagctacttgcccagcagatccaacaaatatgctttcgtcaggtaaagataatacagtgaggctgtggaaacttgatggaaatatcatgaactgtatagctacaggttttagacatacaggttctgtaagttccgtagctttcagtcaaaccaattgcaactttggagtctcagttagtcaagatatgtgtttaaaactgtgggaaataccaacgaaatcaaaaatcgcaagcttaaactgtatgcatactgtcttagctcac

SEQ ID NO: 2928 - DNA, 408 bp, Diabrotica virgifera
  Clone ID: LIB150-039-Q1-E1-F2
ataaaatgaccattaatagcagtgaatacaaatctccttcaatatgggagttttggagagcaagaagatacgtagtgacgtttatgctctttctgggatttttcaacacctactgtctacgagttaacctcagcgttgctattgtagctatgactcagtattacaatgtcacattggcaaatggtactactattgtgacacgagattttgactgggataccaaaatacagggttatctcttgagttcctttttttatggctatatatttactcagtttattggagcatatatgggtatcaggttcggaggaaaaattgtttttgctgtaggactcggcatggcatccattttgaccattcttacaccagtagctgcatatataaatgtttggctcctgttacctgtaa

SEQ ID NO: 2929 - DNA, 339 bp, Diabrotica virgifera
  unsure (1)..(339): unsure at all n locations
  Clone ID: LIB150-005-Q1-E1-D5
gatatagaatacaaaaatgtttgcctgtgctagactgattgcccctgccaccagaagcgcactcgttgccaacacanaacaatacttgagggcactgagcagtgtagtaaaccaaagtcaaatacaggtacagaatgtgcaacaacacaagcaacctaacctcctcgccgctatccgcagtttccaaactacacagtcagcagagacattgactctgcagctaaattcattggtgctggtgctgccacagttggagtanctggattaggagctggtattgggacagtgttcggttcactcatcatccgttacgccagaaaccctaacctaaaacaacaa

SEQ ID NO: 2930 - DNA, 396 bp, Diabrotica virgifera
  unsure (1)..(396): unsure at all n locations
  Clone ID: LIB150-009-Q1-E1-F8
acattatagaaatttaaagcaggctttatccaacggattaattttaactaaaatacataaagttttgaaatttaatcaatctgcatggctgcgaccctatattgagttaaatactaacttacgggctgcatctaagagcagttttgagaaaaatctctataaaatgatgaacaatgctgtgttcggtaagaccatggagaatataaggaggcatanaactgtaaaaatatgtaaaaattggaatggaaggtatggagccaaaaacttgattgcaagtattcggtttcacagtcgtactatctttagtgaaaacctagtagccatcgaactaaccaaatcagtagtgtgctttaataaacctctgtatataggtgcagcaatcctagacatatcaaa

SEQ ID NO: 2931 - DNA, 528 bp, Diabrotica virgifera
  unsure (1)..(528): unsure at all n locations
  Clone ID: LIB150-021-Q1-E1-A10
ctcgttcaaatgttcattggagatggtgccaaacttgtcagagatgcttttgctcttgccaaagagaaggcaccagctataatattcattgatgaattagatgctatcggtaccaaaagatttgattctgagaaagctggagacagagaagtccagcgtactatgttagaacttcttaaccagttggatggattcagttcaacagctgatattaaggttatagctgctaccaatcgtgtagatatattggatcctgctctactccgttctggtagattagatcgtaaaatagagttccctcaccccaatgaggaagcgagagctagaatcatgcaaattcattcaagaaaaatgacagtcaatcctgatgtcaactttgaggaattagcaagattaacagatgacttcaatggagctcaatgttaagcagtctgtgttgaggcaggtatgatagccctaagaaggagtgctacnagctgtactcatgaagattatatggatgcaattatggaagttcaagctaagaag

SEQ ID NO: 2932 - DNA, 420 bp, Diabrotica virgifera
  Clone ID: LIB149-039-Q1-E1-B11
cgggccgagacacgcgtctagcatgactcagtactagaaattagcagacgtgtggcatgcgacattggtgattccgatccggaacgaatgactccagccagagcagaagagtatgtaaggaatctattccagggaaccagcatcaaattaagcgtagtaagtgatgaagaagaattcaataaaggatatccattgtttgcagctgttaacagagcagctagccttaatgccaggcataggggaagaattatttatttggaatacaatccaccacaggctgttaaggaaacgttatttattgtaggaaaaggggtaacaatggatactggtggtatagacgtaaaaatcggcggagctatgatgggaatgtcacgtgataagtgtggagcagctgcagcagctggttttatgacagtcgtg

SEQ ID NO: 2933 - DNA, 421 bp, Diabrotica virgifera
  Clone ID: LIB150-047-Q1-E1-C6
actgcattcagggaaactcgtctgttgatcgtcactgaccctgcttttgatcaccaacctatcactgaagcctcttacgtaaacattccagttattgctttgtgcaatactgattctccattacgttttgttgatattgccattcccggaaacaacaaagcctcacacagtattggtttactgtggtggcttttggctagagaggttctccgtcttagaggaatcattccacgggataccaaatgggatgttgtagtagatcttttcttctaccgtgaaccagaagaggctgaaaaggaagaacaagctgccaaagaagctgtggctgctgttgtcaaacctgtagatatcccagctcctcttgaaggccaagacttggactggaatactactgaaactactgattggaatgctgaagttg

SEQ ID NO: 2934 - DNA, 432 bp, Diabrotica virgifera
  Clone ID: LIB149-004-Q1-E1-E12
actcgcgggccgatgcaagcctctacagtgactcgggttatattattaaatcaccctttaacttgtggtttaatattattaatacaaacaattttcacatcagttattacaggattaataaattataattactgattttcttatattttatttttaattatagtaggaggaatattaattctttttatttatataaccagaattgcttcaaatgaaaaatttaaatttaattttaatataactttaataataattagaatttttattattatttctatattaagatttattttagattatttttattttaattcttttataaaaattatagaaatgaataaccaatttaatattattaataataaattatctttaattaaatattttaattttccaaataatttaatcataataataataattatttattta

SEQ ID NO: 2935 - DNA, 397 bp, Diabrotica virgifera
  Clone ID: LIB150-014-Q1-E1-E4
aagacctaatacgcttccttgagggactcctgctctgatttcaggtatatcgtatgtgtataacagttagagaacaggacctaatacgcttccttgagggactcctgctctgatttcttttagatcagtgtacacgtcttcttgcttaattctgaaatatctgtcagatatatatgattgtaaaatttctgaatattgtttaggcataagaattttgagtttgtagactaaaccttcatgccaaactttgtcgaaggccttagctacgtctaaaaagattgtagaacagactttcttttcttctattgatttatcaattatgttagtcattctgtgtacctgatcaatcgtagaatgtttatttctgaagccaaattggtggtttggaatcattttt

SEQ ID NO: 2936 - DNA, 229 bp, Diabrotica virgifera
  Clone ID: pGUT4059
gcttcttatattcttcgtgtcgatgtcgaacgcgtgcactttttctctagtaggacgtcgcgatccgttgggtgtctgtctaagactcgaggtggagcccgcgtaatttttaattatgcggacccttgatgttccgacagactcgctcgacggtatactaatggcgcagggccgctacttcagttagcgttcgggccgtagcaagcacgttctgtgtttgatggcgatc

SEQ ID NO: 2937 - DNA, 425 bp, Diabrotica virgifera
  Clone ID: LIB150-035-Q1-E1-E6
cctttttaatggcggacacatcgttcgcttgatgtgtgtgtgagctactgtaaataatttatagaataagagaaaatgtcgttatccaccgctcgcccattagtgagcgtatacaatgagaagtccgaggaagtaaagggttcaaatatttcacttccagcagttttcaaggctccaatcagacccgatgtagtcaatttcgttcaccaacaggtttctatgaaccatcgtcaaccctacagcgttagtgacaaagctggacatcaaacatctgctgaatcatggggtaccggacgtgctgttgctcgtattccccgtgtaagaggaggtggtacccaccgttctggtcagggagctttcggtaacatgtgtagaggtgggcgcatgtttgcaccaaccaagccatggcgtcgctggcacagacg

SEQ ID NO: 2938 - DNA, 462 bp, Diabrotica virgifera
  unsure (1)..(462): unsure at all n locations
  Clone ID: LIB3026-015-Q1-E1-B2
taccggtctgaccattcccggtggccacccacgcgtccgccaacgcgtccgattcttcgatttgttaaaattatattttcctaccatatatgatgtaaagtaccttatgaaatcatgcaaaaatcttaaagggggattacaagaagtggcagaacagctagaacttgaaaggattggaccacaacatcaagcaggttctgattctcttctgacaggaatggcatttttcaagatgaaagagatgttcttcgaagacaccatagacgactccaaattctcgggccatctctacggtctcggcacctctttcgcagtgaacggaactgccaacaactactcgaacgacaacggagataccacaaactcttcatgaaacttactggtcttctgtctcctcatcaaattactaaagctaaagtggaaaacactaatgtgacncgtttcttcaacaaaatatatgaa

SEQ ID NO: 2939 - DNA, 428 bp, Diabrotica virgifera
  unsure (1)..(428): unsure at all n locations
  Clone ID: LIB150-014-Q1-E1-D3
cccacgcatccggaaactgaaagtgaagaagggtgtccgataggacctggcttcacacttagcaaagtttttacgcttactcccttactggccaataacaaagataaatggggcttagccctcgacggtcaattaaaacatgaagacacaaatcttgcgtctagtacacttgtagctgatatgtcacaacgagaaaacttgggaatcatcgtccaatacaaagttaaggtaaaattgtgccttggtgcattgggaggagacctcgtagctgaattaccttttattttgatgcatcctaaaccagaagaggaaattttaccgccagccactccttctangcgtgtcagtgaagacgtcagaagtgacgtaccagtcgatgccaacttaattcagctggaggaggaaaatcatgacgatgacataatttt

SEQ ID NO: 2940 - DNA, 361 bp, Diabrotica virgifera
  Clone ID: LIB149-047-Q1-E1-C9
agctggagtgccccttctgcggggaggagttcgatggcgtcggcctgtgcttgcacatcgaggacgagcacgcggcggagaccaaggccggggtgtgccctatatgcacagatagagttgggatggacttggttgggcacatgacctcagagcatcccagtttcttcaagggcaggtggaggaaccagcgagtttcatctggatcaccttcttcaatgtattccgcattgaaaaaggatgcggcgcacatacaataccgctacggtggatcctctcgtgccacctcgctcaatacagtgcctgatcctctactctcctcctttgttggtagcttcattgatgatgatgcacattctccaaa

SEQ ID NO: 2941 - DNA, 206 bp, Diabrotica virgifera
  Clone ID: LIB149-038-Q1-E1-H10
tagtgagtcgtattaaacagtgcggcatcacatgggtagatgggattctagcccaaagggagatcgcagacacaccgtggcagggtaaaggctttcccaagagaggatccctcattacctgtccacttgactgggcttcagatgttacgagagctggaaggtacacacatgtggagagaggcagagatacctgcatcattgatcag

SEQ ID NO: 2942 - DNA, 389 bp, Diabrotica virgifera
  Clone ID: LIB150-036-Q1-E1-F6
cccacgcgtccgcccacgcgtccgaataaagaaaaccacatctccactaagcacaaaacttaaaaaaggtacggtatttcacaataaagatccagtttcggaaagtttaaaattatttaaatggttaattgcacctctaagtccaaccaagttttttgaacagtactgggaagttaaagccctacacatacaacataattcacctcactactttagtgatatcttgactacagcaagattggatagtatttttagggaatttccgttatactacaccaaaaacattgatgtcgtctcatatgaaaatggtgtaaaagaagttcacaatgaacaaggaaaggtggttgcttctgctttatatgattattattcaaatggttgtagtataa

SEQ ID NO: 2943 - DNA, 359 bp, Diabrotica virgifera
  Clone ID: LIB150-048-Q1-E1-C8
aaagaaactgcatgaaaataatgaagatattacgatttatccacaaattggaagtccaggccgtgaacaaaggacttgtgtcatcaaaaaacttcaggagagaacaccactttcaaaaggtttggatcatttattaagtcagttggagaagaaggatcctcagaacttctttgcctggccagtcactgataacattgctcaaggttattctacaataataagtaatccaatggatttaagtactatgagacagaaaattgaagaaaatcattatgcacatttagatcaatttattgaggactttaaattgatgtgcaccattgcaatgaaatacaaccatgtacacacactctactaca

SEQ ID NO: 2944 - DNA, 423 bp, Diabrotica virgifera
  Clone ID: LIB3026-019-Q1-E1-G10
tcccgggcaagaatggtgatgaatgtatttcaatattgcacgaacctggagatgataaatttggttatgaaaaagcctcggaacggtggttaccagtacatacagtagaaactattttaatatcagttatttcaatgttagccgatcctaatgatgaatcacctgccaatgttgatgctgcgaaagaatggcgagaatcatactcagaatttaaacggaaagtagcaagatgtgtccggaagtcacaagaacaagaggagtgttaggactgtattaaatttgaattgataaacaactaattatataaaagcccataattgatttgattcccgggctgttaaaatctacgtgactttttgtaagtcgtttccgtagttttttatacaacttaataatagtaatatactttttaaacattcgata

SEQ ID NO: 2945 - DNA, 380 bp, Diabrotica virgifera
  Clone ID: LIB150-028-Q1-E1-C8
gctctctttagacgaggacaagcatacattcaattgcgagagcccgagttggccagacaagactttacaaggtgtttagagatagatccgaacaacacagctgcgaaatctcaactaaccatttgttcgaaaacgttgaaggaacaactacagaaagagaagaagatttacgccaatatgttcgacaaattcgccaaaatggacacgcagagggaagaatatgagaacagaaaactgcccaatgtgatgagctccgtcggcgaatggggtcaggaagacagagaaagagaacccagcgaatttgaaaaggaaaatcccgacattattctactaaataaaactggcgagtttaaagatatgtaaacattttgtatttcaat

SEQ ID NO: 2946 - DNA, 407 bp, Diabrotica virgifera
  Clone ID: LIB150-050-Q1-E1-E10
aggtgaatgttatatcgtttttcaaagtgtaaggtgtttattttcaaaaagtttataaaataagcaatcactatgggtaatgtgtttgcaaatttattcaaaggcctctttggcaaaaaggaaatgaggatattgatggtacgactcgatgcagctggtaaaaccacaattttatataaacttaaattaggagaaattgtaacaactattccaacaattggatttaatgtggagactgtagaatataagaacattagttttacagtatgggatgtaggtggtcaagataaaattaggccattgtggagacactatttccaaaacacacaacgcctaattttcgtagtagacagtaaccacacggaaactaacactgaggctaaagattaattaatgcgttagttggg

SEQ ID NO: 2947 - DNA, 428 bp, Diabrotica virgifera
  unsure (1)..(428): unsure at all n locations
  Clone ID: LIB150-045-Q1-E1-E8
accacgcgtccgtgaccaacttacgagaaattaaattaagtaaaaacttcattcaaatactggaaggcaattcctttggtaatctaaaaaatctaaaaagtatatatttagatgaaaatgacatcatgttagttgaacagaattttgttaaaatgctaccgtcattaaaaatgcttaaactgcaaaagaataaattagaagaactagctattcacacgtttaacacattactaagtctacagaatttggacctacaggaaaatatcctcaagataatagaccctaatgcattcaatttggtaccacaattactaactctgaacctaagccacaatgagatttctaaaattgaagatgctggcttacaaaatttaagatctctagaacttcttgacatgagtttcaatanaatttacacgatgagtcct

SEQ ID NO: 2948 - DNA, 215 bp, Diabrotica virgifera
  Clone ID: LIB150-004-Q1-E1-G7
acccatatgtactcaagttcgttcaccaataggtttctatggagcatcgtcagcgctagagcattggtgggagcgctgggcatcagagatctgccgagtcatggggtactggacgtactgttgctcgggttcgccatgtagcaggaggtggtacccatcgttctggacagggagctttcaggacaacgtgtcggcgtgggcgcatgtttgcacca

SEQ ID NO: 2949 - DNA, 408 bp, Diabrotica virgifera
  Clone ID: LIB149-047-Q1-E1-E7
acccacgcgtccgcggacgcgtgggcgggacgggcctaaaattctgataatatttaaaaataatttaaaatggcaaatattttaaggaaaatttctacatcacaagctttgggtagcagattatttagtagtgaagttaaaaaatgtacacttattcctggtgatgggattggtcctgaaatttcagcggctgtgcagaaaatcttccaaactgccagcgtgcctattgaatgggaaagtgtagatgtgacacccgttaggggcccagatggaaagtttggtattcctcaagctgctattgactcagtcaacataaacaaaatcggtctgaaaggtcctctcatgacccccgttggaaaaggacacagatctttaaatcttgctctcaggaaagaatcaatctttatg

SEQ ID NO: 2950 - DNA, 477 bp, Diabrotica virgifera
  Clone ID: LIB150-030-Q1-E1-D8
gcgttttaggctacaacaccctataatgagtcgtattatgagttacgacaattctttgaagaacaaggtaaagaagttcatattattaatgaattagaccatattgtgaatgctggttttgacaagaactccttctatgacgacaaggacaaagaaaatcatattagaggacttttgaaatctgaggtattaaaattagtgtctgctaacaatattgtaattttggatgccttgaattacataatatgatatagatatgaacttttctgcggaaccaaagctaataaatgtactcagtgtacagttcacactgaaataaatcgagaagaggcttggcagtttaatgaaaaccgaacaaatgatgctgaatgatacaatagataaacctttgatgcacttgttatgaggtacgaagatcctaatggtaacaacagatgggacgctccgttattcactaattttcctaatcaagatttg

SEQ ID NO: 2951 - DNA, 326 bp, Diabrotica virgifera
  Clone ID: LIB150-009-Q1-E1-D3
agtaaactatggtcaagcataatggtgataataatggcaaatctgccataattgaagtactaactatagaatatacagtattatcttcacaagaggttacatggtattagtttcaataaacgtgcccctcgtgctattaaggctattcatcaatttgcgttaaaacagatgggtaccccagatgtcagatttgatactagacttaacagtcaactatggtccataggaattacgaatgttcctttcacagtacgtgtacatctttccagaatgagaaatgatgatgaatattctgtgagcaaattgttcactcttgtaacatatgt

SEQ ID NO: 2952 - DNA, 397 bp, Diabrotica virgifera
  Clone ID: LIB3026-001-Q1-E1-A10
aaaagaaacgaaaacgaatttttgtcggcatttggactttactattttattttttcatttgtaacggaatatgttcgggttcaggcaattagcaactgtaacaaggactacagcccgaagtgctgtcagagccaagcataccctacctgagcttccatacgaatatgccgctctcgaacctattatttcaagagatattatgagcttacatcattctaaacatcataacacttatgtaaccaatttaaatgctgctgaagaaaaattacaagctgctgcttctaagggagatattagtactgttatttccttggcacctgctttgaagtttaatggaggaggtcatttgaaccattctattttctggcaaaatttgtctccttcgaagtcaaatccc

SEQ ID NO: 2953 - DNA, 383 bp, Diabrotica virgifera
  Clone ID: LIB149-030-Q1-E1-H9
ttcaacaatcttattttataaaataattagttaacatgatgcaaacagctaataatgcatattatcccgattattccactgctccaatgcaacgtcaaattaacccctatgcagataatggagggagtgtagtagcaatagcaggtgaagactttgtaataattggtgcagatacacgtttgagtactggattttccatttataccagagaacaatacaaacttttcccactatcaggcactactgttttgggttgtgcaggatgttggtgtgacactctaacattaaccagaatccttaaatctcgcatgcagatgtaccaacaagagcataacataacaatgtctacaactgcatgtgcccagatgttgtcaaccatgctc

SEQ ID NO: 2954 - DNA, 353 bp, Diabrotica virgifera
  unsure (1)..(353): unsure at all n locations
  Clone ID: pGUT2909
tcgcaccaaccgcaccaacttattgcggaaaaccggttgctggggccggcgcccttaaaagaactgggcgtaaaaccaggccgaaaattctgtatggtaggccgcctttaaaataaagttgaatggaaataccaatctgttgtacgtccattgaaaagcaaacgtaaagttaaggctgtattggctatccgcaaacgtaacaaacttaagaagctcacacagcaagcttctgagaaggttgccaagcaaacaaaaccattcacaagtcttatcaattcttatggttataattaaagtttttattaataaatgacttataatttanaaaaaaaaaaaaaaaaaacctgaggggg

SEQ ID NO: 2955 - DNA, 404 bp, Diabrotica virgifera
  unsure (1)..(404): unsure at all n locations
  Clone ID: LIB150-009-Q1-E1-G1
acaaaatataaggaaaagtgagactgtcatcagttaaatatcccagaaaaaactaaaaatacactcaaataaaaacattaaaggcgtgctgtttaccttttaggggttagaaatggcattaagttcagtagatgtggaaactacagctttcgaggggcaaaagcccggcacaagcggtttaaggaagaaagtcaaagtgtttatggaaaaacattatactgagaactttgtacagtctataattaatgctttgggagacaaggctaaaggctctacacttattgttggtggagatggaagatacttctctaaacangccatcaacattattatcagaatcgcttccgctaatggggtttcaaagttgctcattggtcaactaagaatactctcaacacctgctg

SEQ ID NO: 2956 - DNA, 424 bp, Diabrotica virgifera
  Clone ID: LIB149-035-Q1-E1-C6
cggacgcgtgggctcagtttcagctttccctttgtaacactcagtgaggtcgagatagaacaaccagtttttggagccaattacataaagggaaaggttcgagcgcagccaaatggcaattggatcggtgaggccaagtttaagatgaccttcaagcatggaggggccattgagtttggacaggctctgcttagggcagcacattttgcctccagaggtggtggttacgatgcccctcctccatatgttcctcctcagacccagtggtatgcagctccacctccatcctacgctgctgcatcacaaggctattatggttggatgcctcccaccaatgtattcccacaacatccacctactgatggtgtcttcatgactgatgctcccccaccatacccaggaatagtacccggctaccaaccta

SEQ ID NO: 2957 - DNA, 326 bp, Diabrotica virgifera
  Clone ID: LIB150-012-Q1-E1-G4
gtcggacaagccaaagtcctttgtcatcgtgttgtgtatttttcaatgagtttaactgtttagtaagtacaaataaatccaaaatgtgtgaagcacgtttagttcaaagtgccaccttcaaaaaagtaatagacgcaatcaaagatcttctaaatgaagcatccttcgattgtcccgaatctgggatccaactccaggcgatggagaactctcaagtgtccttagtctccataacgctgaaatcagaaggagtcgacaagtacagagtgtgagagagaccttacaatgggcatgaacttgggaagcatgtcgaagatcttcaaatg

SEQ ID NO: 2958 - DNA, 436 bp, Diabrotica virgifera
  Clone ID: LIB149-005-Q1-E1-G8
gacccacgagtcagcggacgcgtggggcaaaaggtgacgataacatcgtcgtcatacactacacctaaccttcaaaatatcagattgggatcaacaggtcgtatcgccatggctgggaaaggagatattggtttaattggtctagccgtcatgggccagaaccttattctaaacatggcagatcacggattcaccgtagtagcattcaacagatccatagaaaaagtccaccattttcttgcaaatgaagctaaaggaaagagtatactcggagctgaatcaatcgctgatttgtgctcaaagctgaaaagtcccagaagagtcatgttgctcgtcaaagcatgagatgctgtagatagttttatcaaccaattggtgccacatcttgaaaaaggagatattacattgatggaggtaaatcagaataccaggacag

SEQ ID NO: 2959 - DNA, 375 bp, Diabrotica virgifera
  Clone ID: LIB150-038-Q1-E1-D7
aaaccaacttgcacttgccgatgttcagagttggtaaggagtggtcgtatagttttaagaagtatttttaaaagtattacagtgaacaaaatgtctgatgtgtatatagttgcggcctgtaggactcctatagggagctttcaaggacagtttgaaaaacattctgccgttgacctaggtgctgttgtgattgcagaagctattaagcgagcaaatcttcaaccagaagatgtacacaaagttatcatggggcaggttttaactgctggtcaaggtcagaaccccgcaagacaagctgcattggccgcgaaaattcccacaacttgccccgcgcttaagttagattttctttgcggatcaggacttagcactgtt

SEQ ID NO: 2960 - DNA, 366 bp, Diabrotica virgifera
  unsure (1)..(366): unsure at all n locations
  Clone ID: LIB149-006-Q1-E1-G11
acccacgcgtccgcccacgcgtccgcttatccacacacaaattgtttcctggtgtgcttttctgtcgataaaaatttggcatcctatgacaacgttattctaaaatgggtaccagaagttagacatttcagcccaaatgttccaattcttctagtagcgacaaaaaaagacttacggacagatcccagcttggcttgctacacgcccgaagaaagcaaaaagctgaaacgaagggtcaaagcgcaaggctacatggaatgctctgcgttaatgaacgaagggttgggagaggtcttcatcgaagctatacgggtgtttaaaaagacaaanacaaaaaaacagttgctaggcactgtactgttttgt

SEQ ID NO: 2961 - DNA, 425 bp, Diabrotica virgifera
  Clone ID: pGUT3045
tggaccatggatttgaaaaatgctaaggtctttgaaagaaaacctgaaggcaaccgaacacaaccttgaccatctcagatgatgatttcatgccaatggctgaaggaaaacttaaccctcaacaagctttcatgaagggaaaactcaaggtcaccggaaacatcatgttggcacaaaaattagcacctcttcttaagaccaatgctaaactgtaaacgtcactttaaattaagtttaaaatgaatatttctgttaaactatttttttacgttgtgtctggtatagcaatgcgaggtgattgttaaaaattatattttttttgttaagctgttatctctattttagcagatttttacactctttgtctaagggaactgatgtttatattatacatcttatatattacttgaatatataaatttaaa

SEQ ID NO: 2962 - DNA, 421 bp, Diabrotica virgifera
  Clone ID: LIB150-032-Q1-E1-C8
acgacgcgtccgttaaaatataacctcattatggaatatggtaggataccgtcagttcattctattacctatgttacgcctatgcgtccatatgagagtgtccgtttagatcaagaattgaatatcatcggagcctttggtctcagatacaaatgtgaattatggagagtttaatacactctatccaatttccgttaggccgccatagaactgcttactctaaatgagaatgaacccatgtggttgtatgaaagtaatgcacgcttacgtcgtgtggttcgtattggagtattaaacgagaatagaatgaagctctattacttaatgggtcacaagattgagcatgtcttgggaagacgtctgctggcagcagtcttcatatctggtctaggtaagtcaatccatcatgctatggtattga

SEQ ID NO: 2963 - DNA, 435 bp, Diabrotica virgifera
  Clone ID: LIB150-003-Q1-E2-E4
acgtttctagaagtgaggttaaaatgtttaaaagttactatattaagaaacaaattactttaaatttaaattgtaaacaaattacagtatattaatatgtttccaagattggtaagaagagtgctagtacaaagaagttactatagtagtcaagtaaactcaaatgtacaaatgaatcctaatattaaacctttagaaaatattaaagcagatctaaatattacagactcctgtgtgaaacgtctcaaaaaaattactagtgacacaaacgaagtgttaagggtgtctgtcgaagggggaggatgttctggctttcaatacaaatttgacctagatacaaagattgaagcagaggataaaatttttaaaaaaggatggtgtgacagtggtgggtagatactaatttctttggattacatcaaaggatcgacaata

SEQ ID NO: 2964 - DNA, 456 bp, Diabrotica virgifera
  Clone ID: LIB3026-005-Q1-E1-D7
gttaactttgtgtgttttggcaggtccgatggctgcaataagaaaaaaattggtgattgttggtgacggagcatgtggaaaaacatgtcttttaatagtatttagtaaagatcagttcccagaagtatacgtgcccactgtattcgaaaactatgtggcggatattgaagtagatggaaagcaggtagaactcgccttatgggataccgcaggtcaagaagattatgatcgtctgcggcccctttcatatccagacaccgatgtgattttaatgtgcttctcagtagactcccccgactcattagaaaacatcccagaaaaatggaccccagaggtaaaacacttttgtccaaatgtgccaattattctggtaggcaataagaaggatctgcgtaacgatcctactaccattaacgaacttaaaaagatgaaacaagaaccagtaaaacctcaaga

SEQ ID NO: 2965 - DNA, 407 bp, Diabrotica virgifera
  Clone ID: LIB149-047-Q1-E1-H7
agatgcattatgatgaaagactttccccattttactaaccatgggacttacgtaaatgaggaagttgatcctttgactggacatctgtttaacttggaagacgagaaatggaaaatcattacggctaaattgacgcccacttttacatcaggtaaaatgaaaatgatgttccaaactatggtagaatgcaccgaaggtcttcaagaactcttaaaaaaatctgcagcaagcaaagaacccgtagacataaaaagcaatctctcctgtttcaccactgacgtcatcggttctgttgcattcggtgtggatataaacagcatgaagaatctcgactcggattttcgaaagttcggtaacagaatattcgtgcatacaactttggtgatactaatattcatcttcttgtc

SEQ ID NO: 2966 - DNA, 409 bp, Diabrotica virgifera
  Clone ID: LIB149-009-Q1-E1-G2
gttaatattttcagacagaaactccagaaatttattcctcttccttatactgaacctgtctttcgcatttgtagaattaatttatggagtatggagtaatagtttaggtttaatttccgatgccttccacatgtttttcgactgcactggcctgcttgcaggactagcggcatctgttatcactaaatggaaagcgaacgacaggtactcttacggatatgtgagagccgaaattatagctggcttcgtgaacggactgttcttgctctttatttctttcttcttgatgtcggaggctgtcgagcgtgcgatcgaaccacctgaggtcaaacatgaaagactgtttgtcgtatcagtcctaagtttgttggtcaatttagtaggtatctacgccttccagcacggtcat

SEQ ID NO: 2967 - DNA, 375 bp, Diabrotica virgifera
  Clone ID: LIB149-004-Q1-E1-E10
accgatagtgaggaagaaattcgtgaagcattccgagtgttcgacaaagacggcaatggtttcatctcagcagcagaattgcgccacgtcatgaccaacttgggtgaaaaattgacagacgaagaagtcgatgaaatgattcgggaggccgatatcgatggtgatggtcaagtcaattacgaagagttcgtcaccatgatgacttcaaagtgaggaaaccagagttgcattttcagctttccattgtttcatcccggctcattgtctacatttttcaacacctcgaactttttgctttgtggccgggtccactaaagtgaataacttaaccgttatttgatttacaagacaaatttaattaataaatatatttat

SEQ ID NO: 2968 - DNA, 273 bp, Diabrotica virgifera
  Clone ID: LIB3026-025-Q1-E1-G9
ccacgcatccggaaggaacaatacccctatacaggcgtagatggtcattgcaatcatgtaaaagacaaacaagtctcttcgatcagtggttacgtcgaacttgatgaaactgaaagtgctctagctgatgctctcgctaatgttggtccagtgtcaatggctgtcgaagctgatacatggcaattctatccaggtggagttttcaagagtaaacattgtggagacgctcttactcacggcttccctgctgtgggagcgactactgggtgtctc

SEQ ID NO: 2969 - DNA, 325 bp, Diabrotica virgifera
  unsure (1)..(325): unsure at all n locations
  Clone ID: pGUT1215
ctcgttaaaaattctgtattaaattaaatcagactttaaataatcgtttcacagaaaagtaatgaaaaagtgtaaaaaaattgaaaggaattttttgtcttaaaaacaagtgatttgtcatgtctggaatcaaatntaatattcttcagctccttcaccctcaccttctccggagtccataccaacttcttcataatctttctccaaagcangccaatcttcacgagcttcagagaattcaccttcttccataccctctcctacataccagtggaagaaaactctcttgggatacataaaatcgattttgtggtccaatcttggc

SEQ ID NO: 2970 - DNA, 422 bp, Diabrotica virgifera
  unsure (1)..(422): unsure at all n locations
  Clone ID: LIB149-015-Q1-E1-E9
gattgaattataagtactctttggatacttatatgccattgaataggcttatcagtattttaggtaacaaaatgcagacatgtacccaaagatacgaccgcagaccatttggtgtaggtcttctagtagctggttatgacgaatctggttctcatatctaccaaacgtgcccttctgctaatttctacgattgcaaagctatgtccattggagctcgatcccagagtgccaggacatacttagaaaaacatctggatgaattgccatctagttctttagaagaacttatcaaacatggattgagggctcttagagatactctacctccagaggttgacctcacaacaaaaaatgtctccatangatacactggcaaaggtcagacctttaaaatcctcgaagaagaagaaacttccccctac

SEQ ID NO: 2971 - DNA, 323 bp, Diabrotica virgifera
  Clone ID: LIB150-049-Q1-E1-G8
agaaatatgttgtgggctgataaatatcgtcctaaggacttatcaagtgtagactaccacacagaacaaagtgtaaatttgaaaaatcttacaaaagatggtgatttcccccatttgcttatctatggtccattgggggctggtaagaagactcgagttatgtgtttgttaaaggaattatatggtggctggagtagacagattgatcgatggaaatgatgcactttaccaccccttcaaacaagaacttagaaatcatgactttgagcagcaacgagcacatagaagtcaatcccactgatgtaggtatttacgagagagtt

SEQ ID NO: 2972 - DNA, 421 bp, Diabrotica virgifera
  Clone ID: LIB150-005-Q1-E2-B5
ccgggccgacccaaacgtcagtttttttttttttttttttttttctatattggattttattgaaaaatacaattattaatgttacatacatcccgccacaaatggagaaacggaaataaaatagtgatattgcaattaccagaaagaaacataattaggtacatcgatttaatatttattataatttttaaactagatacatacaatttaaggcagaaaacagtcacaagagagacttcactgtttccgctatgcatggtgatatggaacaaagagagcgtgacgttattatgcgtcagttcagaacaggatcatctagggttttaataaccactgatctgttagcgagaggtatagatgtacaacaagtttccctagttattaattatgatttgccttctaatagagaaattacattcac

SEQ ID NO: 2973 - DNA, 366 bp, Diabrotica virgifera
  unsure (1)..(366): unsure at all n locations
  Clone ID: pGUT2985
agtacttaaaatgtcaaataaaaaattaagtgatgctgaattacgtgaaatagccgagaatatgagtgaaaaggagtatgagtttattagtgaagatgatgatgatgatactatggatatagatgatccaaatgatcaagattcgtgttcttcttcctctaatttagaaattaacagtgatgggccagagttagaattcgaatctgatctagaatctctcaacaacgattctgaacctgataattntttaaataatcctaatcctaatatcatcttatatataaaaatctattgctgtgcgttagtctcgctaaaactcgaaaatgtgtggaccgatttggctaattttgatggtgaaatatttgg

SEQ ID NO: 2974 - DNA, 411 bp, Diabrotica virgifera
  Clone ID: LIB150-014-Q1-E1-D2
gacgacaggccggaaaattaattagaggataaaattgttttcaaaatatcctgtttaaacaattgaaatttatttaaaagacatggcggtaaatgtttattccacgaacgttacatctgagaatctatcacgtcatgatatgctagcatgggtgaacgaatgtttgcagagtagttttgcaaaaattgaagaattatgtacaggcgccgcatattgccagtttatggacatgctttttcctggatctgtgcaattaaagagagttaaatttagaaccaatttggaacatgagtacatacaaaatttcaagattcttcaagctagttttaagaaaatgcaagtagataagatcgtccccatagatagactggtgaaaggtagattccaggataattttgagttcctacagtg

SEQ ID NO: 2975 - DNA, 416 bp, Diabrotica virgifera
  Clone ID: LIB149-046-Q1-E1-H6
aaaaatgaactacgagacactaatgaagatgaaatatttagacatggttatctcagaaagtctaagaaaatggccaagttttcccttgtcagaccgatggtgtaacaaaacctacacgctagaacccgaagctcccaacgagaagccaataatcatccaaaaagacttactaatcatcatccctattaaagcaatccaccgtgatccaaaatacttccccgatccagaacgttttgatccagaaagattcagcgacgaaaacaaggataagattgacccatatacgtatctaccattcggactaggacctaggaattgtatcggttcaagatttgctctgatggagatcaagagctggtttgcacatgtactgcataattttgagatagttccaactgcagacactcaaattcccg

SEQ ID NO: 2976 - DNA, 433 bp, Diabrotica virgifera
  Clone ID: LIB150-018-Q1-E1-E8
cacacgcgtccggaaagtagaagacagaggtgttaaatagcaataattatgaaggtaaagttccttatattaccatttttggtaatattaaatttaagggccgtattttccgcaccaggagatgtaagttttattatatcgacaactgaacaaccaaaagaaggcaaggaaggagtgaccacagatattgaagatgtttacttggtgcctgtgatttatgaaatggatgtacattccaatgtaacgaatcgttacgctaagactgtgataacaaatagggtaaaaaacccagctaagtcagccaagcaaacaaccttctctgttgttcttccagaaaaagcatttatttcggaattcgtgatggaaattggctggaacaagtaccaagcttacgtcagggaaaaagaagaggctaaaaaaatttatactaagg

SEQ ID NO: 2977 - DNA, 428 bp, Diabrotica virgifera
  Clone ID: LIB150-035-Q1-E1-D8
ccacgcgtccgcccacgcgtccgcccacgcgtccgcccacgcgtccggttgccagttaagatccgtccattctattcggaggtaactaagggttgggtgatgccctttgcaggacacgatagaaagataatgcaagagactcaaaagtatttctatgaaaaagaatcgcaaagaccaattaatggtcaagtactgatgtccgttacgagtatctttacattgatttatattaatattgtattgttaacgctatttgctttagctcaattttccttcacaagaaattggttgatagaatatccccaaatcttttcttttggctacgtcaaaaaagaagagcatccttctgaagaagtcaaagcaggcggtcgctatcgtctaacattgtatggagaaggatggaaagagaagctggcaaatgtaaacga

SEQ ID NO: 2978 - DNA, 459 bp, Diabrotica virgifera
  Clone ID: LIB150-044-Q1-E1-F1
gtcgacccaagactctaaaataagtctcactaaatcacaaggagacacatgtcctgcacaaagtccaaaaaatgtttattatttaggagacaaacaggtaacttggtctgacgctattatagcatgtcaagccgttggaatgtcattagtaagtatccagagtcaagctaagcaggatgaaatcattaattatttggaagtcagaaaagtaaattacactggactcgataactccatatggatctcaggaaatagacgtctggataaagttaaatggttttggttagctgtagaacctattatatacactaatttccttcctggtgaaccaaacaattctggtgggaatgaagaatgtctaaccgtagtttactccggaaggcctggttggaacgatatcgcatgtagcagcaagttttatcctttatgcgagaaagagaattgttgtgctggttgtaa

SEQ ID NO: 2979 - DNA, 182 bp, Diabrotica virgifera
  Clone ID: LIB149-029-Q1-E1-D10
ccttgaatgcaacttcatacctcttcaaaattgtcaccaaaattcaattcattggccttctttttaaaacttcttaactggaaaaaccctggctttacccaatttaatccccttgcaaaaaatccccctttcgcaaactggcttaataccaaaaaggcccgcaccaatcgcctttccaaaaa

SEQ ID NO: 2980 - DNA, 394 bp, Diabrotica virgifera
  Clone ID: LIB149-016-Q1-E1-A9
attcattccattactcagggaaagaatctacacgaaaaacccattctccagacaattcatcatttcatggatatcagtattgaattctgaaccaggccttgacttaataagttatttaccagaattactggatggcttatttagaattttggacgattccaatcttgaagtgaaaaaaatgtgtgaaacaattttgggagaatttttaaggaaaatcaaagcagagccatctaatgttaattttggtggcatgatcaatatacttattaatcatgcccaagaaaaaggggacgatcttgtacagtttacagccatcacttggattaaggattttgttcaactctctggacccgctatgttgccgtacatgtcgggaatatttacagcattattg

SEQ ID NO: 2981 - DNA, 404 bp, Diabrotica virgifera
  Clone ID: LIB150-028-Q1-E1-H11
gttcactacagctggaggattcttatcattttatgaaatctgcgaaagagttcgaaaacaaggatggacagtaaccagggatcctgaaggaagaattgggccctacgctacccatggaaaccaatgggtttcctacgacgacatatccgaagtgaaaagaaaggcccaacttgtcaaagacctcggacttggtggaggaatgatctgggcgttggatttggacgactttagaaacagatgtggttgcggcaaacatcccttgctaaaaacactaaataaagaactgagaggaatcagaactgatatttatgtgcagaattgtacttagtgtacattaattttagacaataagtcagaagctattctttccactgagattttcaatttgatctggcaacgtcccg

SEQ ID NO: 2982 - DNA, 375 bp, Diabrotica virgifera
  unsure (1)..(375): unsure at all n locations
  Clone ID: LIB149-034-Q1-E1-F8
acccacgcgtccgatttaatttattttttatttatctgtgtgtataccaatgcacaaattattgttgatacaccaaatggtcaagttcaaggaagtgaggaagctggtactcagggtgaaccattctataggtttcaacaaataccgttcgctaaacctccaacgggatcgttgagatttagggaaccacaaccagtcgataaatgggagggtgtctttgacgctactcgtaatgacaaagtttgttaccaacaaattgccgacccagtttcgggagaaaatgaagattgtttatttgtcaacgtttacacaccgctgtatccattgccaaaccaaggattgccagttatggtctggttttacgganggggattt

SEQ ID NO: 2983 - DNA, 429 bp, Diabrotica virgifera
  Clone ID: LIB149-011-Q1-E1-E9
accacgcgtccgaaagatattgttacgacagttctgtagattgatcctacataaaagaaaaagttccttaaaatgggttggtaggtttatttgaagataccaatttatgcgctattcacgctaagagagtcgccattatgcctaagaacatccagctggctagaagaatcagaggagaaagggcataaacaaataaaatacatattaaaaatgtaatataagaaattaatcttgaaagacaagaaaggtacaccttttgcaagatgctggctagaagaatcggaggagaaagggcataaacaaataaaataaggtacaccttttgcaagatcagataattttcgacatattgtctacgcagccaacccttagtgtaatacgaggtctatatgtctcataacgcagcgaaggtgttgatttcatataaac

SEQ ID NO: 2984 - DNA, 392 bp, Diabrotica virgifera
  Clone ID: LIB150-027-Q1-E1-D10
agagccactggccagaattatttatttgtattttgtaattttgtatgatttgtatcctgtctttactgtgatttgtatcagaaatggttcattttagttgcatataatatacttccacagttttaaattacaaaaatctataatatgtctgcggtcaacccaagtaaagattcttttacttgtatatcatgtagagtcgccttcaaagatgcagagttgcaaaggaaacactacacaacagactggcacagatacaatttgaaaagaaaagtagcagagttacctccagttactgctgaagaatttcagataagagtgttgaatcagagaaaagctgacgaaatagccactcaggataaaagtgtctactgttccgtatgccgcaaatcaat

SEQ ID NO: 2985 - DNA, 434 bp, Diabrotica virgifera
  Clone ID: LIB149-013-Q1-E1-F7
gaaagtttcttttgatactacccaatctaattttataatacatgaaaattttgtcgacgaaaccctagaaaatgatattggattaataaagctaccaagttcagttgaaagtaatgagtatatacaagtaattccgatggctactgaggatcaagaagaggcacaattaggtgaactagttgtcgtatccggttggggtctcacatactatggttacccagaatctatggcaactgtaccaatggccgaatggttagtggtattaaacaatacaaacaaagaatgtcaacgctttggaaccttagttaaagatacgaacatctgctgcagtacgaccaactcttgggatggcccattgcaattgtgtgatggagattggggtgatccattggtaaatgatggcaaaaataaaacactgtatggtattgccaatt

SEQ ID NO: 2986 - DNA, 399 bp, Diabrotica virgifera
  Clone ID: LIB150-034-Q1-E1-C8
gaaagggtcaggggtgaagctagaatcgcataaataaaagaaaataatcatggctttatcgcgtttatacagtcccagccggcgattgggagcgagaattacgtttttgttcagaaattacagagaatctttcacccctcaaatagcaaatatggctgactacagagttgaaaaagacacctttggagagctgaaagtgccggtggacaagtattatggggcgcaaactgttacatctattatgaatttccccattggaggagaatttgagcgaatgccgtatccagtcattactgccatgggagtcttaaagaaagcagccgcaattgtcaacaaagactacggtttggacccaaaagtcgccgatgccatctctcaagcaacagacgaagtcatctc

SEQ ID NO: 2987 - DNA, 500 bp, Diabrotica virgifera
  unsure (1)..(500): unsure at all n locations
  Clone ID: pGUT2461
ctccaactaaaaaacacttactgaccaggcccatttgaactactttcagtgggaaaagacattctttttaaccggggtctttgacctggggaaccaaacaacatttttacaaacaaacaattcctatttactcaaacttttcaatggttttccagccaatttaaacttaaaaccccttttaatactgcccaaaaaaaaaaaaaaacctgggggggggcccgggccccaattgccccttaaggggggccttttaaaaattaagggcccggtttttaaacaatnagtccaactaatgaattaaatgattgtaatttttgatgatttgatgttgataatcgaattgctgtcccatttgaaactaatattcgaatattacttactgtagcagatgttattcattcatgaactatttcttcattaggaggaaaaatttgatgcaacacccggacgttttaaccaaattaggttctcacttatacgattaagaattttttttggac

SEQ ID NO: 2988 - DNA, 389 bp, Diabrotica virgifera
  Clone ID: LIB149-005-Q1-E1-E12
aaagaaaaataggaaactaagaggacatgtaagccacggtcacggccgtatcggcaaacaccgtaagcatcctggaggtcgtggtaatgctggtggtatgcaccaccacagaatcaacttcgacaagtaccatcctggatacttcggaaagttgggtatgaggaactaccatgtaaggaaaaactccaaatggtgcccagctattaacctagacaaattatggacactagttagtgaacaaactaggttaaaatacaaggaaaatccagagggaaaggccccagtcattgacattgtcaaagctggttactacaaacttcttggcaagggtcgcctacctgaacaacccgttattgttaaagctaaattcttctcaaaaaatgcagaag

SEQ ID NO: 2989 - DNA, 393 bp, Diabrotica virgifera
  Clone ID: LIB149-048-Q1-E1-D12
gcgggtcgacacaagactctatcgagagtcgtagcagataaaaattgtacagaaaaattagaatatacattatcagatcacttacaagattttggatcaaaattaacaattcagttgccccaaaaagaagttaaaaaaattcatatcgagtatgaaactgcccccgacgccagtggtcttcaatggctccagccacaaacaaccgcaggaaaaatacacccatttttatttagccaatttcaaccaacacatgcaagatctgtgataccttgccaagatactccagctgttaaacatccttacagagctacaatttctgccccaaaggaattggaagtgttaatgtcggctatcaatgaaggatccaaggtgattggcgacaagaagcaatat

SEQ ID NO: 2990 - DNA, 341 bp, Diabrotica virgifera
  Clone ID: LIB150-021-Q1-E1-B1
aggcattgtggtgcaaaacgtacaaaacttatcttaccttttaaaagttattaagaaaatgtctggtcccggtcgtaacgattgtagaatatacgttggcaatcttcccccagatatacgcaccaaggacatccaggatctcttttacaaattcggaaaggtaacttttgtcgatctgaaaaaccgacgcggtccgccatttgcatttgtcgaattcgaggatccaagagatgcagatgatgctgtccacgctagagacgggtaccattatgaccggtaatgattacgagtaagatttccccccggaaggcgcggcaaatggtgggggggggggtttaaag

SEQ ID NO: 2991 - DNA, 393 bp, Diabrotica virgifera
  Clone ID: LIB150-018-Q1-E1-A1
aaaatgcaacacgacgacgttgtttggagtattataaacaaaacacattgttcatacaagactcaaaccaagacacaaaagttttgccgtaacgaatataaccttacaggtctgtgcaacagatcggcttgtcccttagcaaacagtcaatatgcaacgatcagggaagaaaatggtataatctatctgtttatgaagactgccgagcggtcagcgtttccaaataagacctgagaaaaggtaaaactatccagaaactttgaaaaggccatacatcaaatcaatgaaaatttactctattggtctggttttattaagtcaaaatgtaagcagaggttcgtaaaaataacacaatacttaattcgaatgagaaagttgaaattacgaagacag

SEQ ID NO: 2992 - DNA, 244 bp, Diabrotica virgifera
  Clone ID: pGUT2597
gtaaacaacaaggttttggtggacaaactaagccaattttccgtaaaaaggcaaagacaaccaaaaagatcgtattgaggatggaatgcagtgattgtaaatttagaaaacaaattccacttaagagatgcaaacattttgaacttggaggtgacaagaagcgtaaaggacagatgattcagttctaagttattaaaccttgtttttaagttaagacctcacaaaataaaccaagtttgtatat

SEQ ID NO: 2993 - DNA, 278 bp, Diabrotica virgifera
  unsure (1)..(278): unsure at all n locations
  Clone ID: LIB150-015-Q1-E1-B3
gtttttaaaaaaaagagttcgattaaacccaagtttagctaaatacagttcttctgcacctgggggctacaattttactcttaatgacactcaacgggaattccaggaattagctaggaaattcaccagagaagaaattatcccagtagcagctgaacatgataggacaggaaaatatcctttggacatccttaaaaaggcttgggccttggggctcaccaataatcatattcctgaaaaatatggtggtatgggaatgggagtnatcgatggatgtg

SEQ ID NO: 2994 - DNA, 467 bp, Diabrotica virgifera
  Clone ID: LIB150-013-Q1-E1-A7
agttaagagattcgatttgggtattcgaaaaaaggtgtgtgcgctagttcagttcaaattacagttctttgtgtgacggttaaataataaattgtgtaaataactgaatatgagattaattattttggataaagctgaagaggttgcggaatgggcagccacgtatataatgaaaaggatacaagattttaaaccatccgcggaaaaatattttgttcttggactcccaacaggaagcacacctctgggaatgtacaaaaagctgatagaatttcagaagcaagggaaaatatcattcaaatatgtaaaaacctttaatatggacgaatacgttaatttaccaaaagaacacactgaaagctatcattactacatgtggaataatttttttaaacatatagatatacaaccaaataatgttcatttactggatggcaatgctgcagacctaaatggtgaatgtcaaa

SEQ ID NO: 2995 - DNA, 438 bp, Diabrotica virgifera
  Clone ID: LIB149-049-Q1-E1-F7
aatttatattattaaatcaccctttaacttgtggtttaatattattaatacaaacaattttcacatcagttattacaggattaataaattataattactgattttcttatattttatttttaattatagtatgaggaatattaattctttttatttatataaccagaattgcttcaaatgaaaaatttaaatttaattttaatataactttaataataattagaatttttattattatttctatattaagatttattttagattatttttattttaattcttttataaaaattatagaaatgaataaccaatttaatattattaataataaattatctttaattaaatattttaattttccatataaattaatcataataataataattatttatttacttatcactttaattgcagtagtgaaaattacaaaatttt

SEQ ID NO: 2996 - DNA, 398 bp, Diabrotica virgifera
  unsure (1)..(398): unsure at all n locations
  Clone ID: LIB150-005-Q1-E2-H9
cgaaaattctggaaggaaaggaaatttcgataccagttacaaagcaagtgtttagttcgtgaataagttaaatatatttatcatttaccggtaaaatggaacaggtcgcagttttgaaagataaaggaaatcaagcactttccgcaaataagatagatgaggcacttaaatattacactgaagcaattaacctagatccacagaatgccgtcttatattcgaatagatctgctgcttatgctaaagcgaatcaatatgatctagccctaaaagatgctgaaaaagctgttgaaatcaagccggactggtcgaaggcttattctangaaaggtgctgctttgtcctatttaggtagacacgatgaagctattactacgtatgagaaaggatttggaata

SEQ ID NO: 2997 - DNA, 208 bp, Diabrotica virgifera
  unsure (1)..(208): unsure at all n locations
  Clone ID: pGUT1665
cagcggacatctgtcaccgggaaatgtggtgttagggagggtccatttatcccgagatcgtgcggtgcgtccaagtccttcttgaacggggccacagcccatagagggtgccaggcccgtantgaccgttgccgattgcgggaggatctctcctcaaagtcgggttgcttgaaagtgcagccctaagtgggtggtaaactctcgtgcc

SEQ ID NO: 2998 - DNA, 313 bp, Diabrotica virgifera
  Clone ID: pGUT472
gttaatatttgtatttgctgctgtttttgtcattgctgaaatcaataaaattccactgaagaaatttgataagccgagggatgcacttaacagaaatggactaaaggatagattattagccaaatacaatacacatgtcagtgacgatagcgccgtcgttttaactaactatgtagatgctcactattatggagaaattggtagtggaactcctgctcaaacctttaatgtaatttgcgacactggttcatcgaatctctggattccgtctagttaatgtggatttatggaagttgcttgcttacttcataac

SEQ ID NO: 2999 - DNA, 365 bp, Diabrotica virgifera
  Clone ID: LIB149-042-Q1-E1-E2
aggctgggtgataggtgtagttattaaagaataaattatctaggttttattaacaatagaagtgaaatgttagcaaatataacatccaagtttcgtaattgtacttgctcagttagaaaatattctgtagtttcactatcttcaaccgaaaatagaataaatgtagaacctcgcgaacttgcctttcctccaaaatatcaagaacctcgacaagtttggttggagagtttagatacgatagacgacaaaaaattgggtattcttgagctgcatcctgatgtttttgctactaatccaagaatagatattatacatcaaaatgttagatggcaaagtttatatagatatgtaagctatgctcatac

SEQ ID NO: 3000 - DNA, 449 bp, Diabrotica virgifera
  Clone ID: LIB150-019-Q1-E1-B12
cggacgcatgggcggacgcgtgggtgaacttggaggtgattttatttgtattttttggtgttgttttaaattacagtaccgccaatgtcgtccacaaaagattcgagtacaaatattcattcaaacctccatacctagcccaaaaagatggatcagtgccgttttgggaatacgctggaaatgctattgccagttcggaaaatgtgagattggcgccttctctaagaagtcaaaaaggagcaatatggacaaaaaaccccatcaatttcgactggtgggatgtagatatctcatttagggtaactggaagaggcagaattggagccgatggattagcattttggtacacccaaaataaaggctcagtcactggcgaagtgtttggttcatcagatcaatgggttggattaggtctattttttgattcatttgacaatgacaacaaacac

SEQ ID NO: 3001 - DNA, 408 bp, Diabrotica virgifera
  Clone ID: LIB150-010-Q1-E2-C1
gatggacaagaccttctcacctgtcagaagacaacagaaacagtattggcatacgtctacaaagctcttgctgatcacaacgtctacctcgaaggaactctcttgaaacccaacatggttacagcaggtcaatcctctgcaaacaaagccacaccagcacaagtagcagaagccacagtaaccgctttacaacgcagattgccccctgcagttcccggtgtcaccttcttgtctggaggacaatccgaagaagaagctaccgtcaacttaaacgccatcaaccaattcccaggaaagagaccgtgggcgctaactttcagttatggacgtgcccttcaagcttccgttctccgcgcctggggaggaaaagacgaaaacgtcaaagctggacaagaagaattgatgaaa

SEQ ID NO: 3002 - DNA, 402 bp, Diabrotica virgifera
  Clone ID: LIB149-022-Q1-E1-B11
agggggaaacagcagaagaacatatgactaacttgagggaagttcttagcaaacttgaaaaggctgggctgacagtttgtaaagaaaaatgtgtattttttaaagaggaagttgaatacttggggtacaaaatatcaaaagaaggccttaagaaaacagatagtaaaattgctgcaataataaatgcacctaaaccagaaaatataacagaagttagagcttttacagggctagtaaattattaccataaatttatacctcgggctgcccagatcttagaaccaatatacaagcttttaaaaggtaatgtaaagtttttctggtcaaaagaatgtgaaagggcattcaatattataaaagatataatagcatcagataattgtttagtttaatttgaccctg

SEQ ID NO: 3003 - DNA, 430 bp, Diabrotica virgifera
  Clone ID: LIB3026-011-Q1-E1-B7
tcattatgataagatttttatttagattaatttttttgattcctttatgttttaaaaaaaatttttgattaattcaatgattaatatttttttttacatttttatttttttttaattatggtagaggtttaaattatttctctatttcaaatattttaggtattgatttttgatcttatagtttaattttactaagattttgagtttgtactttaataattttagctagaggaaaattatataaatatggaatttattcaaatttatttttattagtattaatttttttaatattaagtttatatttagtattttcttcattaaatattttcattttttatttattttttgaaattagattagtaccagttttattattaattattggttgaggttatcaaccagaacgtttagaggctggaatttattt

SEQ ID NO: 3004 - DNA, 278 bp, Diabrotica virgifera
  Clone ID: LIB149-026-Q1-E1-H5
tacaacaccatatagtgagtcgtattataaatgtgttaaagtatcaggagctgtctatttttacaatcaagatttattaaacctcatttctggcatttatggtaaaactgcttacacaaatcctttacatccagatttatttcgcggagtatgcataatgcaaacacaagttactacaatagcatctactcaatttcatggataccagagtgtacatggatctatgacaaatggtggtacctaatcaatactgatagcctgcaaggcatacaaagact

SEQ ID NO: 3005 - DNA, 454 bp, Diabrotica virgifera
  Clone ID: LIB150-029-Q1-E1-A2
ggtcgacccacccgtctgaagatggtaacctttatccaaaagatcctaagaagagggctattgttgaccagagactgtactttgatatgagcactatgtatggaagacttgctgattattattatcccgtgatcttcggtggagccagttacgatcccgacaagttggaaaagatcaaagaagccttcagcttcctcgaccagctcattgacaacaacgactttgctgctggcagcaacctcactttggccgacttggcccttgcctcatcagtttccacttacgagctgctaggattcgatttcagctcctacaaaaacgttgtcagatggttcgagaaagcaaaagccacgattcctggatacgaagaggccaacgctgagccgctccagcagttcaaagctttgatggagaagttggcaaagaagtagataggattggatacagtattatt

SEQ ID NO: 3006 - DNA, 185 bp, Diabrotica virgifera
  Clone ID: LIB3026-003-Q1-E1-G4
atttccaatgacagaatcctgatcaagttggcatcaacatgggaaggaatccaagctgcaagagagctcgaaaagaaacacggcattcactgcaatctgacattactcttcaactttgcccaagctgtatcttgtgctgaagctggtgtcactctcatctcacctttggtcgggcgtattcttga

SEQ ID NO: 3007 - DNA, 386 bp, Diabrotica virgifera
  Clone ID: LIB3026-033-Q1-E1-B2
acgcgtccggcaggagaagataaattaataaaatatgggtattacagacgatgtacatcttcccactgaagaagaattaacagttcaggaaatccctttatccggcccagcacttaaagcgggtgcctttcatgtaggaaaaacttgcgaatgggaaaataatgagtttattctctgtcgcgatgagttgaaagatccaagaaaatgtataaatgaaggtaaagcagttaccagctgcgccatgaacttctttagaaagattaaagcaacttgtgcagatgaattcatgcagtatgtaaactgtcttgacaaatctagccctgatcaggcccttgtaccatgtagaaaaactcaagccgttttttgaaaatgtgtaaaagataatc

SEQ ID NO: 3008 - DNA, 292 bp, Diabrotica virgifera
  Clone ID: pGUT218
gtgaaattggaggtgttgctgaagaacaggctgctgattatctgataaagcacaactctggttcaaatgctaaaccagttgtgtcctttattgctggtctgtctgcgccacctggacgtcgtatgggtcacgcaggtgctatcatttctggaggaaaaggaggtgctcaagataaaatcaacgcattggagaaggcaggcgtaatagttacaatatctcctgcacagatgggcaacgaattgttgaaggaaatgcgtcgtttgggattagcctaagtatgtttgactgtatg

SEQ ID NO: 3009 - DNA, 435 bp, Diabrotica virgifera
  Clone ID: LIB150-019-Q1-E1-A2
cttatggtacaggtgcagcttggttacattatcaagcatttcggctagacacaatagcagtatggcaactgaaaacgaacaacgagactgtcctgacgatttggaatctgtctaagaagaggaagttgatggatccaaacagttggatttcactaacgtttatgctgcacttcaaagtcagatgaatgctgcgatgcatgcactcttgcctacctcagttaagataagaattacagctctaacgagaatccaattagaggcaactaatattgaagctaaattcttcaaagaggtacataatctagaatgtaaataccacatgttgtaccaacctctttaccagatgagaaataccattgtcagcagccaatacgaacccactgatgaagaatctcaatggtcgtctgatgatgagtcagatcttccagaagccat

SEQ ID NO: 3010 - DNA, 440 bp, Diabrotica virgifera
  Clone ID: LIB150-011-Q1-E1-E11
caaagtgacagcttaatacaatttaaattatgaagtgtaagtgtgcatgtttaaatccaaattctgatgaaaatgaaggtaaaccaaccaaaaatccacacctatccaagatgcaaaacgactacttataccacattgcgttagacactgaaactatgaatctggttgatgcatttcaagatactaagtttgtttgtatgggaggatctccgacaagaatgtacgcctttgctaagctcatagctcacgaaatcggccatgaactaccttttggcacaaaattaatggatatcagtgaaaaagctgataggtttgctatgttcaaagttggaccagttatatcagtaagtcatgggatgggttgcccgtcgataggaattcttctgaatgagctgattaaattgatgtactacgctaaatgtaaaaacccggtattcttc

SEQ ID NO: 3011 - DNA, 425 bp, Diabrotica virgifera
  unsure (1)..(425): unsure at all n locations
  Clone ID: LIB149-049-Q1-E1-H5
atctaaatgaaaattttattatttaggatagaaattttcaatgaaataattattaattagaataattttttcctgatttataaccatgacagaagacgtccaaagacattctgttcacactcttgtgttcaggtctttaaaacgatctcatgatatgtttttagccaaccaaggaattctgccatcaattgatgatactgcagaaaaaatacgaaggttggttaaggcaagagactcttatggtatggtattcgatgacgtaaaagaatgcaagcaataaaaaactgagggacgctgaagctggtcaanatccaccccctcctgaaacagcagagactccagatggtcagccagcagacagtgcattggttccttacacggataatagtttagtattaaaaagccaacaaaatactaatcagaat

SEQ ID NO: 3012 - DNA, 444 bp, Diabrotica virgifera
  Clone ID: LIB150-001-Q1-E1-C7
cccacgcgtccgccacgcgtccgcttcaatccaaaggctacaaggtggtcaccggtggcactgaccttcacgtattgttagtcgatctgagatccgcaggcttgacaggatccaaaggagagtacgtgctggaagaggtcaatattgcttgcaacaaaaataccgtgcctggagataagagtgcatttaatccctctggaattagattaggaactcctgccatgacaactcgcaacatgaaagaaaaggatatcgatcaggttgtagacttcattgatagagctttgaaaatagccaaagaagcaacagccctttccggacccaagcttgccgattttaagaaagtgattcatgaaaatgctgacatcagcaagaaagtagcaactttaaaggatgaaataaacagatacagcgaaaagttccctcttccggggtatcctgaat

SEQ ID NO: 3013 - DNA, 408 bp, Diabrotica virgifera
  Clone ID: LIB3026-013-Q1-E1-E9
gtagatttaaaaggagtccatccagatgaagcattttcaacagtcccatatgaaaagggtcaaacattccttaggtatttagaaaaaactgttggtggtccagataagttcgagccgtttttaagatcctactttgataccttcaaatacaaatctattgacaccacagattttaaaaacttttttgaaaattactttgaaagtgaacctgaaatcaaaaatatcgattgggacaaatggttgcataccccaggaatgcctttaaccattccagattacgatacttccttggctgaagcctgtgatcaactcttggagaaattttacaattggacgggagaaggttctttgccaatatctgctgaagaaaagcaacaacttataccagaacaactaatatactttttg

SEQ ID NO: 3014 - DNA, 422 bp, Diabrotica virgifera
  Clone ID: LIB3026-035-Q1-E1-G9
ctaaaatatttttgaaaaatattgtttaagtgcgattcataaattaaaaatgagtttagcggaaatatgcggcttgtcagactacggctcacacgagagtagattgtataaacatgatttacaacaattttgcactaatttcaatagtaacatgaatctagaagtgcccccctttgaaagtcctgccaccaacttatctagatttacaaaagatgatactggaaaggctctaaaaattaattttgatcatggtaccacaaccttgggattcatgtatcagggaggagttgtacttgcagtagattccagagctactggaggccagtttattggttcacaaacaatgaagaaaattgtagaaatcaatgattttctgttaggtactctggctggaggcgcagcagattgtgtctattgggaca

SEQ ID NO: 3015 - DNA, 347 bp, Diabrotica virgifera
  Clone ID: LIB150-031-Q1-E1-A1
cgtatcctaaccataacctaaaagtacaaataaatttagcaggatttaagaaaaaattttaatagtgttattaatgaattaaaaacataataaataacaaaaatgtctactagatggtatcccatatatcaaaaaggagggccccaattgagggtgttccttccaaacttctggatgaaattggttcggcctcctcatgcgcaacctgccaacatcgttaccttttcttgttctatggaaatgactaaacacgatataaaaaattatttagaaaaaatatatgaggttaagtgtgctgatgtacatactaagatacacatgcccaaaaccaaaagagagaaaacaca

SEQ ID NO: 3016 - DNA, 406 bp, Diabrotica virgifera
  Clone ID: LIB150-032-Q1-E1-D8
agaaataattaaaataataattattataagggctaaatctaactaaatcagttttatattgttatacaaacatcacattttaaaaccaattaatttggtgtagttgcagcttaaacaaatgtgatacaatatgtctaaagtagaatattctctatagatgctctcgtattttaggtgtagttatttccacataatttttatacaaataggacccaaatacaataaagatgtatataagtgatttacgtattgctgtaatatgttctagtaacatgaaccgtagtatggaagctcacgcttttttggccaaaaagggatttgatgtcaaatcttatggaacaggtgataaagtgaaaattccaggttcttcttttgataaacgcaacgtttatgaatttggaacctc

SEQ ID NO: 3017 - DNA, 384 bp, Diabrotica virgifera
  Clone ID: LIB150-036-Q1-E1-B2
tatttcgctgggtgggcagacaaaattgaggggtctacgttaccagtatcccacgcgagacctaacagaaatctctcgtttacaaagaaagaacccattggtgtatgtggattggttaccccatggaattacccattaatgatgctttcatggaagatggcagcttgcctggcagctggaaataccgtagttattaagcctgcacaggtttgtcctttaacagcattaaaattcgcagagttatcagtaaaagctggaattccaccaagggttatcaatgttgtgaccggatcgggatctgttgctggacaagccatagccgatcaccctcacgtcagaaaattgggattcacgggaagcacagaaataggacaagtcataatg

SEQ ID NO: 3018 - DNA, 386 bp, Diabrotica virgifera
  Clone ID: LIB3026-031-Q1-E1-E2
atttgaaaaacccttcttgtggttggctaggaaactcattggagatcccaacttagaattcgtagctgcacctgccttgcttcctccagaagtccagatggatccccaatggcagcaacaaatcgaaaaggatcttaaagaagcctcagaaactgcactgcccgatgatgacgaacatttataaactcattaaccaattactaaaactctgtcatcgttccaaagcgcgtgtgtaacaattgatatcttacaatgacttaagttaaattacattttatgtatttctgaagcagaactgttgatatttttatataaatgttttctaaatttgttgaaaggtttgtctggagtctggacgtatgttcttcaagatattagtggtatgg

SEQ ID NO: 3019 - DNA, 405 bp, Diabrotica virgifera
  Clone ID: LIB149-037-Q1-E1-C9
aggaagctcaagatgtcgtcgcatttggtgtggggaattatccgcaataacaatgcttttcttctgaagaaaagaaacatttccaaaccttttagcactgaagctaacaatctcacaaacttgagctcataccgttacaatggtttgatccacaaaaagtctgtaggaattgtagatgctgctgacaaaaaaggattcacagttgtttacaagaaggccagcaaacaacacaaacctaaacaaaacgttgtaaagaggacaatgaagtctggccccagaagatctttacataagttaaagagattgttgaatgccaacaaatacagaacagaccttaccaaggctgcccttcgcagagctagtgcagttctaagatcacaaaaacctttaccagccaagaaacag

SEQ ID NO: 3020 - DNA, 200 bp, Diabrotica virgifera
  Clone ID: LIB150-001-Q1-E1-G7
gcgcggtctgttaacagccgattacaagtactctaccatattcttttgagaaaagttttaaaagaataaaacaaaatgtctctcgctgatcccgttgcctttatgaaggatttcctcgctgaaggtatttcggccgctatttcaaaaacatgtgtacctccaatcgaacgtgtaaagttgcttttgcaagtacaacacat

SEQ ID NO: 3021 - DNA, 462 bp, Diabrotica virgifera
  Clone ID: LIB3026-012-Q1-E1-C3
cccgagtgccccacgcctccgctagaaacaagagctgccaaaagtgggcttgccgcagaaactcaaaagagggtaaacgccaaatacagcgaagacttggctaaagaaagtctcgaatggatcgtgacgatcacaggagacgaactgaacacagctggtgatatggacaacttttatgaagtacttaaggatggaaccgtattgtgcaaattagtaaataacatccaacccggtatcgttaagaaaattaacacctccacaatggctttcaagtgtatggaaaatatcaacgccttcctagaagctgccaaacaattaggtgtaccacctcaggaaacattccagactgtagatctatgggagaggcagaaccttaactcagttgtcatttgcttacaatcattaggcaggaaggctgacaaatatggaaaacaatccatcggaccaaaagaagccgaaaag

SEQ ID NO: 3022 - DNA, 400 bp, Diabrotica virgifera
  unsure (1)..(400): unsure at all n locations
  Clone ID: pGUT3858
attcagatgaattttttatggaattatgaatttgtatatatttgtaataagaattttataattccctttaattactattagttatgtaaatatgtccgaattggagttacaagaggaagagagggaagctctgtcatcaatatatgaaggagatgatctgtttaaacagattgataagtgtacatatcaatataaatatggtgagcatgatacaaataaatcctttgtattggaaattaaatgggttgagcagtatccaaatgagttaccagttatgaatatggacacattttacaataatcacatagtaacatcattaaagcagaagatagtagaaatgtttaggactgaagctgaacaatacttangaatgtctatgacttactctctatttgaattt

SEQ ID NO: 3023 - DNA, 460 bp, Diabrotica virgifera
  Clone ID: LIB150-029-Q1-E1-E2
ctgaaatcaacatgattgctaaggttgtacttgtttgcgcattcgtagccgttgctcatggagtaggcatttctgtattagatggaggactgggactgggtttgggtggtcatggtcttcttggatctggagctcttgttactggacattcagttgctgtagcccaaccatcagtagatttacatgcaccagccaattatcaattcaaatatggagtccaagatgctcacacaggagacaacaagcaacaatctgaagtgagagtaggggataccgttagaggagaatactcattagctgaaccagacggcaccataagagttgtcaagtacactgctgatcctcacaatggtttcaacgcaatagttagtcgagttggacacgctgcccatcctcaagtagtccaaagaactgtagtagctgctccagttattagccatgctccagtcatcgcacacgc

SEQ ID NO: 3024 - DNA, 317 bp, Diabrotica virgifera
  Clone ID: LIB3026-029-Q1-E1-C4
aaagagcaaaaaaattaaaatttttattgtgaaataaatattttaaataatttttttgtaatgaaatgttattcgtttttaaatatatctaattttttaagaaataaatgagatggagttattaacaatatatttataattaaatagttttatattattaatattaaatatttttagggatgagcttaaaaataaaattttattaaaatttaatttttaaataaaaattaggattaaaaattttcatattttaaaatatgtcattatttagttttatatagtatcacttttagtttttataaattttttactaaaat

SEQ ID NO: 3025 - DNA, 394 bp, Diabrotica virgifera
  Clone ID: LIB149-040-Q1-E1-E10
aggtattcgttgatgaagttgcacaagcatgtgaacctgaagtttgcatagccttaggtatggttaaacatggacagcagatagtattggccggagaccccaagcagcttggaccatcattaacttctgattctgcgatccgatatggcttaggtatatctctccttgagagaattatgcaaaccgaattgtatcaccaacataaccagcggtgtatcaccatgttgatacagaattttagaaaccatccaaagattctaacgttgcctaacgagctgttctacggagaccagttgcaggcccagtcacaaaggtcattattagaccccttagcaacaacttgcgtcttccaaaagctacaagaaatgtacagtgttgcgggaaagaagaactc

SEQ ID NO: 3026 - DNA, 322 bp, Diabrotica virgifera
  Clone ID: LIB150-040-Q1-E1-B5
gcaaaactctagactgcgtctgaggagagttgctaaagtaaaggtatgatattatagagtatataatatagaagcagagtatagtttattagcatagtatcaagattcggtcaaatatgagttacggtacaccagcgccgcgtattgactgcatggcctcattaaaagtcgataacttaacctatcgcagaactccagacgatgtaaggcgcgttttcgaaagatgcggcgatcttgcggatatttatataccaagacatcggttcagcagagaaagtagatgctttgctttcgtacggttctatgacaagatagatggctg

SEQ ID NO: 3027 - DNA, 322 bp, Diabrotica virgifera
  Clone ID: pGUT3895
atttgcgataacaaagatatcaaagcgatcagttttggcggatctgatgtagctggaaagtatatttatttcagaagaactggccatggaaagaaggtcccaatcaacatgggtgccaaaaatcatgctgttattctgccagatgctcacaaagaatctgcattggaccacatcatcggagcagcattcggagcagctggccaaaggtgtatggctctcagcgtagtaattatggtcggagaagctcaacaatggatccccgacctagttgctaaagctaaacaactaaaaagtaatgctggacatgaaccacgaactgatg

SEQ ID NO: 3028 - DNA, 388 bp, Diabrotica virgifera
  Clone ID: LIB150-020-Q1-E1-G9
aggagagttctggtcttgctcgaaatgtacctttttcaaggtcatgtcgtggttcagggtgatggatctgagcttggagccgtaacaggcttcgcagaccagagatcgctcgctgttgaccaagacatgaccttgaaaaagggagagttctggtcttgctcgaaatgtaccttgaaaaactcacttaacaacttagtctgcaaagcgtgcaagacggacaaatatccagaaactatgtcttctaggagtccgtctcctcgccacgatagatctaaaaggaatatggttaggggtgcgactagttcgaaggtggtgcaaagtactcgaagtatagctgtcgttaagggcaaagttaatatacttacagatttggatcacaattcaatca

SEQ ID NO: 3029 - DNA, 403 bp, Diabrotica virgifera
  Clone ID: LIB3026-028-Q1-E1-B10
agggatttggaaggtacaaaatgaccaactctaaaggttaccgccgaggaaccagggatctatttgcccgcaagtttaaaaaacgtggtgtaattccactttccacatagttgagagtctacaaagttggagatattgtagatatcaagggtaatggtgcagttcaaaagggtatgccccacaaagtgtaccatggtaagacaggacgtgttttcaatgttactgcacatgcattaggtgtaattgtaaacaaaagggttcgaggaagaatcatccccaaaagaatcaatctccgtattgaacatgtaaaccactccaagtgtcgtcaagacttcttgcaaagagtaaaatccaacgaaaagctacgtaaagaagctaaagaaaagaacgttaaagtagaact

SEQ ID NO: 3030 - DNA, 401 bp, Diabrotica virgifera
  Clone ID: LIB149-044-Q1-E1-B9
aaagaaatttgcatccataaacgacatttagacttttgtcgcttattacttttggtaatcgaaaaatgttggcgattcatggcattgtttgtggttgacaccttcgctgcgtttagagatatttataaacttgcgtgaactgcgttacgacccacatatgtttaacaaagccatttaaaggctgcttgattcgaaaattaaagatattgttacgacagttctgtagattgatcctacataaaagaaaaagttccttacaatgggttggtaggtttatttgaagataccaatttatgcgctattcacgctaagatagtcgccattatgcccaaaaacatccagcttgctaaaagaatcagaggagaaatggcataaacaattgttatataagaaattaatct

SEQ ID NO: 3031 - DNA, 384 bp, Diabrotica virgifera
  Clone ID: LIB3026-001-Q1-E1-B9
gcgtccgataacattgtagaaatcaatgatttccggtaaggtactccggctggaggcgcagcaaattgtgtcaattgggacagagttctggccaagcagtgtagaatgtatgaactcagaaatagagaacggatttcagtagcggctgcttctaaattaatggcagatatggtttacaattataaaggaatgggattgtcaatgggtatgatgttaactggatgggacaaaaggggaccacaattgtattacgtggactcacaatgtctgaggacagcacgaaaagttttcaatgttggttccggttccatatatacttttggtgtacgagactctgggtacaaatgggatcttacggacgaagaagcatatgacttgggccgt

SEQ ID NO: 3032 - DNA, 435 bp, Diabrotica virgifera
  Clone ID: LIB150-030-Q1-E1-F6
cacacgcgtctggtcgtcacttgtggtgagttgctaaaataaaaatattatattatagagtatataatatataaaaagaatatagtttattataaaagtatcaagattcgttcaaatatgagttacggtagaccaccgccgcgtattgacggcatggtctcattaaaagtcgataatttaacctatcgcacaactccagacgatctaaggcgcgttttcgaaagatgcggcgaagttggcgatatttatataccaagagatcggttcaccagagaaagtagaggctttgctttcgtaaggttctatgacaagagagatgctgaagatgcgttggacgccatggatggcaggatgttggatggaagggagctcagagttcaaatggctcgctatggaaggcctacatcaccccatcggaggtacggtcgtcgccga

SEQ ID NO: 3033 - DNA, 402 bp, Diabrotica virgifera
  Clone ID: LIB3026-029-Q1-E1-C2
cagagctggatttggataaaaaggttgtagtttaagtatggtagggtctagggtttatgtaggtggtctgccctatggtgcctcggagcgggacctggagcgattctttcgaggatacggccgtatgagagatgttttaattaaaaattgatatgggtttgttgagtttgacgattatagagatgctgatgatgctgtatatgaattaaatggtaaaaaacttttaggggagcgagttacagttgagagggcaagaggcactcctagaggtcgagaccagtatgcatcaggtggcagcagaagcagtagaaataatgacgattgtcgctcctcacataatgacagatatggaccccctacccgcactaactacagggtgctcctggaaaaccttccctcccg

SEQ ID NO: 3034 - DNA, 364 bp, Diabrotica virgifera
  unsure (1)..(364): unsure at all n locations
  Clone ID: LIB149-019-Q1-E1-G1
cggtcaaaattccgggtcgaccaccgtcacaagaattgaggctgatgctcttggtgacaaatggaagggctacatcttgaaaatatctggaggtaacgacaaacaaggattccccatgaaacaaggtgttcttacaaacggtagagtaagacttttactttcaaaaggtcactcctgctacagacccagacgtaccggtgaacgtaaaaggaaatcagttcgtgggtgcattgttgatgggaacctcagcgtgttggccctagtcattgtaagaaaaggagaacaagaaattcccggacttactgacaccaccatcccacgtcgcctgngacccaagagagcatccagaatccgtaagctcttc

SEQ ID NO: 3035 - DNA, 432 bp, Diabrotica virgifera
  unsure (1)..(432): unsure at all n locations
  Clone ID: LIB150-014-Q1-E1-G10
agggatttcaactaacacactcgctaggtggtggtaccgggtctgggatgggtacgttgttgatttcaaagatcagagaggagtatcctgataggatcatgaacacttattcagttatgcctagtccaaaagtatctgacactgttgtggaaccatataatgctaccctatccgttcatcaacttgtagaaaataccgatgaaacctactgtatagataatgaagctctttatgacatttgctttagaacattaaaggtaccaaacccaagctacggcgacttaaaccacttagtttcactgacaatgtccggagtaaccacgtgccttagattcccaggtcaattgaatgctgatcttagaaaactggctgtaaacatggtgcctttcncccgccttcacttcttcatgcctggatttgcccctttgacct

SEQ ID NO: 3036 - DNA, 407 bp, Diabrotica virgifera
  unsure (1)..(407): unsure at all n locations
  Clone ID: pGUT1513
cctgaagtagaatgttcagctcctgaagatattctttgtgagaaaaattttgttgagaatgtttgtcgagacggctctggtcgttataccgttgctctacctttcagagaattatctcctgtttttccaggaatgtttgagttagctgtaaatcgtnttctttccttagaaaaaaggcttttganaaatcctagtgtttatcaggaatattgtacctttatgaaagattatttggatttgcatcatatggagcttgtgtcaganacttctcgtccattatcttgttactatattcctcaccatgctgtattaaaacctgatagtttgactaccaagttgcgagttgtatttaatgcttctgctcgaattgganatcagaattctcttaatcagtgcttgtttactgg

SEQ ID NO: 3037 - DNA, 416 bp, Diabrotica virgifera
  Clone ID: LIB149-043-Q1-E1-H6
gacaagtgcagtgttgttcaattcacacccacatttaacaatatgagttcagctgctaccgaaccaaaagtttgccacaagtgcaaagagcaggtcaaaggaggagtgctaacagctttaggtaagacatggcatcctgaccatttctgctgcaatgaatgcaaaaatccgataactgagaattcattccacactaaagatgattttccttactgtacgccttgccatactaagctttttgcgtctatttgccatgcctgtgaccaaccaattttggacaaatgcgttcaagcgatgggagtcaactggcacgaagaccatttcttgtgcgaagactgcaaaaccaaattaattggacaacaattcatggacgtcgcatgacttcctcgttgccaaaaatgctacattgccaaaca

SEQ ID NO: 3038 - DNA, 433 bp, Diabrotica virgifera
  Clone ID: LIB150-037-Q1-E1-C11
gccctaaggccgactcatattaaaatgtttgttttggatgaggctgatgaaatgttgtcaaggggttttaaagatcaaattcatgacgtgtttaaaatgttgaacactgacgtacaggtaattttactttcggctaccatgccaaacgatgtgctagacgtgacaaaatcctttatgaggagtcctgttcggatacttgtcaaaaaagaggaacttaccttagaaggtattaaacaattttatgtatatgtagaaaaagaagattggaaattagagacattatgtgatctctatgatactctttcgattacgcaggctgtaatcttttgcaatacccgtcgcaaggtcgattggttaacagaaaacatgcacaagagagacttcactgtttccgctatgcatggtgatatggaacaaagagagcgtgacgtta

SEQ ID NO: 3039 - DNA, 430 bp, Diabrotica virgifera
  Clone ID: LIB150-042-Q1-E1-H5
acgagaaaactacgagtttattaaagtttccaagactggagaaaagcaaaatgttggactgattcaactcaacagacccaaagcactcaacgccctctgcaatgggttgatatccgaagtatctgaagctttgaactcctttgacaccgacaaatccgtgggggctgtagtcataaccggaaacgaaaaagcttttgcggctggagctgatattaaggagatggtatccaatacctttgcaaaatgtgtcactgaagattttattggtgcttggcagcttatcgctaacatgaagaagcctcttcttgctgcagtaaatggatacgctcttggtggtggttgtgagttgtgcatgaagtgcgacatcatttacgctggggataaagctaagtttggacagcccgaaattcttcttggtgtcattcctggt

SEQ ID NO: 3040 - DNA, 418 bp, Diabrotica virgifera
  Clone ID: LIB3026-020-Q1-E1-E9
aatttatcttaggtagaatagatgtgtcatttctaaacaaagaaagaaagtttcaatacaaagaagactacgaaaaatttaaacttgtttgtcacttcatagctttcgtgttatgtattactttaagccattacaactatagatttttggacaagatattcgctggcttcttagcttggtactattgtacgatttcaattagagaaagcatcctcaaagtgaatggatcaagaatcaaaggttggtggagggttcatcacatcctatcaatagttagttctggtttgttacttacatggcctgacaatgaaccgtgggagttgtttagagtgtacttcatccgttataccatttacagtacttttacacagtacctgcagtttagataccaacgtggagttctccacagactaaaatc

SEQ ID NO: 3041 - DNA, 408 bp, Diabrotica virgifera
  Clone ID: LIB150-028-Q1-E1-E3
aggaagatttttatgtggattagcatgcggtatgacttatgtcaacatacccacttatattgcagaaatcgccgacaacgaagtaagaggttcattgggatcttacctgcaacttttttgtaccataggtatactgtttccatattctctaggaccatatgtaactttaaaattatttaacattattttactctttcctccaactatatgcatagtattgtttattgtattcttgcctgagagtccttattatttattgcaacgtggaaaaattgaacaggcactacaggttttaagtaaattatcagggaagccgacttctattgctgaaaaagatttagcagatatgcaggtacagatacgacaagaaagcgagcaaaaaggaggttttggcttaataatgaaaac

SEQ ID NO: 3042 - DNA, 428 bp, Diabrotica virgifera
  Clone ID: LIB150-023-Q1-E1-F8
aaacacgcgtccgcccacgcgtccgcccacgcgtccgcccacgcgtccggtaaatataattttactgacgattattacttgagtctacacaatgccatccacaatgaagatccagaattgtatgagtgcgtggtatgcaaaaagtttaaaacaaaaatcagcagaacgttgtacgagcatataatcgaagagcatgaaaaagagggaatgtattgcaatgaatgtgacaagacgttctcatctcagacatggttcgaaagtcacaaaatatttcacgtagaaattaatgaaaaagattcatataaatgtcgccgatgtgaggctaagtttactacgaactattatttgatgcagcacatgcaagaatctcacaccaaatacaaatgcaatgagtgtgatgtaacgtttccctacaagcaaaatttaga

SEQ ID NO: 3043 - DNA, 408 bp, Diabrotica virgifera
  Clone ID: LIB3026-027-Q1-E1-B8
caaattctttcgatgcaagggaaaactggaaagagtgttcagatgttatcaacactattgtcgatcaatctgcttgtgcggctggttgggccctagctgcagcttctgcaatgagtgatagacgatgcatagcctcccaaggaaagcttaaagtgcctgtttctgctgaaaatgtagtggcttgtagccgtaatagtcttggatgcaaaataggatatatggaagatggatggtggtattggctaaaaaatggaattcctacaggaggtctttatggcagcaaacagggttgtcaaccatattcgcttcaatcttgtgaacatcatacaaatggtactaaagtggattgcagtactttgaaattggatacacctacttgcagaactcaatgtaacgattccgcactta

SEQ ID NO: 3044 - DNA, 417 bp, Diabrotica virgifera
  Clone ID: LIB3026-014-Q1-E1-H10
agttaaacataatatttccttaacagaagcactttgtggcttttcctttgtgattcatcatctagatggaagagatattcttgtaagacaacctccaggagaagttattaaaccaggtggtgtaaagtgtgtaagaggtgaaggtatgccccattacaaaaacccattcgaaaaaggtaacatgtatatatcattcgatgttaagtttcccgaaaatcatttcactagtgagaataatctaaaagcattagaaactcttttaccccctagatctttattcacaatgcctgtaggagaacatgtagaagaagttgatttacaagaagttgatccaactgataaaggccattcgtctcgaggtgaagcttacgctagtgatgatgaagaacaatcacatgggccaggtttacaatgtgc

SEQ ID NO: 3045 - DNA, 415 bp, Diabrotica virgifera
  Clone ID: LIB3026-030-Q1-E1-C1
acgcgtccgcaaatattagctgagtcaggccaaatagctgagatggaagaaaaaattaagaaagttaggaataaacataagcaaaactctcacatgtggattgaggttgccaaaatttattatatgttggataaattcaaagaagctaggaatttaaaggatgctgccttaaaatctataacgataaagaaaatgcaattggatataatcgttcagtttgctcttatggaattcaattatggagaaccacattatggttcacatatatttgaagcaattctaagttcggatccaaaaaaagtgacgatttggacgatgtacgttgaccaattagttaaaaaagggaagatcgatgaagctaggcaagttttggatcgctcagtttctcaacatttgcccgtgaagagtttgaaat

SEQ ID NO: 3046 - DNA, 269 bp, Diabrotica virgifera
  Clone ID: LIB149-005-Q1-E1-D9
ttaactttttaactagtggaaccttaattacagtttcagcataatcctgattaagaatgtgaatcggtttacaaattaatttagtgagatttagcgccctaatgaaatctcataataatatttttcccgctgaagccactcttaaatatgttattactcaagctttagcatctgctattgtattgttttcaattcattaacatttacattcttcagattttattttaggaaattgagatttaacataagagttaatcctaaattcagct

SEQ ID NO: 3047 - DNA, 432 bp, Diabrotica virgifera
  Clone ID: LIB150-013-Q1-E1-A10
aacaggaacatcgttcatattttggaagatatgaaatcatgtcaacctgctttggaccatctttgtgaattgatgcccagactacagcccagatattattcgatttcctcgtcacccaagttgtatcccaacacagttcacatcacagcggtcttagtcgagtatgacactccaactggtcgccacaataagggtgttgctaccacatggttgaaaactaagatgccggatcccgagaaagaacttcccacagttccaatattcgttcgtaaatctcaattcagattgcccactaagccacaaactcctatcattatgatcggacctggaactggttttgctccgttcagaggatttatccaggataggaatctttgtaaagaagaaggaaaacctgtaggggacacagtgctctatttcggctgtagaaag

SEQ ID NO: 3048 - DNA, 353 bp, Diabrotica virgifera
  unsure (1)..(353): unsure at all n locations
  Clone ID: pGUT645
cagacttcaataaactaagcttcgtagctgacttacccctaattgatattgaagaatgtaaccgagtggttgattcgatcttagaagagaataccttggacaagaagagcaatatctgcgccggagatctcgacaaaggagcaaataactgtgacggtgatgttggaggttctctcacccaaaacggtgttcttattggtatcgttacctggtacatcgaaccttgtgatattgaaggaactccaaatatnttcaccaacgttgctaacttcgttgactggatcaatcanactattgacaaacatcaataaactgtaatttttgatatntttaatatattggtatntttttat

SEQ ID NO: 3049 - DNA, 359 bp, Diabrotica virgifera
  unsure (1)..(359): unsure at all n locations
  Clone ID: LIB149-047-Q1-E1-H10
cccacgagtccatttagttgtatggtagtagctgattcttaaatcacacatacagatctcagtgcttaaggtcggcttcaatgaaacaacccaccatgtactcctacatggcctctcagcgatacctttaccaaatcgtgttcaacacaccactctcattaccgacattaacatttcactctagcccatcacccagatgaaccagacctgacacgactctaagcatagcaggcatagcaaggtaggaacaacacatacatatggctcaatcaactcctacacatgctantgggtttcatctagttactgtggcaatgacaggtcatgcanaggaaatgggttcaactaccgtagcacac

SEQ ID NO: 3050 - DNA, 427 bp, Diabrotica virgifera
  unsure (1)..(427): unsure at all n locations
  Clone ID: LIB150-029-Q1-E1-B11
gcttgcgctttcattgtctggtgaaaaaccagtatttattacacacacatttcaccaaatggctttaaaacgaattaataaggaattacaagacctcggcagagaccctccagcacaatgttcaacaggtcctgtaagagacgatttatttcaatggcaagccacaattatgggaccaccagatagtccaatacaaaggcggggtatttttcccaacaataaaatttccaacagattaccctttcaaaactccaaaaagtggcattcacaacangaatctatcatccctacattaatagtaatggtagtatttgccttgatatattacgttctcaatggtctccagctctaactatttctaaaagtttgttaacaatctgctcactactgtgtgatccaaaccagatgacctttagtacagaaatgc

SEQ ID NO: 3051 - DNA, 412 bp, Diabrotica virgifera
  Clone ID: LIB149-003-Q1-E1-A6
acacgattgaaagacatttactattagcaaaaatgtctaaagaccgggaattgcagatggggatgcgatgtgtgaagtacatgatttttgtggcgaattttatgttcatgttagttggattgttgctgatatcaattggatataccattaaggctatctacaccgatttcgatgctttccttagcagccatagctacaaagcatccgacttagctatagctgttgggttcatcattctagtggttgctttgtttggttgtgcaggagcaattaaagaaagtgttctactggttaatctatacgctttactacttcttgtaatagttatcctggaattgaccgtaagtatcattgcttacaaatccaggagtcacttggaagaaacactttctcaggatatgtggattagtat

SEQ ID NO: 3052 - DNA, 338 bp, Diabrotica virgifera
  unsure (1)..(338): unsure at all n locations
  Clone ID: pGUT1608
caatgtcaagttcaacaacggagaaatatttcccgcctatggtctaggcacatggaagtcaaagcctggtgaggttacccaagctgttaaggatgccctcgacatcggctaccgtcacatcgattgtgcccatgtctacggaaacgaaccataaatangagctgccttgaaggccaaacttgccgatggtacagttaaacgtggagacatttacatcaccagcaaactctggaacactttccacagacccgacttggtagaaccagccgttaggaccacatnaaagaacttgggtcttgaatacttggacttgtacttgaatcactggccttttgctc

SEQ ID NO: 3053 - DNA, 342 bp, Diabrotica virgifera
  Clone ID: pGUT2142
gaataggaccaaagaagtgatagaactatctgagaagaatgatattaaagtaagaggatacatatcatgcgttgttggttgcccttatgatggaatgattgaaccagcagccgttgcaaagctcacagaatctctactaagcatgggttgctacgaaatatctttgggagacaccattggagtagggacacgagattcagttaataagatgttaaaagatgtgctagctgtagcatcagctgataccttagctatccattgtcatgatacatatggccaagcattactgaatattttcacagccttggaaaatggtatatcagtggtggattcatcagtagc

SEQ ID NO: 3054 - DNA, 403 bp, Diabrotica virgifera
  Clone ID: LIB149-045-Q1-E1-B1
ctctaaacagacgtcctggcataatcaacaaagtgttaaaaaacatatgtttaactgattaattgccaataacatgatggatgaacaaaatataccaattgatattaatactaccagattactagagtggttaataagtcgtagacatgttaaaacagattggcagaactctatattaaaaattcgagagaaaattaacaatgctattcaagacatgccagctcatgaaggtataataaaattactttccggacaacatatcaattatttccattgtttgaaaattgttgaaatcctcaaagaaacagaagcagattctaaaaacctatttggtagatatggttcccagagaatgaaagattggcaagatatagtcacatcttaccaaaaagacaatgtatat

SEQ ID NO: 3055 - DNA, 430 bp, Diabrotica virgifera
  Clone ID: LIB150-019-Q1-E1-E12
cccacgcgaccgcggacgcgtgggcggacgcgtgggcggacgcgtgggcaaaccccggtccactaacctcaaaattaaaaaatgtcaagaatttaggtttatatctttaattattatggcttctcacggaaaagcggaaactgaaaaactaaagcaaaatttggagaatcagttggacagattagtggagcagctgcaggatttggagaattgcaaaaatgaactggataaagaggaatatgaggaaacaaaaaatgacactatggatcaacttaaggaacttaatgatagtttaagtaaattagtaaaaggagacatttctctaattagtgcactaagtgctgttcagctggctacacaagctgccatatcaaaggcctttaagacgccagaagtcataagactttttggcaaaaaagaacctcaacaa

SEQ ID NO: 3056 - DNA, 393 bp, Diabrotica virgifera
  Clone ID: LIB150-032-Q1-E1-D10
aataaatgtgtatagtaactaaaaaagagttccttatgtgcaaattgtaattaagttaacctccgaagttaatttataggtattatagcagtaatttctacagtagaaatgtaattgaaatatttacaatgtcaaaaaataaattaaacctaacactacctcctggttcaatagaccaaacaccggcggtaacaccaacatcatcatttcaagaaacaccagttgcaagtaaccttgtgaggggaaatagtattgaaaatttaactgcacgtatagaagaacttgattcaactcttgaaatggatgatacccagcgtaaaagaatagaggttttcctttgtcaaaaagaaaaaattggaggagagttttctgatgaatgattcgaaaaattgg

SEQ ID NO: 3057 - DNA, 380 bp, Diabrotica virgifera
  Clone ID: LIB150-050-Q1-E1-G12
aggcgtatcagctgaaatcgaaatcgctactcggcaagaaaaagaaggcgaaggagaattatactacgtcagaaatacgttgactcgtaccgaacctttagtcatccacggtaacggtgcagccaaatacgctctgaactatctcagcaattacgttcctaacgtatggaactccgtggacgggtgtaaacaatgcaagaagggagcgatcagtctcggtactactgcgcctaaagattttccttccgtgctgatttctgtattcatcgaacaaagcacgccgtttttggaagagatgttgcagaaggtgtacttcctggactatcctaaagaaagacttcatatttttattcataattcggttaaatatcatgtcgaca

SEQ ID NO: 3058 - DNA, 226 bp, Diabrotica virgifera
  unsure (1)..(226): unsure at all n locations
  Clone ID: pGUT1900
taaacctaagactaaaaaagtggagaagaccgtttgggattgggagttgttgaatgacagcaaaccgatttggaccagaaaaccaactgaggttgaggatgcagaatataatgaattttatcaggcattgaccagagacaccaaagatccacttaccanaattcatttcgttgctgaaggagaattacattcaaagctttgttatatattcctactgtgcaaccat

SEQ ID NO: 3059 - DNA, 390 bp, Diabrotica virgifera
  unsure (1)..(390): unsure at all n locations
  Clone ID: LIB3026-003-Q1-E1-F2
aatcatttcaatcaaaataatggtaaaaatgtctcaagtaaaattattggcccagctttcagagagaattcttctgagacaaagcattgctacaccagctgtgagatgtatgtcagattgggtacctaaggaaaaagaaacacacactggacagaaatgggcttctgatgactacagattatctaggcgtgtatgcacgccanaacatggggggcgagggggggcaatcaatcttgtcgatgaggttgcgccagaagcatgtaaagatcgtgtactatggtgtgatgggggtantggccccgaacgtcatccaagagtatccatcaacttgggcagacccggcaatcatgcctgtgggtattgtggattgagggtttatagggaaggaca

SEQ ID NO: 3060 - DNA, 555 bp, Diabrotica virgifera
  Clone ID: pGUT3279
caaacttactatacagttaagttcgacctctctcaccttgagggcaagacatacgcgtcggtggaatggcatctatcaaatctttgaatttaataggaaacttaaaaaagggaatcaccagaagatcattttcaacaacaaatgctgtagcctccaagcaaatgactgtcagagatgctcttaactcagccatggacgaagaaatggagagagatgagagggtgtttattctaagtgaagaggtagctcaatacgatggagcttataaagtaaccagaggtctttggaaaaagtatggagacaaaagagtcattgacacaccaattactgaaatgggattcactggaattgcaaccggtgctgccatggctggtttgaggcccatttgcgaattcatgacatttaactttgctatgcagtcaattgatcaaatcatcaattctgctggcaaaaccttctacatgtctgctggacgtgtaaatgtaccaattgtgttcagaggacctaatggagcgggctctggtgtagctgcccaacattcttaatgttttggag

SEQ ID NO: 3061 - DNA, 344 bp, Diabrotica virgifera
  Clone ID: LIB150-003-Q1-E1-H12
aattaccacagtcaaagtgcataaaacttaacaatacgcaaaaaccgtagcagtccgtttatttctttcctgcggccttggctggagccttcttggccttcttaggctttgatttcttatctttcaagatttgtgcccttctcctttcttgcaattttcaaggctccaatcagacccgatgtagtcaatttcgttcaccaacaggtttctatgaaccatcgtcaaccctacagcgttagtgacaaagctggacatcaaacatctgctgaatcatggggtaccggacgtgctgttgctcgtattccccgtgtaagaggaagtggtacccaacgttctggtcaagg

SEQ ID NO: 3062 - DNA, 323 bp, Diabrotica virgifera
  Clone ID: LIB149-047-Q1-E1-F12
atctaaattcgttgtaatgtctccaaagaatctccttcgtcacaaggactgcaaatcagtctatctgaattcgatgatcttgctggtcaccctgaatttgataagcaagggacacgcttcaagcgtctaataaaagaccggaatgaccataaggaccttgaggaaggaatcagacgtctagttctttgttctggaaaggtgtactatgaattggatgaagaaagaaataagtcggattccaatgatgttgcgatatgtagagttgagcagctctgtccattcccctacgacctcattcagcgtgagctgaagagatatccaaa

SEQ ID NO: 3063 - DNA, 433 bp, Diabrotica virgifera
  unsure (1)..(433): unsure at all n locations
  Clone ID: LIB150-043-Q1-E1-B6
aggacgcgtgggcggacgcgtgggcggacgcgtgggcggacgcgtgggcgaaaatggcaacttcaatctcaaaaaagcgtaaattcgttggagatggtgtcttcaaagccgaattaaatgaatttttaacccgtgaactttccgaagatggttattccggtgtggaagtacgtgttaccccaacacgtaccgaaattattattatggccaccagaaccgacagggtgttaggtgagaagaacaggaggataagagaattgacttctgttgtacagaagaggtttagtttccctccagattccgtagttttgtatggtgaaaaagtagccaacagaggtctgtgtgctattgcccaagctgagtcacttaggtttaaattgattggtggtttggccgtccgtanggcttgctatggtgtcttgaagtacatcat

SEQ ID NO: 3064 - DNA, 407 bp, Diabrotica virgifera
  unsure (1)..(407): unsure at all n locations
  Clone ID: LIB150-017-Q1-E1-C9
caaacatcatttctattgaaaaaaaaatacttagttgtctgcctctatttgacgtaaaaaatggcacactattttaaagagaaggatattgacgaattcagagaatgcttttacttatttgcccgctctggaaccataaaaacactagatgaattaactgtcataatgagaagcttaggattatctccaactaagtctgaaatgactggatatttaaaacaaaagggaggaaaaatgtcgtttccagacttcttggaagtaatgtacattcactctaaggtggaaaacattccgaaagaagttgttgatgcattcaaggctgcagaccctggaaatactggaaaaatacctgcaaaacaactgcgctatttactacaaaactggggagaatgcttgtcnacaaaaga

SEQ ID NO: 3065 - DNA, 349 bp, Diabrotica virgifera
  Clone ID: LIB149-038-Q1-E1-G11
atagtgagtcgtattaaaaaaatgaatccttcacgggacgccccacgacttttataaaatgccaaaagctgcattaacttgtccaaaaaggctttgagtaccgaaaaggttatccataaggaagagaagtatgcatcccatggctaccatcctctacctgtggctctaacgaaaggacaaggtgtttttgtatgggacgtcgaaggaaaaagatattttgattacttaagtggttattccgctaacaattttggacactgccatccgaaaatcgtcaaagctttacaagaccattgtgcagtacttcaccacacatccagagcatttttttccgattaacttggacagt

SEQ ID NO: 3066 - DNA, 442 bp, Diabrotica virgifera
  Clone ID: LIB3026-009-Q1-E1-F11
cccgcccgtccgaccacgcatccgcaaacatgcgaaatacaaagaagattaactcttgcttgggcagcctacggagctctgagagacatatttaggagcagtataccgatcggtttaaaaagacaagtgtttgaacaatgtgtgctaccggtaatgacatatggagcagagacactgactctaaccaaggcaacagcgtcgaaaatgcgggttgctcaaaggcgcatggaaagatccatgctgggcgtaactctacgggataaaataagaaatgaagatctcagacaaacaaccggtatcgcagatgttgtagaacgtatcaccaggctcaaatggaactgggcaggacacgtcgccaggctgaaagattcaagatgggcacgaaggctgatggagtggagaccaagagaagataaacgaagtagaggaaggccgcctacac

SEQ ID NO: 3067 - DNA, 370 bp, Diabrotica virgifera
  Clone ID: LIB3026-031-Q1-E1-D2
aggaaataagaatggtctgttagtcccaagttccacattcgatacagaacttcagcacatcagaaatgctctaccagatacagtaaaagtacacagagtagaagaaaggttgtctgctcttggaaatgtgatagcttgtaatgattatgtagctctggttcatccagatttagacagagaaacagaagaacttatagctgatacattaaaagttgaagtattcagacagaccattgccagtaatgtattagtgggatcatattgtgtcctcagtaaccaaggaggtctgttgcatcctaatacaaccatagttgatcaggaagaattgtcatcattgttgcaagtacctctcgttgctggaactgtaaat

SEQ ID NO: 3068 - DNA, 253 bp, Diabrotica virgifera
  Clone ID: pGUT3651
tatagatgtctaatgatacacaagactgagagagtgggcttaaaattaaaagactttcctacaatctggcgcaacacgttcatattttgataaggaattattctaaaaattacaactcattatacaatacatccaagggaaaaagatccaagatggaaagaagtaaacatggaacgttttaccgacgaaacagacatcttgattgtaagaggtggtcctgctggcatgagtgccgctatttgggccaaacaac

SEQ ID NO: 3069 - DNA, 419 bp, Diabrotica virgifera
  Clone ID: LIB3026-035-Q1-E1-H8
gcgtcatttcgagagctagcggagcacaggcggacatattcgttgacgaaggagattttgtacgatttggaaatcataaaattaaagttctgagcactcccggccacaccaacggatgctgctcgttttattgccaggaacaggaaatcgcctttacaggagacgctctcttaatcagaggatgtggcaggaccgacttccaagagggcgacccttccactctataccacagcgtgcataataagatattctctctgccagcaaccacgctactttatccggcgcacgattataaaggcatgacagtaacttctgtggccgaggagaaacagttcaacccccgtttaacgaaaagcttggaggaattcgtccgcatcatgaacaaccttaatttaagctatcctaagcagatcgataaa

SEQ ID NO: 3070 - DNA, 432 bp, Diabrotica virgifera
  Clone ID: LIB149-011-Q1-E1-H11
acgattaggaatggtgatactggccctgttaaagtaaaattattatgtggtgctgaccttttagaatcatttgggacaccaggtctatgggcaaatgaagatttagaagaaattgttggaaggcatggactggtagttataactagatcaaattcaaatcctgcagaattcatttacaattcagatttactgacaaaatatatggcaaacatcacaattgtaacggaatggatagcgaatgaaattagttcaactaaagtaagaagagcactaagaagaaatgaatccgtcaagtacattttgcctgacaaagttatagattatattcacaaaaatggtttgtatggatcacaaaaaactattaagtatttgcacgttcccaactcagtattccttacgccttcaccgacagacatcatcatggactcaccg

SEQ ID NO: 3071 - DNA, 394 bp, Diabrotica virgifera
  Clone ID: LIB3026-019-Q1-E1-C2
agcgaagatttaaggcggatgaacaaacgccagttcatttaccaagttctcagtttcggtatgatagtctcctcggccttaatgatatggaaaggactcatggtggtaactggtagcgaaagccccatagttgtagtattatctggcagtatggagccggcattccacagaggagatctattattcttaacgaattatccagaagaacctgttagagtaggagaaatcgtagtcttcaaagtagaaggtagagatattcccattgtacatcgcgtgctaaagctccatgaaaagaaaaatggtactgtaaagtttctgacgaaaggagacaataatagtgtggatgatagaggtctgtatgctccaggacaattgtggttaaccaaagatgatg

SEQ ID NO: 3072 - DNA, 418 bp, Diabrotica virgifera
  Clone ID: LIB150-020-Q1-E1-G1
accacacgtccgtgaaagatgaaaacggcctaaagctacaggccgagtattgcaatttgtggccagctaccgtcagcaacgcaaattcatacaatatcgtagctgtcaacgagttactccttgaggtaatcactcacggtttaaatcaatatccgaataacgttgcgtggttacgattgatgggtgacataaactttgcaaacggtcattaccaaatatcgttaagctactacctcaagtctctcctcgtcttccacgattacttcaacactcccatcggctatgacgaccacgtattccgcagaatgataaagtgttgcacgaccctcggcgcaaacactcaagctgctgtcttatgtcaatttttagaggaaaccgactacatgttggccttccggatattgtccgaacagaaaac

SEQ ID NO: 3073 - DNA, 701 bp, Diabrotica virgifera
  unsure (1)..(701): unsure at all n locations
  Clone ID: pGUT2473
gcacagtgaagatattcaagttccagattctttcgatgcaagggaaaactggaaagactgttcagatgttatcagcactattgtagaccaatctgcttgtggatcttgctgggcaatgtctgcagcatctgcaatgagtgacagacgatgcatagtcacccagggaaagcttaaagtgcctgtttctgctgaaaatttattgtcttgttgcgatgactgtggatttggatgcgccggaggatatatagatgatgcatggtcgttttggcaagagaatggaattactacaggaggtctttacggcagcaaccagggttgtcaatcatattcgcttcaaccttgtgaacatcatacaaatggtactaaagtgcaatgcagtactttgaactacggcacaccttcttgcagaagcgatcaatgtgacgataccgcactaaattataagtccgagttaacttatgcctcaggtccagtgaattactatactacagttcccaatatgcaaaaggaaatattgacaaatggtccgatacaaactcgttttgatgtgtacagcgatttcttcagttacaaaagtggtgtttatcaacatgtcgctggagaatatgtangaggacatgccgtcagagtttaggttgnggagtagagaatggagtcgctaattggttggcttgctaattcatggaatgaaaaatggggag

SEQ ID NO: 3074 - DNA, 309 bp, Diabrotica virgifera
  Clone ID: LIB150-014-Q1-E1-D5
aagacgcgtgggcggacgcgtgggcggacgcgtgggatgctcacgaacaattgaacgatcttggagcccaaaacgcttccttgtctgccgccaacaggaaattggaaaccgaattgcaaaccctccactcagaccttgacgaacttctcaacgaagccaagaactccgaagagaacgccatgaacgctatggtagatgccgctcgtctcgctgacgaactccgcgctgaacaagaccatgcccaaacacaagagaaactccgtaaagctctcgaagctcaaatcaaggacctccaagtacgcttggacg

SEQ ID NO: 3075 - DNA, 321 bp, Diabrotica virgifera
  Clone ID: LIB149-011-Q1-E1-H6
tcgctgtgaatgtgtgtgccgtttccataataaagaacgataaatttatggataacatctttttttgataagctaaggggcgaaaatgcctgaggataagaaaatggcagttgacaatgatactctttcttccaaaaagtcttccactattatccgtagtagtggaagcaccacggcgcaggttactatgctagatggttcgattttgcctattgttatagacaaaagagccaaaggaaaggatcttctggacaaagtttgtgaagcgataaatttaatagaaaaggactattttggtctagtgtatgcggatagacacga

SEQ ID NO: 3076 - DNA, 464 bp, Diabrotica virgifera
  unsure (1)..(464): unsure at all n locations
  Clone ID: LIB150-030-Q1-E1-E3
attatggattactattatggattactattatggattaccattatggattaccattatggattaccattatggattaccattgtgataccattatggattaccattgtgataccaattatggattaccattgtgataccattatggattaccattgtgataccattatggattaccattgtgataccattatggattaccattgtgataccattatggattaccattgtgataccattatggattaccattgtgataccattatggattaccattgtgataccattatggattaccattgtgataccattatggattaccattgtgataccattatggattaccattatggattaccaatatggttcatcattatggattaaacatacatttaacacgtttctttaatgatgcttctaacatgcttgcaaaaaaaattgcatacatgtttcattantgcaagttt

SEQ ID NO: 3077 - DNA, 443 bp, Diabrotica virgifera
  Clone ID: LIB149-032-Q1-E1-G12
ctcgcgggccaatacacgcctctacagatgttcttgaaaattttagagatataggtcacagaactagtggtctagatccagcatggtactataccatccccgggtattcctttgactgtatgctcctgtacacaaaatgtgaattggagctactaagtgatgtagatatgatattatttatcgaaaaaggaattcgtggtggtattagtcaatgttgttcaagatattcagaggctaacaataaatatatgacaaattatgaccctaacaaaccggataaatatatattttatgttaatgttaataatttatatggttgggcaatgtcgcaaccgcttccaattagtaatttcaagtgggttgatacaaatattgatgtaactggtatatctgatgattcattatttggatacatatgtgaagtggatatagaatatccacaa

SEQ ID NO: 3078 - DNA, 420 bp, Diabrotica virgifera
  unsure (1)..(420): unsure at all n locations
  Clone ID: LIB150-045-Q1-E1-C2
caaaagtctggtcagaattttctctatggtaggtttcatccgaggactgtanagactgttaaggagtatcagcactgcaatgaaaatactccatttgatgcatttccattgggccagagtttatggaagtcncatcaattctcagaagattttacagataaaattaggaactatgttgaagaatgtgataattttcagggtttccattttcttacagattgcaccaatgctttcgctggtttgtcgtcttcctgtttagaatacattagagatgaatacgatagaaaatcagtgttgatacttccaatgattccatcttactttcctgacaatgactttagttcagaagaagaaaagaatcagtcccttataaatgattctgttanggtattaaatatggcattcggatttaacgaattt

SEQ ID NO: 3079 - DNA, 410 bp, Diabrotica virgifera
  Clone ID: LIB150-018-Q1-E1-C12
ggaatacgagattgggagaatttttccaagtccattatagctttatgtgcgccggaggggagaaaggacaagattcttgcaatggagatggaggtagtcctttggtgtgtgcttttgatgacgacaaagacagatattaccacgcaggtatagacgcctggggcatcggatgcggtgaaaaacaaattcctgcggtgtatactgacttggccgtattcagaaattggatagacggagaaatgtctaagaagcgactgccgacgacgttttatgacagatccgatccttttatagcaaggattacaaatgggcagaaactctaagtagaaaacagccgacgaattttatacatacgatatttgcattgggttatacaatttaattttttaagtaatacacagacataatac

SEQ ID NO: 3080 - DNA, 431 bp, Diabrotica virgifera
  Clone ID: LIB149-048-Q1-E1-C12
ctcgcgggtcgacacaacactctacactcacgtcctagtaaggttaacttcatcgtgtgcaaaaatgcctatttcccgctgtgtttcatcagagttttttagtctggtggaaacacaactaattttgttgtggattccagacaaaaacagccgttccagttaccaaaccacaggggaagaaaccccaaattagaggaaaaggtctaaagaaaaagaaggttgctttgaaatttgtgattgactgtacccatcctagtgaagacaatcttctagatgttgcaaactttgaaaattatttgaaagagaggattaagatcaatggcaaaacaggaaactttggtgctggaaaaagtggtcaacattcagttaccgtaagcagagacaaacatgttaaaatttgccctgtccgctgaaaatcccattttcaaaaa

SEQ ID NO: 3081 - DNA, 376 bp, Diabrotica virgifera
  Clone ID: LIB3026-021-Q1-E1-H6
cacgcgtccgcaggaacctctattatggccgcggagtttgatggaggcgttgttataggagcagattctcgcacaactactggggcttacattgcaaaccgggtagcagacaaactcaccaaagtcactgaccatatatactgttgtcgttcaggatctgcagcagatacacaagcaattgcagacattgttgcttatcatcttaattttcatggtatggaacttggtgaagaacccaaagtacaagtaggtgccgccattttccaagaactttgctacaattatagagattcgctaatggctggtatactggtagcaggttgggataaaaagaaaggcggacaagtatattccataccaattggtgggatgtgtg

SEQ ID NO: 3082 - DNA, 339 bp, Diabrotica virgifera
  unsure (1)..(339): unsure at all n locations
  Clone ID: pGUT075
gtcatcattggtaacaataattttacagtatttttgaacgataaacaaaatagtagtgctgttaaggaacatttggaatccgaggttgaaaatagtagctacaagattgaaaactacgataatatcgagaagaaaatagaagaattgaccaataaagtcgaaggatatatatggttttcggagcactccagctttgctctgacagatcttgtccccaagaaacaccgattgctgaccgatataacacctgtttgcttgatganaggcgttcaanacgataatgatatccaaagcatgcgcaactgccacattaaagatgctgctgctctgtgctgctac

SEQ ID NO: 3083 - DNA, 445 bp, Diabrotica virgifera
  unsure (1)..(445): unsure at all n locations
  Clone ID: LIB150-030-Q1-E1-B12
tatattcanaatgcaatatttatgtcattcctcttgatcaactagaatatttttggacgtcctacattagacctggttttaaattttcctaattacataattaagtttatgaatatccctccaattgggaaggaaatcgcatggggccaaatatggtgaatactgttgatgggggagcagttcgtagccaaattcgnacagtttggttatgaccactgcggaggtgtgagccagtgcgttgtcatgatggaagagcacttttttcttcaacacgtggggtcgtcttctccaggtagtcgatgtaagatagtccagatattgtaactttcttatttttattgggtttattatttcgtattctttgcacatttcttaaaatacttccgtgtctgtttttcctctgtaacatcacatatcaaatgactagcttatctatgtgttcttg

SEQ ID NO: 3084 - DNA, 413 bp, Diabrotica virgifera
  Clone ID: LIB150-002-Q1-E1-D3
cccacgcgtccgcccacgcgtccgcaaaaatgggtatcgacatcaaccataaatacgaccgtaaggttaggagaacagaacctagaagtcaagatgtatatttacgtcttttagtaaaactgtaccgttatttagcccgtcgtacaggggccaaattcaataaaataatcctgaaaagattgtttatgagcaaaatcaacagaccaccactatctttatccaagttagtgcgtttgatgaagaagcctggccgtgatggacttattgctgtcgtagtaggaacaattactgatgatgctaggatttttgaaattcccaaattgtctgtatgtgcccttcgcgtgacacaaactgctagggccaggatcttgagagctggaggtgaagtcatcaccttcgaccaattggcactc

SEQ ID NO: 3085 - DNA, 418 bp, Diabrotica virgifera
  Clone ID: LIB150-044-Q1-E1-C1
accaagcgtccgcccacgcgtccggcgaccccatcaactggtgttgttgtgcctcgaaactttcgactacttgaagaactagaagccggtcaaaagggtgtttcagatggtactattagctggggcttagaaaatgatgatgatatgacacttacacattggatggggatgataatcgggccccctcgtacaccgtatgaaaataggatgtattctgttaaaattgaatgtggccaaaggtatcctgatgatgcacctactgcaaagtttatctctagaatcaatataaactgtataaacagtaacacaggggtggtcgataacagacaagtcccaatattggctaagtggcaaagggattacactattaaaacggttttgcaagaattacgaagaataatgacacttaaagagaaca

SEQ ID NO: 3086 - DNA, 428 bp, Diabrotica virgifera
  Clone ID: LIB150-016-Q1-E1-E9
agacccaattctgctgattttttggatgtaaatccgaattgttgggccgaatagctctaagaatacaaatgggacgatagttacctatatccgattttcgacctgatttatatattggagtgacataagaatttttccagtagtctggaaattcccctgttaataaagacttattaaatatataaaaaagtgggcgcgatagaatgaagctgaatgctttaaggaaagtggggggaattccatcaggaccaggacctttgttggtattgagttcaaacagttttccgtaaatttttgaaatttcatggtgataattagacacattaacaaaaggtgaatcctgggtaacatgcggatgtaaggattggttagtataaatggaaaagaattggttagcaaaaagattagcaatatcagttccattgaag

SEQ ID NO: 3087 - DNA, 341 bp, Diabrotica virgifera
  Clone ID: LIB3026-003-Q1-E1-H8
tggggtttctgggactgctccatttggaagtgttcactcaaagattgacacaggaatatgacgccgaacccataatcacggccccatctgttacttacaaaatcaaattaaaacctaccaagcaaaatataaaagatggatcagatgtgatctttatgaacaatccagccaattttcgcgaccatgttagaatagaggaggggggtggggggaggattattggaacaatggtaacgcctggacaagtacttgggacccgtcatatcactgtgtatggaacgtagggggatccagagatctgcaaataatatagacaatgaaagagttatattacaatatga

SEQ ID NO: 3088 - DNA, 421 bp, Diabrotica virgifera
  Clone ID: LIB3026-016-Q1-E1-A1
gggtggccccaagcgtccgccaaaacgtccgcgaaaatttaacaaagagagcaactacagctttaactcaacaaggcatgaatgttacagccacaattaatgacatcaatgatgcttcagaagatgatgattccaattttgaaccaaatgaagaaactgttttggaaacatacacgacacctttagatgaagaagactgcgacgtagacgaatatcaagcatttaagcaagtgatgacagctttgcaaggtcaagacccagaatggtataacgccctgacgaataatctgaacgaaacccaactgaagtctttaagcgaagtttgtgttttggcagaacaaagagccgcagctagggaaagtaaaagaattgaacagcaaggaggttatatcttcactcaacaagcggtgccaacatcttt

SEQ ID NO: 3089 - DNA, 414 bp, Diabrotica virgifera
  Clone ID: LIB150-032-Q1-E1-A6
cacgcatccgaccgaaatgaacaaagaggaatggtgggaatagtacttgatactatgtggatggaacctgatactgaaagtgaactggacaaagttgccgctgaaagaaaattgcaatttatattcggatggtatgctaatcccatcatcaacggcgactatccagcacaaatgaagcaattcatcgcgaaaagaagtatcgcgcaaggtttcaaacagtctcgtctaccgcaattcacaccagaagaagttaagtacatcaaaggatctatcgacttcttgggagtgaaccaatacacatcgatgttagtacgaaacatggatgataagtataaaaccgaagtagcgtgggaagctgactcagaaacgtatctttaccaaccagacaactgggaatccactgcaactgattgg

SEQ ID NO: 3090 - DNA, 287 bp, Diabrotica virgifera
  Clone ID: LIB149-042-Q1-E1-E10
acaatcccctagattgagtcgtattaacaagctttggtcaagaatccaaacgttgataaaatcgccttcactggatcaacggacgttggaaagctgattcatgccaatgctggaaaaggcaacttgaatacaacaactctacaatggaggggcataagccccaataccattttagccgatgccgacctcgatcacgctgtcgaacattctcaccaaagagtcttctacaatcagggccaggtttgctgtgctggaaccatatgtttcagccatgacacagtttatga

SEQ ID NO: 3091 - DNA, 391 bp, Diabrotica virgifera
  Clone ID: LIB150-042-Q1-E1-D4
accacgcgtccgcccacgcgtccgggaagttgatctatacactgtaaaaaaagaagatctggatttcacttcacccttcaggctgacagttagaagaaatgattatgtgcaagctttagttacatattttacagttgaatttagcaaatgccataagcgtataggtttcaccactgccccagacgctccatacacccattggaaacaaacagtgttctattttgaaaactatatgacagtaaagaagaatgaagaaatacatggaatgtttaccatgaaacctaacccccgtaataatagggatttagattttgtcattgaactacatttcaagggagagttaggcgaagtgcatgaagtcaatagatatagaatgcgttaacattatttt

SEQ ID NO: 3092 - DNA, 386 bp, Diabrotica virgifera
  Clone ID: LIB150-026-Q1-E1-H11
caatagaaggcccacagcagtgggtgcaggatgaaaataaaaatattggacatatgatatttagatttaaagacaaagaatctcctagaacttatatctcgtctttagttcatagtatacaagaatatccaatggaagacatcctgagtgcaaactacatgttacgtgaatggcgtcctgatcttgttgaaagtgtatggaatagttttgttccagataatgttagaatatctgtgatagctaagaaattcgaaaatgaacttaatgagacagaaccctggtatggaactaagtataagaaagttgatatccccaaagaaactatagaggcgtggaaacaaactggactgtgtccagatttgaagatgcccgaaaagaacgaattt

SEQ ID NO: 3093 - DNA, 407 bp, Diabrotica virgifera
  Clone ID: LIB149-036-Q1-E1-G10
aaaagctattgaaccattgtaaggattgatgactgaagccaaaagcatttaattttcccaataacatgttatgatctactctgtcaaatgccttggagaagtcagtataaatagtatccatctgacttttattctccaacgcgtttaatattttttgttcaaagagtactaaatttgttaccgttgatttattctgagaaaatccatgttgattgtgtattagacgctctttacaataaaattttaattgatcgtgcaatagtctatcaaaaagttttggtatagaggattgtttacaaacgcttcgataatttgttatgtcttgtttattacctgatttaaaaattggacagatataagagtgcttccataaagttgggaaaactgatgtctttaatgatgactca

SEQ ID NO: 3094 - DNA, 408 bp, Diabrotica virgifera
  unsure (1)..(408): unsure at all n locations
  Clone ID: LIB149-047-Q1-E1-H1
tatgaagactctgaattttcttttataatattgataataactaaatccacatacaatggcttcaatatcagcaacagaacaaaaaggaatgcaacagattgatctcactacactgaacgtacaacagctatcccaactaaaacaccaattggacaatgaagtcagcttgtttcaagactctcttgcgtctttgaaggtagcacagggcaaatatcaaacttcaggcgagacactggagaaaatcactgcggaaactgagggacaggacattttagtacctttaactggatctatgtatgttcctggtaaacttcatggcacacaaaatgttataatcgatattggaacaagatattatgtagaaaaggacattgagggagcanaagactattttcagcgaaaagtcaa

SEQ ID NO: 3095 - DNA, 412 bp, Diabrotica virgifera
  unsure (1)..(412): unsure at all n locations
  Clone ID: LIB150-032-Q1-E1-B12
aagcctctaaaaaactcctgctacgcgtccgcgatttgtgtgaaaggtttattattatttattatttacatatattgcaaacatgaatacaatttttaacggtaacatcctgatgaatggaaatggagctctcaatggaaaaactaatggcacaaacgtagaaaatggagataacggagtatacacttacgaaactttaaacgaaactgcagaatttttgaagaatttggttcccatcaagcccaagattggtatcatctgtggctcaggcttgggtaccttggcagatgctttggatcagaaaatagcagtcccatacgaaaagattcccaattttcctgaaagcacagtaaaaggccacacangagccctcgttttcggttatattggaggagttgctgtagtctgtatg

SEQ ID NO: 3096 - DNA, 428 bp, Diabrotica virgifera
  Clone ID: LIB3026-006-Q1-E1-B6
gaacctgcgactggagattttgaaaaccgcaacaatcgtgatcgaggagaacgacgtgaaggacgtgagggacgcgcaattggaaacagacccggagcaccacgtggccaacgtaggaattttgatggagacaggcgaggcaaaagggaattcgataggcaaagcggatcagacaagacaggagttaagccgatcgacaagcgtgacggagctggggcacacaattggggatctcacaaggatgttattgaggaagcagacaggcctaataccgatgctaacgaaagttggggagacgaagttaaaattgaacctattgaaacggaaaagaaagaggaaggaagaccagaggaaggaagaggaggagaggaacagacaccagtagaagaagaaccaaaagaattgaccctagatgaatggaaggctca

SEQ ID NO: 3097 - DNA, 377 bp, Diabrotica virgifera
  Clone ID: LIB149-040-Q1-E1-F3
acaccagtgcagattttcctacaaatcccaagacgacgtaaaagacgtagtagctcgtttggatgaaaacgattttccctgggacgccatttggttagacggtgaccacacagatgactacaaatggttccactggaaccacaccacttacactgatcccgttgagctacaacaaaacatttctgctaccggaagggtctgtgtttcaatttctgatccccacatcaaagtcgacgatgattacgacgtctatgccggagctaagggcaaatacttcaccaaatgggcaaacggaagtgaatatgttgctgattgttggcctggagcatccagctggatcgactatttgaaccctgaagccgctgactattactcga

SEQ ID NO: 3098 - DNA, 395 bp, Diabrotica virgifera
  Clone ID: LIB150-047-Q1-E1-A5
gggtcgacccaaacgtccaatgtgtaacgtgttacttttttaagtttgatttacatattgtactaattttaaagttctaaaatacaaagaatggcagaaaaaactataaaagacaaaacaataacatcattatatgcagagttaaataaatttaatcaaaatggggaatacgaaaggtctttgaaaacatcaaataaaattctgggtgtggctccacatgaatttttagctttccagtgtaaaatggtgtgtcttattcatctatcacgttttgaggaagccatttctttgatgaacaaaaatccacaatttttacaggaactaatatttgaaaaagcttatagttactatcgtgttaataaaccagaagaagctttaaaaacaattgatttaag

SEQ ID NO: 3099 - DNA, 428 bp, Diabrotica virgifera
  Clone ID: LIB150-016-Q1-E1-H2
tagaaatcagcctattaatttgtaaataatgttaaaaaattaaaaattaccaaccaaaaataaaccgggcggcccaaaattacccaagggcttcttaaacgttcgggaattacattctaaaattactgaggcaatgctttttgagaaattttcaaccgcgggtcctgtgctttcgattcgcgtgtgtagagacttgattacacgtcgattcctgggttatgcatatgtgaacttccaacaacctgcagatgctgagcgtgctttggataccatgaattttgacttgataaaaagtacgcctatccgcatcatgtggtctcaacgtgatccatcattgagaaaatctggcgttggaaatgtttttatcaagaatttaaatcgttccattgaaaacaaagccatgtaagatactttctcagcttttgggt

SEQ ID NO: 3100 - DNA, 397 bp, Diabrotica virgifera
  Clone ID: LIB149-030-Q1-E1-F7
agcccacgcgtccgatcagcggaatactggctttagcagcgaatagtttgccaactttgtacgaatattacactggaaatggaattacgctgggtttatcggacaaccagccctattttaccctcaacgagaaaaatattaccctgtacagtggggctttccactaattccgagtgccgaggaagtactggcaggacaggctgaggataatgagggcagcaggcttgaataccgtggaaacttacgttccgtggaatctacacgagccccaaccaggtgtgtacgattttggtcatggatgaactgatatggaagactttttacacattgacgaatttttgagaaccgccatcgaggatgatcgtttactgttggttagacctggtccgtacatttg

SEQ ID NO: 3101 - DNA, 443 bp, Diabrotica virgifera
  Clone ID: LIB150-025-Q1-E1-B5
caaaagcctacaataaatcggcattttgatcatcaattttgtggttttttattataaattcagctgttaggtcaggttgaaaaatatttcagtctaaaaattacgttataaaagacatcgaaatcttcgatcgattataaccataaaagcattttagtttgtttgcatttttacataacttaacctctcatagtgaacttcacatgtaaagatgtctgcagctcaaattttcaacagaatcggccaagttggcctaggaatagccctcgttggtggagtagtcaattcagcattgtacaatgttgatggaggtcacagggcagttattttcgacaggttcgccggtattaagaaacaagttataggcgaaggtacacatttctttataccttgggtacagaaacctattatctttgatgtacggtctcgccctaaaaatatcc

SEQ ID NO: 3102 - DNA, 453 bp, Diabrotica virgifera
  Clone ID: LIB150-019-Q1-E1-D6
ccacgcgtccgccaacgcgtccggatggtgtcacccacaccgtcccaatctacgaaggttacgctcttccccacgccatcctccgtttggacttggccggtcgtgacttgaccgactacctcatgaagattcttactgaaagaggttactcattcaccaccaccgctgaaagggaaattgtccgtgacatcaaagaaaaactctgctatgtcgccctcgacttcgaacaggaaatggccaccgctgctgcttccacctccctcgaaaagagctacgaattgcctgatggacaagtcatcaccattggtaacgaaagattccgttgcccagaagccctcttccaaccttccttcttgggtatggaatcttgcggtatccacgaaaccgtatacaactccatcatgaagtgcgacgttgatatccgtaaggacttgtacgccaacactgttctct

SEQ ID NO: 3103 - DNA, 459 bp, Diabrotica virgifera
  Clone ID: LIB150-048-Q1-E1-H4
cgacccaggcctacgaatgtctatcagtagccatgaccactccttggggaatactggaacagctacaacattgggcatccgttttggctgatcatctcgataagctaaaattagatatagatctgagacaatctaggaaacaactgatgattaagatgtggctggattacattgaacctggagatgaattggaccctgcttctcccatgaagagaagttccagaaatttgggagacgatgatgagggttacgatggaactatgctaccagaaggaacattatcaaataatttaggtctggatattgtggtggttgtcacaaaaactgattatattcaaaatcttgaaaaagagcaagattatcgagatgaacatctagactttatgcaacaatggattagaaggttctgccttcagtatggagcagcactttttttatacaagtgcagaagaagataaa

SEQ ID NO: 3104 - DNA, 387 bp, Diabrotica virgifera
  Clone ID: LIB149-020-Q1-E1-A9
aggtctagagtcatgtgtctagtcaaagctattgtgattacttgtattctactaattaagttggacggaagtgatagcatacaagaagtaaatcaatttgatgatggaggctctaatattcttgtagctgttgttcagatttatcgtcacggaatacgaactccatattcattttacaaaaatgatcctcattttaacttatcaatatgggagggacttggtgccaaacaacttatgaatgaaggaaaacgtcagcactattcgcttggtcaatttacaagacagcggtatgcagactttttaccggagaggtacgacaaagatgtaataaccgcatatacaacagactccgacagaacccacatgtcaggtcaatgcaatctatat

SEQ ID NO: 3105 - DNA, 312 bp, Diabrotica virgifera
  unsure (1)..(312): unsure at all n locations
  Clone ID: pGUT3992
agattggtaaggagggacaagcttctttgaaatccaaaggctttacccaaccttattccaggtggtaaaaaacaccccaaatggtttatttggggcccctaccaatgtcggttcaaaacaaatccaacaaattcgtatttcattgcgaggaaatgctgtcgttcttatgggaaaaaataccatgatgcgtanagctatcaagggccatattgaacacaaccctgctctggaaaagatcttgccccacatcaagggtaatgttggttttgtttcacccgaggtgacttggtgaaatcagagacaaactattgg

SEQ ID NO: 3106 - DNA, 421 bp, Diabrotica virgifera
  Clone ID: LIB149-031-Q1-E1-D9
acggacgcgtgggattgcactgaactcctggaagaaaataatggatggacaaagaaatgggacgaacatggaaaagtaccgtatgcttataaaggaacacaatgggtcggctacgaagatccagaatctgtacaaataaaaatgaactggataaaatcaaagggatacgcaggtgctatgacttgggctatagatatggatgacttccacggtttgtgtggtcccacaaacgttttgatgcatatattacatgccaacatggactcttatagtgtcccagaacctcatgtatcaacaacagcaaggcccgaatgggatcgaccaaaaagtacaacttcttcaggcagtgcaacagtagtaacttcatctacacctaaaccacctaaaccaacgtactccagtacggtttccacttcacagc

SEQ ID NO: 3107 - DNA, 407 bp, Diabrotica virgifera
  Clone ID: LIB3026-002-Q1-E1-B8
atgctaaaataccatctggagattggttatggccagctgtctggatgttaccaactaactgggagtatggaaattggccagcatctggagaaatcgacatcatggaaagtagaggaaaccgtcagtattatgcccccaatggacaaaacgttggaactgcaacagaatcatctactctacattggggacctactccacaattcaacaaacaactgaagactcactgggaaaagatcaattataacggtggttgggataacgctttccatagatatcaagtggaatggacgcctgaacatattaaattttcctgcgatgatcaagaacttggtacaattacacccccatctggaggcttctgggaatacggtgatcttgggccatctggattgccaaacccaagggcc

SEQ ID NO: 3108 - DNA, 444 bp, Diabrotica virgifera
  Clone ID: LIB3026-004-Q1-E1-E5
cccacgcgtccgacctcgtggaagtttcttttctgtctgcgaccttagcgaaaatggcaacttcaatctcaaaaaagcgtaaattcgttggagatggtgtcttcaaagccgaattaaatgaatttttaacccgtgaactttccgaagatggttattccggtgtggaagtacgtgttaccccaacacgtaccgaaattattattatggccaccagaaccgacagggtgttaggtgagaagaacaggaggataagagaattgacttctgttgtacagaagaggtttagtttccctccagattccgtagttttgtatggtgaaaaagtagccaacagaggtctgtgtgctattgcccaacctgagtcacttaggtttaaattgattggtggtttggccgtccgtagggcttgctatggtgtcttgacgtacatcaaggaatgtgggg

SEQ ID NO: 3109 - DNA, 416 bp, Diabrotica virgifera
  Clone ID: LIB3026-030-Q1-E1-H5
ttccgggtgcccccacgcgtcagcatccacgtaagtaagattagaaacctacccagcagcctcagccagctgttgatccatccaaacgtgcgcctgactgggaattgcatcaaacgatacgttcgaaaactagcacgagatttcgcaggtttcgatggcgataacatggttgataattgtgttgatttgggacttttcgccaacagggttctttctatacgtgacacgtggagcttggagcgactggtggagcattttctagacttacaactaagcatagacatgaacgtgaggcatagtcggtggcatataattcctctgtcgaaagaacagcaactatatgctgcaaccgattcatatgcaagtcttttactctataatgttttgaaaagtcgtgaaaatgagttaaaggcttt

SEQ ID NO: 3110 - DNA, 339 bp, Diabrotica virgifera
  Clone ID: LIB149-027-Q1-E1-A4
gattggagaccacttgctttcaatttatcaggtcatgatggaattaggttggggtcatttctcgactgtgtggttgtgttgggatgactaggagaagagatttgttgccctaaagattgtctggtcagcagatcacttcacaaaagctgctcgtgatcaaatacacagtttgagttcagttagagagtcgagatccaacatatccaaagcgtattacaactgttcagcttttaaatgagttttaagatcagcgggatcaatggggtacacgtctgtaaggtctgtgaactgcaacgtcatcaattattataattaagtattaaatccaattatagagga

SEQ ID NO: 3111 - DNA, 341 bp, Diabrotica virgifera
  Clone ID: LIB149-047-Q1-E1-C12
ggcacactaactaaactcctactaccgccgccgtccgctctaccccaggtaaggaacggaggagcggcgatgtctcaccgcaagttcgagcacccgaggcacggttccctcggcttcctcgccaggaagcgctgctctcgccaccgcggaaaggtgaaggccttccccaaggatgaccaacagaagccttgccacctcactgccttcctgggctacaaggctggaatgacccacattgttcgtgaggtcgagaagcctggatctaagctccacaagaaggaaacctgtgaggctgttaccatcattgagacccctcctctggtcattgttggtcctgtggc

SEQ ID NO: 3112 - DNA, 429 bp, Diabrotica virgifera
  Clone ID: LIB150-024-Q1-E1-B5
aatttgttgaacggcaatcatcatggctaaggtacccaatgtcaagttcaacaacggagaagtttttcccgcctatggtctaggcacatggaagtcaaagcctggtgatgttactcaagctgtgaaggatgccctcgacatcggctaccgtcacatcgattgcgcccatgtctacggaaacgaaccagaagtaggtgctgccttgaaggccaaacttgccgatggcacagtcaaacgtgaagacatctacatcaccagcaaactctggaacaccttccacagacctgacttggtagaaccagccgttagaaccacattgaagaacttgggtcttgagtacttggacttgtacttgattcactggccttttgctcttaaggaagacggagaccttttcccagtaaatgccgatggcagcacagcctacag

SEQ ID NO: 3113 - DNA, 336 bp, Diabrotica virgifera
  Clone ID: LIB150-035-Q1-E1-E3
agaacagtacctgtaggtcgtgttgaaactggtgtattgaaacctggtatggttgtagtattcgctccagccaatttgacgactgaagtagaatccgttgagatgcatcacgaagccctccaggaagcagtacctggtgacaatgttggtttcaacgtcaagaatgtctctgtgtcagaattgcgtcgtggttacgtaactggagacaccaagtaacaatccatccagaggagcttcagacttcactgcccaagtcattgttctcaagcaccctggtcaaatctcagaagggtatacccctgtaatcgactgtcacacagctcacattgcctgcaa

SEQ ID NO: 3114 - DNA, 388 bp, Diabrotica virgifera
  Clone ID: LIB150-010-Q1-E2-H12
ccattgtttattgccgagttcttaaattcgaaaatacgagtccctaaccacttcaaagatgggtagggaggacaaggctacttggaagtcaaaatacttcaccaaacttatccaattgctagaagactacccaaagtgtttcattgtgggcgctgacaatgtcggctcaaaacaaatgcagcaaattcgtatttcattgcgaggaaatgctgtcgttcttatgggaaaaaataccatgatgcgtaaagctatcaagggccatattgaacacaaccctgctctggaaaagatcttgccccacatcaagggtaatgttggttttgttttcacccgaggtgacttggttgaaatcagagacaaactattggaaaacaaagtcaaagcccct

SEQ ID NO: 3115 - DNA, 407 bp, Diabrotica virgifera
  Clone ID: LIB149-036-Q1-E1-D5
aaaatcaatcacacatgagtgaagaagaagttgctgctttagtcgtagacaatggatccggtatgtgcaaagctggttttgccggggatgatgcacccagagctgtattcccttcaattgttggacgtccaagacatcagggtgtgatggtaggaatgggccaaaaagattcctatgttggcgatgaagctcaaagcaaaagaggtatccttacattaaagtaccccatcgagcatggaatagtcacaaactgggatgatatggagaaaatttggcatcatacattctacaatgaactcagagtagccccagaagaacaccccgttctgttgacggaagctcctctcaaccccaaggccaacatggaaaagatgacacaaataatgtttgaaactttcaacacccca

SEQ ID NO: 3116 - DNA, 320 bp, Diabrotica virgifera
  unsure (1)..(320): unsure at all n locations
  Clone ID: pGUT470
agtaaggtgccccataaccgcaacgaaaaaaaacgtaaaaatactaaataataataatggcaccctttaaaattgttatggttcgtcatggagaatcagaatggaatgaaaagaatctattttgtggctggtttgatgcaaatttaagtgaaaaaggtaaacaagaaaccattaatgccggataagcactaaaaaatgcaggatacaaatttgacattgcatatacatctgtccttacaagagctcagaacacacttaattcaataatcaaagatattgggcaagataatntggagactatanaaacttggagactcaat

SEQ ID NO: 3117 - DNA, 186 bp, Diabrotica virgifera
  Clone ID: LIB150-004-Q1-E1-E11
aatcgctcccccagaaaggaactactccgtctggatcggtggatccatcttggccacactctccaccttcgaacagatgtggatcaccaaacacgaataggacgactccggcccaggaattgtccaccgcatgtgcctctaagccatttaagcgtttcacacctagtaagctatttgtcatgttgt

SEQ ID NO: 3118 - DNA, 389 bp, Diabrotica virgifera
  Clone ID: LIB149-034-Q1-E1-A8
acggacgcgtgggtaagtatcgaacttagacgaaagaaaagccctagacaagagttactggaaaacgaacctacccttagaaaatatggatacagactggaatttcttaaaaacagaagaattaaagaaccccgaacaaacgattctatcgctttatacagatatttggacaacgagttttatggcacaatagtcattggccatccaggaaaaacatttgatgtctcttttgataccgcatggggcctttcatggttattgtcgtcaagatgtgatacgagcctaactccaggatgccgtggccataacttgtacgatcgttacaaatcttcaacttttaaaaagaatggtacccaatattttatacaagatggagcttttaatttcac

SEQ ID NO: 3119 - DNA, 433 bp, Diabrotica virgifera
  Clone ID: LIB3026-005-Q1-E1-F7
gcaaaaaaacatccagaagtcaagttcgaagagaaatatttggacacagtatgtctgaacatggtacaagatcccacccaatatgatgtattggtaatgcctaatctgtatggtgatatcttgtctgatatgtgcgcaggtcttgttggaggattaggtcttactccttctggtaacatcggccttaacggtgctctatttgagtcggtgcatggtacagctcccgacatagctggtcaagacaaagccaaccccaccgccttgctcctttcagccgtcatgatgctgaggtatatgggccttaacaaccacgcgaccaaaatcgaaaacgcctgcttcgagaccatcaaggaagccaaatacctaacaggcgatcttggaggcaaagccaaatgttcagagttcacgagcagcatctgcgagaaaatagcat

SEQ ID NO: 3120 - DNA, 432 bp, Diabrotica virgifera
  Clone ID: LIB150-033-Q1-E1-B10
ctcgcgggtcgacacaagcctctaaaatgtgtcataatattgaaattaatcaccttcatattcataatagtgaccgtcaatgcagcagaaagaatcaacaataatttaatttataaaaatgtggatagaaccatagatttaacgtcacagttagtaaaaatcaccagcaccataactcttgaaaatgccggcgcagaccctatcaagaattttctactggcggagcaaccaaatttagttggacagatagcatttaaaggtgccaaagactctgccaagcaagatttaaacgtcttaacagcccaagtagaaaaccagagcgataagagattccacaaagttatcttgaggcagaatttggaaccgggccgtactgcaacagtggtggttgaagaaatactcattaaaagtttaattccatatccacatagt

SEQ ID NO: 3121 - DNA, 401 bp, Diabrotica virgifera
  Clone ID: LIB150-017-Q1-E1-A5
cgcgtccgggccaataggggtgtatgtttgagtatttttagtgctagttaaattttactaaattttatcccaatttgattatagtttaaaggtccagtgtttaaaaagatcggcgaaatgggctcgttatttcgaagtgcggaaatgactttgtgccaactgttcttgcagagtgaggctgcttacgcctgtgtctcggaactgggagaactaggattggtacaattcagagatctaaatcctgacgtaaatgctttccaacgtaagttcgttaatgaagttcgccgatgcgatgaaatggaaaggaaactcaggtatctcgaaaaagagattaacaaaggtggaaaccccaagcctggtaacggggaaaattcccgaacctcaacagcaaagagagatga

SEQ ID NO: 3122 - DNA, 421 bp, Diabrotica virgifera
  Clone ID: LIB3026-005-Q1-E1-G2
cttgaatgtctcaagttgtacgataaagaagaaaacggtaaaatgatggctgctgaactttcccacacactcctttctcttggtgagaggttagctgacgcagaaacagaacaagtcttagccgattgtatggacaaagaagatgacgatggcttcatcccttacgaaccattcctcaaaaaactgatggcgtaagatgtattttactttttttttatttttaatcacctgagaagtgctgtcaaattgaaatggcttttcgaacaacagaaattgaacaccagaagtcaaacaggagtgtgtactaccaacaacaatcataggcactgcctttaccaaccacatttcaaatacgctgaaatacaatgtatttatttttaaattattttattatatttaattaaaattataaaaactgtcc

SEQ ID NO: 3123 - DNA, 419 bp, Diabrotica virgifera
  unsure (1)..(419): unsure at all n locations
  Clone ID: LIB149-042-Q1-E1-E9
tacaagcctctaaattgagtcttattaacaagctttggtcgagaatccaaacgttgataaaatcgccttcactggatcaacggaggttggaaagctgattcaggccaatgctggaaaaaacaacttgaagagaacaactctagaattggggggcaaaagccccaatatcattttagccgatgccgacctcgaacacgctgtcgaacattctcaccaaggagtcttctacaatcagggccaggtttgctgtgctggaaccagatgtttcatcgatgacaaaatttatgacgaatttgtcgagagatccgttgaaagggccaagaaacgtgttgtangggatccattcgacttaaaaactgagcaaggaccccaagttgacgagacacaatttaacanaattttgggattaattaaagaaa

SEQ ID NO: 3124 - DNA, 438 bp, Diabrotica virgifera
  Clone ID: LIB149-007-Q1-E1-D1
cataagtaataataataatacaaaagagtcatcatgaagttcttggttttcagcttggtctttgctgtttactatgcaaatgcagctattactcccgaacaagctgagaagatcaaaagtttccacaaagaatgtcttccggaatccggagttaatcccgaattggttcaaaaggcaagacaaggagatttcgccaatgacgacaagctaaaagcacatatcttctgcgtctccaagaagatcggtttccaaaacgatgccggtgaaattcaagtggaagttctcaaagccaaagtgggtgctgccttagaagatccagctcttgctgcccaattgatcggcacctgtgctaagcaacaagcaaatggaccagaaactgcctttgaaaccatcaaatgctatcacgaaaagacaccaattcatcctaagaataattaa

SEQ ID NO: 3125 - DNA, 401 bp, Diabrotica virgifera
  Clone ID: LIB149-019-Q1-E1-B11
acggacgcgtggggtagcttgtcctagttacatattgttgttaaatatatatttttttgatattttctagtgttgagttgaaataaggcaaaaaaatacaaaatgacagcccacgatcagatgagggctatgttagatcagcttatgggaacaggaagaaatggtgaaagtaacaaattccatgttaagttcaatgataccagagtgtgcaaatcatttttgctcagttgctgtccccacgagattttatcttccacacgaatggatctgggtgaatgcccaaaaatacacgatttggcgctgcgagcagattttgacaaggcccagcaatccaaggactacttctatgatttagatgcaatggaacatttgcaagcgttcataggcgattgcgacagacg

SEQ ID NO: 3126 - DNA, 390 bp, Diabrotica virgifera
  Clone ID: LIB150-010-Q1-E2-B7
gacaagactggttccacggaaggtgtgttggcattctgcagtcagaagccgataatatcgatgaatatgtatgtccaaggtgtcagcgaaacaattccgtcaactttgcaaatatgaaagatttgcaacctaaggaccatgaaggattgaggaagcttatcaagcaattgcaggttcacaagagtgcctggccatttatggaacctgtggatccaaatgaggctccagattactataaagtgataaaagaacctatggacttgcaaatgatcgaaacaaaaataaacgatcaggtctacacgaaactgagtgagttcattggggacatgacgaaaatttttgataactgtagatattacaaccccaaagaatcgccgttctacaagtgtg

SEQ ID NO: 3127 - DNA, 382 bp, Diabrotica virgifera
  Clone ID: LIB150-010-Q1-E2-G3
ttccaggtcgccccacgcgtccggaaaattggaaaccgaattgcaaaccctccactcagaccttgacgaacttctcaacgaagccaagaactccgaagagaaggccaagaaggctatggtagatgccgctcgtctcgctgatgaactccgcgctgaacaagaccatgcccaaacacaagagaaactccgtaaagctctcgaagctcaaatcaaggacctccaagtacgcttggacgaagctgaagccaatgcccttaaaggaggaaagaaggctattgccaaattggaacaacgtgttagagaattagaaaatgaattagacggtgaacaaaggcggcacgcggatgcccaaaagaacttgagaaagtctgaacgtcgtatc

SEQ ID NO: 3128 - DNA, 400 bp, Diabrotica virgifera
  Clone ID: LIB149-004-Q1-E1-A3
agccagaagcagtgtctctattcttcactgctttaactgcagctccatttttgatccttctaatttgctggggaagaattggaatcaatttaggaaactttacagtactagcgttacctttccacttaggttttggatctatattggcactattcactctattctggttgaagttagatatgttcatgacatgcgcctggttagttcccataggaggttttactttcctctccgggcacaagctattgagtcatttagctgccaatagaaagcaagataaggctgataagtaagtttagtactgtttattatttgctgataaagcgggtattttgttcacatacagataactttttgtacaagaaattttgttaacatttcagttctattcatttcttta

SEQ ID NO: 3129 - DNA, 421 bp, Diabrotica virgifera
  Clone ID: LIB150-049-Q1-E1-H11
cgggccgacccacgcgtccaatcacacacggattcgcctatgttgtccagtcccaccaaaacaactttgaatggatttctttcaagacaaacgctaacgcgatggtcagcacgttggccggtagaacctcggccttgagggcattgccactagaggtcataaccaacgctttccaaatttctctcgaggaagctagaaggatcaagttcaacacgcttgagaccactttgactcgtgcgcgcggtggacaaccccagttgatcgaggagatagtcgaggcttaagttaaaacgtttacttttactaataaagtagtgacatggttactattgtaatggtcagtttgtaatcatggtcactctaagtttttaaccttatgtgtaaaataagtgtctaaagaacacgccgggacgtctcttgt

SEQ ID NO: 3130 - DNA, 252 bp, Diabrotica virgifera
  Clone ID: LIB150-018-Q1-E1-F6
ccacgcgtccggtttggatcggtggctccatcttggcctccctctccaccttccaacagatgtggatctccaaacaagaatacgacgaatccggccctggaattgttcaccgcaaatgcttctaaactactttatatttatcgtatacatattaagtacaatactgagagttggagcatgaatgtatgtttttatttatggttatatatatgatgacttgttgatattgtaacaataaattcattttgtatt

SEQ ID NO: 3131 - DNA, 229 bp, Diabrotica virgifera
  Clone ID: pGUT1572
aagatatgaaaatatctaatacctggttcaagctaccacctagacgcttatatacatggaaagccccagcggaccgccccgagagtatagttcgaaaccagatcgattaaattatggttaacaaaagatttggatcatcagtaactagaacttgtacataccctggcgccgatgttccatcagaccatgtccttctcttagcagaaaaaaaaaaaaaaccccaaggggg

SEQ ID NO: 3132 - DNA, 346 bp, Diabrotica virgifera
  Clone ID: LIB3026-019-Q1-E1-E9
aggaaaaagagtaccttagcttatggttagtgatgtccgaaatcaggaacagatactgtgcccttcatgacatcgttcttaaaaatctcgacaaaattaagaagcctagaccctcaaatgctaccgaatctttgtactagaatcaataaaaattcattctgtcatattaaatttatttgtaaacattaactaattggagtatatctggcgcgtatggaagtttttctaaaagtaaacatattttcttaagatttgagttgacatttttcatgtatattatttttgtcttagggtagttgttcaccaaacttttttgacaataaaaataggcggaaaatatgacaaa

SEQ ID NO: 3133 - DNA, 409 bp, Diabrotica virgifera
  Clone ID: LIB149-012-Q1-E1-C9
accaaatattcaaggtatacttgcacaattgtccgatgatccaatacctgattcctttgattggagaggatcaggtgcagttttggaagttaaggaccaaggcagttgtggatcttgttggtcgtttagtgttactggagcattagaaggacttaatttcttagcaaataacgtaacacttcctctaagtgaacaagaacttgtagactgtacggcactatacggtaacgctggttgcaatggaggaaatatgcaatacggttttaagtatgttaaatctaaaggtatatcaagtgaagcagcatatccgtacgcaggagtagatgagtcttgtagacgaaatgcgagcaatattgtttttaaaataaaaggtttccaaacggtctcaaaagatgatgattcattgaga

SEQ ID NO: 3134 - DNA, 406 bp, Diabrotica virgifera
  Clone ID: LIB149-045-Q1-E1-B2
aaagagtcactcttgacttggtactgagattgagaggaggtatgcagatcttcgtcaagacactaactggaaagaccatcactttggaagttgaaccatctgataccagtgagaatgtcaaagctaagatccaagataaggaaggtatcccaccagatcagcaaagattgatttttgcaggtaaacagctagaagatggtagaactttgtctgattataacatccagaaagagtccactcttcacttggtacttagattgagaggaggtatgcagattttcgtcaagacattgactggtaaaaccatcacattagaagttgaaccatctgatactattgagaatgtgaaagctaagattcaagataaggaaggtatcccaccagatcagcaaagattgatctttgc

SEQ ID NO: 3135 - DNA, 435 bp, Diabrotica virgifera
  Clone ID: LIB150-043-Q1-E1-B5
aatgggaacaaagattttattagaataatataccgaaaatgccgagtcaagaattaacaactaataaagtaatagtccaccctttggttcttctaagtgtggtggaccattttaatcgcatgggcaaaatcggcaatcaaaagcgtgttgttggtgttcttcttggctgttggcgtgctaaaggagtcttagatgtttctaacagttttgcagttccttttgacgaagatgacaaggataagtctgtgtggttcttggaccatgattacttagaaaacatgtatggaatgttcaaaaaagttaatgccagggaacgagtagtaggttggtaccacaccggccccaaacttcatcaaaatgatattgccattaatgagttaatcagaaggtattgtccaaattccgttctagttatcatagacgctaaaccaaaag

SEQ ID NO: 3136 - DNA, 379 bp, Diabrotica virgifera
  Clone ID: LIB150-032-Q1-E1-E11
accacgcgtccgatcccgaccaagaaaagtcaagtattctcaacagcagctgatggtcaaactcaagtagaaattaaagtccaccaaggcgaacgtgaaatggcatcagacaacaagattcttggtcaattctccctcatcggtattcccccagcacctcgtggtgtaccacaaattgaagtaactttcgacatcgacgctaacggtattgtacatgtatcagccagagacaagggaactggaaaagaacaacaaattgtaatccaatcttctggtggtttgagtaaagatgaaatcgaaaatatggttaaaaatgctgaacaatacgcacaacaggataaagtcaagagagatagagttgaagcagtaaatcaagctg

SEQ ID NO: 3137 - DNA, 429 bp, Diabrotica virgifera
  Clone ID: LIB3026-028-Q1-E1-B3
acccaagcgtccgcccacgcgtccgctagtcccggtgaattgtggtttatcggacaaatatttccaatagtccttgtagcaacaaaagtaatccaaaaatgactgaccaaccactaccacctccagttatgtgggcccaaaggtcctctattgtatttcttaccataaatttagaagatgtcaaaaatccggaaattaagttcaataaagattctatatattttaaaggtacaggaggtgtagaaaaaaaggattacgaagtaacaattcccctgtataaagaaattgatcctgaacagagtaagagcttcaataaaggaaggtgtattgaaattattgtaactaaagcaaacacagatggaccctactggcctacattaacgtctgacaaaaagaaacaccattggttaaaatgtgatttcaacaaat

SEQ ID NO: 3138 - DNA, 426 bp, Diabrotica virgifera
  Clone ID: LIB3026-034-Q1-E1-A11
accacgcgtccgcccacgcgtccgcccacgcgtccgtaaaagacgaaaagtccactttatcaactgtattgcggctgtgcacgagctgggcttatctcttaagtatttcaattatctcgtagaattagctgacaaacaacggtacgacgttgcagttgcagaattagaagccagacaatgtaaagatctgttatctcaagctcaatatcacgttgcaagagctagacgcgttgacgaggaagaacgattgatcagacgaaaacaagaagaggagcgagtagcattcaaaatgcgacaaatcgaagaacaaaagaaattcgcagagttccagaggctcaacaaggaacaactggtgcaaaaacgacaagaatacaaagaaaaaacaaagaacgcaattatattccaagatatgccctccgagaaaaa

SEQ ID NO: 3139 - DNA, 305 bp, Diabrotica virgifera
  unsure (1)..(305): unsure at all n locations
  Clone ID: pGUT780
gtaaatgcaagcaaaaaacaccttcctttcatggccaaaggtttcgattccgccaaattaacgttaaagatctgtgatggattcgaatatatgaagaaacacaaaaatgaattcgatgttattataactgactcttccgatccaattggacctgctgtgaatctctttactgaatcgtattatanacttgccaaagaaacacttanaccaaatggtatcatcagttgccaagctggaactgtctggtctgatctnacacacgtcaagaaaaacctcancaattgccgcanacattttaaaacagt

SEQ ID NO: 3140 - DNA, 320 bp, Diabrotica virgifera
  Clone ID: LIB149-022-Q1-E1-A8
agtatgcatctggtcgtacaactggcattgtgttggattctggtgatggtgtatcccacactgtctcaatctatgaaggttatgctcttcctcatgcaatccttcgtttggacttagctggtaaagacttgactgattacctcatgaaaattttgactgaacgtggctactctttcagcatcacagcagattgagaaattgttagagatattaaagaaaaactctgctatgtagctttggactttgaacaaaaaatgggaacagctgctagttccagttcccttgaaaagaattatgaacttcctgatggacaagtcatc

SEQ ID NO: 3141 - DNA, 425 bp, Diabrotica virgifera
  unsure (1)..(425): unsure at all n locations
  Clone ID: LIB149-036-Q1-E1-E5
ctcgcgggccgacacaagcctcaagattcaatcgtagtacaaataaattaggtattgggataattaaggatggcaaagtactttcaaattgtagaagaacctatattacaccaccgggtgagggttttttacctaaggagacagcacaacaccacagggaaaacgttttagtggtattaaacgaagctttacaggaatcacaattaaagcctgaagatatagatgtcatttgttacacaaaaggtcctggaatgggagctcctttagccaccgttgctgttgtggcaaggactgtagctcagttatggaacaagccacttcttggagtaaaccactgtataggacatatcgagatgggtagactaataactggagccagtaatcccactgtcctctatgttagtggtggtaatactcanatcata

SEQ ID NO: 3142 - DNA, 404 bp, Diabrotica virgifera
  Clone ID: LIB3026-001-Q1-E1-A7
atgaaattcgcagaaagatgcattaaagaaagcttaagattatatccaagcgccgtcagtatttcacgattgtcaggagaagaaataaaaaccaaaactggatatactattcctaaaggatgtacagtagctgtcttgatttacgacctacatcgtaatccagagatctgggaaaatcctttaaaattcgaccctgatagatttttacctgaaaatatgtcaggaagacatccatatgcttatattccttttagtgctggaagcagaaattgcataggacaaaaatatgccatgttggaactgaaaactgcagtttgtggactgataaacaattttaagctggaacctgtaacaagacctgcagacatgagatttaaagctgacatcgttcttagaccagctaa

SEQ ID NO: 3143 - DNA, 390 bp, Diabrotica virgifera
  Clone ID: LIB3026-010-Q1-E1-E8
atgcaagaaggggttctaactttctaacaaagatattaaaaacaaattttgtatttaaataaaaatatttactgtaagggacctacaaaatgtttcaatttggattcaacatgtttcctgaggtccccaggccttttaatatgacttataagtgctactcagtggctatgtttcctggcaatgaacgagaagacgttgaaaggggtggaaaaattattatgcccccatcagctttggaacaattgactaggttaaatataaactatcccatgttgtttaaacttgtgaataaaaacacacatcgcacaactcattgtggagttttagaatttgttgctgatgaaggaaaagtttatttgccactttggatgatgaacaccttactactga

SEQ ID NO: 3144 - DNA, 453 bp, Diabrotica virgifera
  Clone ID: LIB150-026-Q1-E1-D6
ctcgtgggtcgatacaacaccctaaaatgagtcgtagaacagaaaaatggaaaatatgtagttgtagcaggaatgactccaacacctctgggagaaggtaaaagtacaactcttttgggattggtgcaagctttgtcaacacatttgaaaaagaatacatttgctacaatgaggcaaccttctcaaggtccaacatttggtattaaaggaggtgctgctggtggaggatattctcaagtcattcccatggaagatgtcaatcttcatctcacaggagatatccatgctattacagctgcaaataaccttttggcagctcaacttgatgctaggattttccatgaagcaactcaaaaagatgcagctctatatgatcgtcttgttcctaaaataaagggtgcaagaacattctcaaagattcaacttagacgccttaaacgattaggtataaac

SEQ ID NO: 3145 - DNA, 402 bp, Diabrotica virgifera
  Clone ID: LIB149-021-Q1-E1-G11
atttttatttaaaataaaacatattaaacgtaacactaatatttcgtttaaaattagacttgagcaggtgcagcaacaatagagtcctcgaagcctgattcattatttccgcgacgtattttaaacaatcccttgtctccccaatcttcattccatgaattagcaaccaaccaataagggactccactctcttctccccaacctaaaattctgacggcatgtcctcctaaatattctccagcaacatgttgatagacaccacttttataattcacgaagtcgctgtacacatcaaaagctgcttctaccggaccattcgtcaatatttccttttgaatatttgcaactgaatagaagttacgcacagaacctgaaccaaaagttaactcggacttataattg

SEQ ID NO: 3146 - DNA, 322 bp, Diabrotica virgifera
  unsure (1)..(322): unsure at all n locations
  Clone ID: pGUT3872
tgtggatcttgctgggcaatgtctgcagcatctgcaatgagtgacagacgatgcatagtcacccagggaaagcttaaagtgcctgtttctgctgaaaatttattgtcttgttgcgatgactgtggatttggatgcgccggaggatatatagatgatgcatggtcgttttggcaagagaatggaattactacaggaggtctttacggcagcaaccagggttgtcaatcatattcgcttcaaccttgtgaacatcatacaaatggtactanagtgcaatgcagtactttgaactacggcacaccttcttgcagaagcgatcaat

SEQ ID NO: 3147 - DNA, 402 bp, Diabrotica virgifera
  Clone ID: LIB149-031-Q1-E1-G3
acatgctgcaaattttacatttacgtatcaaaacagaccaagcatattagaagttatcgctcaacattccctcaatgaaaccttgcacccagctctacaaagacttgctttggtgctttccacaaatattccgcacaaatttggatggttgaataagtatttcgaagaaacttttgttgtgttgaatggtttattacagtatcactatttagctcactatgattcatcatttgctgaacacttttatggactgaaacgggtatcttccaatggtgaccccataaccaaaaggcatagagaattgtctttaatatttttagttggtattccatattttaaaaggaaaatagatgaaaaagtagctataataaggatagaaaatgctgaagggtctatacgaaa

SEQ ID NO: 3148 - DNA, 369 bp, Diabrotica virgifera
  Clone ID: LIB149-022-Q1-E1-D7
acacagacgtcgtactaacgcgtgggcggacgcctgggacaaaatggggagacaggatgctctaattcaggagtatccgtaccaagtttcaattctcttttacggaaaacatggatgcggtggttcaataatcaatcgctactagagtttgacatcaggacattgtacttatgatgtcacgaaatcagtgctgaccgtacgtgtaaactcttccttcagagacgagcaaggcacagtctacgaggtaaatcaaatctttgtacatgatggttttgaccacaggacattagagaacgatgaaacgcatcgttcgtcttgcaacaacttttaaaccttggaaacgggttcagtccaatcgcagttgcaact

SEQ ID NO: 3149 - DNA, 202 bp, Diabrotica virgifera
  Clone ID: pGUT343
cttgtgttgggtttctcctgcgtggaattggaaacatcaatagctactcgcaccccaatttcttggttgttgatataaattctgctgttatcgaaatacaatatttcttttatcgtatcctcataagatatgatatcgatattatttgggtcatccaaaactttgctgatctcatcatatatgttttcgatagccactattc

SEQ ID NO: 3150 - DNA, 254 bp, Diabrotica virgifera
  Clone ID: pGUT2146
ggcaaatagagaattaatttattaacactaatatgtaatttatgactttatttccagaaaaacgaaatcgcagtatttccattagttcgttatagttattgattctggcatttctggtggtggtggtcgtggcattctcatggcaaccttgaaggcatcatagatgaaccactgcaaagcagtcaatgtaccaatcatcacaatcctaggagtcaatcccttccatatccagccattcccaatttcttagcagc

SEQ ID NO: 3151 - DNA, 459 bp, Diabrotica virgifera
  Clone ID: LIB150-022-Q1-E1-A1
caagattctggactgatgaacgttgcctaactttaaactttgacgtaggacgacaggtacaaggtgaaatttgggtacaaactccgaccctggtgcccttattccgggtattgactcctctaaatcatgtaacttggaaattattctaatcctaacgaattgtggagatgacctgggtcctgcttaacaaccaacaatgatagccacttcaagatgtttcatatatcccactttttacggaatgtcaattttgaaacctagtatcagagatgaaatgatgttggctacagccaaaaaggccgaagacttaaataaccccgacaaaatgaatgacgcctctgagcaaatcatacatatggtaaataaagcagtcacttctatttcaaacagacttaccaatttagcacaattcgaatggactgatagtaaggttgctacattggatgctgctgcaaacag

SEQ ID NO: 3152 - DNA, 352 bp, Diabrotica virgifera
  Clone ID: LIB149-028-Q1-E1-G10
aggttagcaaaaaagactatcctgtaattttatttttaagctcaaaatctaactaaacataaaaatgtctgcttcgtttattcatagaataatcctgtctgtaagattcctatcattgtttcattctgcatattcagctgctcaacatcgataatatcttcgtttgaatgacttagattttacacatttaccttgagatatctttattcatgctttgattagcctctttgtcatcatgtatggtgttctgagcatcgtcggtaagtttaatgagattaattccacatctgaattggaaaacatgtcctgtgaaacttttagggaaattccttccttctttaccttcattcat

SEQ ID NO: 3153 - DNA, 290 bp, Diabrotica virgifera
  Clone ID: LIB3026-027-Q1-E1-F3
aaggcaagataaaaagagcgaccaaaccactccaagaatttaaaacaagaccttacaagccccggggttgcaaaagttacggggggaacccatcaaaactttcagaaatccgtgtggtacggaaagctattgcccgtgtatacattgttaggcaccagaaacaaaaagaaaacttgaggaagttgtacaaaaataagaaatacaaccctctcgaccttagacctaagaagacccgttccatccgccgtgctctatccacacatgaacagatgatcaagacacctaaagaa

SEQ ID NO: 3154 - DNA, 430 bp, Diabrotica virgifera
  Clone ID: LIB149-025-Q1-E1-H11
caagactctacaaagacgtcgtgttaacgcgtccgcccacgcgtccgcccacgcgtccggagccacgacacttttagattttgtgaaaatcattcttaaacttaaaacttgttaaaaccatgtcaacataattataatactaaagttctagaaagttatttatgttttaaatttcctacaagtgtactgacaaaaaataaaaaatgtcagatttgggtgaatggtttaggagtgttcccatttttacaagatactggtttgctggttcaatattattcacacttttagggcgattcggtttcataaatccatacaatttaattctgttatatgaacctttaaaaagctttcagttatggaggcttgttacaagcgttttatattatcaaattcaacaggctggtttcactatctcatcaatttatatttt

SEQ ID NO: 3155 - DNA, 418 bp, Diabrotica virgifera
  Clone ID: LIB149-031-Q1-E1-G4
gggccggcccacgcgtccacccaagcgtccggttgaatcagacaatgataaaaatgatgaaaatgaatcaatagatgaaacttttgacaatagaaatgaaaatttaaatgaaagtatggatgataccgaaaatgaacataatgagttacgtaaatctcaaagagacaaaaatcctccaaagaaatttgatgattattatgtgtataatagtagtatttttgtaaatatgtgtagaactgatataccacatacatttgaggaggcgatgaattctgatgaaagtaagtattgggaaaaggctatggataaggagattgatagtttgaataaaaataaaacttggaaattggtcgaaaatgttgaaaataaaaaagttttggatgttaaatgggtatatactaaaaagtctgatgataat

SEQ ID NO: 3156 - DNA, 451 bp, Diabrotica virgifera
  Clone ID: LIB150-022-Q1-E1-D9
gaaaaggctactttacaagcccaatcagaagcttcaatgagacaagcccagagtgcaactactgcagctaagagcttgttggcccaacgtggagaagtagcacaaaatgagagcaatgaagctcatgaccaggtaaacgaactcaagacaaaaattcagaaactcgaggacgaattaaaaacagaacagaaagataagactgccataaagagccaagctgagaacttggccaaggaatacgacagattggccgaagagcacagcaaactacaaaagaaggtgacaatccagggagccgagaagaaaggagaataatgtacattaaaaaacgttgattgcacatcctataactatttataataaaaagctttggttgtaacaagctctagtgtaaatatgataagatttggtgattggctatagtgagagatatgctattttttaataatat

SEQ ID NO: 3157 - DNA, 333 bp, Diabrotica virgifera
  Clone ID: LIB150-003-Q1-E2-E9
gccacgcgtccagtcaatgagcgtcgagtccatacacttactcagagtcgctgtaccaccaaaccaaaaaaccataaatcatgtgtgacgacgatgtagcggctcttgtcctcgacatgggtccgggatgttgaaaacccggttcccccggtaatgagcaactccttgcggcctttcaatcaaccttaggtcgtccaaaaaacaaaggtgtcatggtggttatgggtcaaaagacaccctacttaggaaacgaaccccaaggcaaaggaggtacccccaccttaaataaccccattgacacaggaattaccattaattggaacaatatggaaa

SEQ ID NO: 3158 - DNA, 434 bp, Diabrotica virgifera
  Clone ID: LIB150-024-Q1-E1-A7
gtgatcatcaaccaagagggcctacgcaagcctgcttctgtgtttcctactagttgaattagtaacttcagagataaccttcatagagggtaagtttagacgaggtcctgtattcaaacatcacagaagtcataagaagcatatagtaaaatctagtggctctacgttgaggctcagttgtgacgcttctggaactccaacacctaatataacttggtacaaagatggtttatccccactcccacgtagacttacaccaataaaaacttacaaatggactttggtattagaagatatggagaaagaagacgcaggaaagtacacttgcaaagtttgtaatgaagtaggttgtaaagacttacaattcgacgtagaagtaaatgagcgtgaacaaaatacaccacgtctcgttaaagagcttcacaatatgaccg

SEQ ID NO: 3159 - DNA, 328 bp, Diabrotica virgifera
  Clone ID: LIB149-038-Q1-E1-E1
tcgtattaaatcgggtacctggtagcggaaccgtcaagaattcaggccctcgcaagatagttcgtcggggtaacctaaatcgacctggagacgtcggccagagatccgggaatagttttcttttctgtataagcgttcgagttctacggaatcctccatcacggagatatggtttggaacgcgaatagcaccgcatttgcagcggtgtccggatcttctccgcgaatcttgtcaatccaggagagggccacttggaggctcgcagcggttcgtacccatatccggagcatgtctccaaagtgaagagcctctagtcgattagataatg

SEQ ID NO: 3160 - DNA, 444 bp, Diabrotica virgifera
  Clone ID: LIB150-016-Q1-E1-F10
aaataaagtatcttaggtttaatttaatttttctatattcgtcaggatatacattatttcttaattttccttttcaaatggaggaggatacgtcaacaaagaaaaaagctcacagagatagacattcaggtagaaaattggaaaagaagaaagcaaaaaaagttactcaaaatggtgaagtgggtgctaaagaacgtaatccaaaagcattcgcttttaattcagctgtaagagctgaacgccgatttagacgaaaggaagatatagataccaaaaagcaacatgttcctcttgtagacagaacacctattgaacctcctcccatagtagttgctgtggtaggtccaccaaaagtgggaaagagtaccgtaataaataatttaataaaattatttacgaagttaccattaactaacataaatggtcctgttacaattgtaacca

SEQ ID NO: 3161 - DNA, 408 bp, Diabrotica virgifera
  Clone ID: LIB149-028-Q1-E1-B6
aaacacaagtcattagtgatattttatggttttcactttttcactaatttatataaatataaaatgaaccacgacgacaaaatgatgatagaagataacaatccaacgctcggccaacctttgagtgattttcttttgcaattagaagattacacccccactattccagacgcggtaactgcatactatttacgatcctcaggactagagcctaaagatccacgattggtgcggctgatctcgatagcagctcaaaaatttatatctgatattgctaatgatgctcttcaacactgtaaaatgaggtctactaattcttcaagccacagtggctccaagagcaaacaaggcacaaaagacagaagatactgtctaactatggaagatctgacaccagctttggcagaa

SEQ ID NO: 3162 - DNA, 403 bp, Diabrotica virgifera
  Clone ID: LIB150-040-Q1-E1-H9
atccgagggagaacaagtcataacagtgtttacattaccccatagtgcactttgcaagtttggagtaacttgtaaactgttagtgaaaaccaaagagactcttggacttaattttcttgtgatttttctgtgaatttataacagataacaatggcaccaaacacgtcaatgcccaccggtgttcttcatgaacacgatgacgaagtccaagcaaaaatgattcccgcggaaattgtaaaaccaagcgagcgcaaacttgaactggtttggcgcaacatcattctttttgcttatcttcacatggtagcgctgtatggattttatctgatgatagcacaggcgaaagtatttacttcgatattggctgtagtgttatatatttgcggtggtctgggaaatacag

SEQ ID NO: 3163 - DNA, 546 bp, Diabrotica virgifera
  unsure (1)..(546): unsure at all n locations
  Clone ID: pGUT2577
gctttgtgcaacatcccttaatcgaattagaagttgatataccaaaagaggacaaagaggaagaactaactccagaaaccgtggactatgaagacgatgttgaatacttgagaagtttagaccctaaagaatggaagtcccaagaccattacaaagtcctaggtatcccaaacataagatacaaagcaacagatgacattatcaaaacggcatacaggaagaaagtcttaaagcatcatcctgacaaacgtaaagctctaggggaagaaatcaaaacagatgatgactattttacctgtataacaatggcttatgaaactctaggaaatataagtaggagaagagcgtatgattctgtcgatccacaattcgacaatgatctaccttgtactagtgatataaaaaaagacttttataaaacgtttacttattactttgacttaaactcccgatggtctgaaaaaacacgggtgcccaaattaggaactgaaaattcgacaagggaagaggtggaacacttttattcattntggtatgattttaaaa

SEQ ID NO: 3164 - DNA, 426 bp, Diabrotica virgifera
  Clone ID: LIB149-044-Q1-E1-C5
aatttattacctcatccaaatgttaaactatttattactcacggaggattcttgagcactatcgaaactctttaccacggaataccaactgtcgcagtacctgtggttcacgatcagcaaacgaatgcaaaacaagcagaaaaaaatggttattccattgttgtagactataatactcttacagaacaacaactttcggcggctatagaagaaattctttcgaatccaaaatatcgccaaaatgcaaaaacccgctctaaaatcttccatgacagaccagtaaagcccatggacgaagcagttttctgggtagaatacatcgcaaggcataatggtgctaaacatctcagagttgcttatgtggatttagcctggtaccaatattacctactagacgtcttcggacttatattcggaactatattc

SEQ ID NO: 3165 - DNA, 422 bp, Diabrotica virgifera
  Clone ID: LIB149-011-Q1-E1-B11
aacacggtatagtcagagactgggacgatatggacaaaatttggcatcatacatctctacaaatgaactcagagtagccccagatgaacaccctgttctgttggcataagctcctctcaaccacacggccaacagggatcagatgacacaagtaatgtttggaactttcaacaccccagccatgtatgttgccatctaggctgtactctccttgtatgcatctggtcatacaactggtattgtgtaggattctggtgatggtgtatcccatactgtctcaatctatgaacgttatgctcttcgtcatgcatgccttcgtatggacttatctggtagagacttgactgattacctcatgaagattttgactgaacgtagctactctttcagcaccacagcagcttgacaacttgttacagata

SEQ ID NO: 3166 - DNA, 448 bp, Diabrotica virgifera
  Clone ID: LIB150-022-Q1-E1-E12
agcccacgcgtccggcaaaaagtgaacatcctactcccgttctattcatgcgtattttgtattttgtattttgatgaatctaaaaaaatattaaagttaatgaattttggtaattaaacgtgtttaatgaaagtatgaactgtatggattagtagcattttggtatttaatagtcgttgagaatatgaatgaagcctcatcagtaggtggtcctacgggacctttaaccataagcaaggagcttatcgttaaggaaggatggttacaaaaaagaggagagcactggaaaaactggagaccaagatatttcatcctgctcaactatggagcattggtcggtttcaaaagtaaactagaagactactaccatgtcgaaccattaaacaattttactgtaaaaggttgccagatcatgtccatcgacagaccaaaaccttttacgttcatc

SEQ ID NO: 3167 - DNA, 423 bp, Diabrotica virgifera
  Clone ID: LIB150-027-Q1-E1-D12
ctcgtaggtcgatacaagcctctatagcgagtcatataaaccaatgtaaaacattcttttaagctttgaacagaaaatatgaatttggaacttttagaatcttttggacagaattatccagaagaatttgatggtacattggattctctctcaatagctgtaacttgccagtttaacaaaagaggaacccttctagctgttggttgtaatgatggaagaattgtgatctgggacttcttaacacgaggaattgcaaaagttattgcagcacatgtacatccagtttgcagtataagttggtcgaggaatggtcataaagttgcttctgcttccactgacaataatgtctgtatatggaatatactttctggagaatgtgaacaaaaatataaatttccctggtccgttccaaaagttcaattt

SEQ ID NO: 3168 - DNA, 371 bp, Diabrotica virgifera
  Clone ID: LIB149-041-Q1-E1-H3
atccagaacactatttggaagtaaaaatgaacatggaggactcatatcacattgccagaagaaagtttattccgcattcccaaaagtattgacgttcctgaaggggctacgttgcaagtaaatccagtaacaatgtatacgatgctgaaagaattcgtagacttaggacctgaagatacagttattcaaaacggagcgaattctgcttgtggagttattgctattcagatgtgcaaggcatggggaataaaaactgtgaatgtggtaagagataggccactgatcgatgacttgaaaacatttttaaaaagtttaggtgctacatatgtttttactgaagaagaaattagaaaaaccgacatatttaaaac

SEQ ID NO: 3169 - DNA, 322 bp, Diabrotica virgifera
  unsure (1)..(322): unsure at all n locations
  Clone ID: pGUT4174
gaagatttgccgcagcgcttctacaagaactggtacaaggagcagaagaaaggctttacccaagctttcaagaaatggagtgatgaattaagaaaaaagtccctcgaaaaggacttaaagaaaatttgttaataactgtaaagtgtcagagttattgctcatactcagatgaaattgttgaaacaacgtcaaaaagaaagcccacattatggaaattcaattgaatgggggtagtgtagctgacaaagtagcttgtgctaaagaacagcttgaaaagcctattcctatttgncaacgtttttgctcaagatgaaatgattga

SEQ ID NO: 3170 - DNA, 327 bp, Diabrotica virgifera
  Clone ID: LIB3026-017-Q1-E1-B9
ccgcccacgcgtccgagaatctagtgacagtgagtcggatgatgacgaaaagaacatacaggataccttgagaaaccaacggaggaaatgaatcaataaaattgggggaaaaactggacacgggcacaaagggatcagaagaatttgttcttgatcatcatccaacggtttagcatgatcctgactgagcatttggtaagatgcgacacagacggtaaagattacggtacgcactggtacaagtggactattggaagactgcaacaaatctttttggcgcaccacgatcaagtgcagaaatacagctcgacgttggagacgctatta

SEQ ID NO: 3171 - DNA, 415 bp, Diabrotica virgifera
  Clone ID: pGUT3234
gtgttcctaaatctggagaaggattcatagattttattggacaggtccacaaaactaaggagcagtttggacaagatggacctatcactgtgcactgcagtgctggagttggtagaactggtgtgtttatcacactaagtattgtgttggagagaatgcaatatgaaggagttgttgacgtgttccagaccgctagaatattgagaactcaacggcctgcaatggtccaaactgaggatcagtaccagttttgctacagagccgcactggagtacctcggctctttcgatcactacactaactaatcaatactcataagaaagaattaattttgaatcgtatttatgcatattgcatatttttactgccaaacaggatattaaacaaacaaaaaaaaaaaaaaaactcggggggg

SEQ ID NO: 3172 - DNA, 449 bp, Diabrotica virgifera
  Clone ID: LIB3026-011-Q1-E1-A8
aaacaacctacaattccatcatgaagtgtgatgttgatatccgtaaggacctatatgccaacactgtactctctggaggtaccaccatgtaccctggtattgctgatagaatgcagaaagaaatcactgccttggctcctagcacaatgaagattaagatcatcgccccaccagaaagaaaatactctgtatggatcggtggttccattttggcctctctatccaccttccaacaaatgtggatttccaaacaagaatatgatgaatctggtccatccatcgtccacagaaaatgcttctaatttgtttttgtccgcatttatattctttatttctatttacataagcccgcccattttccgggcgcgaactgccgtgtttatcgtatgggatcgagaccatagaatatccacactaggccaaagtattactaccttaatttttgtaat

SEQ ID NO: 3173 - DNA, 331 bp, Diabrotica virgifera
  Clone ID: pGUT2933
aattttccggagaagtcttaacttcttctcgtggaagaaaagagaatttattcaaagcattaatttaggggaagacggcattgcaccgctcgaagtcagatttttacaccacccccaaaaaccacacggatatgttggttgtgctgttaatgcaaaaatctttaggttctatcgtaaagatgacggtacttgggctgcacataaagttatcgacgtccctcaaaagaaagtttctgggtggattggaccctacactcaaggaatgatgactgacatcttaatctccttagacgacaagtatttatactttaacaattggcttcatggagat

SEQ ID NO: 3174 - DNA, 459 bp, Diabrotica virgifera
  Clone ID: LIB149-014-Q1-E1-C11
gatagaacaaatagaagacaatgagaaaagtacatcgcaaagtgtcgagaacaacaataccaaaggactgagtcagccaatcgaacacaaaaaatcggtttccggttatttgaacttggtagctaacaccatggacaacttcacccacggtctgtcattgggtggcgccttcttggtatcccttagactaggactgctgaccaccttcgccattttagtccacgaaatcccccacgaagtcggagacttcgccatcttgcttaagtccggcttcacgaggtggcacgccggcgttttccaacttttgaccgcaagtggcggtctcatcggcgccatggcggccatcttgttcagcggcgcacatacagctcttgaagcgaggagctcctggatattaccatttacagccggcacattccttcacatagctttagtaaccgttcttcccgatttactcaa

SEQ ID NO: 3175 - DNA, 362 bp, Diabrotica virgifera
  Clone ID: LIB149-037-Q1-E1-E11
aggtttatcggataaccagccctattttaccctcaacgagaaaaatattaccctgtacagtggggctttccactatttccgagtgccgaggaagtactggcgggacaggctgaggaaaatgagggcagcaggcttgaataccgtggaaacttacgttccctggaatctacacgagccccaaccaggtgtgtacgattttggtcaaggaggaactgatatggaagactttttacacattgacgaatttttgagaaccgccaaagaggaggatcttttagtgttggttagacctggtccgtacatttgcgcagaatgggaatttggaggttttcccagctggcttttaagaaatgttactacag

SEQ ID NO: 3176 - DNA, 401 bp, Diabrotica virgifera
  unsure (1)..(401): unsure at all n locations
  Clone ID: LIB149-031-Q1-E1-H1
gtaatgttcatgttttgtgtgtagaaaaacgctaaaactgtgtgcaggcacatcctttcgcgatgagtagacccaacacaaactgttttcaagtcttaccgaacaatagcagatggctatcgacacaagattctggaatttttcccaaacgtcacactgactactatgtatttaatatgggaagacaggaagtgttagtggaaggatggtggggaacaaaactgggatggactggggttttggatggagtgaacctggcgcctggcaatggttacagaattgtagtcagtgataaaccatattttgtaacagctgtgaaaataacaaataaaacaactgtaagggctctcatgcattgttctgagatanacggttatcctctgcggagtcaaggaactgac

SEQ ID NO: 3177 - DNA, 410 bp, Diabrotica virgifera
  Clone ID: LIB150-002-Q1-E1-H10
gcattactagctaatctgaacgtctgtcgtaattttggttcaattgtggtgtaaaagttaaaactcatcaaccaagatgcgtgaatgtatctcagtccatgttggccaagccggagtcgaaatctgtaatgcatgcagggagttgtactgcctggaacatggcaaccaacctgactgtcagatgccatcagacaagactgttggtggaggagatgacagtttcaacacattctttcagtgaaactggtgccggcaaacatgtaactacagcattatttgtagatttggtaccaacagtaatagatgaagtacgtaccggcacataccgtcaattgttccacccagaacaactcatcactgggaaagaagatgccgccaataactatgctagaggtcactatacaattggt

SEQ ID NO: 3178 - DNA, 410 bp, Diabrotica virgifera
  unsure (1)..(410): unsure at all n locations
  Clone ID: LIB150-049-Q1-E1-D12
cccacgcgtccgcccacgcgtccgcccacgcgtccgcgattacggtttatcccaataacaagttccgctggtgatgctggtcttggccgaattcaacttacacttcgctacagtgtccaaagacaacgacttattgttgtggtccataaaatcatgaatattcctcttaaagatccatcgagtatacccgatccatatgtcaaattgtatttgttgccagagagagctcgtgacacaaagagaaaaactcaggtaatcaaagacaacgtaaatcctatctttgatgaaagtttcgaatatgtgattaaccaaggagaagtanggtcaaaacagctagaaattacagcctgcacacaaaaacaattgatttactctagcagcaacgttttaggacagattatcatagatct

SEQ ID NO: 3179 - DNA, 218 bp, Diabrotica virgifera
  Clone ID: pGUT1847
cacttatccacaaaacttccgtcaactgcagtaaccaggatcaaggatttccatacccattctttgtatttggagaaaaaatcagaaccagagctgtatcttgcaaacagatgactatggttacaccccttcatcttctgctgttcggttcccgaaaagtaaatgggttgataacgtggttaggttggacaactggatcaatttggacatggatcccg

SEQ ID NO: 3180 - DNA, 438 bp, Diabrotica virgifera
  Clone ID: LIB150-018-Q1-E1-C10
aaactcttaggtctgttttagaacttatttaaaagtttaccctttcagaaaaatgtcagggataatgtcttctagaattccaatgatacgaagagttatcccaatagtagctcggaggtttgtatccacttcccaaaagaagaatgttacagcagaagcagtagatgctgcaaaatctaaagcaaaagtagcagaccaaaactggataagttacgggtatgagtacacgtcgaaaacagatgaccgaaatgccatgcattcaataatgttcgtctcaatcaccctatgtatagttatgggaacactcttctttgcctacatgcccgactataatttaagggattgggcacaaagggaagcctttttagaattgcggaggagagaagaacaagggctgccacccatagatgctaattttgtagatccatcaaaaattac

SEQ ID NO: 3181 - DNA, 285 bp, Diabrotica virgifera
  Clone ID: LIB150-030-Q1-E1-E1
gtcgatcaacaagagcttgcgatttttatttttgaaaaatagagagtattcactaatagttaaggacagtatggaaaacgattgggctgtggataaacagaatggtggagttgtcgccccaaaaagtgcagcacgaactgaaattaagttgttcgctagatggaactgccatgatgtccaagtttcagacatgtcccttcaagactacattgcagtgaaagaaaaaaatgcaaaggaattaccccattcagctggtagatatgctgcaaaaatgttccgtaaagc

SEQ ID NO: 3182 - DNA, 423 bp, Diabrotica virgifera
  Clone ID: LIB150-003-Q1-E2-D11
gggccgcccacgcgtccacccacgcgtccgcccacgcgtccgggttgttggaaatcagatcatggcgaccgttttgccaggtattcaactaattattggattaaggcactccacatcaagtgacaagaaacaacaaaatcctccaccatctaaaagcgatcacgaccatgttctggaacattctttacatcaacttctaagggaagtgcaccacaaaaatacgcaccatcctttcccccatcctgcaactgggccgttgggtccatccaagaagagaatgcttgcaggtcctatggcagctgaccggtacgaacttcttgaaatgacgaaaacccaaacacttctggaacagatagttcaacaagcccaacattttattatgaggatgagaactgagtatgtgcttgacaccataacaaaaga

SEQ ID NO: 3183 - DNA, 431 bp, Diabrotica virgifera
  unsure (1)..(431): unsure at all n locations
  Clone ID: LIB150-032-Q1-E1-D9
gggtcgancacgcgtccgagaaagttgagccgtaaaaagtaaaattggttttactcgaattaatttaatttggtttggtttgatacaaatttccaatttgtttgcttatttactaaaccataatgccagccaaagcagtttgtgtactaaagggagaagtcaccggaactgtcttttttgaccaagcaagtggttccagtcctgtccaagtaagtggcgaaatctccggtttaacccaaggccaacacggctttcacattcacgaattcggcgacaacaccaacggttgcatctcagccggagctcacttcaatcctcacggtaaagaccatggtggtcccgacgcttccgttcgtcatgtcggagatcttggcaacgttgtagctgatgctagcggtgttgccaaaattaacatctcagacanatatatt

SEQ ID NO: 3184 - DNA, 373 bp, Diabrotica virgifera
  Clone ID: LIB3026-019-Q1-E1-C1
agtttttattctagttcacccttggtgaaccaaattaaggacttagtaaactaagaccagaggaccgttcaagaaatcagagcttttctatcagaaatatgcaggtgtccagaagccaaatgaaggaatacagagaagcctttagactgttcgacaaagacggtgatggcagtataacaaaagaagaattaggcaaggtgatgaggtcgttaggacaattcgctcgcactgaagagcttaaacaaatgcttcaagaaatagatatcgacggtgatggtaatgttagttttgaagaattcgtagatatagcttggtcagcaagctcagggcgtgatcccgatcacactatgtctttggaggaagaagaaaaaga

SEQ ID NO: 3185 - DNA, 92 bp, Diabrotica virgifera
  Clone ID: LIB150-031-Q1-E1-C1
aagactctagagaaagtcgtattaatctttaatttattaatatattttagtacgaaaggaccaaatatataaaataatttttatatttagat

SEQ ID NO: 3186 - DNA, 229 bp, Diabrotica virgifera
  unsure (1)..(229): unsure at all n locations
  Clone ID: pGUT1888
gcaacaacagctcctatcactacgccaggagacaatggaatctcgttgatgatgatattctgaaatataagtttttgaacaactgggacgccgctatgaaccatctagagcagaaatacggatggttggctgataatccaggatacgtcagtacaaaacatcaggatgataaggtgatagtctntgagagagcaggattggtattcgtcttcaacttccatcccaccaa

SEQ ID NO: 3187 - DNA, 456 bp, Diabrotica virgifera
  Clone ID: LIB3026-011-Q1-E1-G12
cacacgcgtccggaagttgattggagagaaattgctgttttgggaatcaaaaattaagggcaatttggattaagccgggccttcaataacaccgggttcccccaaaggcaactccccaaccacaaaaatcaacctgttccccccaattaacaaaaaattggaaaacgttaaaaaggaaaccaaggttggtacggaaggttgatgacagatgccttcttttatattgaacatcatggtctttcatcagaagaacaatacccctatacaggcgtagatggtcattgcaatcatgtaaaagacaaacaagtctcttcgatcagtggttacgtcgaacttgatgaaactgaaagtgctctagctgatgctctcgctaatgttggtccagtgtcaatagctgtcgaagctgatacatggcaattctattcaggtggagttttcaacaataaaaattgtgga

SEQ ID NO: 3188 - DNA, 376 bp, Diabrotica virgifera
  Clone ID: LIB149-020-Q1-E1-G2
gggccgagccacgcgtccacggaagcgtgggattttttaaaaatggtgaaaggcaagcgattcgttttgcagaaggtcttcgatggatttcccaaggagagtgactttaaagttgaggaatatgagttaccaccagttaaaaatggagagttcttggcagaagccctttacctcagcgtcgacccttacatgagggcatatgtatctgactcatctgtgattgggacaacaatgataggatcccaggttgctaaaatagtggaaagcaaaaatccaaagtatcctccaggtaaatacgttgtgggctattttggttggcaaactcacacagttgcagctggcgaacgggctggtatcacatttcctccatttttga

SEQ ID NO: 3189 - DNA, 477 bp, Diabrotica virgifera
  Clone ID: LIB150-030-Q1-E1-G6
ctcgcgggtggccacacgcctctacaaagacgcctgctaagatgcgcttttcttctttgtgaataatgtaattccaccaacatctgctactatgggatccctttaccaggaacatcacgaggaagatttctttttatatatcgcttactccgatgagaatgtatatggaggtgacctgtagaaacatacccctgaacgattaatctatattttacggttcagcaatctgatttttaatgtataactgaaatttattaaatagttaacaacaactttgtgattattaaaaaaaatttcaagtttttcttttgggttactgacatttattattagttatggtgattatgatttttttatttaaggaataagtacgtatgtgcacatatttaatcttaagagagctacagctagatattagatcttatccacctgatttgatggattaatgtatttagatattgtgattaaaattagtta

SEQ ID NO: 3190 - DNA, 442 bp, Diabrotica virgifera
  unsure (1)..(442): unsure at all n locations
  Clone ID: pGUT3038
ttggggttacccatagcacaaaaatattattttagtgttagtgttcattcaaatcgttgagtgtggtttttatagtgggtatgaattacataaatgcctgtttagaagccagcgcccctcatcaaagatccagaacgtagttgaaatcttagggaagaggaaagaacaaatttctgaaagccatcgaattgtcgctgaaagagagcgggggctcccctcgttctttgacgaacactacaaccacccattcgacttntttgtatgcgtcaatgaacttgaacgctccttcgagcgcgccggcaggagcaactgctgctgccgctccctcttgtaaagaacccaaggaaggttagagctttgtatgattttgaagctgccgaggataacgagcttacgtttaatagtggggaaatattatttgtattaaatgacagtaatccaa

SEQ ID NO: 3191 - DNA, 381 bp, Diabrotica virgifera
  Clone ID: LIB150-040-Q1-E1-D2
aactatttatttgtatttctaggactagtagtgtattgtctcgtaacctctccactcattctattggtaattgccggcacattctacgtaggttaccgcctaaacaagagacaacaggaaaaaccgctagtcctattcggcaaagaattaaccttagcgcagcaatacgtaatcgtaacgttatgttcactaccgatatttttcatggtaggcgcacacggggcgatattttgggttttgggtgcttcgatggtcgtgatcacactacatgcggcattttacaacattgaagcgctcgttacaagagaagacgattcctacgccttactggaagaagtttaactaaataagtgtatatttatgggaaatgtatataatttt

SEQ ID NO: 3192 - DNA, 299 bp, Diabrotica virgifera
  Clone ID: LIB3026-023-Q1-E1-C2
aaaaactctgctatgtagctttggacttcgaacaagatatggcaacagctgctagttccagttcccttgaaaagagttatgaacttcctgatggaggggtcatcaccactggtaatgacagattccgtggcccagaagctctcttttaaacatccttcttgggtatggaagctgctggtattcatgaaacaacctacaattccatcatgaagtgtgatgttgatatccgtctggacctatatgccaacactgtagtctctggaggtgccaccatgttccctggtattcctgatagaatg

SEQ ID NO: 3193 - DNA, 309 bp, Diabrotica virgifera
  Clone ID: pGUT148
ccaaaattaacatctcagacaaatatatttccttggaaggagaacacaacatcgtcggtcgtaccgtagtattccatgcatatcctgatgatttgggagttggtggtcacgaattgagcaaaacaacaggaaatgctggtggaagattggcctgcggagtcattggcttggccaagatgtagaatatttttgtaggggaccagtataagactaattatataactctatttttaatttaaaaagtgtcattcagtttttatcaataaatagttggtttaaagtgtcaaaaaaaaaataaaaaaactccag

SEQ ID NO: 3194 - DNA, 479 bp, Diabrotica virgifera
  Clone ID: pGUT3768
atttgaggattactggtcagaagaccaaaccgattcttgggatagccatcgaaagaggagcgaacaccaagcatcctcttccaaggattattaacatcaatgaaagtggtgccgctttctacgcaggcggcctcgaggtcggccaactaatcctccaagtggacggtaccagggtcgacggccttcagcaccaagacgtcgcccgcctcatagccgaatgcttcgcccgaagagatcgcgaagaaatcgaatttctggtcgtggaggcaaaaaagagcaacatggagccgaagccgacggcgttaatcttcctagaagcttaacatttgctgagcctcccccctagtgaccctccggggccgagtcaccaattaaaggactgaaaggatctacgatctacgatttactacatatcacgtgtattataaatgaccagtctgagactcaccacacgttcacgctctcactgatctaatata

SEQ ID NO: 3195 - DNA, 398 bp, Diabrotica virgifera
  unsure (1)..(398): unsure at all n locations
  Clone ID: LIB150-038-Q1-E1-F11
aattacatcaagttatgatctctttagaaacaaatctttccggtgtccataacaaaatccatagatttagtttctagtcattcctactgatcagatactctgcagatttaatcattgtgatgtcanaaaatttatgaaggtgcataaagagagtgcatactctggtgatgagagggagagttcagtgccagttgttcctgattaaccagcaaagggtattcctactggaaaatacaagcttgtaggatggggtatagatactactggccgcagactaattgatgaaatcattcagatagctgcgtttacacctgaatcacagttttcacagtatgtcacgccatttggagatttgaatcctacctacagcagaagacatggtatcagagtagtaaaca

SEQ ID NO: 3196 - DNA, 440 bp, Diabrotica virgifera
  Clone ID: LIB150-041-Q1-E1-B12
tcgcgggccgacacacgcctccatattaagtcttgaaagtcatttttaaaaacattttaatttaaaagtagtatttttaagatttttcattttcacaccagttcataatggcatctggttcaatatacgacgctgcacataagggagattttgaatatgtttcccaaaagattgaagaggatccactaattataaaagcaccagactctagtaaaaggcttctaattcattgggcagttctcagcggaaatgtaaagcttgttactcatttactggaacttggatcttctgtgaacccctcggatgatacagatatgacaccattaatattagcttcatcggctggccataccgaagttgtcaaattgttattaaaaaaatgtgatgatgtcaatcataaaaatgcacagggtcattcatcacttcagtatgcagcctcc

SEQ ID NO: 3197 - DNA, 328 bp, Diabrotica virgifera
  Clone ID: pGUT3837
gcaaggtgacagatcatctgcaggctaaagaaaatgagtaagtcactgacgggggtaaatttgaagatcgtctctttggatgtcaaggatgtgcgctttccaacttctctccaggctgatggatccgatgctatgcacaccgatcctgactactcttgcgcctacgtcaccataaaactccaatcggggttagaaggatacggactaactttcacttgcggtagaggcacagaagttatcgtagcagcccgtgaatctctaaagtcattggtcgtcggccaagttgtaacaaacatctacaaagaattcggtgtgttttggagatctt

SEQ ID NO: 3198 - DNA, 438 bp, Diabrotica virgifera
  Clone ID: LIB150-019-Q1-E1-D7
gtattgtcaacactccaatgtccaattttaaatactttcttagcggttttataccatatttattcgttgatgaaggtaaggagcacttggtctctccagtttgggataaaatagagttcttgatgttggaatttggttacactcatattcaatctacaaaacctgatacaattggtgttgctcttcgtgatagcccagtgggtctagctgcatacctgttagaaaaattcaccacatggacaaatgctgcctataaagatttagacagtggtggtctgactaaaaaattcaccatggaacaactaatagataatgtgatgatatactggattactcgatcatcaaccaccgctatgagactgtacgcagaaagtgtaaataggaaacatttagctacaaatatggaaggaattcctgtacaacctcaaagtggctgtt

SEQ ID NO: 3199 - DNA, 486 bp, Diabrotica virgifera
  Clone ID: LIB150-031-Q1-E1-F1
tacagaaattcatatgacccgaatcccgcgactaccatagtagctgaagacgtttatatgcagtacatcactagtaaggaagaagataataagcaggatgatgactctttggacaaactgaaaggaatgggtgataagaaattctttaaatgtcgtacatgtaatggtgaacattggactacaaaatgtccatggaaggacactatgtttgttggtggaaagccaccagatgataagaaaatatcagctgttggaggtgcagctgttggtgaagctggtaaacaaggatccaaatatgtaccacctaatttgagagatggaggtgtgaagagaactgatggatctggtgtagctaaacgagatgatagttcctgtgctatcagaattgccaatttgagtgaatcgacaactgaaactgatttggaagatctggttaaacaatttggaccaattcaaaaactgtatttggcgaaagacaagataact

SEQ ID NO: 3200 - DNA, 319 bp, Diabrotica virgifera
  Clone ID: LIB149-007-Q1-E1-B1
gcagaatcccgccaccttttgtacctacagtggagtcaatggaagacgtaagcaattttgacgaagaatttacatcagaaaggccgcagctgacgccaccaaaagaacccagacaattatccgtacaagatcaacatttgttcagagagtttacatacatggcagactggtgctgacaatagtattaagtattaaaattaacttacgaaaaaatcaaattgtttttgtattaaattgaggatttcgatttattattattctatattaacaagttattatatatataccatatttttaacaaaaagactccgaatcgtta

SEQ ID NO: 3201 - DNA, 377 bp, Diabrotica virgifera
  Clone ID: LIB150-044-Q1-E1-B10
acaacactctgatgtgagtcgtattataatcctacacccgcattatcatataccgcatctcagatgtacgagacgtttctcacggagaaacagaggaattcctgtctcaaatggttgtgagcacaacgatcaaagctacaaccgatacatcagcaggagtggtccatttccaccatagcaaagatcccagcgatgtcatgaacgagtgggctcatgatgtgacacagctgacgcagcacgtcaacattatcactcatctcatcatcaaggatgaatgtgtccacaagcatcttcagtcgacttcagcttagtttacgagttttcagtctgagaatcattttttagttataaaatatagttgcaaataaatgttttgt

SEQ ID NO: 3202 - DNA, 389 bp, Diabrotica virgifera
  Clone ID: LIB149-022-Q1-E1-B3
ttcaaagtcgtcgagaccgatcccgctccgtactgtatagtggctccagataccgtcatgcaatgtgatggatatcgaatcaggcgcgatgaggaggaagaagctcttaacgcagttggtgtcgactgcatcgcagggtgtagaaaacagctcgctcatatcataagaaatggctggagttaccacggagacatcctagtcttttcaaggctattggagttataccaccagaaatgtatcgtacgttacgggccacccggtactggtgatacacacattgcacgtgccgtaactaacgatactgaagcgttcttcatcttgaataacggtcctgaaattatgagcaaattggccggtgaaaccgaagagcatcttcgtaaagctttcgg

SEQ ID NO: 3203 - DNA, 431 bp, Diabrotica virgifera
  Clone ID: LIB149-047-Q1-E1-C10
gggtcgacgcgcttttgtaaggaaatattgcctgtacatggagttccaaagacgatcgtctcggaccgcgacgtcaagttcctaagctacttttggaagaccctatgcgccaagctcaaaatcaagctactcttctccacggcgtatcatccacaaaccgatggccaaacggaggtgaccaaccacacactctccactctactccacgtgctcatcaagaagaacatcaaggagtgggaggagtgtctacctatcaccgagttcgcctacaaccgcgcaagacactcaacaaccggcaagtcccccttcgaggtcatccatggattcaacccattctcaccattggaaattcttcctctaccactacaagagcgcatcagtatcgaagcaagtgcatgtgtgaaccatctcaagaagttttatgaagatac

SEQ ID NO: 3204 - DNA, 335 bp, Diabrotica virgifera
  Clone ID: LIB149-014-Q1-E1-B12
gggtcgcccacgcgtccgcggacacatgggttgcacaaccagttgtcgctgtgcgatcgtgtacggactcatgtagtatctgctgatttgtctcatattgggagcgcagctaaagtaaagggattcaatggacctgagatgtcttaaggatgctttgaaaggcgccgacgtaattagtattccagctggtgtacccatgaaacctgctatgaccagagacgatctgttcaacacacacgccggaattgtaaaagcgttggccgaatgcgcagctgaagtagcgccatggtccgcttattggtatcattaccaaacctgtcaactccgctgtccct

SEQ ID NO: 3205 - DNA, 400 bp, Diabrotica virgifera
  Clone ID: LIB149-019-Q1-E1-H10
acccacgcgtccgggagtaccgaaaattcataaagcgaacataccacttagacccatttgtagtaccatcagttctccttgtagtgaactatcaaaatttttattaaacattataaaaccatttgctaataatgatgacacatttataaaaaatacaaaacattttgtaaacaaattatcaactattgagtttaatccaaataatattttagtaagttttgacataaacagtttatttacaaatgtgccattcgataaaactttaaacataatcaaaacgaaattagagaatgatgatacattgacaactaggacaaaactaaatgtatcagctataatggagttattgacattatgtactaataatacctattttcaactaaataatgaattttataaa

SEQ ID NO: 3206 - DNA, 461 bp, Diabrotica virgifera
  unsure (1)..(461): unsure at all n locations
  Clone ID: LIB149-012-Q1-E1-C6
ccgggtgcccccacgcgtccgcccacgcgtccggcaaaagcaagagctttattttatggcatgacagggtttagtggtcatattataataatatcagttttgtattatggtggggtgatggtgtcttcaaataccataacagtaggtaatctctcatcattcctactatatgccgcatacattggtatttctgttggtggattatccagtttttattcagaactaaacaaatctttaggggcagcaaccagaatttgggaaataattgacagagaacccacaattcctacccaaggaagtttaattccaatgacagacgttgagggtcatattgagttcanaaacgttaagttctgttatccttcaagaagtgacattgaaattttcaaaagtttagttttggacatccaaccaggcaaaacgctcgccgttgttggtcctagtggttcgggcaagagtac

SEQ ID NO: 3207 - DNA, 367 bp, Diabrotica virgifera
  Clone ID: LIB149-034-Q1-E1-B3
cggaagcgtgggcggacgcgtgggtggaacttgtaggaagcccgttttcgccggcattcattgaaagaaaatcaaaccagagtgttaagtgcaagttattatataaagatgtaccgtctacctaacactgttcgctctgtggcactccgcaaggcccacataaataatcaagttcaaagatggtacgccaaagatgtaaggtttggatcagaggtcagagccctgatgctccagggggtagatgtacttgcagatgcagtggcagtgacaatgggtccaaagggtcgtaatgtaattattgagcaatcatggggatcaccaggaattaccaaggatggtgttacagtagccaaaggagttaaagctc

SEQ ID NO: 3208 - DNA, 402 bp, Diabrotica virgifera
  unsure (1)..(402): unsure at all n locations
  Clone ID: LIB149-048-Q1-E1-H1
cccacgcgtccgtggaattgtcgttgtgagcttcaactacaggcttggtcctttcggatttgttggcactaatgatggagttattcccttaaatcttggacttaaagatcagaggttggctatgcaatgggtgaataaaaatattcatttgtttggcggaagtcccgatcatgtaactatagctggtcaaagtgcaggatctatatcagttggatatcatcttacaggaccgggggagaatggcaaacaattgttccatgctgcaataatgcaaagcggaagcccagtctcaggttggctcacacaggaagatgaaaccagctcggccttagcacttggtanggcggtggattctcactttgctggtaaagatacaaaggaattgttaaaagtgttacaaaa

SEQ ID NO: 3209 - DNA, 430 bp, Diabrotica virgifera
  Clone ID: LIB149-048-Q1-E1-A6
gtgcagtgaatattatataattgtaatttttaggctgtcctaaaaaaccgtgaaaatggcatacttgcttaaccagggcgttcgtagattcatgcaaacgtctgcaaaaagagcagcccaaattgaaggcccctcagccgtatctggtggacatgaaggtggttataagatttggaaaaacctcaccattttcgtagctttcccatcaattatactgtgtgcagttaactgctatctttctcaccaaagcggtcaccacgaacccccagagttccacaagtatgatcacatgagagttcgcaccaagagattcccatggggcgatggcaacaaatccttgttccacaatccacactgcaatgctttacccgatgggtatgaacaccattaaaagaattttccaatagaaagtgtattaattaaataaaag

SEQ ID NO: 3210 - DNA, 370 bp, Diabrotica virgifera
  Clone ID: LIB150-009-Q1-E1-D12
accaaacgtccggtcgacactcactgactgctaacaaaacaaaaatagctaaccggaaaagtttagtagataaacaaacaaaatgagaaccgacaatgttcaagttatagttgggaatattatccattgcagtgatcaatttaatgtgcaattgattgataatggattcattatcatcgcaggttctaagattttagctataggtaccgaatcagatctgtctgaaacggtaaccagactgaaactaaagaactttagcacccgcctattaaagaagtcacaaatcctcatacccggtttggtagacacgcatattcatgctccacaatatccaaattgcggtctcggatatgacatgcctctgttggat

SEQ ID NO: 3211 - DNA, 383 bp, Diabrotica virgifera
  Clone ID: LIB149-020-Q1-E1-B6
acccacgcgtccgcccacgcgtccgattcatctcttttctcactcactgttactgtatttaatctctcatctttctatacttctacctttgttctccatccacctttcctattccttctagctctacttgccgtattcttttctgaatctgtaaaataccaagttcttctcccgcgttctcatcttgtttattgtctcccattgtctctcttccttctcccttttgtcatatgtcctcactgttttttttcctcaattactcgtctatctcatactatgatcatcattaagtttttcatcctatctgactccttcaggtttaccacgcctggaaagcgaagaaccgcaaacgcaccatcatggacgaaaacgaacgcgcccct

SEQ ID NO: 3212 - DNA, 412 bp, Diabrotica virgifera
  Clone ID: LIB150-005-Q1-E2-G5
gcatttgaacggtgcgtccggcacaaggcttttgaagttctgcactcggcgcgagtgattgtggtgattgtttttggttttagtgtgttttcgaaaaggatttaggtaacaatggtcaaaggaaaagtaatacaacttaccgacaacatgtcgaccaaagacagagtaacaatatgcgccgcagaaattggaggaacagccatgctcgtttttttgggttgcatgggctgtgttagctccttggcttccggaggtgtaattccccacgaacaaatttcctttactttcggattagctgtaatggtagcagtccagacttttggacacgtttcaggatcacacattaacccaatagtgactgtcgcagcggcaactttgggagatatagctttaattcaagttccagtttact

SEQ ID NO: 3213 - DNA, 626 bp, Diabrotica virgifera
  Clone ID: pGUT3499
gtttaagataaatatattttattgcaggtaatattgcgtatatgggctcagttggaatatttccctccataattttaacctctcaggctcgggattgctcctcatcgttaattcatctccaatatccaaataatttacttcttcttgattaactggactccaggttatattcatatcgtttccttgaggagttgggttaccgaatttggcaaaattggtccagagtttaacaaatattctaattgcttttagttccttttctcctctgtgcatgtttagggactcaagtggcatttggaacaaatatcctagatcgtcagcatggcaagcacctggcatatcactgaaaccgttggcacgtttaaggaaatttagtccggcatctagactcataagatataaataaacaggttcagtttgggcttttgcatgaagcttagcagttccaaccactggtgcagtgtaggtaccatcagttgccatcacatacttggccatttcatctgcattttcggtgaagtagaacttcttgagtttctctttaatcaactccttcttagggtctttattttctatcgccatatgcgggtgaacaaacttgtagagattgaaataatctggtttta

SEQ ID NO: 3214 - DNA, 413 bp, Diabrotica virgifera
  Clone ID: LIB150-009-Q1-E1-B1
acccaagcgtccggtgataagttgtagttgtatctaactcacgtttgccgcaaacagtgttcatactaaaccccagaatctacacaaaatttagattgttttcactgaaaaatgtctcaagacgaggacctagaacagaatttgattggagtgatagatgcgggtaccagaacagtgcagttttgtgtgtttcggactgaacatacgaaagaaatagccaaacacactgtagacattacaacagctgtgccccaagaaggatggtccgagcaagatcccagggagatcctgagagctgtagaaacttgtatggaaaatgttgccaaaagccttggctctgaagcatctgaaaacatcgtaactataggtatttaccaacagagggaaacgacgatagtatgggaataaaacac

SEQ ID NO: 3215 - DNA, 360 bp, Diabrotica virgifera
  Clone ID: LIB3026-010-Q1-E1-C6
accacgcgtccgcccacgcgtccgcccacgcgtccgcccacgcgtccggcataaggcatttgctaatccagaagatgctatacgacgacatgtcaagccaaaagtaagtgaacatgtggaaagagttcgaagagctcacttgaacgacattgagaagattccactattctttgtgactggtttgatttataccttaaccaatcctgcagtgtatctcgcaaaaactttctttttggcatatacactggcaagaatcagtcacactgttgtgtaggctgttgttccgattcctcaaccagcaggaggactgtgttggatggttggatacggaataactggatatatggccgttgtcagttt

SEQ ID NO: 3216 - DNA, 385 bp, Diabrotica virgifera
  Clone ID: LIB150-006-Q1-E1-A8
acaagattctggactgatgaacgttgcctattttaaatttgacgtggacgacagtacaggtgaattggatacaactcgacctgtgccttttcggttgactcctaatattattgaatatttatctacgattggagtgactggtcctcttacaaccacaatgatagccacttcaagatgtttcatatatcccaattttaaggtattgtcaattttgaaacctattatcagagatgaaatgatgttggctagagccaaaaaagccgaagacttaaataaccccgaaaaaatgaatgacgcctctgagcaaatcataaatatggtaaataaggcagtcacttctatttcaaacagacttaccaatttagcacaattcgaagggactgat

SEQ ID NO: 3217 - DNA, 307 bp, Diabrotica virgifera
  unsure (1)..(307): unsure at all n locations
  Clone ID: LIB149-003-Q1-E1-B1
gtccgcacacgcatccgatcgtatcagatcagcggtagttctctctactctaagtggacaaatttagttttctaaaatggcacatacatataaacttacatattttgacttccccggaaagggtgaagcaattagaatgatcttaagctatggagaaataccattcgaggacaaacgtatccagatgggggattggtcaaaaattaagccaactactcctcttggacaacttcccatattanaggtcgatggtaaagaaatcccccaaagcactgcaatcagcaagtacttggcatctaaattaaac

SEQ ID NO: 3218 - DNA, 384 bp, Diabrotica virgifera
  Clone ID: LIB150-027-Q1-E1-C3
acgacgcgtccgcccactcatccgcccacgcgtccgcccaagcgtccggaaagctaacatccatgataaggaacgtatcccaccagaccatcaacgcttgatatttgcaggaaaacagcttgacaatggtagaaacttgtctgactataagatccggaatgagtccactcttcacttggtactgatgttgagacgaggtatgcagatcttcgtcatgagactaactgggaagcccatcaccttattagtataaccttcagataccattgagaatgttaaagctaggatgcaagataaggaatgtatcccaacagaccagcaaagactgatctttgcagggaaacaactacgtgatggtagaaccttgtcagacgtatcacatcc

SEQ ID NO: 3219 - DNA, 425 bp, Diabrotica virgifera
  unsure (1)..(425): unsure at all n locations
  Clone ID: LIB150-039-Q1-E1-B1
aaccgaaaaacactcacctagtggaaaccaaattgtgataacagtgatagaagtgataggttttttgctgtattctcttgcgctaatcgtcaccgctatttacaaagcctgtttaccgtcagcttatcaacataggaaaaatataaatggcaaaatttctttaattacgggtggaggaggaggactangaagattactggctctcagattggctagactgggatcaactgtggtattatgggatgtgaatgaaaaagctgtggaggaaaccgtangattagtaaaaagagtaggtggaaaagcctatggatacaaatgtgatttagctgataaggaagatgtatatagagtagctaagaaaacccaagangaagttggggatgtttctattttaattaacaatgctggtgtagtatctggacaca

SEQ ID NO: 3220 - DNA, 359 bp, Diabrotica virgifera
  Clone ID: LIB149-042-Q1-E1-F5
aaattagcgtcttttcatcttttaattcaggctttattctaaagcattattatttatgtgtgctggtagtattattcatactttagagagttgtcaggatattcgttatataggacgtttaattaagcatttaccattgacttgtacttagttaaatattctgtatctttctttatgtggttctccttctaggtctggatttcattctagagatataattgttgaaattttatctatcagttatttaaatatttatatttatatagtttctgatatttccattggtttgacacttgcttatagatttcgtttaacttattattctttatcgggtagatttaattatctatcgttaaata

SEQ ID NO: 3221 - DNA, 450 bp, Diabrotica virgifera
  Clone ID: LIB3026-023-Q1-E1-C10
cacgcctccgcagacgcgtgggagctgatattaaggagatggtatccaatacctttgcaaaatgtgtcactgaagattttattggtgcttggcagcttatcgctaacatgaagaagcctcttcttgctgcagtaaatggatacgctcttggtggtggttgtgagttggccatgatgtgcgacatcatttacgctggggataaagctaagtttggacagcccgaaattcttcttggtgtcattcctggtgctggtggcacccaaaggcttacccgaaccgttggcaaatctaaggcaatggagatagttttatctggtaaccaggtaacagcccaagatgctgaaaaaatgggtctggttagcagcgttgtaccagccgccaaacttttgactgaaactgtaaagcttgccgaaaaaataacaggaaactcacagatcgccaatatcatcg

SEQ ID NO: 3222 - DNA, 387 bp, Diabrotica virgifera
  Clone ID: LIB150-047-Q1-E1-F1
aaacacaagtccggaaatcgcccaccaagacgaactcatcaacaagctcaacaaggaaaagaaaatgtctggtgaaaacaacaagaaggtttctgaagaactcaaggccgccgaagacaaggtcaaccacctcaacatagttaaggctaagttggaacaaaccttggacgaactcgaagactctttggaacgcgaaaagaaactccgtggtgacgtagaaaaatctaaacgtaaggttgaaggcgacttgaaactcacccaatatgctgtagctgacttggaacgcaacaagaaggaactcgaacaaaccatccaacgcaaagacaatgaaatctcatcactcactgccaaactcgaagacgaacaatccgttgttggtaaacaaca

SEQ ID NO: 3223 - DNA, 400 bp, Diabrotica virgifera
  Clone ID: LIB150-043-Q1-E1-D5
atccaatcagcagcgcaaaacttaatcacaatcaacatgaaattcatcattgccgtttctgcactcctagcttgtgcggctagttctcctaccgcatacatagtaccactagcggaaatatcagcgcccatcgcgagccaataccactctcaagatagcctaggacaatacacttacggatacgctaatcatctcagtgccaaatcagaagctagagcatttgatggatctgttttgggaagttacagctacttggatcccagtggtaagattcagtcggtagagtatgccgctgacgatcaaggatttagagcgacgtcttctaatttaccggtagctcctgcagtacctgaagttcctgttgttgcggttcctgttcctattcaagacacacccgaag

SEQ ID NO: 3224 - DNA, 293 bp, Diabrotica virgifera
  Clone ID: LIB149-015-Q1-E1-H4
gttgaattttaaaatattgaaagtagtaaatattgaagaaagtattaataacacaatcatggcaaagttcgacttaacttcgaagatgggccagtatttagaccggcatctcgtttttcccttattggaatttctgtccgcaaaaggaatttacaatgagaccgaactgttaaaagccaaattagatattctaagcaagactaatatgatagattatgctattgatatcagaaaacaactgtaccctgatcaggaaatacccgaggacctaaaacagaggcgtaatcatgttg

SEQ ID NO: 3225 - DNA, 645 bp, Diabrotica virgifera
  unsure (1)..(645): unsure at all n locations
  Clone ID: LIB150-021-Q1-E1-F10
ggaaattggaaaccgaattgcaaaccctccactcagaccttgacgaacttctcaacgaagccaagaactccgaagagaaggccaagaaggctatggtagatgccgctcgtctcgctgatgaactccgcgctgaacaagaccatgcccaaacacaagaaaaactccgttaagctccccaagctcaaatcaagggcctccaagtacgcttggacgaaactgaagccaatggccttaaaggaagaaagaaaggtattgccaaattggaacaacgtgttagagaattagaaaatgaattagacggtgaacaaaggcggcacgcggatgcccaaaagaacttgagaaagtctgaacgtcgtatcaaggaacttagcttccaagctgaagaagaccgcaagaaccacgagaggatgcaagacctcgtcgacaaactccaacaaaagatcaagacctacaagagacagatagaagaagccgaagaaatcgccgctttgaacttggccaaattccgtaaagcccaacaagagctcgaagaagccgaagaaagagctgacctcgccgaacaggccatcgccaaattccgtgccaagggacgttcaggatctgcagctanangagccagttcagcgccccaaagacagcgcccca

SEQ ID NO: 3226 - DNA, 446 bp, Diabrotica virgifera
  Clone ID: LIB150-016-Q1-E1-H5
gaggactaaagatatttgtttgacatataaaagggatgatttagatttaacagggtttgttgatgctgattgggcctcaaataagttagatagaatatcttacacaggttttgcttttaaactttcgggtggtgcaatttcttggaagagtgttaaacaaaaatcagtggctctttctagcactgaagcagagtatgtagctttaggggaggctactaaggaagccatttatttgagaaatttgttgtcagaaattcaaggaacactggaatcagttgttttgtataatgacaatcaaggggctcagaagttatgtatgaatccagtattccatgaaaaaacaaaacatattgacatccgtcaccattttatcagagaggctgttcaaaataatgttgttgaattgaagtatttatgtactgatgaaatgttggctgacatcctta

SEQ ID NO: 3227 - DNA, 377 bp, Diabrotica virgifera
  Clone ID: LIB150-044-Q1-E1-H10
gcgtccaagagtagtctaacttcagtaatatattatccacatgatacagtagaacacaatgattatagacgatgacatgatttttgatgattcgggtaatgaaaccagtggagacgatgtacattttggtatcgacgctgattcaggttgcagcagcacagaatttcaaagcttcgaggaagaatatcaatatgatgttctttctacagaagaaatagttgtacatatgaatgattgcattcaggatgtcaatgtagtagttcaagtacctgcaacagttactagaattcacttaaattagttcacttgggatacggagaagcttatggaaaagttctttgatggcaatcaggatgaagtgttttaggaagcacatg

SEQ ID NO: 3228 - DNA, 399 bp, Diabrotica virgifera
  Clone ID: LIB150-002-Q1-E1-A11
ttcgctcagaaagtaataatagaccgaaagagcaaatcagccaccggagtgcaagtcgaaattggaggaaaaattataaacttaaaagctaagaaagaggttatagtttccggtggaactatcaactctccacagctgttgatgttatctggtctaggccccaaacatcatcttgaaaaagtaaatatcgatctcattaaagatctgcccgttggtgaacacttagaagatcatgtattgcacctcggatttttcgtgaagtttaatcccgaaatacaatcgatagaaaatcagctagatacgatctacaagtactttgcccatcaacaaggagatttaggaactctcatgatcaccaacatcatgagtttcattaacaccaaaaatgattcgcagtat

SEQ ID NO: 3229 - DNA, 386 bp, Diabrotica virgifera
  Clone ID: LIB150-034-Q1-E1-B6
gtcaaaaataggtagtaaattagtaaataatagcaacattttgatttaaagacttagttaggaacaatattatggtctttaaatgccaagaagactctttccttagagagttcacttccaaagtagttacttgcgataaagttcagatccaggaagtagtaaatggaacaactcgtacagtggatagttatgaagtaatcctagaagacaccatattatttccagaaggaggtggccagccttgtgattatggttttttgaataacttgcccgtcaaaaaaatcttgaggaaggaagacaaagctgttcactatgtatctcaagaattacaggtaggtactactgtagaacaaaagattgattgggaaagacgttttgattacatg

SEQ ID NO: 3230 - DNA, 435 bp, Diabrotica virgifera
  Clone ID: LIB150-047-Q1-E1-E8
caagcctctaaatagagtcctattaattttttgtgtaaaagtaattcatttattttcttccattttcagcagttttttgtgctatttttgtactaatagtgatatctaataaacattaacaatgtccgcacaagacaacgtgaccacccctgaggaattcgtagaacacgaaaatgaaagcagttacaagcctccaccagagaagaccatcgaagaaattctacagatcgatcaggaggatgaaagtttgaggaaatacaaagaggccttactcggtcaagcacaaactggacctgttgtagtggaaccagacaacccatagaaagttatagtgaaaagactggtactagtagcagccgatagaccagaattggctctagatctcaccggcgatttgtcaaagctcaaaaaagaaacgttcaccatcaaagaaag

SEQ ID NO: 3231 - DNA, 418 bp, Diabrotica virgifera
  Clone ID: LIB150-026-Q1-E1-E6
ctcgtgggtcgatacaagcctctatactgacgtcgtgactaacgcgtccgcccacgcgtccgtgaaatatctaatacctgcaagtatagacctattgcactactaccggtactctccaaaattattgagagactcataaaagaccgacttatgtcctttctagttgaaaacaacattttatcacaaaatcagttcggctttttaaataataaatgcaccactgatgccatcttttctgtactgcatgaggtttatcaagcactgaacaataatcttcacactgcgcactgccaccgttttttgtgactacgccaaagcttttgattgtgtaaatcataacattttgataagaaaactaaaggaattcgaggtatttctttagattggttccaatcttacttggatgataggaaacaac

SEQ ID NO: 3232 - DNA, 395 bp, Diabrotica virgifera
  Clone ID: LIB149-046-Q1-E1-A11
cgcgtccgcagcttcatatacagctttaaatataaattgaggaggtttacttagtgctgtcggtgataagaacaaacatattaagcaacagcagcagcctgggaagtttactgtggtggaatttgaccaagctgggtctataaatggagtactagcatctgaatttaacttggatagtttagaggataaaccatggtagaagcctggtgctgataacactgaataatttaattaccgcttcaatgaagatacatggagagcttactgtgaaaggcaaaatagaataacagtaaatgagtcaagaacgggcttagtaccaatgaccatgatgagtggcttgcctcgtggtcctatgccaatcatgaatgataacagtatagatactggaaattttg

SEQ ID NO: 3233 - DNA, 409 bp, Diabrotica virgifera
  Clone ID: LIB150-027-Q1-E1-D1
agtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaatactatgtaaccatcattgatgcccctggacacagagatttcattaagaacatgatcactggtacatcacaagctgactgtgctgtactcattgttgcagctggtactggtgaatttgaagcaggtatttcaaagaatggacaaacacgtgaacatgctcttcttgctttcacccttggtgtaaaacaacttaatgttggtgtcaacaaaa

SEQ ID NO: 3234 - DNA, 435 bp, Diabrotica virgifera
  Clone ID: LIB150-030-Q1-E1-G5
gttttgattattctaaaggcggttatccgttaatttggaattattatctctttacccagtgaatttacattattgttgttatatattttaaatccgatggtttattattgttttatcttagtaaaaatttatccgtgaaacaatgtaaatactaagtgaaaatagtgtgtgatgtaaaagtgtgttcccaatcctaatatcaagagtagtatccaaaaatgacgaataatacagacagtaccttattaaacgcctcagaatttatcaaagacagactgtattttacttgtgtggaatgtacagtggatctaaaacctacacctacacaccattatttcacactgaataacagtatatattatgacagtttctatgaagactttgggcccctaaatcttgctaagatataccgcttttgtacgaagttgaagaaga

SEQ ID NO: 3235 - DNA, 175 bp, Diabrotica virgifera
  Clone ID: LIB150-049-Q1-E1-C10
acgttgaatacccaaatggttacccttttgttgcacgaagcaacaaggtcgtcgcatgcgccaaacactttgttggagatggtggtacggacaacggggtaaacgaagggaacaccattgcatcatattaagacttggagaagatacatattcctccatatcgtaagtgtcttgc

SEQ ID NO: 3236 - DNA, 311 bp, Diabrotica virgifera
  Clone ID: LIB149-011-Q1-E1-G6
cgggatccccagagataacctcacatctgaagttaaatactggttgagatccatcggatgtcccgctgaaactgtcaaagaggttttggcagctggtccagacaaacgcgtgctagatgaacgcctgaagggtatagagagagttaacaagcaagccacatccaatgctcaaactataaagaagatatcagtgcttcctgctgatttctccatacctacaggagaattatgtcctacaatgaaagtaaagcggagaattgttgaccaactttataaggatatcatcgaaagaatgtactcttaagaaaaca

SEQ ID NO: 3237 - DNA, 389 bp, Diabrotica virgifera
  unsure (1)..(389): unsure at all n locations
  Clone ID: LIB150-039-Q1-E1-G4
acaacaaaatggcttttaagtttcgtagttttgaccactcggctcgctgtcgcccaggcaggccttattggggcacccttaccaactccacgggaagcgcccgttcttcaatcatgcacccatatcttatgcagctcctgcgaatttcttacggcgctcaactggctcctgctattgctaaagtanctgttgctgctccagtcgccaaggctgttgttgctgaggaatacgatcccaacccacagtactctttcggataccaagtggaagatgccttgaccggagacagtaagagtcaaagtgaaaccagaaacggagatatcgtacaaaggatctactcattggnnaatcctgatggcacccgtcgtaccgtcgagtacactgctgat

SEQ ID NO: 3238 - DNA, 412 bp, Diabrotica virgifera
  unsure (1)..(412): unsure at all n locations
  Clone ID: LIB149-004-Q1-E1-D7
agcaaattgtatgaggaactcgaacgagaaatggagaagttacctagagaagacacaatactggtaatgggagattttaatgcccaaataggtaaggaagactacattaaccaagtagcaggtaagcacacaatacacgaaaaaactaacgacaatggccaacgattatgtaatctagcatctagtaccaatatgattatcgttagtacaaaattcgaacatcccaaataccataaagtgacgtggatttccccagaccaaaaaacatggtcacaaatagaccatattctgattacaagaaggaagcaaacatcggtaacagacgtgaggtcctacagaggtgcacatgcagacacagaccattttatggtgactgcaaaagtaagacanaaagtcaaaagaacactaaaaa

SEQ ID NO: 3239 - DNA, 198 bp, Diabrotica virgifera
  Clone ID: pGUT108
gagtcatattacaacacagtggccgtcgttacacaatgtcgagagtgagaaaaccctggtgtcacccatcttactcgccgtgcaacatatccccctctcgccatgtggtgtaatcgagaataagcgcgcacctatcgcccttcacaactgtcgcgcacccagaatggagagtggcatattgtacgcgtacatattgtg

SEQ ID NO: 3240 - DNA, 441 bp, Diabrotica virgifera
  Clone ID: LIB150-016-Q1-E1-A10
ggaaaagaagatcaaagtatatttaaaatagctaaaagggattcgccgacgaagacaatagtctcggatttgaagcctggtacaaggtatagattgtggttggaggtttacttgactaatggaaaaattaagactagtaacgtacaagattttatcaccaagcccagaactgcaccgtcgttgggcgcatcaacacaacaagataaactctccagagcggagcatcttgaacccaaaggagactactatggtcctctagtcattgtagcaatattagcagcgattgccatattgagtactttggtactattactgattttgattcgacgacataatcaaaacaaggctgccatcacaccaccatctcgaatcaatcagtctgcttatgataatccttcatataaggttgaaatacaacaggaaacaatgggtaaaggtttt

SEQ ID NO: 3241 - DNA, 398 bp, Diabrotica virgifera
  Clone ID: LIB149-034-Q1-E1-A12
gactcgtggtacaatacaacaccctagagtgagtcgtattatggactgctgttcaatactgttaccatcataatatgcagttggtaagtttaggaacgcaagaagagaatgatgctctttataatgaagtcgatcaatttcttgccggtcaagcagagttctggtcttcaggaagtagaatagcaaacgatgatgactggatttggcttacaacaggaaggccaattaaagttttcaactggggcgatggagaaccaaacaacaaggacaaaaaggaaagatgcatttcgctatattatagacattatcaaaatgggtggtggaacgacgagaattgcgacaatgaacttggggttatatgcgaaacgaagtgtcaagattaaatgaaacatattttt

SEQ ID NO: 3242 - DNA, 449 bp, Diabrotica virgifera
  Clone ID: LIB150-019-Q1-E1-C1
gaaagacaaacatgcatttgtttttaaaaattaacaatgctaaatgacactgcagtaacatagcaaagaaataattttgcagcaaacgtagcagattgtgttgttgaagttgaaaagtcataagtataaacaataaatttatttttgcgaaatggctgaagatcatgatgcagattgtaagactgtatttgtagaggactggctatgtagcagtaatattttaggtgaaggggcttatggagaagtgaaattgttagaacataaaaacaccaaagagaaaatagcctgtaaaatgattgatcataataaatataaagacgcttcagcaaatataaatagagaagttagtattcataaattattagaccatgagaatattattaaatattatggtagacgacaagaaccaaataaggaatatatattcctggaatttgccgctggcggga

SEQ ID NO: 3243 - DNA, 409 bp, Diabrotica virgifera
  Clone ID: LIB150-038-Q1-E1-A3
ctgaacaggttctaatgtactttttcgtacatcgaaagcaacaggcgatggctgttgccaaatttccgcattgtgcaaatgataatttttcaaacaatgtatctttagcatttttaaacgctcatgagagcgtaacacaggcggttcctttagtacctaatatgattaatattggtggatttcatatcgatccccccaaagaattaccagaagatttaaaagagatgttagatggtgccaaggaaggtgtaatctacttgagtttgggttctaatatcaaaagtactgatataaaaccagaaatcaagcaggctcttattagatccttaggaaaactaaagcaaaaggtactgtggaaatacgaagatgaagattttaaaacaccgaaaaatgtggagattagaaaatg

SEQ ID NO: 3244 - DNA, 423 bp, Diabrotica virgifera
  Clone ID: LIB150-047-Q1-E1-F8
agttagagtccatcatataatattttgattaattttgtgagagtgagagttatcaaagttcaagtagttacaaagatggcatttagacccctaactgaagcagaatgtggccaagcgaaccccttaacaaaattaacttcgcacattacccgtgatcacacattttctgataatcatgggcaagtttttcaaagtagttcagaccaattggttgaacaatttctccaggaaaccagagccattcctcaaagttataggatggacgatttgatgagggaaatgcacgaaattgaatctcaaaggtcagctttacctcccattcctgcttcaacagtcaaagatcagctgcatgacaatgcctgggctcttcagtatattgaagacggaaaacgatttaatgaagtttataataatgaaaatgtc

SEQ ID NO: 3245 - DNA, 422 bp, Diabrotica virgifera
  Clone ID: LIB3026-016-Q1-E1-B2
gtatctctattgaagataatttcaaaatatcgctgcacaataaatgtaatgtgtgcgctaaacagccgtatgatacaagatggggatacatctcttcacattgtctcacagccttcctcatattctttgcgttatcagtcacaatagcgaaaaattttttaggtccatactcctccagaacttcaaccattaattttgttatatattctgcggtatgcttctctgcttttgttagtactgatttgacaaataacggttcgggtgttgtaacaatgaaattaattacactttcatttcgcaagttggaccaaccatcgcattgcaatgataaattgtcagcttgcttaattttatcattaacttgaacttcaactcgctcgtactcttcggtcaggagacgatttgataacatatatctcgat

SEQ ID NO: 3246 - DNA, 391 bp, Diabrotica virgifera
  Clone ID: LIB149-021-Q1-E1-E6
agacgtaccaaagttttagatgaactagctcagaagttatcttcaaagaagggaaaattttttccttatactggcgatgtctccaaagaagacgacattataaaagcgttttcttggaccaaagaaaatgtaggacccgccagtgttttgataaataatgcagctgttttacttctagaggatttgagttcgattacaactcaacatttaaaacaagaatttgatataaacgtaatttcagtttgcattgcaaatagagaagccataaagcaaatgaaggaaaataacatcgcagggcatattattaacatcaacagtattgcaggtcataaggtgatgaattttccaaagcttaatgtatatgccgcaaccaaacatgctgttagtgcac

SEQ ID NO: 3247 - DNA, 411 bp, Diabrotica virgifera
  Clone ID: LIB3026-026-Q1-E1-D9
agggaatatcctgagagtctgggtgcttgataagattacggacttccttttcttcctcagtaaagttttgctgacgctgggagttggagcagcatcatatgtgttcttcgcctcggggttgcttcctacaaaagttatcgacaactctgatctccattacggaatcgtgccggttgcagtaattatgatttgcacttacttcatatcatcgttgttcttcaatgtttattcgatggccgtggacacgctatttttgtgctttttggaagattgtgaaagaaacgatggatctccagaaaaaccttactacatgtccaagagtctaatgaaaatatttggaaagaagaacaaaatagattaaattaattgtaaggcagtatttacaattttacccgtaagaatatctgtgat

SEQ ID NO: 3248 - DNA, 442 bp, Diabrotica virgifera
  Clone ID: LIB149-049-Q1-E1-A7
gggtcgacccaaacgtccagagctgcacatggagacgatgaatttgctaactacacaataaccaaccgcaaatttccaaaaggttttacttttggtgttgccacggctgcttaccagattgaaggagcttggaatttggatggaaaaggagaacaggtctgggatactttcttccacgaacatcctgaccgcgtagatgatggaactaacggtgatgtcgctactgattcttaccatctttataaagaagatgttcgttgtatggaagaagttggtgtggactactatagattttcaatagcttggtccagaatcttacctgacggaacccttgacaatgttagtcaagaaggtgttaactattatgtaaatttatttaaggaactgcgtgccaagggaataaaatcttttgttaccttgttacattgggaatatacaacag

SEQ ID NO: 3249 - DNA, 406 bp, Diabrotica virgifera
  Clone ID: LIB3026-028-Q1-E1-D12
agttaaattgttaattttgtttattgtgaaaagaatctaatcaaaatgcggagaggaataggtgtaggagcaattagaaaagaaaaattagaacaagaacgataccgaggcaaaggaaatgaaattcaagagagtcagtttgggcaaatgaccaaacaaatggaagttttcaagacaaatctagaagattttgccactaaacacaagaatgaaataagaaaaaatccagaatttaggaagcaatttcaggaaatgtgtgccagtattggtgtagatccattatcatcagggaaaggtttctggtctgtattaggcataggagatttttattatgaattagcagtacaaatcgtagaagtctgtttgtctacaacagcaaagaacggaggcctaataagtttagatg

SEQ ID NO: 3250 - DNA, 287 bp, Diabrotica virgifera
  Clone ID: pGUT2783
accggacgaacccaggaccaaccaaccaaaagaactttgggctttaattgccaaagtattggttttcaccacccttgtccaaatttaaaccggtttaccccttgacctgaactgccccacacttaacttggcttgcaattcccttgaaatcaaaaaaaaggtgacccgtcgttcttgtaaaacacttgaaaaaaacccaaaagccttaaattctgtgaaggccgccttggtaaattggtacccaaccaacccattgtgtgtaaaatatttcaaaaaattccaaccct

SEQ ID NO: 3251 - DNA, 412 bp, Diabrotica virgifera
  Clone ID: LIB150-001-Q1-E1-C9
cgaagacgtcttcaatcaagtttgtgttgcgattgtgatagtgtcctgcaggaatatattatataaaaaatggcgccaacagtatttccctacgaaaacttcaaagacgatgaagacgcacaagtgttaaaagatgccatggatggtctaggaacgaacgaaaatgccatcatcgagattttagcaaggagaacaaatgaacaaagacgacaaattgaacacacttacaaaaccatgtttggagaggacctaatagaaactctaaaaggggaactaggaggcgatttcgaggacgtaatactagctctaatgaaagagccgttggacttccaagttgaagaattacatagagccatcagtggaatgggaacagacgacgattcattggtagaaatattggttgtacatgaca

SEQ ID NO: 3252 - DNA, 428 bp, Diabrotica virgifera
  Clone ID: LIB150-047-Q1-E1-B12
acacaacaacaccatccgttggtctaggaggtctagctactacacaagccaaagtagtcaccgcacaaaaagatgtcacacctaaagatcagccccttcctaacgaacttcttcaaactgtagaagccttcaaaggatttgtgaagcaacagaaagtttacagttcggacatatcaaaatgttcagctcgggattttaagaaagtagagcaagacattaagcaattgacggctcttctgaaaaatgtagaacatcagctgcagataaataggcaattggcagaaaatttaaaatatgatacagcaaaatgtttacaagacgtggaaatagcacaaaggactcaagatactccacctgggttgcagtacgaaaacacagaacctctgaagtttttcctaaatcctgcggacaaattcgaaaaggatatg

SEQ ID NO: 3253 - DNA, 394 bp, Diabrotica virgifera
  Clone ID: LIB149-040-Q1-E1-A11
attcgaagagtggtatcgaagtgtttatggaagctaagagcgattccaaatgtccgttgtgtcttgttgctgttaccaagttggaagagatggtatctaataacaagtctgtggctcaaatcagggctgcgcttgaaaaattgtgcaatgttcttccaaaatcgatcgacaaccaatgcgaagcatttgttgataaatatacagatcatatcgtcgacatgttactcgctgatttgactcctgaagaagtgtgtgtagcattaaaactctgtactgatgatagaaaagttaattccttaccaccatatgtagtcaggcaaataggtggaaatatcgaaactaacgttatacccgacaacactgtcaatggtcaaatagtcattgatatccatac

SEQ ID NO: 3254 - DNA, 379 bp, Diabrotica virgifera
  Clone ID: LIB149-021-Q1-E1-D6
accacgcgtccgcgcaaagggatgttacaatggagaggcaaagaacgcctggtttgtctccacgaagggacgatcctcatgagttcagagtggggagattaaagcacgaaagggtgaaagttcctagaggagagcagttgctggaatgggcaatgcaagtgatgaaaattcacgcagctaggaagtccattttggaagttgaattcgctgaagaggagggaacaggtttaggcccaacactcgaattttatgctctggtagccgcagaactacagaggagagatttaggcatgtggatttgtgacgatgaagctataagcctgaacgaaccggtagacttaggagaaggaatgaaacctccaggatactatgtccggag

SEQ ID NO: 3255 - DNA, 493 bp, Diabrotica virgifera
  unsure (1)..(493): unsure at all n locations
  Clone ID: LIB150-031-Q1-E1-E3
tacacaaactcctggtagaaataggtgttttacatttaagaaagtgaatgattaaaaaaaaaaatttaaagggacaacagaaaagttagaatgtctgataataaagaaccggcattgtctgaaacagaccagcaaatttttaaggcaatcgagaataatgacgtagttcttttaaaaacacttcttgcagaaacaaaaaacgtgaatattctcgacgagaattctatgactccccttcaacatgctgcttataagggaaataaagatcttgttcaggttcttctggatcagggagcagatgtgaattactgcgaacaccaacacacatacacagctctgcactttgccggtctctctggaaactcagacgtttgcttggcattgttgttagccggtgcanaatcaaacatcaccaacacagtcggccgcacaccatcacaaatggcagccttcgtaggacaccacacttgcgtctctgttatcaacagctata

SEQ ID NO: 3256 - DNA, 415 bp, Diabrotica virgifera
  Clone ID: LIB149-033-Q1-E1-C6
gagagattaggagtcgctaaagaatttttacacagtgaaaatattcaagttcctgattctttcgacgcaagagaaaactggaaagagtgttcagatgttatcagcactgttgcagatcagtcgtcgtgtggatcgtgctgggccgtcgctgcaacttctgcaatgagtgacagaagatgcatagcctccgagggaagacgccaagtacctgtttctgctgaaaacctactatcttgctgcggtacctgtggagatggatgcaatggcggatatccaatcatggcatgggtttattggcaacagaacggaatttctacaggaggtctttatggcagcaaccagtgctgtcaaacatagtctcttcaaccatgtgaacatcattctaatggtactaaagtacaatgcagcactttgc

SEQ ID NO: 3257 - DNA, 400 bp, Diabrotica virgifera
  Clone ID: LIB150-021-Q1-E1-H10
cccaagcgtcagacatctcataggaaggtatggtcatacacggcgtcaacaggtatgccctattagacaattagctgacggtcaacggtgcagggtagtattcgcttggctagcatggcatgtaccgcatatgcttcttcttgatgaacctacgatctcatttggatatggaaacgattgatgctcttgcagatgctattaatgaatttgaatgacgaatgtgtgcttgttagtcacgattttagattaatcagtcaggttttttgacgacattttgggtagccaaaaagggaccattatcaaattgcaaggggaaattccttcataggaagattactttcaaactaaaattttgtatggagcggtaaaacggaaattatgcttaacatttatagcaata

SEQ ID NO: 3258 - DNA, 418 bp, Diabrotica virgifera
  Clone ID: LIB149-049-Q1-E1-B10
aagatctagttattgaaaagggaacagcagtttacattccttactttgctatgtttagggatcccaaatatttcccaaatcccctgaagtttaatccagaaagatttgctgataatactttcaattcagatggttacacctttttcccattcggagagggaccaagagcatgcataggtaaacgcctaggactcctagctattgctgcatgtgtctcaaatatcgtattaaaatttaatattgaaaaatgtgaagcaactcctgatgcaattgaatttgaacccaaatcgttggctctgcagtcaaaggatggactaaagataaaactaatagccagagaataacatattacaaatatacgtaattaattttaacacaaaatgtcaaagctaatatattgttatgggtctaccccaaa

SEQ ID NO: 3259 - DNA, 342 bp, Diabrotica virgifera
  Clone ID: LIB149-047-Q1-E1-G9
ggagcgaaggcatctctctccatcccgacctctcgtggccgccgcgaagaaaaggagcttatcatggcttcaaaacgtatcctgaaggaactgaaggacttgcagaaagatcctccgagatcatgcagtgcaggtccttctggcgaggatatgttccattggcaggcaacaattatgggtcctcctgatagtccctatgctggaggtgttttcttagtgaatatccatttccccccggactaccccttcaagcctccgaaggtatcgttcaagacaaaggtcttccatccgaacatcaatagcaatggaggcatatgcctcgacattctgaaggagcaatgg

SEQ ID NO: 3260 - DNA, 338 bp, Diabrotica virgifera
  Clone ID: LIB150-026-Q1-E1-D4
gatatgtagttgtggcaggaatgactccatcacctctgggataaggtaaacgtagaactcttttgggattggtgcaagctttgtcaacacatttgaataaggatacatttgctagaatgatgcaaccttctcaagggccaacatttggtattaaaggaggtgctgctggtggaggatattctcaagtcattcgcatggaagatgtcggtcctcatctcacaggaggatatgcaaggctattagagcttgcagagaactcttttgggagctccagcgtaatgctgtgagtttccatgaggcaactcaaagagatgcagctctataggatggtcttgttc

SEQ ID NO: 3261 - DNA, 282 bp, Diabrotica virgifera
  Clone ID: LIB150-012-Q1-E1-C11
ggacgagtcagacatccgaagttcgtaagtcataacgttcaactttagtcgctccgagaccgtgtgtagtgtcaacgggtaactcgtactttctttgagttctttcgttttgtccgtaagcgcgagaacaacacccatccaccatggacgcgatcaagaacaaaatgcacgcgatgaagcttgaaaaagacaacgcattagaccgcgcagcacacaatgaacaactcgccaaaagatggcaacctccgccctgaaaaggctgaagaagaagctcgctcccta

SEQ ID NO: 3262 - DNA, 419 bp, Diabrotica virgifera
  Clone ID: LIB149-033-Q1-E1-F1
cccaagcgtccggctacctggcaagaagccaccaaggaattggcccgaaaaaggaagaattatatttaagaatacgtacttaaaatatgctccagaacttccacctgtattgaaagatttaaatatagaagtaaattctggcgagaagattggaattgttggacgaaccggtgcaggaaagtcaaccctcattgcgtcacttttcagattagcaccgatagagggtactatatcaatagatgatgttgatactgccgaaataggtttgaatgatctaagattaaatatctcaatcataccccaagaaccaattttgttctccgcttcactcaggtataatttagatccttttgagaaacatggtgatgaggttttatggaaagcgttagaagacgttgaactcaaaggtgctattagtg

SEQ ID NO: 3263 - DNA, 593 bp, Diabrotica virgifera
  Clone ID: pGUT3367
ctcgagcactggtccacgtacgagaagagatcactggccacactcacgagtgacgattcagaaggaagctcataaccagtctactatgatggtcatcggagtatactctattggacaacgcagtctacaccatggacattggcattctcgcaccaggaccgtggtaccacgttgaacgctaacgacatgaaactttaatgcgcacgaatctacccctaaaagcgcaccactcttacgagaacacacttcggacaatacgcatatatagcgtggattacggacgagtatagcgcgattcagttggaagcacactactgtatagtagcacacactcgctcgttcaggatctgtcaagcgctcagtacgacagtgtcatacactcagctcatgaggactatactgacgccttatccatactacactgaggcgttgtctatgatggtgggagcttgcgttttctcgactgtgagattacatttaaaagagagtgagactatgtcgtatagtgagtgatacactactctattatgtagtttacatgacgttacgatttagaaaatattatgatacgaaaaaaaaaatttggggggggg

SEQ ID NO: 3264 - DNA, 450 bp, Diabrotica virgifera
  Clone ID: pGUT2013
gagaactagtctcgagtttttttcatcattacaagtgcagttcacttcaaaaaagtattgtaccaaccagaaacatttcttttatatttagtacatagctgttatttttagacacaacacacaaaaatgcctgcttctccgagttctacgaatgtgggttcaggtggaagatccccctcaaaggctgtcgctcccaggtcttctatgggaagcagtgtaaggcagaggaagacgactaccacaactactactgccaggagaaaatacaggtgcaggaactggaggaatgtggcgtttttacactgacgattctcctggcatcaaagtaggtccagtaccagtcttagtaatgtctcttctattcatcgcatccgtattcatgttgcacatctggggaaaatacacgagaagcagctcatagatgaaaattcagcggttcatcattccatc

SEQ ID NO: 3265 - DNA, 326 bp, Diabrotica virgifera
  Clone ID: LIB149-020-Q1-E1-H5
acccacgcgtccgggctcttattccggattctgttcatgtcaggtacacagaagttcatcaatggagatcctgtatggtggaaccttaaaggtatatctcgtgtttatgaagtattacctttacctacgcctctgtcttggtatgcatatgcccttcctgaatggcagctgaagctcacacaagttttcgtcaacgtcgctgagattattttacctttcctgtttttcgtacctataagatgcgccagacattttgcattcttagcacagttattcttacaaatatgcgttattgtaactggtaatttcggatttgccaacatact

SEQ ID NO: 3266 - DNA, 383 bp, Diabrotica virgifera
  Clone ID: LIB3026-030-Q1-E1-B1
ccaacgagtccgcggacgcgtgggaaaatgttgaacactgacgtacaggtaattttactttcggctaccatgccaaacgatgtgctagacgtgacaaaatcctttatgaggagtcctgttcggatacttgtcaaaaaagaggaacttaccttagaaggtattaaacaattttatgtatatgtagaaaaagaagattggaaattagagacattatgtgatctctatgatactctttcgattacgcaggctgtaatcttttgcaatacccgtcgcaaggtcgattggttaacagaaaacatgcacaagagagacttcactgtttccgctatgcatggtgatatggaacaaagagagcgtgacgttattatgcgtcagttcagaac

SEQ ID NO: 3267 - DNA, 471 bp, Diabrotica virgifera
  unsure (1)..(471): unsure at all n locations
  Clone ID: pGUT104
atgcttgtggacgcataggaagaaattgtaaaagcagctatatatgctaattgttcacaaggatcggtacattttgcagctacatcaagaacatcagcatattcaaggtcttctgtgatgcgctgcatcatagaaagtggttcattaaaattaacaggcattggtatcttggaaagatcctttcctatgcaatttttcataatgctccacaaattaagggggtaattatgtttgtccggcacccgagtacgccgctgacgtttcgcaccattggattttggagatgcattagcagatgaaccactatgtgtttctggtcgtctnacgttgttgtgtttacccgtnactacgaccacttgtttcgtctgggtttcctccgtntcactagagctatccgaactatttcttctatgtcctgtagcaattcgaatatccaacctaaaatgttatctccatctgtaacctgtcctg

SEQ ID NO: 3268 - DNA, 375 bp, Diabrotica virgifera
  unsure (1)..(375): unsure at all n locations
  Clone ID: LIB150-033-Q1-E1-D3
gactaaccaaacaatacacatcaacagatcgcactgatttaacaagangggcaaaatccaaagtaactgacatgcctcctatgagcgaagctgtaaaaggactgccacaagctgtctacgcgaatttcaaagaggaagaccaaaagacgaaggtaaccatcctctccaatggcttaacagtggcgtcagaaaacagattcggtgctttctgcacagtcggtgttgtcatagattcaggatcgaggtacgaagtggcttatcccagcggtatctcacattttttggaaaaactagcatttaattcaaccaaattttatccagacaaagacgaaatgatcaataaattggagaaacatggaggtatttgtgacagtc

SEQ ID NO: 3269 - DNA, 459 bp, Diabrotica virgifera
  unsure (1)..(459): unsure at all n locations
  Clone ID: LIB149-010-Q1-E1-A11
tcgggcgtcgacacacgcctcaagaaagattcgtatctatacattctacaatgaactcagagtagccccagaagaacaccctgttctgttgacagaagctcctctcaaccccaaggccaacagggaaaagatgacacagataatgtttgaaactttcaacaccccagccatgtatgttgccatccaggctgtactctccttgtatgcatctggtcgtacaactggtattgtgttggattctggtgatggtgtatcccacactgtcncaatctatgaaggttatgctcttcctcatgcaatccttcgtttggacttagctggtacagacttgactgattacctcatgaaaattttgactgaacgtggctactctttcaccaccacagcagaaagagaaattgttagagatattaaagaaaaactctgctatgtaactttggccttccaacaagaaatggc

SEQ ID NO: 3270 - DNA, 422 bp, Diabrotica virgifera
  Clone ID: LIB149-026-Q1-E1-G5
acagcgggcgcagccatattgatagtaagaaaagtgtacagtattggaattttgtgttaggtgctgtgaataagaaatctgaaatcatctcaaaaatgtccgagcgggaggataatgtatataaggcaaaattagccgaacaagcagagagatacgatgaaatggtggaagccatgaagaaggtagcgaagctggacttggaactgactgtagaagaaaggaatctcctctccgtagcttataaaaatgtcattggtgcaaggagagcatcgtggcgtataatttcctccatagaacagaaagaagaatcaaaaggtactgatgataagctagaaatgatccgccagtatcgttcccaagtagaaaaagaacttagagatatttgctcagacattcttggagtactagacaaacatttgata

SEQ ID NO: 3271 - DNA, 163 bp, Diabrotica virgifera
  Clone ID: pGUT810
tgaaaacgccatcgacaatgaattttcaggaagtaccaaaaatgcttacttagccctagtaacgtcaattagggataaacccgtgtacttggccaccaaactccacgacgcaatgcatggtatgggcacagacgacaaaacacttatcagaattatagtatct

SEQ ID NO: 3272 - DNA, 372 bp, Diabrotica virgifera
  Clone ID: LIB150-046-Q1-E1-H6
agtaacgatcgttttgattgtgattgtgaccactgaccaccttaaaaagtttaataaaaactgagtattgtcaatttttttcgactaatattataaaaatatacacaatgtctgcttttaatgttgattcaatcgcggcaagtttggaaaatgctcgtgttagtgatagtggtgttagttttgctggaaaatctctaaagttaaacactgaggaagatgctaaacaagttaccaaagaaatcgatggttgttcaaacctgcaatttcttaatatggagggcaatacacttggggtggatgcttctaaagaaattgccaaatctttagaaaaacaccctgagttcagacgggcgttatggaaggatatgttta

SEQ ID NO: 3273 - DNA, 411 bp, Diabrotica virgifera
  unsure (1)..(411): unsure at all n locations
  Clone ID: LIB149-005-Q1-E1-F9
agtganccatggtagacggtgaggcgatagtgataaggaagactgcggacacgctaagtaaagatgataagacattatatcttgggctgcgttttagcaagctccttaatccttttggtaagctccttcagaggtgacgactttgctgatctcgcaggtccttattgtgaaaacattggatgctgcaacaatagattagattcttgctcagtgcctattttgggtacattatgttactgcgacgagttttgtaactctagtagagtggatgactgttgcccagattactggtcgcactgtagaggtataactttcccaactacagaacgaacacgtcgaacacccccacaacccccagagaacataaccggatgtcagtggggcgacagaaccctcttccttaaacaaaaa

SEQ ID NO: 3274 - DNA, 393 bp, Diabrotica virgifera
  Clone ID: LIB149-030-Q1-E1-F8
agccactttcttgaacgaaggattcgcgaggtatttccaatacttcattttgacaaaaattactgatttaagtgactttcaaatggataaacaatttatagttgaacaacaacaaacagcatttatagaagatgcgtcgcctctttctcgctcacttacgtccgaagcatggacaccggctgaaataagcaacagatttaatacaatatcttataacaaaggtgcatgtgtctttagaatgatagagaacttgattggttctgttgcttttcagacagctttgcaaaaatatctaaatgctactgcttatggttcaggaaccacggaaaaattatgggccaattttcctaacagtattgcattacctccaaatgtaaattttaccgattttgt

SEQ ID NO: 3275 - DNA, 412 bp, Diabrotica virgifera
  Clone ID: LIB150-037-Q1-E1-F6
agaattgatccaaattgtcacacttacagtcaaaatatcacaactttaaaaacagatgaaatggttcccgaagtgaaaaaaggaattcttgcacttgacgatgatcctctagcagccttagctactgctgccttggctgaaaataattcccatgatcctgaagtgcctcttaaagacacttggtatactgtcggcttcattcgagggaatagttgtgatgtaaagagttatttcttgttaaatgaagacactgagaatctgaccttagacactttgccttctactgtaaattaccccgcgggattcaatcttgaaccgggcactgcatacaagttcagagtcgcagctatcaattcattaggtcgaagtgattggagtgaggtatcagcgtttaaaacttgtctaccgggct

SEQ ID NO: 3276 - DNA, 410 bp, Diabrotica virgifera
  Clone ID: LIB149-048-Q1-E1-D10
ctctaaagaaatcctggtaactggtattaaggtagtagaccttttagccccttacgctaagggtggtaagattggtctctttggaggtgctggagtaggaaaaactgtactgattatggaacttattaacaacgtagctaaagcccatggtggttactcagtattcgctggagtaggagaacgtacccgtgaaggtaacgatttataccatgaaatgattgaatctggagtaatctccttaaaagataagacctccaaagtagccttggtctacggacaaatgaacgaacccccaggcgctcgtgctcgtgtagctttgactggattaactgttgctgaatatttccgtgatcaagaaggacaagatgtactgcttttcattgacaacattttcagatttactcaagctg

SEQ ID NO: 3277 - DNA, 370 bp, Diabrotica virgifera
  Clone ID: LIB3026-014-Q1-E1-C7
atgtggtctttgggctgtatgctagcatctatgattttccgaaaggaacccttttttcatggtcatgataattatgatcaattagtccgcatagccaaagtcctaggtactgaagagctttttgaatatcttgataaatatcatatagagctagaccctagattcaacgatattttaggaagacattcgaggaaaagatgggaaagatttgttcatagcgagaatcagcatttagtatcacccgaagctttagattttttggataaactgttacgttatgatcatttagaacgccttacagcacgtgatgcgatggatcattcatatttctatcccgtggtaaaagagcagtgcaggatgctgtctacgg

SEQ ID NO: 3278 - DNA, 96 bp, Diabrotica virgifera
  unsure (1)..(96): unsure at all n locations
  Clone ID: pGUT3668
ggacttcaaggtttcttgattntccactccttcggtggtggtactggatctggtttcacttctttgttgatggaacgtctatctgttgactatggt

SEQ ID NO: 3279 - DNA, 402 bp, Diabrotica virgifera
  Clone ID: LIB150-032-Q1-E1-D4
cggtcgacattaccgggtccacgatccgaacgtacggcagatcatcccgttcatctcgaagccggtcgtgcgctacggcctgtcgccggacgcgcaggtgcgcgccgaggacatcgacgcgcgcgacggccggatgcatttcagggtgatccgcgaagggcgcgcgccgctcgcggtcgtactgaacatgccgggcctgcacaacgtgcaaaacgcgctcgcggcgatcgcgatcgcgaccgatctcggcgtgacggacgacgcgatccagctggcgctcgctgaattcaatggtgtcggccggcgcttccagcgttacggcgacgtaccgaccgcagatggcggccagtacacgctgatcgacgactacgggcatcagccggtccaaatggcgccaccatc

SEQ ID NO: 3280 - DNA, 418 bp, Diabrotica virgifera
  Clone ID: LIB149-042-Q1-E1-B12
acggaaacacagttacctgtatcgttccgacatttgattttgcccgagaaaaacttccctcctactgaattgctggacttgcaaccgctgcctattactgctttgagaaacgaacaatttgagtctttatacgccgataagtttccacagtttaatcctatacaaacacaggttttcaactcagtatacaatggagacgacaacatattcataggcgctcccacgggatcaggaaagaccacaatagcaaaatttgccatcctcagactcttcgattgaaatcctgaaggtcgatgtgtttatctagttcctaaggacgccctcgctgaactgattttcgccgattggcataataagtttggacaggccttggcaaagaaagtggtattgctgactggagaaactggtactgatctaa

SEQ ID NO: 3281 - DNA, 336 bp, Diabrotica virgifera
  Clone ID: LIB3026-027-Q1-E1-G1
ggttcaacccagccttcgttaaaaaattcaaaccgaacaaaaataaacctttccccaagccgccaattttacaatccaagaatgtacctgaaaaatgcggaacattaggaatcactgcactccacatcaaattgagggctacacgtggtaacaaaaccaaaacccctggaccacgagcccaaagcgcactcagaactttggctccttcaaacatgaaaattggtacgattgaagatgtaactccaattccatctgattccacacgtacgaaaggaggtcgccgtcgtcctagattgtaaacagtgtcgattttatctatcgatttattgcaatttt

SEQ ID NO: 3282 - DNA, 408 bp, Diabrotica virgifera
  Clone ID: LIB150-002-Q1-E1-G2
cgagcacggaatagtcacaaactgggatgatatggagaaaatttggcatcatacattctacaatgaactcagagtagccccagaagaacaccctgttctgttgacagaagctcctctcaaccccaaggccaacagggaaaagatgacacaaataatgtttgaaactttcaacaccccagccatgtatgttgccatccaggctgtactctccttgtatgcatctggtcgtacaactggtattgtgttggattctggtgatggtgtatcccacactgtcccaatctatgaaggttatgctcttcctcatgcaatccttcgtttggacttagctggtagagacttgactgattacctcatgaaaattttgactgaacgtggctactctttcaccaacacagcagaaagaga

SEQ ID NO: 3283 - DNA, 364 bp, Diabrotica virgifera
  unsure (1)..(364): unsure at all n locations
  Clone ID: LIB149-047-Q1-E1-B11
tggtgatacgttatgtgatgaaattggagcatgatttatttattgattgtattccttatgagtggcggtcggggacgagcaatggtcttttcctaccaatctatcncctagtatcatgcacatagtacttcggttcaataactaataaatttttgcaataagtatgtgagttctttatgactaatgttgagtccatggattatacgcactctcaccattccaccattgctagcctctctagtaccgcacaactttcgctggtaccatacacccaccatataccttccttaaaaaaacccatacctaactattacggcatttcgatagccactccgagatatattgccacgcaacttttcaccgt

SEQ ID NO: 3284 - DNA, 402 bp, Diabrotica virgifera
  Clone ID: LIB150-040-Q1-E1-B4
gtcgtcacttgtggtgagttgctaaaataaaaatattatattatagagtatataatatataaaaagaatatagtttattataaaagtatcaagattcgttcaaatatgagttacggtagaccaccgccgcgtattgacggcatggtctcattaaaagtcgataatttaacctatcgcacaactccagacgatctaaggcgcgttttcgaaagatgcggcgaagttggcgatatttatataccaagagatcggttcaccagagaaagtagaggctttgctttcgtaaggttctatgacaagagagatgctgaagatgcgttggacgccatggatggcaggatgttggatggaagggagctcagagttcaaatggctcgctatggaagggctacatcaccccat

SEQ ID NO: 3285 - DNA, 535 bp, Diabrotica virgifera
  Clone ID: pGUT3125
ctagcgtcaatatgtgcggaacagcgatgggttgtgccgaagggattgtgaaattgtttgtgtttggggcgaatatcatttttgctctcggtggtcttgctttaatcgtcgtaggagtactatacaaactaaacataaatgattttactgaagctataccagaagaatacagctcaataggcgtagctcccatactgaccattgtagtaggctcaataatatttgtcatcgcattctttggatgctgtggagccattagagaaagcccgtgtttgcttacaacgtacggtgtaatattgttggtaatatttttgcttcaaatcgccgttggagtctttgcttttatagaaataaaggataaagataatttcaaaacccaagtgaacaagcaactggatactttgtttaatagagctaaggaccagaataaacacgaattaacagatttaattcaaaaagaatttgaatgctgtggtcctaacggtccatcattttggggagctagtatacccaaatcatgtttggattcaaataa

SEQ ID NO: 3286 - DNA, 405 bp, Diabrotica virgifera
  Clone ID: LIB149-031-Q1-E1-F6
aatgtagatcttcaagttaatcttgacttggaaacaatcaatgctagaacaagaaattctgaatttaatccttcgaggtttcatggagttattatgagattaagagaaccaagaaccactgcccttattttcagatcaggaaaaattgtctgtacaggagccagaaatgagtatgatggattgttagcatcaaagaaatttgccagaatcatacaaaaattaggatataatatcaaattttgtaatttcaaaatacaaaatttagtagctacctgtgacctgaggtttcctattaaactggagaatttaaatatgatgcatggacaatttagcagttacgaaccggagctgttccctggactagtatacagaatgattaaacccaggctggtgattttaattttt

SEQ ID NO: 3287 - DNA, 324 bp, Diabrotica virgifera
  Clone ID: LIB149-035-Q1-E1-D4
agacattatttaagtggggtgtttagaaggtatacttaactttatctatcttatgagacgacgtaataatttcttgatccaatttttttgattaccagaatacattaccttatggatagcagcgtagttttattggagagttcaaatctataatacagattgcgaccgcgatgttggatcacagtttataattggtgtagcagctatattattaagtctgttctacttttaaaatttgacacgatctgagtttaaaccggtgtgagccaagttggcatctagctttaatttattaacagaggttagtacgataggaccaggtat

SEQ ID NO: 3288 - DNA, 439 bp, Diabrotica virgifera
  Clone ID: LIB150-034-Q1-E1-F2
cagctatattactatttttttaataaaacaccaaatatggctctaaaacgggtgattatgattttagctgctagtttagaattcgataaaaaacataactctgaaattgtggaaagacagtctgataacgaagaagtcccacagttgattaaaaaacttccgaatttgagtgagaaaaataaagagcgtccattgtgttacttatatagcataaaagctagagcgatcatacatgctcatttaagtaggataccattaaataattttacgttagaacaagataggaggtacatagttggcaaatgcccatttttggttaatgagcaagtcaactgcgtgaatcaactcataattatggcttatactagacgaatccccagattgcctcctatagaaacaatagaaaattgtatgaaattatcacctatgatagccaagg

SEQ ID NO: 3289 - DNA, 399 bp, Diabrotica virgifera
  Clone ID: LIB149-031-Q1-E1-B7
acccacgcgtccgatgccatcgctcccaagagagagaaaacacacggagaggtggaacgccgtatagtatcccaacttctaactttgatggacggtatgaagaagagttcccacgttatcgttatgggcgctactaacagaccaaactcaatcgatccagctttacgtagattcggaagattcgacagggaaatcgatatcggaatacctgatgcaactggcagacttgaagttttacgtattcacaccaagaacatgaaattggccgatgatgtcgacttggaacagatcgctgcggaaactcatggtcacgtacgtgctgatttagcttcattgtgttcggaagcagcccttcaacaaatcagagaaaaaatggacctcatcgacctcgaagacgac

SEQ ID NO: 3290 - DNA, 396 bp, Diabrotica virgifera
  Clone ID: LIB150-035-Q1-E1-D1
tgttaatgacattagatctcagattaactctaaatttctgcaatttgctgaggatttaatgatctatataattatcgaatctgtctcatattgtgaaatacttcaaaatgatattaagaaaattatggcatggtgcaattggaaccaaatgagcattaatgttggtaaatgtcactttattagtttctgtagaagaattaacaacctcttttataattacaaattaactgaagaaccactgaaggctgtatcaactgtaagagatctaggtgttcaattacattccaaactaaatttttgcgctcattttgattatgtgaataaccaggcatttaatcatgtaagcttcagtattacaacttctagatgtctgcataacattaattccatcagact

SEQ ID NO: 3291 - DNA, 433 bp, Diabrotica virgifera
  Clone ID: LIB149-008-Q1-E1-B5
caaaattacacataaatgaagtataccctgaagatgaaggagaatatgtgtgcagagcaaccaactctgtaggaacctctgagaccaaatgcaaactaaccattaaaccaatggccaatgccaccaacggcaagaaaaaatcctcagaagacaaacccccaagaatagtagaccatttgaaatcagcatttgtagaagacggcaagccagtaaccctatcttgccgcataataggagctaacaaatttgatgtagtctggttacacaacaataaagaaatcaaaccatccaaagatttccaatataccaacgaagcaaacatttacaaattaatcattgcagaaattttccctgaagattctggtgcatacacttgtgaagcattcaacgacgctggagaaagcttcagcagttgtacactaaatgttgttgt

SEQ ID NO: 3292 - DNA, 424 bp, Diabrotica virgifera
  Clone ID: LIB149-008-Q1-E1-E4
atccacgggtcagaaaatgtataacctattatatattattgtgctattcacaatagcgcttaaatcagtgaatacatcagggcataaggacttttttaaaaagcccccattcaaagatttctacggaaaactagacgcgaatatcagggttggcgacgcaggtgagccgctcatattgacagatcttatcaaaaatggcgatattatatgggccaaggaaaaagctaaagtgacagattttatgccagaagttagcagttatgctggatatttcagggttgacgaaacttataattcaaatttgttcttctggttctttccgtctcagaacgatcctgcaaatgatccagttatcctttggttacagggaggcccaggtgccacttctatgtttgggttgtttcaggaacaatggccgtttgag

SEQ ID NO: 3293 - DNA, 353 bp, Diabrotica virgifera
  Clone ID: LIB150-029-Q1-E1-G1
cccacgcgtccgagttgttgttgtctgatagattcaaagactgtaaaagtattattgtgtattgtacgagaaggcaggagtgtgagaggattgccggatttttaagaacgtgtcttaaaggggaagaaccagtaaataacagtaataccaagaaacggaagcggatgaaccttcaagctgaaccgtatcacgcaggtttgtcggcgtctcgtagaaggactatacagaacgcctttatgtctggacaactgagaatagtagtggcgacggttgcattcggtatgggcatcaataagtctgatattagagctgtgatacattacaatatgcctagtaatttcgagagctatgtg

SEQ ID NO: 3294 - DNA, 283 bp, Diabrotica virgifera
  unsure (1)..(283): unsure at all n locations
  Clone ID: pGUT476
aaagaaagtaaacatagactttgaaccattcaaaccaattaatacctcattgtatttatgtgacaataagttccatacagaagccctgacagcattattggcagatgataataaattcggttttatagttatggatggtaatggtgcattattcggtacactacaaggaaacacgagagaagtacttcacaaatttactgtagatctacccaaaaaacacggtataagatgtcagtctgcacttcgtnttgcccgtctgagaatggannaacgtcataactat

SEQ ID NO: 3295 - DNA, 403 bp, Diabrotica virgifera
  Clone ID: LIB149-048-Q1-E1-E4
atcctttatcgaaacatacgaagcagatcccaatgttgaacttgcaagttctgttgactggagaaacaaagctgttttgggagtcaaaaatcaaggaagttgtggatcttgctgggctttcagtgccacaggtgctctcgaaggtcaacttgccattcacaaaaatcaaaaggtcccactaagtgaacaagaattggtagactgtgactcatcaaactctggttgcaatggcggtttaatgacaaatgcctttgcatatgttaagagccacggacttgcatcagaaaagcaatatgcttacaccggcagagatggtagctgcaaaagaggatcaagaacactttctactatcagtggatatgtaaatcttgccaaaactgaagctgcactggctaatgctcct

SEQ ID NO: 3296 - DNA, 375 bp, Diabrotica virgifera
  Clone ID: LIB150-046-Q1-E1-F2
agttgaaggcacaacaacttacgctttttagttttaaattttaaactcacatttttagtatggccgaaagtgctggaaactggtgtctcattgaaagtgatcctggtgttttttcagaactaattagggaatttgggtgcaaaggggtacaggtggaagagctgtgggggctggataacgacttattcgaaaatttgaagccaattcatggattaatatttttattcaaatggacgaaagacgatgacccatctggttcactagtacaagatagccgattagaaaaaatattctttgcaaaacaagtaatagagaacgcttgtgccactcaagctatcctcagtgttctgttgaattgccgtcacaatgatctaa

SEQ ID NO: 3297 - DNA, 358 bp, Diabrotica virgifera
  Clone ID: LIB149-019-Q1-E1-C2
aaaaagagaactgctatgatgtgttggaagttacaagggagacaaccaaaaatgaaatatccagaagttatcgaaaactggccagacagtatcaccctgatctgcacagaacaccggaagccaaggaaaaggctgaagaaagattcaaaataattgcaaatgcatatgaaattcttaaagatgaggaagctagatcagattatgattatatgttggataatccagatgaatactacgctcattattatagatattatcgaagaagagtagctcccaaagtagatgtaagaatagtattaatagtgacaatttctataatatcaataatccagtattacagtggttggcagaaatatga

SEQ ID NO: 3298 - DNA, 429 bp, Diabrotica virgifera
  unsure (1)..(429): unsure at all n locations
  Clone ID: LIB150-017-Q1-E1-A4
ggttgccttaaatccgatttttggtggaaacctccacattttccaaaaccaggccaaaatggaaaccaccagggcagcaaaaaccggattccctgcaaaacctcaacgaaaggtaaacgccaaatacagcgaaaacttggctaaagaaagtctcgaatggatcgtgacgatcacaggagacgaactgaacacagctggtgatatggacaacttttatgaagtacttaacgatggaaccgtattgtgcanattagtanatagcatccaacccggtatcgttaagaaaattaacacctccacaatggctttcaagtgtatggaaaatatcaacgccttcctagaagctgccatacaattanggtgtacaacctcatgatacattccagactgtagatctatgggagaggcagaaccttaactcagttgtca

SEQ ID NO: 3299 - DNA, 379 bp, Diabrotica virgifera
  Clone ID: LIB149-025-Q1-E1-H8
gacccacgcgtccacccacgcgtccgctggaaaggtggtaaagtatcaggagctgtctatttttacaatcaagatttaataaacctcatttctggcatttatggtaaaactgcttacacaaatcctttacatccagatttatttcccggagtatgcaaaatggaagcagaagttattagaatagcatctaatctatttcatggagacgagaatgtagttggatcgatgacaagtggcggtaccgaatcaatactgatggcctgcaaggcatacagagactatgccagagaagttaaaggcattaaaaagccagaaatagtcgtaccaacaacaatgcattcaacctttgataaggctgcacaataattggagttaaaag

SEQ ID NO: 3300 - DNA, 378 bp, Diabrotica virgifera
  Clone ID: LIB150-005-Q1-E2-F10
agcttcaagttaatagttttgttaaataggatacatcatgaagtttttgctgctttttgttgcattttttgtgggttgccaagccatttcctttgttgatttggttcaagaagaatggactgctttcaagatgacacacagaaaaagttacgaaagcccaaccgaggaaaattccgttagaagattcttaagggaaattaacattaagttggcaaacaaaacaagctccttgccttgggaatgggttcctaaaaaataaggatccaccaattacccgaaaagccccaacaagaattcatcgatactctcaacggcttcaacaaaacgaagaacctgttgagacaatcagagttagaaaattccgtcactttcacaaaa

SEQ ID NO: 3301 - DNA, 420 bp, Diabrotica virgifera
  Clone ID: LIB150-033-Q1-E1-E4
aaaggcattcatcaaacttcaatgcccccattgccatatgcgggctttgacctacaagaaatatgaattgcatttgggtagccgtacccattctcttgcaatgagaagagttgcttttaagcagaaagctatcttaaatcagatgcgccgtgctcagaggaacactcaaaatgaattggaaaagggtgctgcggatctcgacagtgtaactacttactgtcccctgtgcaaactgaatttcaagcaaaagaaagctgtgcatcaattatctgagtcacatgtaaacatgaagaagttcttgatgcccacttgcaaagtttgtaccctggcctttaagagtcgcatgtcttatgaaaaacatttgtgcacagtggatcatattaagcgtaaacaacgaggaggcgttgatgatactgatat

SEQ ID NO: 3302 - DNA, 334 bp, Diabrotica virgifera
  Clone ID: LIB3026-015-Q1-E1-A7
ctttatactacactggaaaatgggatcatccattcgaaaaatacaactctgctgatagattgttccacagctcacctactgaatccaagaaaatccccaccatgtacactgaagcattcgccaaatacgcttacaatgacaaacttaaagctaaatttttggagctcggatttcaaggcgcaaatgttactatgacctttgtattaccggacgaaatcaatggattagcagctgctgaacagaacttgaaagaatacttggctccacaaccattggaatctgctagagttgccatcaccctacccaaattcaaaatcaacacaaaaattgactt

SEQ ID NO: 3303 - DNA, 418 bp, Diabrotica virgifera
  Clone ID: LIB3026-002-Q1-E1-G2
ccacgcgtccaaaaatatgttaggagacttgggaatggacgaagaagaagaagaagtggttcctttaccaaacgtaaattccgccatactcaggaaagtcatccaatgggcgacttaccacatagatgatccaccaccaccagaagatgacgataacacagaaaaaagaacagatgatatttcctcatgggacgcagacttccttaaagtcgaccaaggaaccctcttcgagttgattttggctgctaactatctggatatcaaggggctcttagatgtcacatgtaagactgttgctaatatgatcaaaggtaaagctcctgaagaaatcagaaagactttcaacatcaagaatgacttcacggcatctgaagaagaacaagtgagaaaagagaatgagtggtgccatggaaagtta

SEQ ID NO: 3304 - DNA, 454 bp, Diabrotica virgifera
  Clone ID: LIB149-010-Q1-E1-A12
agaatcaatccgtcataataaattggtgacatcaacattttttaaattcttggatacttatttgtatatgaatcataaataactacaaataccacgtaaaattctccagtaatcatgtctaaagttcacgaatttaatgtaaaaatgacctgtgatggctgttctggtgcagtagaaagagttttaaataaattaaaggacaaaggagtcgaagactttactattaacttggagactcaaaaggtgaccgtaaaatcgtctctacctgcaaatgacattttagaagttattaagaaaacaggaaaagaaactaccttgctatcttcgtcttagtggagatctttttgtgaactttacgatttgcagctaattttatatacttatgtgaacgatttatgttaagtcttattgacatattatttacagttataaaaatctatattttaagaatata

SEQ ID NO: 3305 - DNA, 175 bp, Diabrotica virgifera
  Clone ID: pGUT2000
agaaggcatatgtaaggttagctagagattatgatgctctagatgttgccaacaagattggcatcatataaattaatatcttaccttgttttattttttttgacatctaataaaataagttgagaataaagttttttagtttgagttaaaaaaaaaaaaaaaaaactcggggggg

SEQ ID NO: 3306 - DNA, 392 bp, Diabrotica virgifera
  Clone ID: LIB149-021-Q1-E1-H12
aaaatgcatgcatgactaccacatactcaactttattggttattatatttattctcgagttggctgttggaattactgctgtagtcctcaagggtaaaaccgaagaatttttagctgataaattagaagaaacaatgcatacttataacaaccacagctttaatgaaactacagtagtttgggataccatacaatcacagttccaatgttgtggggtccataatttcaccgactggaaaaatgttcctgctgtcaattatactacaggcttaccattgtcctgttgcaaaattcctgcaggttctacgcaatttacctgcaatcccatttttgcttaccataaaggatgtttggaaaagttcggtgatttcgtaaaacaaaacatttcgtat

SEQ ID NO: 3307 - DNA, 401 bp, Diabrotica virgifera
  Clone ID: LIB149-010-Q1-E1-D4
cccacgcgtccgcggacgcgtgggcaaatgcagatcaagaaaactggaaaggatttcaaaattggaagacaaagttaaattgctaaaatgtgaaaatatagaacttggatctattgttaatcaactcaaagaaactgtaggacttcttaaacttgaggccgttgagtttgtccatcagaattgaaaaggacacggtgacccctctggcacctagactaatatccctatccaatatattccaaaatctttgtggtcaagaacaaatgaatgatttaaaggaaaacatgactaaaattcttggtaacctttggaagtctactgaaagtttagtacagtaacgaactacgtgctttatctagtagtatgagtttttaagaaataaatccaaagttttctcatac

SEQ ID NO: 3308 - DNA, 432 bp, Diabrotica virgifera
  Clone ID: LIB150-037-Q1-E1-E4
acagtatcatacgccgctccagctctctcataagccgcaacaatccccaaagttaccttctccacaagcccaagctggcccctaatccaattgtaccggcacaagtagcctacggggcggccccagcttacgccaaagtagctgctccagtatcgtacgcagccccagctgtttcctacgccgctccagctctctcctatgccgccccagcccttaaagtagctgccccagtagcttacgccactcccgttgccaaagcagtttacgccgaaccatcagcaccagctcactacgattttggatatgccgtaagcgacccccataccggagacagcaaaagccaacaagaatcccgtcgtggtgatgttgtccaaagcagctactccctcatccattccgatggtacaaaacgcaccgttgactacaccgctg

SEQ ID NO: 3309 - DNA, 430 bp, Diabrotica virgifera
  Clone ID: LIB3026-031-Q1-E1-D12
cccacgcgtccgaaaaacgtcaaacatagagataacctatttcctattttatattgaaaattgaaatttttatcaaattgcactaattttattataaaaatgaacagaaaggaggcactatcgactttcattcaacaaattcatggtagacctgttgtagtaaaactaaacagtggcgtggattatagaggcgttctagcatgcctagatggatacatgaacattgctttggagcagactgaagaatatgttaatggccagctaaaaaataaattcggtgatgcatttatcagaggaaataatgttttgtatataagcacacagaaaaggcggtactaattttagttttaagttatataaataacatgtaattctgctaagaataaaaagttttgtaaattttgtaaaaaaaaaaaaaaaaggcggccgc

SEQ ID NO: 3310 - DNA, 256 bp, Diabrotica virgifera
  Clone ID: pGUT094
gaagaattaacgaaatacgatggtacccaaccagatggaagatttcttgtagctgttaatggaaacgtttttgatgttaccaaaggaaaacgcttctacggtccaggtggtccatattcaccttttggaggcagagatgcttctacatgtttggctacttttgaggttaatgctgttagtgagaactacgatgacctgagcgatttaagcaccatggacatggattcgataaacgaatgggagtcacaatttcatg

SEQ ID NO: 3311 - DNA, 422 bp, Diabrotica virgifera
  unsure (1)..(422): unsure at all n locations
  Clone ID: LIB150-009-Q1-E1-D4
gaacacgcgtccgctgagttgtgtggtgctcctggacctctttgtcatcaactagtttttttttaaatctccttaaccatgtctgacgaagaagaagtttactccgaagaagaggaggaggaagaagtcgttgaaacaaaaacgactaccaccactaccaccaaagtcgaggaaggagcgggagatccagaattcatcaaacgtcaagatcagaagagatcagatctcgatgaacagcttcgcgagtacatcacagaatggcgcaaacaacgtgccaaggaagaagaagacttaaagaaactcaaggaaaaacaggctaaacgcanaattactcgtgctgatgaagaaaggaaaatggcagaacgtaagaaagctgaaaaagaacgtcgcgttcgtgaaattgaagagaagaacanagagat

SEQ ID NO: 3312 - DNA, 278 bp, Diabrotica virgifera
  unsure (1)..(278): unsure at all n locations
  Clone ID: LIB150-041-Q1-E1-B2
cttacaacactctaaagtgagtcatatacggtaccatggacgcagtacgttctggaatgtacggcaaactattcagacctgataacttcgtgttcggccaatccggagctggaaacaattgggccaaaggtcactacacagaaggggctgagctagtaaatgctgttctagatgtcgtacgaaaagaagcagaaaactgtgactgtctccagngatttcaactaacacactcgctaagtggtggtaccgggtcctgggatgggtacgttgttgatttc

SEQ ID NO: 3313 - DNA, 394 bp, Diabrotica virgifera
  Clone ID: LIB3026-001-Q1-E1-C6
agaaaaccagagttaagttaccttctggagccaagaaagttattccatcaaacaacagggccatggttggtatcgttgctggaggtggtcgtattgacaaaccaatcttgaaagcaggtcgtgcttaccacaaatacaaagttaaacgtaactgctggcctaaggtacgtggtgttgctatgaaccctgttgaacatcctcacggaggtggtaaccatcaacacattggtaaagcatccacagttaagagaggaacatctgctggtcgtaaagtcggtcttatcgctgccaggagaactggtaggattaggggaggcaaagttgatgccaagaaagaggattaggttatatgagttaaaagtttttgtacaatttgtatcagtgtaattcctgt

SEQ ID NO: 3314 - DNA, 439 bp, Diabrotica virgifera
  Clone ID: LIB149-009-Q1-E1-G3
ggttacgtggacgaagttttctaattttaatttaaagtaaacatgtatcttttcggcttccttatttcactggtttgtttgggcataaatcaaagtttggcctattttatcacagtagatgcacatgcagaagaatgtttctttgacaaagtggaagctggcacaaaaatgggtctcacttttgaaatagcagaaggaggattccttgacatagatgtgcgtattatagatccaaacggccagaacttataccagggtgaaagggaaactgccggaaaatacacatttgcagcccacacatctggtatatatacatattgtttctcaaacaagatgtcaactatgacacctaaagttgttatgtttaatatggctgttggggaatctccaaaggcagaacaacaagaaggtgaaaatgctaataagttggaggaaatga

SEQ ID NO: 3315 - DNA, 350 bp, Diabrotica virgifera
  Clone ID: LIB149-006-Q1-E1-G3
acgcctctagttgaaatcgatcatatagactggttgattcaatcttagaagagaataccgtggacaaaatgagcaatatctgcgccggagatctcgacaaaggagcaaataactgtgacggtgatgttggtggttctctcacccaacacggtgttcataatggaatcgttacctggtatatcgaaccttgtgataatgaatgaactccagatattttcaccaacgttgctaacttcgttgactggatcaatcagactaatgacagacatcagtacactgtaatttttgacatttttactatattggtacttttttaaaacacagcgcagtgtactttcacgttatttatc

SEQ ID NO: 3316 - DNA, 415 bp, Diabrotica virgifera
  unsure (1)..(415): unsure at all n locations
  Clone ID: LIB3026-019-Q1-E1-H7
aggtcggtagttatcgtttcagtttcatagtccagaagataaatttgcaaaatggctggtggcaaagctggtaaagatagtggaaaagccaaagctaaggcggtttctcgttcagcgcgtgctggattacagtttcctgtaggaagaattcacagacatctaaaaaataggactacaagtcatggacgtgttggagctacagctgctgtatactctgcagccattttggaatacctcacagctgaagttcttgaattagcaggaaacgccagtaaggatttgaaagtgaaaagaataactccccgtcacttgcagttagcaatcagaggagacgaagaattggacagcttgatcaagggctacattgctggtggtggtgtcattccccacatccacanatcacttattggaaaga

SEQ ID NO: 3317 - DNA, 406 bp, Diabrotica virgifera
  Clone ID: LIB150-002-Q1-E1-G1
gacagtttggtttaggattccgataggttgttggtgtaaatttttttgtataagttagttttaatgtaataattataaaaacgtgaataagaaagtctcgcgattatcccctacagcagtacttgtcctgtagatcataatgatggcggaagcagatgcaacggtcgaagcgaccagaagattaaatgtaaagaaacaaacgttggatgatgcttatgcggcaccagctaattttttagagatcgatgtcgttaatcctgttactacaattggggtgggaaagaaaagatttacagattatgaagttaaaatgagaacaaatctacctgtttttaaagtaaaagaatccagtgtacggcgacgatacagtgattttgaatggttaacgaatgaatttggaagagat

SEQ ID NO: 3318 - DNA, 508 bp, Diabrotica virgifera
  unsure (1)..(508): unsure at all n locations
  Clone ID: pGUT3749
gtggtacgcaaggcaagaggatttttgccttatgtaggcatggttactatattaatgaatgaataccccaagtttaagtatgcggtattggcctgtttaggactgtatgtgttggtacacagggagtgagattacatttttaacatcttaatttaatttttgttacttaaaattaataaataaataagaaaataaaaaaaaaaaaaaaaaaaaaaaaaatttttggggggggggccgggccccaatttccccttttaggggggtgattaaaatttccggggcgggggttaaaaaaaannnnntttaaaaaaaaatggtttttattttatggaaaccccacttttttaaacccttttagcccccctaaaattggggggcccctttttcacaatatatttttttttggaaaaaatttttttttttttggggggccccccaggggagtgtttttttttcttttggggggggacccaaaaaaaaaaaaaaaaaaaaaaacaatgtggggggg

SEQ ID NO: 3319 - DNA, 364 bp, Diabrotica virgifera
  Clone ID: LIB150-028-Q1-E1-E4
cacaaaacacaggtcagtttttggcgaagtcgacaaagcttttaaaaaatttgtgtgtaacgacgtgtttacaaacgagtaaaaacgacgatatcggcgattaccaccggactcgggtctataatggcagccagcgattctgcaggcgatgattctttgtatcccattgctgttttaatcgacgaactcaaaaatgaggatgtgcagcttcggctaaactcaataaaaaaactttcaacaatagctttggctcttggagtagaacgcacaagaacagaactaataccttttttgacagaaactatatacgacgaagatgaggttcttttggcacttgcagaacaattgggaactttcataaatt

SEQ ID NO: 3320 - DNA, 332 bp, Diabrotica virgifera
  Clone ID: LIB150-041-Q1-E1-E7
caagcgtctaaagtgagtcgtaatataacagttgtgtcatataatgctggggttgatacatttggatcacgactcttgtcaaatcagaacaaagtctataggatgatatcctcatatgtgggagataatgctgaattcgatagacagtttttaagaggtgaactggaagtacaattgactccacagggtactttaccagaaaggataattggacgtggtacaggtactccaacaatttttactccagaagcagatggaactcatgtacatgaatgtggggccctcattaaatatggtaacgaaggcacaactgaaatacctatcacaacacg

SEQ ID NO: 3321 - DNA, 432 bp, Diabrotica virgifera
  unsure (1)..(432): unsure at all n locations
  Clone ID: LIB149-027-Q1-E1-E9
cccacgcctccgatcaatccgtatttactacaatcaaataatcgttaagacaagattgattagtaattagtctctcagatttagttctcgttctcaaggtagtcagtggaaacaagtggttttctcatttcactaagaaaatgtcttacgccggacgtgtaatcgtttatggaggtagaggagccctcggcgctaaatgtatatcacattttaaagcaaataatttctgggtaggatctatagatttagccgaaaatgcagaggcagatgtaaacattttagtgaaaagggaagacagtcttcaagatcaggaaacatcaatcctatcttccgttaattcctcattaaatggttccaaactggatggaatattttgtgttgctggtggatgggctggaggaaatgcttctaaagatctagtanaaaattctg

SEQ ID NO: 3322 - DNA, 274 bp, Diabrotica virgifera
  Clone ID: LIB149-029-Q1-E1-D12
catattaaaaaattgtggcatcaattgacactaaaattgctgaattttattaagaaaccagaactacagaaaaatgataacctcattcaactgtacaataactttattcaaagttttgaaaataaaatcaatcctttgtcattggttgaaattgatgctatagtattcgaacaattcaaaaatccagaagatgctgtcgcatttcttgaaaagactgaacctaaggttaacattaattcagatgcccaaaacttgtccaaagttttagctgggc

SEQ ID NO: 3323 - DNA, 473 bp, Diabrotica virgifera
  Clone ID: LIB150-030-Q1-E1-G8
acgcgaccgccaacgcgtccggtttagtgaagtaaaggacattggatattttttcgtaataataataattattaattaaaatacgtaaaattaagcctaaacttatttagtaaaatgcacggaagattaaaagttcgtacctctgaagagcaaaaagctattaaacataaagaacaacagaagaaactagctgcatatcattggggaatgaaaagaattttatctactagaaacaaagacagttatgagcctgaaagttttcagattagttcacaaattttaatagcgaatccagatgtgtatactttatggaattataggaaggaaataattttaatggaaattgagaaaagtaaaaaagatgaaatagatcaggaagataacctaatgccattcttagaagatgaaattaaatttacagaacagtgtcttcctgctaatccaaaatcgtatggagtttggcatcatcgcta

SEQ ID NO: 3324 - DNA, 404 bp, Diabrotica virgifera
  Clone ID: LIB3026-001-Q1-E1-C7
gatcgacatgatgaaggatgttagttgggacggcgatgctgctgagggaagtcgtcaatggacatatcaaacctgtacagaatttggttattatcaaacttcctcctacaaacctcatatatttggcacccgatttccacttagtttctccattcagcaatgccaagatattttcggatcttcatacaatgaaacgtttctaaatcatgctatagaaaggacgaacgttctttacggtggtttagacattgaagtttctaacgttgtattcgttcagggatcattggatccatggcatgttttgggagttacaacaaccttaaatgataaagctcctgctattcttattaaaggtgccgcccactgcgcaaatatgtataacccttctgatgatgatactcctc

SEQ ID NO: 3325 - DNA, 436 bp, Diabrotica virgifera
  Clone ID: LIB149-049-Q1-E1-E3
aaaattggttcataaaaccgccgaatgttaaagggctgccaacaaagtaatggcccgtgctgttaaactgcaagggaccgattccaataaacaaaacggtgatattgaaaagatggtggttcatccagactataactcacaagtagttgggccaaacgatatcgctttagttaaactaaagcaaccattgaaatttaacgatgccattaaagccgctaatttgcccgagcaaggagctgcagttactggattagctgatgttgttggatacggcaacagcttcttgcctgatttcaacactttgagctacatatcagacttgccccttataagctacgacgattgcaatcaagctcttgaagatttaatacaagaaaagagtcctttggacgaaaagagcaacatttgcgcaagtgtattggcaaatggagctaat

SEQ ID NO: 3326 - DNA, 387 bp, Diabrotica virgifera
  Clone ID: LIB150-048-Q1-E1-E5
ctgatagattgttccacagctcacctactgaatccaagaaaatccccaccatgtacactgaagcattcgccaaatacacttacaatgacaaacttaaagctaaatttttggagctcggatttcaaggcgcaaatgttactatgacctttgtattaccggacgaaatcaatggattagcagctgctgaacagaacttgaaagaatacttggctccacaaccattggaatctgctagagttgccatcaccctacccaaattcaaaatcaacacaaaaattgactttaaaccgatcttgaagaagttgggaattacacaaatgttcgaagacagtgctgaccttaccggaattgccaaggctccacttaaagttgactttggtttacaaa

SEQ ID NO: 3327 - DNA, 365 bp, Diabrotica virgifera
  Clone ID: LIB3026-008-Q1-E1-B6
cccacgcgtccggggctaaagctgcagctgaactttaaggcgaggtaaaacttggagcattggatgcaactgttcatcaagcaagagcatcactatatggagtacaaggatatccaacaatcaaattctttgggccacgtgcaaaaagatcccctaacaaatatgatggtgggcgtacatcaagtgacattgttacttgggctttaaataagttataagagaacattccagcaccagaagtaactccacttttagatgacaagtcatttaagaaattgtgtgaagacaaacctctgtgtgtaatagccgttcttcctcacattttagattgtcagtctgaatgtagaaacaattatattaagatg

SEQ ID NO: 3328 - DNA, 412 bp, Diabrotica virgifera
  Clone ID: LIB150-035-Q1-E1-G1
cccacgcgtccgagttagtgttccatctagattagctcaatgcctgaacggacctgaacctcacaacgtcggagaccaatttagcgtaaaagtaccaaagaatgcagctgatattgttgttctggtcgacactatcaaatctaatgagccagtttacaatgaactagtaaaaccccttattcaagagcttaccaagggattagctgccaaaggattaacagatgttgaaacccaccttattacctacggaggtgagaaccaatggcccagccatgtcaccgttggtggaaagcttgttttcaaaggaaaagctcccgaaattaaattctccgaaaatccccaggaaccaccagttgttggagaactatccaaatctgtagagggcctccgtagtattcttagagacatcaag

SEQ ID NO: 3329 - DNA, 463 bp, Diabrotica virgifera
  Clone ID: LIB150-014-Q1-E1-D4
tagccgtccgagattctagggtccaccgacgcgtcggcacacgcatccgaataaactaaattaaaataattaaaccatggctacccttgaaaatgtttcaatttggaaaaatggaaaggaagcattaggtgaaaaaggttttacgaatgtccactgatgaaatagttagccggacacgtttactagacaatgaaattaaaataatgaagagtgaagttatgagaatcaatcatgaattacaagcccaaaatgagaaaataaaggagaatactgagaaaattaaagtgaacaaaaccttaccgtacttggtgtccaatgtaatagaactgttagatgtggatccccaagaggaagaggaagatggtgcagttgttgatctggactcacaaagaaaaggaaaatgtgctgttgttaaaacttccactagacaaacctactttttaccagtgataggtctggtgga

SEQ ID NO: 3330 - DNA, 446 bp, Diabrotica virgifera
  Clone ID: LIB150-017-Q1-E1-B7
cacacgcgtccgcacaacaactaataccgatagcagtggaaatatgccaacacttagctacgactttcaaccaggttctagacactgacgaaggatctgacgaaaaagccataactgcaatgggcttactgaacaccatagaaactcttctaactgtgatggacgaacaacccgaagttatgagattgttagaaccaactgtactacaagttatagctaatgtcttacaaaacgaagttcaagagttttatgaagaggtgctggcactaatttacgacctaactagtaaacaaatttctccagatatgtggaaagtctttgaattattatatcgggtatttatgaagaacggtatagatcatttcacagacatgatgcctgctctacacaactacataactatcgataccaacgcgttcctttcggacgagcaaagactgctagcc

SEQ ID NO: 3331 - DNA, 270 bp, Diabrotica virgifera
  Clone ID: LIB3026-028-Q1-E1-H11
agcgaaggagactgcaccacagcccgacctggactgttggaccttaaaggaaaagccaaatgggactcgtggaacggcaggaaaggatccagtcaagacaaagctaaggaagaatacatcgcaaaagtacagtcgttgatcgatagcttaggactcgcataaggcatttttatcatcacttttttttaagggaaaactattttgttatcattatactctatggttctaataaaaacaattttcttgtaattaaaaataaaaacataaaaa

SEQ ID NO: 3332 - DNA, 434 bp, Diabrotica virgifera
  Clone ID: LIB3026-032-Q1-E1-H8
ccttcgtagcatctctagagttgggaatcttcggtatctacgaaaacgaatgtgaaggtgttatccttaatgaaaattgggttctaacatcaggtgaatgcgccaaagaagtatccagggttgtagctggtgttacagacttgcatggcaatgaaacaagcagacaggtggctgaagtcgaacatgcttatgtacatcccgaatacgacagtaatgggcctagtccaaacgacatcgctcttgtcaaactgaagacacctttggtatttaaccagttcgtcggtaatgtcagcttgcctgaacaagaacccgttattaatgggaacggcaaccctaacggcttggggatggaccttcttaccagacttcaataaactaagcttcgtacctgacttacccctaattgatattgaagaatgtaaccgattggttga

SEQ ID NO: 3333 - DNA, 231 bp, Diabrotica virgifera
  Clone ID: pGUT056
acctggtgttgcagctgcagcagttaaagttccaggttgagcaactgcactgcaaagtttaacttctccaagtacagctatgaattgtggctggttaataagtgtattgaaccatctattgacgttaccaaaagatttgctaaagttgggatcaagtacatatttgtaggcattcaataggttgcaggcaactacaatgtcagctaaagtgattctctctcctaccaagta

SEQ ID NO: 3334 - DNA, 406 bp, Diabrotica virgifera
  Clone ID: pGUT2348
caggtgccaaattcagcacgagctcatgccgaattcttcactagatttgaggcggattagcagaagataatgcaactttaactcgattctatacatatcattctattataccttctattatacatggcttttataattattcatcttctattagtacatcagacaggatcacgaaatctctctgggaacataaggaagtattgataagattccatatcatacttatattactatcaacgatatccttggatgcttaatattattattatgataaacaacattaactctataagacccatatttattcggagactctgataatttcacccctgcagatcctatacgtacaccagttcatatgcatccagaactgatatattttgttggcatatgcgcatttacgctc

SEQ ID NO: 3335 - DNA, 401 bp, Diabrotica virgifera
  unsure (1)..(401): unsure at all n locations
  Clone ID: pGUT2296
cagcaatgcgtgaataaccatgaaatacctaaagaatggaaagagtcacatctgagcactatccacaaaaagggagataaatcaaaacctgaaaactatagaggaattgcagtcactagtagtatcagcagaatatatggaaaacttattaaaaatcgaatagaagaagaataccaaaatatggaagccgaagaacaggctggttttcgcgcaggtcgatctacaatagatcatgttttctccattactcagataattgaaaagaaagttgctcgtggccaagaagtccatctgatgtttgtagaccttagaaaagcgtatgatagtgtcccgctggttaaattatgggaggcactggagaaaaaaaaaaanaanaaaaaaaaaaaaaaatctgggggggg

SEQ ID NO: 3336 - DNA, 343 bp, Diabrotica virgifera
  Clone ID: LIB3026-009-Q1-E1-B2
cacacactgaagaaaagccatatcaatgtcaaatttgttttaggtcgttttcccttaatggatatttaaaagcacatctcagaaatcacactggagaacaaccacatcaatgtgaaatatgttcaaagtcgttttccaatgtgagtgttttaaacacacataaaagaatacacactggagaaaaaccgtttcagtgtgaaatatgctttaaatcgttctctcaatcaagtgctaagaataagcatatgatgtcacacactggaaagaaaccttatcaatgtgaaatatgtttgaagtcgttttcacgaacacatgatctaaaagacttaaaaactggacacgg

SEQ ID NO: 3337 - DNA, 368 bp, Diabrotica virgifera
  Clone ID: LIB3026-014-Q1-E1-H1
accacgcgtccgcaccttcgtatgtcccactgagatcatcgctttttcagatcgcttcgaagaattcaaaaaaatcaatacagctgtagttgcatgctcaaccgacagccagttctcgcacttggcttggatcaacactccaaggaaacaaggcggtttgggcgagatggccattcctttgctctccgacaaatccggagccgtcgccaaggcctatggagtattggacgaagaaactggaattccattcagaggacttttcatcatcgacggaaaaggtaacctaagacagataccatcaacgacctcccagtcggacgttccatcgacgagaccctccgtttagtacaagccttccagttcacaga

SEQ ID NO: 3338 - DNA, 408 bp, Diabrotica virgifera
  Clone ID: LIB149-006-Q1-E1-C12
agttttaaggcaacccataacaaatcttacaacgttattgaagacaaacttcggttcgccgttttccaagacaacctcaaaaaaatccaaggacaacatggcaaataacaaagttgggaaaaaacccaacaacttggcggtaacaaaatcccccaatggtccaacgccgaaattcaagctaagttgggccctcaaaatggcaacaaggccaaaccaatccttaatgcaaaaacacgtaccgaatcccaatgtccaagctgtagaagaagttgattggagagatagtgccgttttgggagtcaaagatcaaggacagtgtggatcatgctgggctttcagtaccaccggatccctcgaaggtcaactcgccatccacaaaaatcaacgtgttcctctcagtgaacaaga

SEQ ID NO: 3339 - DNA, 350 bp, Diabrotica virgifera
  Clone ID: LIB149-013-Q1-E1-H12
tacggtccttactcccgggagcccccacgcgtccggaatggggccaagctcaccccagaccacggcttccccgtccggttaatcgtgccgggtgttattggcgggcggatgatcaagtatctctccaagattatggtgacagaggtcaggtccgacagctggtaccactatcacgacaaccgagttctgccgtcgatcgtcaacaatgcatacatggacaagcgggaacaatggtggacacgaccggaatacactatcaacgagctcaacatcaacagcgccatgggctcaccagcgcatggatcagatgtaaccatctctgagtcgcaagcgctgggaacagaaatcat

SEQ ID NO: 3340 - DNA, 374 bp, Diabrotica virgifera
  unsure (1)..(374): unsure at all n locations
  Clone ID: LIB150-016-Q1-E1-A12
gtacgcatacgcatacgcggacgcgtgggcttggaagatagtatatataattggcaaaaagatgttttaaaggacaggaatacgtatggtcatttcgcttatttacaaggccaggaatatacaatgtacaattcgtatgatgtccacttctacgcatcgcacgccttacataaaaactggcctatgcttcagaaatgtttgcagtacgatttaagagatttcatctccgtggaaattaatgaacccgttaaagtcctatataatggaaagctaatggaaaggtagtatcccagtactgttcctcatgatgcacgaagtcncggtgaagaaccattaacccttatcaatgcttacccaatccatgacgttagtca

SEQ ID NO: 3341 - DNA, 415 bp, Diabrotica virgifera
  unsure (1)..(415): unsure at all n locations
  Clone ID: LIB149-026-Q1-E1-G6
aagtttttcattggcatattgtagacgatcagagttttccttacgtcagcaggaaatttcctgagttaagtttaaagggtgcctacacgtcgtactatacatattcgtagaaagatattcaaaatataacggaatatgcaagagtaagaggtataagagtaattccagaatttgatacaccaggacacacgagatcttggggtgtagctcatccagaaatactaaccgcttgcgaaggagacctaaaatgaaaatacggacctattgatccaactcaaaataaaacctacacctttttggacgatttttttgaagaaattagtaacacatttgctgatgcatacatccatcttggcggtgatgaagttgagtttgaatgttggagtagcagtaccattattaanaactttatgaa

SEQ ID NO: 3342 - DNA, 283 bp, Diabrotica virgifera
  Clone ID: LIB3026-014-Q1-E1-D6
aggaaagagtgttcagatgttatcaacactattgtcgatcaatctgcttgtgcggctggttgggccctagctgcagcttctgcaatgagtgatagacgatgcatagcctcccaaggaaagcttaaagtgcctgtttctgctgaaaatgtagtggcttgtagccgtaatactcttggatgcaaaataggatatatggaagatggatggtggtattggctaaaaaatggaattcctacaggaggtctttatggcagcagacagggttgtcaaccagattcgcttc

SEQ ID NO: 3343 - DNA, 413 bp, Diabrotica virgifera
  Clone ID: LIB150-015-Q1-E1-C5
gtacagtcgagatccgggtccaccacgcgtccggagttggcgaacttttgaaattatttgatccttcatcccacagaatcgtcgtaaggcagttaaatgttccgaaatccggaggaaacttcaggtcggtgcttaaagaaatatggcgatcaggagcaacacattttgtgttggattgcagtatcgaaatattggaggaagttttgaaacaagctcaacaagtgggcttaatgaccaacaagcacaactttatcattactaacctcgacctgcatacaattgaattaatgccgtatcagtacagtgaaacaaacatcactgggatgcgatttgtagacccggatgacgaaggtcttgccgaaaaagcgaaaaagatctataaacaaaatctccaagtatttactgggtacaaa

SEQ ID NO: 3344 - DNA, 412 bp, Diabrotica virgifera
  unsure (1)..(412): unsure at all n locations
  Clone ID: LIB150-032-Q1-E1-A7
acanatgtctgaagaaagtgaaaaaaactcgttggaaaaagttagtgaagtcgatggaagtacggacggaataatattaaataaaagtgcaaagaaacgtaacaaaaataaaaagaaaaagaatgaaaaccaagaagaaaacagtgaccaaagcaacgaggttgtccaagccgaaaacaacttattatctaacttatcgaaccctattaatacaatatcaattaaggagctaaaagcagccatggaggtatttactctatcacaaaaacctgccaagagttcagaggaagctctaaagaagacattccagttttggaatacccagcctgttcccaaaatggacgaaaaaataactgttaacgaagccattgaaccagacaaagaacctgctgacattagacaagaaccgtac

SEQ ID NO: 3345 - DNA, 230 bp, Diabrotica virgifera
  unsure (1)..(230): unsure at all n locations
  Clone ID: LIB150-024-Q1-E1-G4
tgcccaacgagctttattagtcttgaaagcgaanaacattccacatgatgttgtaaatcttaatttgggcagaagaccagagtggtacagcaaaattaatccaaaaacattagtaccagctattcttgatggtgataaaattgtggtagaaagcctggatattgctgactatctagatgaaaagtaccctgaaaacccactctatcctgcagatcctgcagccaagcagc

SEQ ID NO: 3346 - DNA, 450 bp, Diabrotica virgifera
  Clone ID: LIB149-025-Q1-E1-A11
cgcgcgtcgacccactcggccatgagtcgtattaacgcgtgggcggacgcgtggggtgacgtgtaaagaaagtaaagcaaattattttaaagtttttaaattaaaatgggtacttttaaaagagatactcatgatgaggacgggggatcaagtgcttttcagaatctggagaaaactactgttttgcaggaagctagagtttttaatgaaactagtgtaaatccaagaaaatgtacaccgatactaacaaaactgttgtacttattgaaccatggtgaaactttaagtgccaaagaggccacagatgttttctttgccatgaccaaactgttccaatcaaaagatgtaatattgagaaggatggtttatttgggaattaaagaactcagttctgttgctgatgatgtcattattgtaacatccagtcttacaaaagatatgactggtaaa

SEQ ID NO: 3347 - DNA, 427 bp, Diabrotica virgifera
  Clone ID: LIB150-024-Q1-E1-B8
aatatacacaagttagcgcttgcctccacacaaaggataagtaaaatgtcactaccgaatataactccaaacaatggagcccactgtccaagctttggccacggtacatggttggcggctcctggagaacttaaagaaactgttaaaaccgcaattgagcttggttatcgactgtacgattgctcatggctttactggaactaaaaagaaataagcgaaggtttagtagcataaattcaagataaaactgtcaaaagacaataactgtttgtcgttacaaaattatggaatatttttcacgaataagaaaaagtagttccatcatgcaaagaatctttaaaaaattttgggcttgattaagttgatttgtatttgagtcactggccttgtgctactaagaacatagatttcaacattcaactcccaa

SEQ ID NO: 3348 - DNA, 399 bp, Diabrotica virgifera
  Clone ID: LIB150-037-Q1-E1-B10
agtgatcggtgtgttcaacaccttttaggtatgcctagaaaaattatacttgcataaatctgagagcaaaaccagttcaaaatgctgcacgtattccatgtggactcagggcgtatgatgacgtttgacatgagcttagctctagaaagcgtcgacaacctgaaacgatacgtccaagaggaattcaaaatcccagctgagaaacaagtgttgttgattagcggaggagaatgtttggacccgaagaagagggtgtgctcctattcggcaggaaccgacacaaatcctatttttctttttagtaaatcaattatcgaatctccgattcctcctccgcctactggagattatggaagtgaaagtgatgtcgatctcaaagttcaagaacactgtgatatg

SEQ ID NO: 3349 - DNA, 363 bp, Diabrotica virgifera
  unsure (1)..(363): unsure at all n locations
  Clone ID: pGUT1290
ttgaaaatttcagtccgcgcagcaaattttacaagaagttgcaacccataaattggttataaagttagtgcagtttgcagtaatttttattttccagagtatttcttgaatatcgtatgtccatccagaatctaaacacattcgacccatttgctgatgcaagtaagggtgcagatgatgatgttcaagacggccttgttcacataagaatacaacaacgtaatggtcgcaaaactctgactactgtccaaggactctctanaaaatatgatctgaaaatnattgttcgggcatgtaaaaaagaatttgcatgttatggaacagtaatcgaacaccctgaatacggcgatgtcctacagttgc

SEQ ID NO: 3350 - DNA, 443 bp, Diabrotica virgifera
  Clone ID: LIB150-014-Q1-E1-G11
cggacgcgtgggcggtcttgtgtctttgctcttcaaaatgggatcgaaaaaagtggtgataagtgcgatgtgtttaattttagttttaggtatatcatcctgtttagcagatactgacgatattgaggattgtggatccgtgactggccaaatagtcaaagtagagctggcaggttgtgaaggcgaagatcgatgcccattaaaacgaggcacaaacgcatcaatggtggcaacgtttaaatcgaataccaactctaaaaccttaaagaccctcgtcattggtaagcttggtctacttaaacaaaaatttaatttgccaaatccaaatgcttgtgaaatgggagtgacgtgtccaataagctccggagatacctacacctataccgtcagcatgcctgtaaaaaaaaattatccaagggtaacagtagatattgagctacatc

SEQ ID NO: 3351 - DNA, 366 bp, Diabrotica virgifera
  Clone ID: LIB150-008-Q1-E1-C11
tccgggtccgaccacacgtccgaaacgacatcggaggttgtagaaaacagctcgctcaaatcaaagaaatggtggagttaccactgagacatcctagtcttttcaaggctattggagttaaaccaccaagaggtatcttactttacggtccaccgggtactggtaagacactcattgcacgtgccgtagctaacgaaactggagcgttcttcttcttgattaacggtcctgagattatgagcaaattggccggtgaatccgaaagcaatcttcgtaaagctttcgaggaagccgacaagaattccccagccattattttcactgatgaattgggtgccatcgctcccaagagagagaaaacacacg

SEQ ID NO: 3352 - DNA, 422 bp, Diabrotica virgifera
  unsure (1)..(422): unsure at all n locations
  Clone ID: LIB149-049-Q1-E1-D3
aatgggaaccttgaattttaaaaagggggaaccggaaaacaaagaacgttgggaagggataaaaacggatttaaacagttacccaatagaccaaaatatatgcgcaatgtaagcaacagaaacttatcaacanatatcttgggtaaacctgtggcagttccataggaatatctccctctgcttatcagaaaatagcacacccggatggagaatgtgctactgcaaaagctgcccaagaatcagacaccatcttgatattaagttcacactctaattgtacctttgaagaggtcgcgaaagcggcaccacatggaagaaaatggctacaattgtatatttttcaaaacagggaaattacgaaagattttgtaaaaagagcagaaaaaaatggctttgaagcattagtagttaccgtggatttt

SEQ ID NO: 3353 - DNA, 435 bp, Diabrotica virgifera
  Clone ID: LIB149-039-Q1-E1-H8
tgaacacgcgtctgccaacgcgtccggactattttaactcagaagttaattataaatattgcggaggcatgggctgcgcaccagactcgattagtactcagatatttatggcaaaacttcagccagacttaactcgaatagcaactcaggccaactcttggttagacgatttcaaggactggagcgaaaccgagagctgttgcaagtactttaaggacaccaactacttctgccctcattcatacagctctgaagattgcgatccttgttacttcactttaataaataaaactactggcttaagccagtacaattattaccgaaagtatctgcctcactttttgaatgacaatccgaatccaagttgcgccaaagccggacatccagcatatgctaacggcattacttatttgtccgatgaaaatggatatacag

SEQ ID NO: 3354 - DNA, 418 bp, Diabrotica virgifera
  Clone ID: LIB150-003-Q1-E2-D6
attaatttactaatatttgcctgctattacgtatacttattgtggggtaaacttagaaggaaagttccaaatacatggttttgggatacaatatggctcgtactttttattggatatattatgataatgttttatgccacaacgattttagttatacatttagaactgcagtttgccacaagattgctaattttatccgaatcgactagattactaatgaaattatactcatttgttagaagtaatgtgcccagagtaaccaacacccgttcatcgaatgattatgtacacattcccacatttggaaagtatttatattttttatacgcatctacccttatctacagagatgaatatcctacgactggccacattcgttggagttttgtaatccacaggctactggaagtgtttggaa

SEQ ID NO: 3355 - DNA, 195 bp, Diabrotica virgifera
  Clone ID: pGUT1880
catatccaaggatattgaaaaggcctgccagggtatctaccccctacatgatgtgtacatccgtaaagtgaaagtattgaaaaagcctcgttttgaactctccaaattgttggaattgcatggtgatggaggcaaaagtggtgctggtgactccactggtgaagctggttctaaagtcgacaggcctgatggata

SEQ ID NO: 3356 - DNA, 209 bp, Diabrotica virgifera
  unsure (1)..(209): unsure at all n locations
  Clone ID: pGUT1646
ggaatgtgtggctcttgttggacctttagtacaactgggtcagtagaaggagctcattttcttaaaactggaaatctggtatccttaagtgaacaaaatctagtagattgcgcaaaagacacttgctatgggtgtggaggtggctggatggacaaanctctggaatatatcganaaaggaagaataatgtctgagaaagattatcctta

SEQ ID NO: 3357 - DNA, 384 bp, Diabrotica virgifera
  Clone ID: LIB150-034-Q1-E1-D10
cacgtagtaagcgtaaagaaaatgggcaaccacattacgaattccccattcaaaattaatgtttgtgaaagagaggtaggagacgccagaaaagttaaagtaactggtagtgccctaaaagatggcaaaactcatcaagataacacgtttaccgtcgacaccaggaacgctggtttcggtgggttatcactatcaattgaaggacctagtagagctgagatacaatgtaatgataacacagatggcacattagacatttcatacaaaccgactgaacctggatattatattgtaaatcttaaattcgccgatcatcatttggatggatcaccattcactggttaaggtcactggtgaaggttcaaacagacaacgtgagacgat

SEQ ID NO: 3358 - DNA, 435 bp, Diabrotica virgifera
  Clone ID: LIB149-009-Q1-E1-C7
atcactttggaagtagaaccatctgataccattgaaaatgtgaaagccaagatccaagataaggaaggtatcccaccagatcagcaaagattgatctttgcaggtaaacaattggaagatggaagaaccttatctgattataacatccagaaagagtccactcttcatttggtacttagattgagaggaggtatgcagatcttcgtcaagacactaactggaaagacaatcactttggaagtagaaccatctgataccattgagaatgtgaaagccaagatccaagataaggaaggtatcccaccagatcagcaaagattgatctttgcaggaaaacagctagaagatggtagaactttgtctgattataacatccagaaagagtccactcttcacttggtactaagattgagaggaggtatgcagatttttgtc

SEQ ID NO: 3359 - DNA, 243 bp, Diabrotica virgifera
  Clone ID: LIB150-029-Q1-E1-D9
cccaaacgtccgaccacgcgtccgaattccatcatgaagtgtgatgttgatatccgtaaggacctatatgccaacactgtactctctggaggtaacaccatgttccctggtaatgctgataaaatgcagaaagaaatcactgcctttggctcctaacacaattggagaattaaaatcatcgccccaacagaaagaaaatactctgtatggattggtgggtccattttgggccccccatccaac

SEQ ID NO: 3360 - DNA, 333 bp, Diabrotica virgifera
  Clone ID: LIB150-026-Q1-E1-G9
gtcgttacaacaccctaaagtgagtcgtattacaagtatttagtaaagccaagaagcaagtaatgaaacagactcagggattatatccagcacctttaaaggcactggaagttttacgaatcagtttagacaaaggtgaaaccgtcggattcaaagaagaagctcgggcttttggagaactagcaattacaccccaatgtaaaggactgataagtttgttcaagggacagacgcaatgcaaaaagaaccgtttcggtaaaccaaataaagaggttaagactgtccgagttttaggggctggtttgatgggggccggtattgcgcaagtcacga

SEQ ID NO: 3361 - DNA, 396 bp, Diabrotica virgifera
  Clone ID: LIB149-037-Q1-E1-F6
ctcgcgggtcgacacacgcatccaaacacacgttctgccacgcgtccgatcgctgttgatgctgatacatggcaattatacggaggtggacttttcaacagcaaaaactgtataaccaacctcaatcacggtgttcatgctgtgggacacacgaaacatgcattcattgtcaagaactcatggggaactagctggggtgaacaaggttacatcagagttgcccgtggtgaagacttgtgtggtattaacctcatgaactcgtaccctaaagtgtaactgatttaatgcaaacgaaataccaaatagaattcataaatatagataaatacaatactattaaaaattaaatatttttatattattaataattaaatatttttagggatgagcttaaaa

SEQ ID NO: 3362 - DNA, 293 bp, Diabrotica virgifera
  unsure (1)..(293): unsure at all n locations
  Clone ID: pGUT1754
atgagcaatcatgggggtactcacgttttgagagtgatgccttgcntaaagtactangtacgttatactcagtgactaaggcaccgatgctgaccagagaggttcccttgtagaccagataagttacgttttgactttaccaataaaggtgcaatgacgactgatcaagttaaaaagacggaggaaaactcaaaagaactcatctccagaaataacaaagtcttcgctaaggattcaagtttaggcgtagcanaaactatcagaggacttcgtgctgtctttgaagagactta

SEQ ID NO: 3363 - DNA, 387 bp, Diabrotica virgifera
  Clone ID: LIB150-027-Q1-E1-D9
cccacgcgtccgcccacgcgtccgcccacgcgtccgcccacgcgtccgcccacgcgtccgtggacctctttgtcatcaactagtttttttttaaatctccttaaccatgtctgacgaagaagaagtttactccgaagaagaggaggaggaagaagtcgttgaaacgactaccaccactaccaccaaagtcgaggaaggagcgggagatccagaattcatcaaacgtcaagatcagaagagatcagatctcgatgaacagcttcgcgagtacatcacagaatggcgcaaacaacgtgccaaggaagaagaagacttaaagaaactcaaggaaaaacaggctaaacgcaaaattactcgtgctgatgaagaaaggaaaatggcagaacg

SEQ ID NO: 3364 - DNA, 331 bp, Diabrotica virgifera
  Clone ID: LIB150-035-Q1-E1-D2
gctaaatactatgtaaccatcattgatgcccctggacacagagatttcattaagaacatgatcactggtacatcacaagctgactgtgctgtactcattgttgcagctggtactggtgaatttgaagcatgtatttcaaagaatggacaatcacgtgaacatgctcttcttgctttcacccttggtgtaaaacatcttattgttggtgtcatcaaaatggactcgactgaaccagcatacattgactcacgtttcgaggaaatcaagaatgaagtatcctcatacatcaagagaattggttactacccagttgccgttgctttcgtaccaa

SEQ ID NO: 3365 - DNA, 337 bp, Diabrotica virgifera
  Clone ID: LIB3026-012-Q1-E1-B12
tgaagcctgggcaagattggaccacaaattcgatcttatgtatgccaagagagctttcgtccactggtatgtaggagagggtatggaagaaggtgaattctctgaagctcgtgaagatttggctgctttggagaaagattatgaagaagttggtatggactccggagaaggtgagggtgaaggagctgaagaatattaaatttgattccaaacatgacaaatcacttgtttttaagacaaaaaattcctttcaatttttttacactttttcattacttttctgtgaaacgattatttaaagtctgatttaatttaatacagaattttttacgagcaa

SEQ ID NO: 3366 - DNA, 442 bp, Diabrotica virgifera
  Clone ID: LIB149-042-Q1-E1-C11
ctcgcgggccgacacaagcgtctacccacgcgtctgcccacgcgtccgaaacactattaaatttttttaatcaaatatggttatcagaagatattccagataactggagagagtaccgggtgattcctattctcaaaacaaatcggaatcctgattcagcagaatcttatagaggtatttcattgagctcctgcataacaaaaacactggaaagaatgataaaacttaggctcgaaagttggctagaaaaaaacaataaattatcacaaacacaatttggatttcgaaaaaatcattctactgtggaagctgtgagtcatttggtaacagatataaatttagcgtttacgaaaaattcttcagtaatcgctcttttattagatgttgaagcagcatacgacaacgttaatttaaatatactatataacagaatgatacaaat

SEQ ID NO: 3367 - DNA, 280 bp, Diabrotica virgifera
  Clone ID: pGUT1614
ctaggtagccagtttttgtttatatcatttatcctaaatgtataaaataattttatatatttggtccttacgtactaaaatatattaataaattaatcatataaaccatcctggctcactccgatttatactcagatcatgtcaaatctgaaaagtcgaactgacttattaatatctctgctactccaattataaattttaatcccacatcgatgtcacaatctatttcatcgatatgatctctatagtaaaatcaagctgtgatccctatggtaattta

SEQ ID NO: 3368 - DNA, 151 bp, Diabrotica virgifera
  Clone ID: LIB3026-027-Q1-E1-G6
cacacgcgtccgcggacgcgtgggcagacgcgtggggcgtaattttattggagagttcaaagcgagaaaagaaattgcgagctcgatgttggaataaagtttataattggtgtggcatctagagcattgagtctgttggacttttaaaatt

SEQ ID NO: 3369 - DNA, 379 bp, Diabrotica virgifera
  Clone ID: LIB149-043-Q1-E1-B12
aaccatccatatggctactccaatatgaagtatgtagcatcattgatttcaggtgttggaatcttttgtgtaggtacaggattgtcagtttaccatggcatatctggcctgcttcatccaactccattggaagacttcttttgggcctacttcatattatgtggttctctagtatcggagggtgccacttggttagttgcatttaattcaataagaaaaggtgccagagaagtcaatatgactgtaaaggaatacatttttagaggccaagatcctagtgtaaatgttgtcttgttagaagactttgccgctgtgattggagttatagtggctgctggttgtatgggggtgtcgtctgtaacaaatagtcctgtacctg

SEQ ID NO: 3370 - DNA, 340 bp, Diabrotica virgifera
  Clone ID: LIB3026-035-Q1-E1-F9
ccggccgacgcctgggacctatattgagtcgtattaaaataattattccaaatttaaaggatggctgttaggtttggatccgctttaaaggaattacggatacacctctgccaaactggggctgctagcaaaggagtcagagagtttatggaaaagcactatgtacaagtaaaatctagcaatccaaaatttcccatacttgtaagagaatgttctggagttgaaccgaggttgtgggcaagatatgatttaggaaaggaaaaatgtatttcattgaaagatttgtctcctgaaaatgttttgaacagagttcaagctgtacctaaaggtccataaacca

SEQ ID NO: 3371 - DNA, 553 bp, Diabrotica virgifera
  unsure (1)..(553): unsure at all n locations
  Clone ID: pGUT3398
cggacaatgccagttgtccttgcaagcaaagtgccgagatgtttccaaaattacatggagatgtgattgttttgggagcacgtgacactgcttttgactgcgccacttcagctttgagatgcggagccaagaaagtctttgtggtgtttaggagaggatttactaatattagagccgtaccagaggaggtgtcagtagcagttgaagagaaatgtgaattgataggatttttggctcctcattctgttaatgttaaaaatggaaaaattgtttccgttacattcaattgaactgaagatactgaagatggcaagtgggtacaagatactgaacagctaaataccatcaaatcaagcttcttaatatcagcgtttggatcaggagtagaagatcaggaagtcatcgatgctttagctcctctganactaggacctaaaaacctgccagtagttgatgttaatactatgcagacatctcatccttcggtgtggggtggtggagatctcgctggagtcgctgaaactacagtggaagctgtgaatgatggaaaaat

SEQ ID NO: 3372 - DNA, 430 bp, Diabrotica virgifera
  Clone ID: LIB150-019-Q1-E1-D1
gggaaatgaactcacaccgactcaagtacttgaacagccccaattatcgtacgaaggagataataaatctttttatacattaattcttactgatccagacgcacccagcagaagcaatccaaaatctagagaatggaatcattggctagtagtcaacatccctggatccaaaatatctcaaggcgaaaccataagcgactatgttggatcagcgccacccaaaggctcgggactccacagatacgtgtttctactatacaaacaacccgaaaaactgaaatttgatgagcccaaacacagccctaccgacggaaatcgcggaaaattcaacaccgaaaactttgcgaagaaatataaattgggtaaccccatcgctggaaacttcttccaagctcagtgggatgattctgtgccagctagtcacaaaaag

SEQ ID NO: 3373 - DNA, 370 bp, Diabrotica virgifera
  unsure (1)..(370): unsure at all n locations
  Clone ID: LIB150-042-Q1-E1-E2
ataatggagaagcagctgacaatgaaaacaaccttaacgaaaactacacaaaaacaacacaattaatcgaaacacccaagaaaagttaaaaaagaaaaaactaaaaaatccaagaaaggagaaaaaggaaacattcagtaaatccacttagtanatcgatccctcaaaagaagaatgttcttcacatcagatcatctgattccgccaaggctcaagagaaatttaacggtacacaaatcgacatgacaaactgcaaggcttgcgcgaagcaagtctttcaaatggaacaaatcaaagctgaaaaagcaatttggcaaaaaaaccgtttcagatgcacggaatgtagtaaacagttaaccgttgaaacata

SEQ ID NO: 3374 - DNA, 369 bp, Diabrotica virgifera
  Clone ID: LIB149-037-Q1-E1-A7
gagtcgtattagttgctgttccgataaggaggactacggcaaaggtccgatggctgcaatatgaaaaaaattggtgattgttggtgacggagcatgtggaaaaacatgtcttttaatagtatttagtaaagatcagttcccagaagtatacgtgcccactgtagtctaaaactatgtggcggatattgaagtagatggaaagcatgtagaactcgccttatgggataccgcaggtcaagaagattatgatcgtctgcggcccctttcatatccagacaccgatgtgattttaatgtgcttctcagtagactcccccgactcattagaaggcatcccacaaaaatggaccccaaaggtaaaacacttttg

SEQ ID NO: 3375 - DNA, 279 bp, Diabrotica virgifera
  Clone ID: LIB150-016-Q1-E1-G10
gtccgcccacgcgtccgcctgttcccatagatgggcggccggcgtgttatttttaagtgcactcgacactcactatgaaaacgacgcttcgcgtcattagcgcactcgttgttaacgtcgctgagcgtcgactccatacacttactcagagtcgctgtagcaccaagagcatagaaccataaatcaggtgtgacgacgatgtagctgctcttgtcgtcgacattggctccgggatgtgcacagccggtttcgccggtgaggacgccccgtcgagctgtc

SEQ ID NO: 3376 - DNA, 283 bp, Diabrotica virgifera
  Clone ID: LIB3026-002-Q1-E1-A5
atggacatgccattttattgtatacctatatatcttgttgttaatgctcatgtaggataagcaggaagattgcagagattttataaatcatgagacatgattcgctatagcttttggtgggatgtttgatatctgggagggctattggagctaaatctgcatatttttatattagatgatagttttagaatgaggcttcaattttgcaggttgtttttgccgatggatgacacactggatttttaggtaagataccatgtggtttctggctagggttttgagt

SEQ ID NO: 3377 - DNA, 412 bp, Diabrotica virgifera
  Clone ID: LIB150-019-Q1-E1-H12
gtacggtgacggtaacgtttaaaattgtattttgtgtttgtagttgcgataactgatgtgtacttttttaattgttagaagtctgctagtattttattgttgtaaaagtctaaactaacttatttttttttaaaatgaagtggtacagtggagaaatagccgatgcggttgctttttctaaatcgaaaggagccgtttttgtagtgtatattgaaggtactgacgaaaagtcacaaaaaataacagacctcatcaataatggcgaccttggagaaaaactggaacaagatcactttgtagctatcaaagtaattgcgggctctacagctcaccagcagtttagcgaaatttataaagaaccgagtgtaccctcgatatattttattggtcagaagggtgttcctttaaatat

SEQ ID NO: 3378 - DNA, 354 bp, Diabrotica virgifera
  Clone ID: LIB150-006-Q1-E1-C5
acacacgcgtccaccagcttgccggagttgtggccgtcgaggtcaccggtgggcctgagatccccttccaccccggcagggaggacaagcctcagccgccacctgagggccgtcttcctgatgccaccaatggttctgaccacctgaggcaagtctttggcaaccagatgggtttgagtgatcaggacattgttgccctctctggtggccacaccttgggaaggtgccacacaaagcggtctggttttgagggggcctggactacgaaccctttggtctttgacaactcttacttcaaggaacttctgagtggcgacacggagggtcttcttcagctcccaagtgacaaagccc

SEQ ID NO: 3379 - DNA, 373 bp, Diabrotica virgifera
  Clone ID: LIB149-041-Q1-E1-H12
aaatcgattcattcccaaggctttaacactgccctgtggattaatccgtgtgctagcaatgattgtcagaattattctaacgacggacatgacaaatgatacattgttaaagatgtcaatggtgatactagagctatttggtgggaaagtgataatgctcatcacgtagattttacaaatccagatgccgccaaatggttttccgacaaaatcatcgcactatctgacgatcctggcctacatggtttcaagtttgatgcacgataaacagattacgcaatgccgccacaccagtttgatcatgtcgaagatcaagaagaagttcccaatatattcaccaaacaatatgttgaaacttgtgcgcaatttggag

SEQ ID NO: 3380 - DNA, 394 bp, Diabrotica virgifera
  Clone ID: LIB3026-013-Q1-E1-B2
atgaaaagtccgatatttacagtcttggcattttaacatgcgaattagctaacggatcagaaccattctcagggatgtcaaaaacattaatgttaacggagaaagtgcgaggttgtgttccaccccttttagataaaactacaattcctcgaggtgaaaatttagattgtggagatacggaaattagttcgagcattttaaacagaagatttagccataatttacaccaatttgtttctctctgctttatgtgggatgtgaccgatagaccttccgctacgcagttgatcaaccatcctatttttaagactgtcaaaagagctctacctctaccagaactactgaagccagcattgccattaagtgaccgtgtgggatttgatacagatgaaat

SEQ ID NO: 3381 - DNA, 313 bp, Diabrotica virgifera
  Clone ID: LIB150-002-Q1-E1-H11
tgggtgctgccacagttggagtaactggatcaggagctggtattggaacagtgttcggttcactcatcatcggttacgccagaaatcctagcctagaagaacaactcttctcatacgccatcttagggttcgccttgtccgaagctatgggtctcttctgtcttatgatggcgttcttgttattgttcgccttctaaataatcggcctttactggcatcatcatcttattccatcgttcgttacgtcaataccatggtaactcatatttttaacttaaataaaattcagtaagactttgatgagtttaagtgt

SEQ ID NO: 3382 - DNA, 438 bp, Diabrotica virgifera
  Clone ID: LIB150-045-Q1-E1-F4
agacgttcgatccaagtcaataaggcacaaattctctgcccacgaaagcgctgtaaaatgtatagccatcgaccctcacgaagattatttcgccactggatctgctgatggagatattaagatctggggtgtgacggttccaaatgtccttctatccctaccagcagaacatgctcgtagcagcttcttcaagaacattggtcaaggagtcacccagttacacatcgataatcattctcgattattttcgtgcggagctgatggtagcatgaaagtcaggcaattgccagaaagggaatccctattgagtcatcattaaattaatagaaatatgtgttacttttatcaaatatgatgcctacgttatttcagcctaaacaatagtactatgagaaaataataattagatatatatttatattcagagtttattctaat

SEQ ID NO: 3383 - DNA, 336 bp, Diabrotica virgifera
  Clone ID: LIB150-039-Q1-E1-C6
attacgcgccaatctgaacgtctgtcgataatctgttctcaattgtcggtgcttaagttagtaccacatcatggagtatgcgtgaatgtacctcagtcaatgtgggtcaatctggagtcctcaacgtgtgtgcctgctgggacttgtactgtctggaacattgcaactagtctgaccgtcagaagcgaacacacactaatgttcaaagacgatatgacagtatcgtcagatgctgcaatgacactggtaccagattccacattcctacagcagtatgtgtacatgtggaaccaacagtattagatgaagtaggtaccggcatataccatcaattgt

SEQ ID NO: 3384 - DNA, 427 bp, Diabrotica virgifera
  Clone ID: LIB150-012-Q1-E1-E12
cgcaagtgattttaaagtgcagttattaaatcagtaccttattgtaaaaataaaatatgaccacaaatttcgatgaagaacaagcactgcgtgaatgtgaggcctatgttcaggcccacaacatccagcaggttctcaaggattgcatcgttcagttatgtatcaaccgtccgtcgaatcccattgcgtttctccgcgaacattttcaaaaattggaacgggaacaagctctggacgctaaacaacaagccatgtctcccgaggacactgaagacttgtctcctctaccagcccatgctcagcagcctgcccgacgtcgtggaggaatatcagcggagcccgtgagcgaggaagacgccaccagctatgtcaaaaaggtcgttccaaaagactacaaaacaatggctgctctctccaaagccattgc

SEQ ID NO: 3385 - DNA, 362 bp, Diabrotica virgifera
  Clone ID: LIB149-034-Q1-E1-G6
acccacgcgtccgcccacgcgtccggtgaggtgagggtgcaagctagaaggagtcttttttattaaattaaataattagtggaaaaagatttaataacaacccgtcaaaatgtccaaattagtagcctcaattccagtattggccggaagacttgtacaagaaggacgaccaaagtttaataccttcatgaaatatgcacgagtagaattatcacctcccacaccagcagacattccgcaaatcagagctggcattggccgacttatcacatcagcaagaactggtgcctggaaaaatcaatctgtaaaagaggcttggttgaatacccttgtcggtatcgaagttttatgttggttctatg

SEQ ID NO: 3386 - DNA, 209 bp, Diabrotica virgifera
  Clone ID: pGUT1781
tgaaggtatcgatgtaagttcaggaaacaatcacgatgacaaagccaaaggtccgtacatgtacgaattattcagtattatgatacactctggaagcgcttcaggtggtcattattatgcctatagcacagatttcgataagaatctttggtactgctttaacgaccaaagtgttacagggattaccgaaaaaaaaaaaaaaacacccg

SEQ ID NO: 3387 - DNA, 316 bp, Diabrotica virgifera
  unsure (1)..(316): unsure at all n locations
  Clone ID: pGUT3994
ctccaattctccttgaacttggaaaagtcaagagcggatggncaaatgtagatgctgactccggtgttctcttacagtattatggacttaaagaaatgaactactacaccgttctcttcggagtatcgagagctcttggtgtaatggcgtcactcatctgggaccgcgctctcggcttgcccatcgaaagaccaaaatccatgtcaacggatggtttgatgaagctccttaaggctaagtaagagactggaagagtcgattcatcgttaacatttacagcggcattgtagtttgaactattacttgagagccatat

SEQ ID NO: 3388 - DNA, 411 bp, Diabrotica virgifera
  Clone ID: LIB149-028-Q1-E1-G8
aagaaatttttagaagtaaactgtgtcagtgctttagtttttgtttcctggtgcccatacaatggaagtctgaaaaaattatcaatcaggttaaagtgctatagatttatcaatatacttcgtgtttcgttttaaggcgtattttaaaaactggggcataaagacacttgtggcaccaacatggtggactactacagagtccttgaggtgccaaaaaccgctactaactcggaaatcaaaaaagcatacagaaaattggcattaaaatggcatcccgacaaaaacccagacaacatggacgaagcaacaaaaaaattcaaagaaatatcagaagcatacgaagttttatcagacgagaaaaagagacgtgtttatgatgaatatggcaaagacggtttactgaatggcaac

SEQ ID NO: 3389 - DNA, 383 bp, Diabrotica virgifera
  Clone ID: LIB149-048-Q1-E1-A11
cccgggccgatacaagactctaggttgagtcatattagtccttacggatatcaacatcacacttcatgatggaattgtaggttgtttcatgaataccagcagcttccatacccaagaaggatggttggaagagagcttctgggcaacggaatctttcattaccaatggtgatgacttgtccatcaggaagttcataactcttttcaagggaactggaactagcagctgttgccatttcttgttcgaagtccaaagctacatagcagagtttttctttaatatctctaacaatttctctttctgctgtggtggtgaaagagtagccacgttcagtcaaaattttcatgaggtaatcagtcaagtctctaccagctaagtccaaa

SEQ ID NO: 3390 - DNA, 406 bp, Diabrotica virgifera
  Clone ID: LIB150-002-Q1-E1-G7
atttatcactgttgacttttggttttcaaattagtttgttaatttttatatatatatttttatatataactgcagcccaatggcaaaaaacacgtttagttctgcctttcgtaaaattgatgtagaccagtattcggaaaacaactttaaagaagacgaaaccgattcagggggctcagttggtccagacgaaactgaagtcaataatttacttcaaaaaggtaaaaattttgatgccttaaaggttgtgctgaacaatgcaccactaggaataaaaaatcagcaaattaaagaaactgcattcaatgtgacttttaaagttttattggcaatcaaaccatcccaaatagaatagacagtgaactccctagatatcgaatcattagatactttgatgaaatatgtg

SEQ ID NO: 3391 - DNA, 423 bp, Diabrotica virgifera
  Clone ID: LIB150-029-Q1-E1-G5
aacaccctatagagagtcgtattaatggttaaatttaatatttgtgttttgggccatgaaccatttccagtccaaatataaagtgctagaaaaaataggcgagggatcattttcggacgttctaaaatgtgaaaatatagaaacaaaagtatgttacgcagcaaagaggcttaagaacacatatcgatctgaggcaagtatacaggcatgcgcggagatagttgctgcgcagaagataccgaatcatcctaatgttgtcaacatgttggagtaccactatgacatatacacagggaaactgacctttatctttgaacttatggatatgagtatgcatgattacctcaaaacaaagcgtaagggtttgtcagaacatagagttaagttctatttgtttcaaatactgaaaggattggtacacct

SEQ ID NO: 3392 - DNA, 323 bp, Diabrotica virgifera
  unsure (1)..(323): unsure at all n locations
  Clone ID: pGUT334
cagatttagttaacaaccttggtacaatcgcaaaatcaggaacaaaggcattcatggaggccctcctagctggagctgatattagtatgattggtcaatttggtgatggagaaaatgcttcccgtatggaagaagtaaattaaatgcattcgtttaaagagcatgtgttgtaatatgttcaaatgacaatttctctcattccttatttttgtaaataatttatttcttttttatacagagtattactagcatntgatagggtactggaatattctggctgtgtaaagtactaatgaccaattgtcgattcacaactgtactga

SEQ ID NO: 3393 - DNA, 419 bp, Diabrotica virgifera
  unsure (1)..(419): unsure at all n locations
  Clone ID: LIB150-005-Q1-E2-H3
actctcggttcggttattgtgatagtatctgcgttagtgttctggttaaacgactgggaattataatattacattgattcagctctcagtgttcttttagttttattaatcttgaattcggtatggccgctattaagagactcggcacttattttgcttcaaacagttccgactcacattcaagtcgacgctatccaaagcaggctgctgtcgaaagtggacggcgttctggcagtccacgaattccacgtctggcagttggccggcgatagaattatagcttcagctcatatcaggtgtangaatctttctgagtacatgaaaatcgcagaaaaggtgaaagaattcttccacaatgaagggattcattcgacaacgatacaaccggaattcatagactacaccgatataccgaccac

SEQ ID NO: 3394 - DNA, 417 bp, Diabrotica virgifera
  Clone ID: LIB150-047-Q1-E1-D8
aaagacacttgtgcgaacgcgtgggaaatatttcaacaacattaaaaaataacagaaatgaaaataaataaacgtggacatgtttaaatgatacagtgaagaataatatatagttttagttaatctatttataattttgagtcagaggaaatagaaacaaaaaagttttatttaattttgcattttcaacttactatggaagcaatatttcacgaaaagcaagagggttctctatgtgctcaacactgcttgaattcattattacaaggatcatattttacagctgtagatcgaagtactttagccgaaaagttagatgatgaggaaagacaacggatggcagaatgtggcgaagaaagcgaagaatatcacaaatttcttcagcagccttcaggaaacatggatgatagtggatac

SEQ ID NO: 3395 - DNA, 414 bp, Diabrotica virgifera
  Clone ID: LIB150-020-Q1-E1-B8
acaaaagtgcttttacctaccgtgctgagcatggcgaacgataaagtagcaaacgtcagattcaacgttgccaaaaccttacaacggatagcgccgcaattggatcaatcagtcatacagcctcaagtcaagcctgtgctagacaaattgaatgttgacactgatgtggatgtaaaatattcagcgtccgaagccatcatgggcattgctggttgagtaagaagaacataagaaaccacctttcttcaaggataagattaacaaaagatcagaaacaaagtaattgaaatattatacatattaatataattaatcttaaatagattgtaatatcacatttgttgtgctcgtttatttcaataaaaaacaagtgtaatatagcgtttttagcagtttagcaattataaaagatac

SEQ ID NO: 3396 - DNA, 335 bp, Diabrotica virgifera
  Clone ID: LIB3026-034-Q1-E1-E3
agaacttctccttcaagatttcagccgtaatgtatcaacaaaatcatcagccctgttctatggaaatgccctgattgtgtctgcagttccaatatggttattctggagaatacacatgattgatatttattcctccttgatcttgttcgcagtcatcacagctatttctacctatttattggctatggcatacagaaacacaaaattcaccctaaaacataagattgctgtaaagagagaagaagctgttaccagagacttgagcaaaaaactagcagaagacaagaaaatgagcaagaaagaaaaggacgagagaattctatggaagaagaatg

SEQ ID NO: 3397 - DNA, 302 bp, Diabrotica virgifera
  unsure (1)..(302): unsure at all n locations
  Clone ID: pGUT1447
cagcctaaccatttattcattacacatcaaatatctaacaataaatgattttgatataaattaaaacaataaataataaataatgcttatttggcttttccttgggcagctacagcttccatagcctttttcacagtttctggatctcctaggaattctaaactctttattggtttcaaattttcatctaatgtgtagacaaatggaattcctgttggcaaattcaactgcataatttggtcatcagtaagctggtctagatgctttacaattcctctcanactgttaccatgtgctgcaat

SEQ ID NO: 3398 - DNA, 473 bp, Diabrotica virgifera
  Clone ID: LIB150-015-Q1-E1-A5
ccggggccacccacgcatccgaaaaaggtgatgattttaaaattcgtgtaataaaaatgagccacattgaattcaaagcattacaacttcaagaagaagctcagaggaaggtaaaatcagcaggattcttacagtccttgtttttgcggtctacaagtaaatcggaagagtcaatagaatattacaaaagagccggaaatctgtttaaaatggttaaaaaatggaaacaagctggttcggcgtttatggatgctgctaatctttgttacaaagctaaaaattttactgaagctgctctggagtatatcgaagcggcaaattgttttaaaaattgtgacactgaaatggctataaaggcgtacaaagaagctgtgaaattatatagaaataacggaaagtacagtgctgttgctaaaaattatgaagcaatgtcagaattattgcaagaggactataataaccagggagccgaa

SEQ ID NO: 3399 - DNA, 397 bp, Diabrotica virgifera
  Clone ID: LIB150-035-Q1-E1-H5
cagatttttctgcacaagtaaaagataaaaagctttttaactttaaaaatgtcttctaataaagaaaatagaattaacaagcaagtagaacaatatgtatcaaaattaaaaatacccaagcaaatagatcaagatatgcgaaacttagttaagtcgatgatatcccatgatgcttttggaaatacaaattacaaatggtcaataaatgatttcgaacttggaggaagactcggtagaggaaagtttggtagagtgtatattgcccgtgagaaaaaaactggattcgttgtggccttaaaaacgctgttcaaaaaagaaattgttaaaggacgagttgagcgacaaacattaagagaaattgagatacagagtcatcttaagcacccaaatattctac

SEQ ID NO: 3400 - DNA, 411 bp, Diabrotica virgifera
  Clone ID: LIB149-020-Q1-E1-F10
agcggacgcgtgggcggacgcgtgggcggacgcgtgggtgtgattcgagaggtttcttacagattaaacgacgatgaatggcattctgtatcggtggaacgtaacagaaaagaagctatgattgtaatcgacggtgccctcaaagctgaagtaagagaaccaccagggccagtaagagcattgcatctgacatctgagctctttattggagcgtcgacagactatagagatggttttactggttgcatccgagctttactaattaacggtcttcacatcgatcttcgtcaatacgcaagaatgggtctttacggtatacaagagggctgcgtgggaaaatgccagagcggcccatgtttgaacaacggtacgtgccatgagagatacgattcctatatgtgcgattgtcgt

SEQ ID NO: 3401 - DNA, 407 bp, Diabrotica virgifera
  Clone ID: LIB150-021-Q1-E1-H5
gtgaattttacaaatcattgacaaatgattgggaagaccatttagcagtaaaacattttagtgttgagggtcaacttgagtttagagctttattgtttgttcctcgtcgtgtaccttttgatttgtttgaaaacaagaagaagaagaacaacatcaaattatatgtacgcagagttttcattatggacaactgtgaagaccttatcccagaatatcttaactttattaagggagtagtagactctgaagatttacctctaaacatttcaagagaaatgttgcaacaaaataagattcttaaggtcatccgcaaaaatttagttaaaaaatgtctggaactttttgaagagcttactgaggacaaagatggatggaagaaattctatgaacaattctcgaagaacatc

SEQ ID NO: 3402 - DNA, 412 bp, Diabrotica virgifera
  Clone ID: LIB3026-014-Q1-E1-C10
acttttccacgtttgcaaataccggctataatcaaagaattttattaaaaccagtccatttaacagtattagtttatagttaacctgcatttaaataataatggtggacacagcacgattgacacgatatgcatcacctgtaaacccagcaatatttccccacctgacactagttttactaggaataggcatcttcttcacagcatggttcttcgtatatgaagtgactagtacaaagaaatctagaagtctgaagaaagagctgcttgtagctcttgtagcatcaattttttctggatttggaatcctatttctactgctttctgtacgaatatatgtataatattttacgtggtatattttcgtaagattaattttcataagtacatcattgatatttgttaatatttta

SEQ ID NO: 3403 - DNA, 412 bp, Diabrotica virgifera
  Clone ID: LIB150-024-Q1-E1-E6
aacataagtagcacaagccacagtaaccgctttacaacgcagattgccccctgcagttcccggtgtcaccttcatgtctggaggacaatccgaagaagaagctaccgtcaacttaaacgccatcaaccaattcccaggaaagagaccgtgggcgctaactttcagttatggacgtgcccttcaagcttccgttctccgcgcctggggaggaaaagacgaaaacgtcaaagctggacaagaagaattgatgaaacgtgcgaaggctaacagcgaagcttcccttggaaaatacgtagctggtagtgtgtcaggaaaagctggagatgcaggtctcttcatcaaagatcacgcctattaagcaaatcctcacaaatttgttgtgaatgtaacgttattagtgaaaaacatgttt

SEQ ID NO: 3404 - DNA, 339 bp, Diabrotica virgifera
  Clone ID: LIB149-038-Q1-E1-E5
cctatagtgagtcgtattaaaacgaggttccttattctacttgccgtattggctgtagctgtgaatgctacatcaatccaccaacaatgggctacatttaaggtaaaccattccaagaagtacggacatcttaaagaatagcaagttcgcttccaagttttctctcaaaatctccgcaaaattgaagatcacaatgcaagataccacaatggtgaagtatccttctacgtgggggttaatcaattcgcagatatgactccagaggaactcaaggctacgcttgactctcagctcattcacagagcctaagcgaaatatgacatcccgctttgtacctga

SEQ ID NO: 3405 - DNA, 252 bp, Diabrotica virgifera
  Clone ID: LIB149-003-Q1-E1-H6
aacgtcagcccacgcgtccgggaaagtatatcatattatgatacctcagcttttgaaacactgattacaaaaatgtatattactttaatcctttttgagtgcgtaggcgcaaaatttcggtcgaattatcgatggtcgaaagtccctgagaaattctataatgtttattttaataagtcacaggggtgaaaaaaaaaagagaaaatttagtatgattattcttatatatttcaatttactgatgaggtagat

SEQ ID NO: 3406 - DNA, 426 bp, Diabrotica virgifera
  Clone ID: LIB149-016-Q1-E1-F6
caaaaatatagaataacaatgtctaactctgcatcaaatctagtgtgtgtcaacgattatgaagaatatgccaaggaggaattaaaaaatgggagctttgagttttataatggtggagctggacagcaaagaacgttggaatggaataaaactgattttaacaagtatcgcattagaccaaaatatatgcgcaatgtaagcaacagaaacttatcaacaaatatcttgggtaaacctgtggcagttcccataggaatatctccctctgcttatcagaaaatagcacacccggatggagaatgtgctactgcaaaagctgcccaagaatcagacaccatcttgatattaagttcacactctaattgtacctttgaagaggtcgcgaaagcggcaccacatggaagaaaatggctacaattgtatatt

SEQ ID NO: 3407 - DNA, 350 bp, Diabrotica virgifera
  Clone ID: LIB149-019-Q1-E1-D5
agggcctcagcatcacacagtttccgattcgcaatacgcccgccccataaaggccactcaaacgcagagtgcccctcctccacccaaacagaatttggattctatgctaggaaacctccaagcagacatgagccgccaaggagtcaacaccagccaaaagggatgctgcagcgcctgtgacaaacctatcgtaggtcaagttatcaccgctttgggcaagacctggcatccagaacacttcacctgcgcccattgcagccaggaattgggtaccaggaacttcttcgaaagagaaggaaagccctattgtgaaccagactatcacaatctcttcagcccaagatgtgcct

SEQ ID NO: 3408 - DNA, 443 bp, Diabrotica virgifera
  Clone ID: LIB150-014-Q1-E1-G3
tcaaccaacccttcggaaaacctgggggaagatattagaaaacttgattatggcaagaaggtcgtaattggaaaacctggaaaagtttatgatatgataagaagaagagctctaagaacaagatctgtaaaaatgttggttttagatgaggctgatgaaatgttaaataaaggattcaaagaacaaatttatgatgtctacagattccttcccccatcaacacaagttgtactcatttcagctacactgcctcacgaaattttggaaattacttccaaatttatgacagatcctattaggattttggtaaaacgtgatgaattgacattggagggtataaaacagttctttgtggctgtggaaagggaagaatggaaatttgacaccctctgtgacctctacgatacattaaccattacacaagctgttattttctgcaacac

SEQ ID NO: 3409 - DNA, 241 bp, Diabrotica virgifera
  Clone ID: pGUT580
atcaaaagtaccaccacccaaatcaaatactaatacattcttttctccttccttcttatcaagaccataggcaatagctgcggcagtaggttcattgatgattctcatgacattaagaccagcaatggtaccagcatctttggtggcttgacgttgggcatcattgaaataagcaggtactgttacaacagcatgggtaaccttcttgcctaaataagcttctgctgtttccttcatcttt

SEQ ID NO: 3410 - DNA, 379 bp, Diabrotica virgifera
  Clone ID: LIB149-038-Q1-E1-G7
ttacaacaccctaaagtgagtcgtattaaccaataatatttgtacatacatttaaaacatggctttcgtaaaggttgtgaagaacaatcagtacttcaagatgttctaggttaaattcatgatgcgtatgcgaggaataactgatcacgatgcccgtaaacgaatgactgttcataacaggaacaaatataacacacccaagtaccgtttgatcgtacgtagctccaacatgaacagtacatgtcagatgtgctgactcccttatcgagggagacatgattgtacgtgctgaataaacccattaattgcacagatatggaatctatacaggtcttactaactatgccgcagccctagccactggtttaccgtatgccag

SEQ ID NO: 3411 - DNA, 458 bp, Diabrotica virgifera
  Clone ID: LIB149-026-Q1-E1-C8
gacccacgcgtacacccacgcgtccggaaaaactcaaaaaggtttcaaatcagaatgggctaccgttagggatgaagtgctttacgtagggtcaataggaaaagaatggacaagtgcagagggtgagtttgtaaataatgatccacaatatataaaaaccatcaccaaagaaggccatatcaaccatataaactgggttgaagaatataatagattaagaggtataatcggaataaagtggcctggttacatgatccatgaaagtggactgtggtcagctgtacataagagatggttttttctaccaagacggtgcagcaaagaaaggtataatgagagtttagatgaacatcgtggatgttcagtgcttattaccgctgacgcaaatgttaatgatgtgaatgtgatagaaattggtaatgccaaaccaactagaagtttttcaagctttaaatttg

SEQ ID NO: 3412 - DNA, 450 bp, Diabrotica virgifera
  Clone ID: LIB149-014-Q1-E1-E8
cccacgcgtccgctacattattagaagacagaagagatgcctgtagagctattaaagccctttccaagaaaaatagactggaggttggggcccagggtctagacatattgagacaagtattagaactggacaggagtgactgcgaaatagtaggatactgtttggataccttatgcaatataacatcaaaagaaacattcgaagaagaaaatgaaaacctaaatcgacaaattaatgtaggagaacaattcacagagatgttccttaaaaattccgaaaatgtgacgttaatattaggatttatggaagaatacgattttagggttagatggccagctgtaagattaatgacgtcattagtagcatctaaaccaaaagatgtgcaagatatcatactagtcagccccatgggtgtgtcgaagttgatggatttgctgtttagagaatagg

SEQ ID NO: 3413 - DNA, 397 bp, Diabrotica virgifera
  Clone ID: LIB3026-012-Q1-E1-F9
atattcttgattagtattttctactcctatttttatttgtcttccttttttaataaaaattataactttgatttttattatagttggagtttgattaggttatgagttagctaaatttaaaatttcttataatttattaaggttaaataatatttctagagtattattttttagaataatatgaaatataccttttttatctactttaggaattaattattatccaatttattttggtatattttataaaaaattttttgatataggatgatttgaatattatggaagttcaggtgtaataaaacaattaaataatagaatatttttacagttattttctcttaatcatttaaaaatttatttattattattaattttttgattaatttttttacta

SEQ ID NO: 3414 - DNA, 425 bp, Diabrotica virgifera
  Clone ID: LIB150-039--Q1-E1-A6
acggacgcgtgggccaccatcagcctgataaggacattgcagcattaggagagagtacccgaagtgatatttctattgactcaattgaaagaaatggtggagaagaacgaggttttggaagaaaccaggaaagtttccttgaggacttacaaaacagaggcgctaccatcgttcaagttacatatcctagaacagcgaataatgagaaagagttgactgtcgttcggggagaatatttagagatattggatgatagtagaaaatggtggaaagctagaaatagcagaggacagatcgcccatgtaccccatactatagtaacaccttatatttttaataaccgcttacacgctactcaaaactacagaagaaatgactcgccagtagaaagatttaaccgtgttcatagcaaccaagatcactcc

SEQ ID NO: 3415 - DNA, 192 bp, Diabrotica virgifera
  Clone ID: pGUT219
gtgaaatcggaggtgttgctgaaaaacaggctgctgattatctgataaagcacaactctggttcatatgctaaaccagttgtgtcctttattgctggtctgtctgcgccacctgtacgtcgtatgggtcacgcatgtgctatcatttctggaggataaagatgtgctcatgataaaatctacgcattggaaa

SEQ ID NO: 3416 - DNA, 441 bp, Diabrotica virgifera
  unsure (1)..(441): unsure at all n locations
  Clone ID: LIB3026-031-Q1-E1-A10
ttcgccggtccacccacgcgaacngcagacgcgtgggataatttcgaactaaatttaggagaatctgatgtaatacaaggacttgatgtctccctaggacttatgaatattggagaaaaatgtaggttaaaaattacacccaggctggcctttggtagaaaaggattgccttcaaaaattccaggagatagtttagttatctatgatgtagagctagtaaatgttgagccagaagatgatgttgatatgatgcctattactctgagaaaagttaaaggcaataagaagagagaaagagggaattggtggtatactagaggagaaaacaatatagccattcaatgctatagaagagcactagattatttagacgaagtggaaggtggagatcaatctaaaggcgaagtatcagattcagatttgcagagtattttggaagat

SEQ ID NO: 3417 - DNA, 413 bp, Diabrotica virgifera
  Clone ID: LIB149-027-Q1-E1-E12
cgacacacgcctctaatatatttctaaacaaaagtaaaagtgatactgctaaaccagtttattaacatttaaaaaaatatatcaaaatgaatctcagttgcggttcaaggactataaaatacctaatttttactttcaatttttttttcgtgataactggtataattttaattgcagttggagctagtatacatacctactatacaaaatatgattttttccttaacaccgaatatttttcattaccaaatatgttaattgctactggaacatttatctttctcatatgctttttgggatgctacggagcaattaagaacagttggatcatgcttatggcattttcattactgttgggtattatattcatttttgaattttccgctggaattgctggttacgtattaagagac

SEQ ID NO: 3418 - DNA, 443 bp, Diabrotica virgifera
  unsure (1)..(443): unsure at all n locations
  Clone ID: LIB150-032-Q1-E1-B9
tccgggtcggcctctacagtcactcgtgataaaacgtagttaacaaaaaaatgttcgttacaagaatacttagaccagctgttgtgcagaatgtccgcttcatgtcacaattaggagacctaggaagcggtgccggcaaaggaggcggtggaggtggttccattanggaagccggtggtgccttcggcaaacaagaagccgcaagagaggaggaatacttctacaaaaagcaaagggaacagttgcaaaagctgaaaactgatcttaaagatgaaatcagcttccatgaagaacaaattaagagacaccaagaagctatttctcgccataagaaccgagtcactgaattagacaagaaggaatattgagttcctatgaatcctcaaatttagttactctttattttcattcatgtaagttccaagatagtgtattgcttaaaa

SEQ ID NO: 3419 - DNA, 405 bp, Diabrotica virgifera
  Clone ID: LIB150-001-Q1-E1-A9
catttttcatatcatttttcagattgttgtatttgaaaaagttttgttaaaatggggaaaagacaacatcaaaaggataaaatgtacattacgtacacagagtggactaccctttatggaggaaaaaaaggtggctatacatcaaaagagggagagaattttagaaggcttccatttgaccactgttgtctatctctacagccttatgagattccttattgcgatttagatggaaatattttcgatttagaagcactaattccatttttaaagaaatttaaaatcaaccctgtaactggtaaacccctggattttaaatctttaatacagctgaattttcacaaaaaaagtgagggtgtctttgaatgccctgtcgtattcaaaccatttaccaatagttcacat

SEQ ID NO: 3420 - DNA, 230 bp, Diabrotica virgifera
  unsure (1)..(230): unsure at all n locations
  Clone ID: pGUT4262
aaagcacgaaaccaaatttaaaattatcggctcaaggcaaagttatatgccagggcgtgcactgggaaacagggaacctttcatagtaaacaagctattgaatatggaacacgaatggttggtggagtgtctcctggaaaaggtggaaaaactcatcttgatttaccagttttcaactccgtanaagatgcacgcgaagccaccggagctgatgcaactgtaatatacgt

SEQ ID NO: 3421 - DNA, 407 bp, Diabrotica virgifera
  Clone ID: LIB3026-008-Q1-E1-E2
tggttgtagtcggaaattaataaagaatcttcgaatttagtgtaatcggtagctttactaattacatatccaaaatgtctggtattgcgggagcccgtttaactgaagagagaaaagcctggagaaaagatcatccatttggttttgtagcccgaccttccaaaaatcaagatggcacacttaacctaatgaattgggagtgctccattcctggaaaaaaagggacaccatgggaagaaggacattacaaattgagaatgctgttcaaggaagatttacctactagcccaaccaaatgcaaatttgaaccaccattgtttcatcccaatgtatatccatcgggtactgtttgtctgtcgctattggatgaagacaggactggagaccggctattacaattaaacaga

SEQ ID NO: 3422 - DNA, 384 bp, Diabrotica virgifera
  Clone ID: LIB3026-030-Q1-E1-E4
gggtgcccgcacgcgtccggcccagcgtctgatgcagaaggctacgcacggaccttatagagctcttgcacacgctttagaaattattccaaaaactcttactcagaactgcggagcaaacacaatcagaacattaactgctttgagggcgaaacacgccaaccacacggacgttaacaaaccatgcctttggggtattgatggcgaaactggagagctcgtagagatggacaagaaagaactgtgggaacctctagctgtcaaactccaaacatacaaaaccgctatagaaactgccattctcttacttcgcattgacgacattgtatctggctccaaaaagaagggaggcaacgaaccaccaactcctagccaaatgcaaca

SEQ ID NO: 3423 - DNA, 356 bp, Diabrotica virgifera
  Clone ID: LIB150-004-Q1-E1-A6
aactgatgctgcactcagagctgaactcaagaaaatcgctgatgctatcaccgctcctggaaaaggtattttggctgccgacgaatctaccgctaccgtaggcaagcgttttgctgacatcggagtcgaaaacaacgaagagaaccgtcgtaaatacagacaacttcttttcaccaccgatccagccattggacaatacatttctggtgtaattttgttccacgaaagtttataccaaaaagccgatgatggtactccattcccagaacttcttaaacagagacgaatcattcgcggcattaaagtcgactctggtgtagtacctctcttcggcagcaatgacgaatgcaccacac

SEQ ID NO: 3424 - DNA, 180 bp, Diabrotica virgifera
  Clone ID: LIB149-033-Q1-E1-C8
actcttacgctctggataagagatcaagttgcatatttggtaaccaggctgcatgattcaatggcaggcgtcggtactgacgatagaactttaatcagaattgttgtttcgagatctgaaatcgatctagaggaaatcaaacaatgctatgaagaaatctacagtaaaaccttggctgat

SEQ ID NO: 3425 - DNA, 439 bp, Diabrotica virgifera
  Clone ID: LIB149-027-Q1-E1-B10
cccacgcctccaaatagatacaagtgtttacagcaaataagttattttttaagtatattgactgcaaattttcacaatggctaacgatttagaacaaaagatcatcaaacaaatcgaatattacttcggagacatcaatctgccgcgtgataaattcttacaagagaaaatcaaagaagatgaagggtggatcactctggatgtcttattaacgttcaaacgtctttcgtcgttatctactgaccaagagttaatcgcaaaagcagttgaaaagtctgaaaatggcctagtaatggtaagcgaagaccgtaagaaacttagacgcaatccagagaaaccgagtccagaattgaatgaggaaagacgcaaagagatcatggggaggacagcctacgcaaaaggatttccattggatgaagaatttaacaacattatcact

SEQ ID NO: 3426 - DNA, 400 bp, Diabrotica virgifera
  Clone ID: LIB150-034-Q1-E1-A7
gccacggaagatgaatattttgatgatgacgaagaggagaccgttccagatttggcatatattccagcaccaggtagtcctactaggctggagatgatgcaaaagaaaaatgttgaggatgatgaagatgatcccctcgatgcttacatggcaggaattgaacagcaggtccatagagaatctcttcaaaaatcggaaccaactcaaggcatccgtaatgatttagaagaagaggatgtagaagaatcgtattatcgatatatggaagaaaatcctaatgcaggagttccacaaacagatgacgaccacccggaggtagaatatgatgaggacggaaaccctatagctccagacaagaaaaaaataattgatcctctaccccctatagatcactccacga

SEQ ID NO: 3427 - DNA, 428 bp, Diabrotica virgifera
  Clone ID: LIB149-008-Q1-E1-B12
cgcgggtagacccacgcctctacactaagtcccatgaaaccatgtcttcggccaaactcgaaaatctagaaccacaggaatgtttgcacataggagatcagaaatctttagattatgatggtgcaaggaactgcgggtggcacgccgttttagtgaatgataaagaaaaatatccagatattgataaagaacatgtgtttaaaatttgtttgatattcataagcatttcattaaaacttctggcgaatcattatcttctcatacggtataacgtataactgtatattttttaaatgaacttattattgtttttggtgaagtttaggttcttagaacaaaaaacaggatgtggcactccgagagagtgacctaagatgggaagtatagctttcttatcatctacctacgcgatgatttttactttaatt

SEQ ID NO: 3428 - DNA, 412 bp, Diabrotica virgifera
  unsure (1)..(412): unsure at all n locations
  Clone ID: LIB149-020-Q1-E1-H12
agaagcaatcgctccgtaacatcgccgatataatcagcaaacaagttggccaaattgacgctgatctgaagaccaaatcgtctgcgtacaataacttgaaaggaagtcttcagaatttggagaagaaacagacaggaagtttactaacaagaaacttggcagatttggtgaaaaaggaacattttattttggattctgaatatttgcagacattgttggttattgttccaaaagcccaattcaacgaatggaatgcgacatacgaaaagattaccgacatgatagtcnctcgttcttcacaactgattaaacaggataacgaatacggtctatatactgtatccctattcaaaaaggtcgtcgaagaattcaagttacacgctagagaaaagaagttcatcgttcgtgattt

SEQ ID NO: 3429 - DNA, 326 bp, Diabrotica virgifera
  Clone ID: LIB3026-021-Q1-E1-A5
cacccaactgaagggaaaaagttagtagatgatatattaactcgcatccagtactcaaccgaaccacaaaaaggagtacaaaacgcagatctaattgtagaagccattgtggaaaatatggatataaaacataagttgtttaagagcttagacgaagctgcaccagagaaaactcctttcgcctccaatactaattctccatccatcgcagaaatcgcatctgtaacaaaacggctggacaggtttggaggacttcatttattcacccctgtacctatgatgaaacttttggaagtcatcaggatttctgaaaccagtgaccaaac

SEQ ID NO: 3430 - DNA, 360 bp, Diabrotica virgifera
  Clone ID: LIB150-033-Q1-E1-B8
accacgcgtccgcccacgcgtccgcccacgcgtccgcttggtttgataccccagaacaagtcttttttgtagccgtcggctatctggatgcatttatagcacgtataaaggtaccagaaaagtacttgatgtgtcttgcatttgcttgtttcttcatagctgcccgtgaagagcaacttgacattcctttaagcactctgatctacatggctaggtgcaattttactttccaagacgtactaagaatggtggacgttgttacaaacaagctccaattagggtccaaaatcactactattggagatattcttcggctgtatatccagtttttaggaagctgtcactcaaccgtaagtgaaa

SEQ ID NO: 3431 - DNA, 240 bp, Diabrotica virgifera
  unsure (1)..(240): unsure at all n locations
  Clone ID: pGUT1892
caacgagagagataactgcaagacaataccgaatacagatcaggccgacagagatggtgacggcataggagatgtttgtgataactgccctagtgcgtataaccctggttctgaagataaagacgacaataatgttggtgatgtgtgcgattctccaataaatactgataatgatggtgttccanacaatcatgacaattgcagacttatacccaatcccaatcaacttgacactgatag

SEQ ID NO: 3432 - DNA, 382 bp, Diabrotica virgifera
  Clone ID: LIB150-048-Q1-E1-C6
acgatatttcggaatattgtagcagcatccagcctgcaaagtttcattatttttatcaagcctccgacaatcaacacatctaccttcatgccatcaatgcaaggatgttggagcacagctatggttctttggaatttggtccgaagacaattaccggaaaaattcttgataaggaaggtggctccatgacggaagaacttcgtaagagattaagatatcttcagcatttgcctgttacttgccaatttgaggtggccgagattcaacttaagactcctgttgttaataaagacacccttgagcattttcgtgatcaaattgagattcgtatgaagaggcgtcaaaagcgcgcgaaggaataaaaacgccgcgacaagcgcat

SEQ ID NO: 3433 - DNA, 350 bp, Diabrotica virgifera
  Clone ID: LIB150-010-Q1-E1-D12
accacgcgtccggctcatgtggttgtggtggttaggtctgagtggcaaagaaggtttcaaacgctagtgatctttttaatgttttaagtctaactgattatagaaaataaagtaactgaactaaacaaacatgtgtggaatttgggctgtttttggactcacttctaacatacattcccattgcgcttcaactttttgccaaattggtcatagaggtccagatgcatggagagttgagtatgacaacaaacttaagaattgctgtattggcttccaccgtttggccattgtgggttgcaaatttggtatgcagcccatgaagttgcatcagtattcccattctcatgctg

SEQ ID NO: 3434 - DNA, 421 bp, Diabrotica virgifera
  Clone ID: LIB149-016-Q1-E1-C2
gtcgttggtaatcctgccaacaccaatgctctaatttgctcaaaatacgctccctccattccaaaagaaaatttcacagctatgaccagattggaccaaaacagagcacaagcgcagattgcagccaaagttggtgtaccaatcgaaaacgtaagcaatgtaatcatttggggaaaccactcatccacccaattccctgatgcttcccatgctgtcgttgttgttgacaacaaatcggtacccgctgtagaagctgtcaaggatggtgaatggctcagaaatgtattcgtttccaccgtacaaaagagaggtgctgccgtcattgctgcaagaaaaatgtcttccgctatgtctgctgccaaagcagcagctgaccatatgcgcgattggttcttaggcacacctgacaacaaattcgtgt

SEQ ID NO: 3435 - DNA, 434 bp, Diabrotica virgifera
  Clone ID: LIB150-018-Q1-E1-D2
gactttgtaggttttaaaaatgggagcctacaagtatatacaggagttgtatagaaaaaaacaaagtgatgttcttagatttttactgagagtgagagtgtggcaatatcgccaattgactaaactccacagaactcccagacccagtcggcctgacaaggctcgcagaatgggttacagggccaagcaaggttttgttatttaccgtattagagtacgacgtggaggacgcaagcgtccagtaccaaaaggtgccacctacggtaaacccaaaagccatggagttaatgaattgaaacctgtccgtaacttacaagctattgctgaggaacgtgtaggaagaaggtgtggtggattaagagtcctaaactcctactgggtagcccaagattcaacatacaaatattttgaaatcattttggtcgacccctcac

SEQ ID NO: 3436 - DNA, 293 bp, Diabrotica virgifera
  Clone ID: LIB150-008-Q1-E1-B5
ctatattggattttattgaaaaatacaattattaatgttacatacatcccgccacaaatggagaaacggaaataaaatagtgatattgcaattaccagaaagaaacataattaggtacatcgatttaatatttattataatttttaaactagatacatacaatttaaggcagaaaacagtcacaagagagacttcactgtttccgctatgcatggtgatatggaacaaagagagcgtgacgttattatgcgtcagttcagaacaggattatctagggttttaataaccactga

SEQ ID NO: 3437 - DNA, 432 bp, Diabrotica virgifera
  Clone ID: LIB3026-012-Q1-E1-A11
ccaacgcgtccggctatggtggcgatgaagggagaaaactgtgtagcaattgcagcagataggcggtttggtattcaagcccaaacagtagctacaaatttccaaaaaatctttgaaatgggaccacatttatatgtgggtcttccaggattagccacagatacccaaacagttatggaaaaactccgtttccgaaaaaacttgtacgaacttaaggaaaatcgaaaaatatctccaaaagtatttgcctctatgatatcaaatatgttgtatgaaaaaagatttgggccattttttgtagaacctgtagtagctggacttctacctaatacttatgaaccctttatctgtaatatggatttaattggttgtataaaccaaccttcagactttgttgttggtggaacagcgtcagcacagttgtatggtatg

SEQ ID NO: 3438 - DNA, 365 bp, Diabrotica virgifera
  Clone ID: LIB149-027-Q1-E1-C1
ctgatttgaatctacctgatcaattgacattttctagtaaacccgtggatggcaacagtatcagtaaaatatatataaacagtggcgtcactaaggatgcctctgactatcgagatactaacaatttggcaagtgtgcctatatgttggatatgtaatagtgaaattgttagaggtccatttataacagcccttggaaagatttggtgccctaaccatttcatctgctcgactccttcatgcagaagacctcttcaagatattggatttgtagaagaacgtggacaactatactgtgagtactgcttcgaacaatacttagctcctccatgctctaaatgtggtggcaaaatcaaagcggactgc

SEQ ID NO: 3439 - DNA, 347 bp, Diabrotica virgifera
  Clone ID: LIB149-004-Q1-E1-D4
agaagaagcagatcttctcatcaaggtaaattctcttataaagaggtcttcaatttacatgcagacagaaaaaatccaggattgtcttgctgattttgaagcagctgctgaattaggtcctgaagtatcagatgtattccatcacaggggccaagtaaaactgttaatggagcaaatagaagacgccagaaaagactttgaaaaggcggtggccttgaatccagattttgcagtcgcagtcgtacaaaaatgctacgcagactatcgttacgcaatgcaagtcaaagatgtaacgctcctcatgcaaacaatgcacgatttccgtatggcaattgaacgtttcccga

SEQ ID NO: 3440 - DNA, 390 bp, Diabrotica virgifera
  Clone ID: LIB149-010-Q1-E1-C6
cccacgcgtccgcggacgcgtgggctaaattactggctactatggaaagtgacaaagtcgctgctgctcgagctgtccagcaaaatatggaactcaaagagcagttagagagtatggcagaagtatttgccaaaatgaacaatgacaaggtggaactgacagaaaagctaagcattcagcagtctgcaagtaaggacctacttgaaaaattgcaaaaaactgaattgcacttacagatgttaactgatgctatcgaaatcaaagatcgagagctttcgcatctccgagaggcatctgaactaaatgaggtgctggatcacgaagagcaacatacagatgaatcacacgagacttgttcacatactctacagaatgaactgaaagaactac

SEQ ID NO: 3441 - DNA, 399 bp, Diabrotica virgifera
  Clone ID: LIB3026-002-Q1-E1-G5
aagaatttaaagttttaattctttatgtaatgttataataatctttattcataaataattataacgagaggggattaatcaaaatctagatggaataattaatagacctaatactgttcttaatcagtttattggtaaattaaaattagatgtagattttgattaatcccctctcgttataattatttatgaataaagattattataacattacataaagaatttaaagttttaattggaaattataaatcccaaggaagaacattagtttttatctcactatttagattaattttatttaataattttcttggattattcccgtatatttttactagaacaagacatataactttaacattaagattagctttaccattatgattgagatttaaaatt

SEQ ID NO: 3442 - DNA, 414 bp, Diabrotica virgifera
  Clone ID: LIB3026-002-Q1-E1-C10
aatttcaatttcagtactaaatttagcatagtggcaagcggacctaagaaccgtgggtgagaataggcctttatttatcaatcggaactcgtcaacagtgaattgttcggaattcggaacttactctaggaagcacatgtttatttttatagtttgattgacggccacctttcccgtttgagcgctctttttgtgaagtggtctcggtatatgatagccaaaatgacggaaggtacagctactattcgaaccagaaagttcatgaccaacagacttttggctagaaaacaaatggttgttgatgttttacatcctggtcaaccatcagttaagaaaactgaaataagggaaaagttagccaaaatttataaagtactcccagatgtagtattcgtctttggctttaggacaaac

SEQ ID NO: 3443 - DNA, 395 bp, Diabrotica virgifera
  Clone ID: LIB150-039-Q1-E1-B11
aattaaagatcaacagtgtattgtgttggtatgcgtgatggtgagagtagaaggacaatctcaagattctattattatggacaaggactttccggtggggctggaaaatttagggttccaaaaggaaccttccgattatgaaaaagaacgcaatggagatttaactgctgtaacagttacaacaaacgaagaagcaaaggaaagatctcaatggggcaacagtacggagtttttgatgtcctgtatcgctatgtcggttggattgggaaatatttggcggtttccttttatcgctaacaaaaatggtggaggagctttccttataccgtatctgatcatcctaacgtttatcgggagaccgatgtattacatggagatggcactaaggcaatttt

SEQ ID NO: 3444 - DNA, 388 bp, Diabrotica virgifera
  Clone ID: LIB150-035-Q1-E1-F7
attatcatcctattttttaattattgattaagtttatgtaattggctatttagtattaatattcaattcaagatttttcacaattgttattttgctagcattgaatatctttatggatttataccaatttgatttagttattgcttcagcacaagcttataatagtgatgaatatataataagtgatttaattaatgatcgatttagtttacgacttgtaatatttgtattttcagtactagtattaactatcactcctaatttaatttcaattttattaagttgacatgggtcacgtttagtatcataatgtttagtgatttattatcagggtattagtacatttaatgcaggtaaatcaactgcgtcatctaatcgacttggtgat

SEQ ID NO: 3445 - DNA, 430 bp, Diabrotica virgifera
  Clone ID: LIB3026-022-Q1-E1-A8
ccacgcgtccgcacacgcgtccgcggacgcgtgggttattcaactgctggaaagattctacgatcctagttatggaaaagtggaaattagtaataaaaatattcgatatgttgatttgaagtcgttaagatctcagttgggaatagtctcacaagagccaaatctattcgacaaaactatagctgagaatatagcatacggtgcaaattacaaacaagtggaaatggatgctattattgatgctgctaaatctgcaaatattcatgaatttattttaaatcttccaaagggttacgaaacaaaagtaggtagtaaaggaactcagctctctggaggacaaaaacaacgtattgccatagcacgagctttgctacgaaatccaaaaatacttttattagatgaggcaacatcagcattagataatgaaagt

SEQ ID NO: 3446 - DNA, 426 bp, Diabrotica virgifera
  Clone ID: LIB150-020-Q1-E1-C8
acccacgcgtccgcccacgcgtccgacaacatgtacaaaataattgcataagtccagaaccaaataatggcagtgaaatgtcaacttctgacgttgatgtatcacagcaagtcccgaatggtacgacgacggagaagataagcgaaggaatgacatcccttaagtccatggctcaacaagtgatagaccaagctggcctacaaaacaaccaagtcattctagaaccaagcaagttacaaaaccaaggcaagtctgacgcccacataccccccttactgggagttgcgccactgggcgctatacctctccaaaaagaacaccagacccagttccaacttatggaagcggcgtactaccacatgcctcacccttcagattcggagaggataagaacgtacctgccaaggagcccttgcacaacacctt

SEQ ID NO: 3447 - DNA, 343 bp, Diabrotica virgifera
  Clone ID: pGUT2967
ggtgacgagacacaatttaacaaaattttgggattaattaaagaaggccaaaatcagggcgcccagttggtacatggtggtgaaaggcatggagacaagggatactttattcaacccactgtgtttgctgatgtacaagacgaccatgtcattgccaaggaagagatctttggacctgtacaacaacttctccgatttaaagacctggacgaattgatcgaaagagctaacaggacaaactatggtctagcttctgccattttctcgaatgatgtcaacaaaattaactacatttctcaaggtttgaaagctggcaccgtatgggtcaactgctacaacgttt

SEQ ID NO: 3448 - DNA, 348 bp, Diabrotica virgifera
  Clone ID: pGUT3965
ttttgagccgtcaacatgggtaagccccgtggattgagaaccgctaggaaacatgtgaatcaccgtcgtgaacaaagatgggctgataaagattacaaaaaggcacatttaggaactagatggaaggctaatccttttggaggtgcttctcatgctaaaggaattgtattggaaaaagtgggagttgaagcaaaacaacctaactctgctattcgcaagtgcgttagggtacagttaattaaaaatggtaaaaaaatcacagccttcgtacctagagatggttgcttaaaccatatagaagaaaacgatgaagttctagttgcaggttttggacgtaaaggtcatgct

SEQ ID NO: 3449 - DNA, 427 bp, Diabrotica virgifera
  Clone ID: LIB150-014-Q1-E1-G2
cccacgcgtccgcggacgcgtgggttccgctggtggataggtattaaggtattaaggtatttggtattttagtttgttgtgaaactctgtgggaggttaacgttaaataaaaacgactgaaccggtaaaacgtaaaaattaaaaatgttgcgagccattagaaatacgattaacgttgtacaaaaatgtaattacagtgcatatgctctacctaaacctcaaccaaacccaaatgtcctgtattctgggattttcatcaataacgaatggcacaaatccaaatctggaaaaaccttcgagagcatcaatccctcgacggggcaggtaattacggaaattcaacagggatccaagcaagacgtcgatttggcggtggaagctgccaatgaagccttcagattcggctcgacttggagaacaaccgatg

SEQ ID NO: 3450 - DNA, 96 bp, Diabrotica virgifera
  Clone ID: LIB150-034-Q1-E1-E11
agctgaatgtgctgtactcattgttgcagctggtactggtgaatttgaagcaggtatttcaaagaatggacaaacacgtgaacatgctcttcttgc

SEQ ID NO: 3451 - DNA, 402 bp, Diabrotica virgifera
  Clone ID: LIB150-042-Q1-E1-A10
acattgaaaatattgatttttttattttataaaatattaaacaattcgttcagggttcaggtgcaaattcgattaacatgtcgctgtttccattagaatcaaatccagatgttatgaacaagttcatgcatgttctgggcgttcctgagaagtttaaagtagtagatgtgtatggtctagatacagatgcacttgcttgggtgccccggccggtgattgctgttatcctactgtttccctgcagtgaaaagttctatgcacacgcccagaaacaaaaggaagaatatttgaacaaggcaccagagcttagtccaaatatatggtatatgaaacagaaagtatcaaatgcatgtggtactaatgccttgattcacaatattgcaaataatgacgaaagattgc

SEQ ID NO: 3452 - DNA, 431 bp, Diabrotica virgifera
  Clone ID: LIB150-003-Q1-E2-G8
gacccacgcgtcagaaaaacagtgccaaggacagtaaagaatttcagagaattagcaactaaaccagccggtgaaggatacaaaggcagtaaattccacagggttattagagatttcatgattcaaggtggtgacttcactaaaggagatggtactggaggtcgcagtatttacggagaacgcttcgccgacgaaaacttcaaactgaaacatttcggtgctggttggctgtcaatggctaatgctggaaaggacactaacggttcacaatttttcatcaccacgaaacaaacctcatggctcgacggacgtcacgtcgtgttcggtaaaattttgaagggaatggatgtcattaagaagatcgaagcgacggaaactgatagtcgtgataaaccaaaccaagatgttgttatcgctgattgcggtgctgt

SEQ ID NO: 3453 - DNA, 348 bp, Diabrotica virgifera
  Clone ID: LIB150-046-Q1-E1-A6
agctaatctgaacgtctgtcgtaattttgtttcatttgtggtgtaaaagttaaaactcatcaaccaaaatgcgtgaatgtatctcagtccatgttggccaagccggagtccaaatcggtaatgcctgctgggagttgtactgcctggaacatggcatccaacctgacggtcagatgccatcagacaagactgttggaggaggagatgacagtttcaacacattcttcattgaaactggtgccggcaaacatgtacctagagcattatttgtagatttggaaccaccagtattagatgaattacgtaccggcacatactgtcaattgttccacccagaacatctcatca

SEQ ID NO: 3454 - DNA, 328 bp, Diabrotica virgifera
  unsure (1)..(328): unsure at all n locations
  Clone ID: LIB3026-003-Q1-E1-H2
cctgtagaagcaacttttgacgtatacagtgacttcctgaattacaaaagtggtgtttatcaacatgtcgctggatcatatgtaggagggcatgccgtcagaattttaggttggggagaagagaatggagtagcttattggttggttgctaattcatggaatgaaggttggggagacaagggattggcgaaaatgcttgncggagaaaccgcgggggggggcggcngatggtgttgttggcgcacgttgatgggggtagtcctacataaacaaagtattgctataacggtttagttaggatttagtttataataggaaaaattgtttc

SEQ ID NO: 3455 - DNA, 345 bp, Diabrotica virgifera
  unsure (1)..(345): unsure at all n locations
  Clone ID: pGUT3910
tgaatctgttttaagatatggcctccccgtcaatttccaagctattttaatccaccccaataagaaacaattaaaacgtttaagagatgtcttgaaccaactttacggccacctcgatagtagtgctgccctttcaggacctaacgttgatagcgttgacattccaggcctcggattcggccaatcagagtattacccatacgtttactacaagctgaacgtcgacatgttagaatcgaagatctaaactcacgcatcaatccaagagtttgttattaataggttccaaacaaatttaaaaaaacgtactacagatacaaatagnatatttttgagtactcactc

SEQ ID NO: 3456 - DNA, 447 bp, Diabrotica virgifera
  unsure (1)..(447): unsure at all n locations
  Clone ID: pGUT1252
ctcgtaaaaaattctgtattaaattaaatcagactttaaataatcgtttcacagaaaagtaatgaaaaagtgtaaaaaaattgaaaggaattttttgtcttaaaaacaagtgatttgtcatgtttggaatcaaatttaatattcttcagctccttcaccctcaccttctccggagtccataccaacttcttcataatctttctccaaagcagccaaatcttcacgagcttcagagaattcaccttcttccataccctctcctacataccagtggacgaaagctctcttggcatacataagatcgaatttgtggtccaatcttgcncaggcttcagcaatagctgtagtgttggacaacatgcatacggcacgttgtactttagccaaatcacctcaangtacaacagttggtggttggtagttgaatactactttgaaacagttgga

SEQ ID NO: 3457 - DNA, 383 bp, Diabrotica virgifera
  Clone ID: LIB3026-034-Q1-E1-G1
cccacgcgtccggggattaacagctcctcttctagtgatagtgatggtactagttacagaactgctggcccatcagtcgataaagcaaatcaacctgcatgctgtagcattctacgttagtgaatcttcagtaggcgcgactttaactttactggttacgtcaatagggaaagtattagttggtgaacacaggccccattttttggatacctgtgagccggacactgcgaagaactgttctatagggacgtttatagaaacttatacctgtacgtcaacagaatttgaaccttcatttttggttgactcctctttgtcattcccatcgggacactcttcaattgcttggtttattggaatattctcagcatacgtagttcacg

SEQ ID NO: 3458 - DNA, 408 bp, Diabrotica virgifera
  Clone ID: LIB3026-002-Q1-E1-F3
agttttccttttatgtctggattttattctaaagatttaattgttgaaattttatcttttagttatttaaatatttatatttatataattttttatatttctattggtttgacagttgcttatagatttcgtttaacttattattctttaacgggtagatttaattatctagctttaaatatattatctgaaactggttatttaatacttaagggtataagaggattaattttatttgtagtttttagtggaagattattttcttgattagtattttctactcctatttttatttgtcttccttttttaataaaaattataacttttatttttattatagttggagtttgattaggttatgagttagctaaatttaaaatttcttataatttattaaggttaaataat

SEQ ID NO: 3459 - DNA, 347 bp, Diabrotica virgifera
  Clone ID: LIB149-027-Q1-E1-H5
aaatgacccatctcatgtttgaaaccttcaacacacccgccatgtatgtagccatccaagccgtactctccttgtacgcttccggtcgtaccactggtattgtattggactccggagatggtgtcacccagatcgtcccaatctacgattgttacgctcttcttcacgccatcctccgtttggacttggccggtcgtgacttgaccgactacctcatgaacattcttactgatagaggttactcattcaccatcatcgctgaaagggaaattgtccgtgacatcatagaaaaactctgctatgtcgccctcgacttcaaacatgaaatggccaccgctgctgcttcc

SEQ ID NO: 3460 - DNA, 440 bp, Diabrotica virgifera
  Clone ID: LIB150-029-Q1-E1-B1
tctggaatacgttgaaaggggtggaaaaattattatgcccccatcagctttggaacaattgactaggttaaatataaactatcccatgttgtttaaacttgtgaataaaaagacacatcgcacaactcattgtggagttttagaatttgttgctgatgaaggaaaagtttatttgccactttggatgatgaacaacttagtactgactgaaggagatttggttcaaatggaaagtgtttcccttccagttggcacattttcaaaattccaacctctcaatccagacttcttggacattactaatcctaaagcagtcttagaaaatggtttgagatcctttgcctggcttacaacaagagatgtcattgcagtaaagtacaatcaaaaagcttatgagttgtgtgtgccagaaaccaaacccggagatgccattagtatca

SEQ ID NO: 3461 - DNA, 434 bp, Diabrotica virgifera
  Clone ID: LIB149-009-Q1-E1-A7
ccggagacaatcatgtggtacaaaattacgaaattacttattttatagtacaattgtaggctaggtaaatagtaaccatgaatggaccgcgtcttggtttaagtcgagaagaaattatcaaaattagtgagacaattagggaaaataatttaaacaaacaggaattgatctttaaaattgtaattattggagattatggagtaggaaaaacatctataattggtagatttacagaagggcaattttctacccagtataaaattacgataggtgcagattttgccgtcaaaaccttagaatgggatgaagatactcgaattagtttacatttatgggatattgcgggcaacgagcgttttggcagtctactaagcgttttttataggcatgccgtagcagcagctatagtatctgatttaacaagaccagagaca

SEQ ID NO: 3462 - DNA, 432 bp, Diabrotica virgifera
  Clone ID: LIB149-028-Q1-E1-H8
cacgcgtccatttttatttagattaatttttttgattcctttatgttttaatgaggattttcgcataatgcacagtattggaccatattggagatatggaatttatttttaatatcgaataggtgcacatgtattctctatttcacatatgtcatgtattaatatttgagcttatagattaattttacagttcttttgacttggaactttaataatttttactagatgaaaattatctaaatatggaatttattcaaatttatttttattactattaatttttttaatattaagtttatatttagtattttcttcattaaatattttcattttttatttattttttgaaattagattagtaccagttttattattaattattggttgaggttatcatccagaacgtttagatgctggaatttatttattatt

SEQ ID NO: 3463 - DNA, 358 bp, Diabrotica virgifera
  Clone ID: LIB150-025-Q1-E1-G9
acaagactctatagtgagtcgtattaataactaataaaatttgaaaaaaatataaaaaaagtttttttaataaaaaattaatttatataataaattatatttgattggggtgattatgtaatgggtttaactttttttatattattattgtaattgctcattttttgatcgaatttttttgaatattagaatatattaccttagggagttcagggtaattttattggaaagttcaaatcggtgataaagattgcgaactcgatgttggatttaagttaataattggtgttagagccatattactaagtctgttagaattttaaaagtttataggatcggagtttagaacggtgtgaag

SEQ ID NO: 3464 - DNA, 473 bp, Diabrotica virgifera
  Clone ID: LIB150-013-Q1-E1-D8
ccaagcgtccgcaccttcagatccagtgggaaattcaaatccagtgggaagagtacttccagccgcttttactagaagttcagctcttcctgacagaagtacctgtggttttcagaaatctgatgagaacgaaaaggtagaaggacttatttatggaggagtagagaccgagttgaaagatttcccttggatggccttattaggttacagaacgagatacggaacaacaaagtgggcttgtggaggtacactaattagtcacagatatatcttgacagctgcgcattgtgttacaggcgaagtttcaaccgctgttggacaacttacgtacgtcaaattgggtgaacacgacaagactaaagaaatagactgtgataagaatggaaattgttacgagaaacctgtaattactgggattgagaaagtcatgttccatgaaaagtatgacgctactgacagaactagtcccaatg

SEQ ID NO: 3465 - DNA, 361 bp, Diabrotica virgifera
  unsure (1)..(361): unsure at all n locations
  Clone ID: LIB150-040-Q1-E1-B2
ttgaaacggtgtttgaaaattatcattaaatatttaaaatctctatcagtctgatataacagcagcaaattatcacatcattttataatttcatcaatatcatggctggattaattaaaaatctggttaccagggttccacaaattctcaaaacagttccactgaaacaaataactcacagaaattttggtgtcacgtcatcgttatttattccaaaagtacaagaaccagctccaaatttttgtggaacagcagttgtgaatggttgcttcaaagacattaaattagctgactttaangaaagatttgttgttctatttttctatcctttagatttcacatttgtttgccccacagaact

SEQ ID NO: 3466 - DNA, 614 bp, Diabrotica virgifera
  unsure (1)..(614): unsure at all n locations
  Clone ID: pGUT3340
agggatacaggagaggggagtctttcttttagctgaggccagcgcanctggtaacttgattacagaaagttatgttaaagatacactaaaaatggcagaagaatattcagatctagttgcaggagtcgtttgtcaaaatccgttatttttaaacagtcatggtctcatccatctatgcccgggagtccaaatagaaaaaaaaggggataccttaggccaaaggtataactccccagaaacggtggtcctagaaaaaggtgcagatatcgctgtagtcggcagaggaatcacgcaagctccagatcccgcaactgcagctgaatcttacagacaactgttatggaacgcatatgaaaagaaaacttgaccanaaaagagattaaaaggaaatgttcaaaatatatttaggtaggttcaaaatatatntgcccatatcgaataatatgtctccaaatatatacatatttcaatatcttctcgtcaaattttaggaccattaaggctgataaaaggaattgaactctntatattccaatatatggatagttctagagacattccagaaaagtatatntttattatatgtanaaatggatgttatcaaataaatattt

SEQ ID NO: 3467 - DNA, 351 bp, Diabrotica virgifera
  Clone ID: LIB3026-029-Q1-E1-H1
agttcttacggctgtgttaaccatcttcgtcatgctgttcttttgtttttgtcgttccaccactgtctaccatatatcagcgtggttacaactaatttcagccgcttgtatgattgctggttgtgctgtttacccagctggatggaactcagaaaacattcgcaaagtttgtggaacgtctacagataaatatatgttgggcgattgccacattcgatggacttacatattggctgctattggttgtttggatgctgttatattatcaacgttagcatttcttctagctttgagacacatcaagctacaggctgatccagattattctacgtcacctaatcccttcaaagg

SEQ ID NO: 3468 - DNA, 392 bp, Diabrotica virgifera
  Clone ID: LIB150-006-Q1-E1-E5
agccgggtcatccaaagacgaagtttcaaagtcacccttcgttgaaaggttattacgtaaaggttacgaagtattgttcttggttgaagctgttgatgaatatgcaatctctgcaattcccgaattcgaaggcaagaagttccagaatgtagctaaagaaggtttcagtctaaccgaaaccgaaggaggtaaagaacaattggaacaattaaagaaaacgttcgaacctctcaccaaatggttagccgatgatgcattgaagaatgaagttgcaaaggcaaccgtttccgaaagattgtctgactcaccttgcgctttggttgctagtctgttcggctggaccggaaatatggaaaggttggctttatccaacgctcatcaaaaatctgacg

SEQ ID NO: 3469 - DNA, 382 bp, Diabrotica virgifera
  Clone ID: LIB149-033-Q1-E1-G11
cgcgtctacccacacgtctgcgaacgcgtgggtaacatacttcttttatcttaaagataaccagcacaaagatgtctctaacatagggtgggtgccaattttaagtcttgtagtcttcattattacgtattgtcttggtttcggacctctaccatgggcagttatgggagaattgttcccaggaaatgtcaaatctgtagcctctacagctacggcttcattttgctggatccttggcttcttgctaactaactactttggtgcagttgcaggagttataggaaaatctggatcttttggtttcttcacaatttgctgccttttgtcggctatttttaccttcaaatttttacctgagactgcgggaaagagtctaacgaaa

SEQ ID NO: 3470 - DNA, 283 bp, Diabrotica virgifera
  Clone ID: LIB3026-010-Q1-E1-C1
accacgcgtccgccaacattcgacgtgtcggattggctcagcaaggggatcaactggatcagttgggtaggaggaggcagcacaatttggagcaacagatacaagcgagaaaccagtcgggtgtgagtgaggaggccctaaaagaagtctccaggatgttcgagcagttcgacaaagaaaaatccggaaaactcaaccatcaagagttcaagagttgtcggctagctcttggatacgactgacctatggtggaagaagggcaacctgatccagagtgggatgc

SEQ ID NO: 3471 - DNA, 440 bp, Diabrotica virgifera
  Clone ID: LIB150-015-Q1-E1-G10
cagacgcgtgggcggacgcgtgggcggacgcgtgggtgccgaggaaaatagttttgtgctttatggtccaaagactgatattcccataccggaaggattattgggaaactttatgtacaactcattactaaacacggatgtcaatcattattgtatggtagacgtatttactggagaaacgcgtacattcagaagactactggaagattcctgcacgttagcacaagcgctacgtaattttggacttaaacccaacacaattgtttcaatatgtagtgagaacaacgtgaggttctatgaagcggttttagcttctctgtacgtcggagctacgatagcacccattaatcatgtgtacacggcagatgagttaagacatgcacttacactttatcagccagagattgtattttgctcgaaaacaactattaacaagtttt

SEQ ID NO: 3472 - DNA, 214 bp, Diabrotica virgifera
  Clone ID: LIB3026-035-Q1-E1-E3
tggagtagtcgttgactccccaaaatgcagatcttcgttaaaaccttaacgggtaagaccatcactcttgaggtcgagccctcagatactatcgaaaatgtgaaagctaaaatccaggataacgaaggaattcccccagaccagcatcgtctcatcttcgctggaaataaactcgaagatggtcgtaacttgtctgactataatattcaaaaag

SEQ ID NO: 3473 - DNA, 249 bp, Diabrotica virgifera
  Clone ID: LIB150-016-Q1-E1-D11
cacaccaatgcctgtttccatcctgccattcacatggtaaactgcgatcccagacatggtcaatatatggcttgctgtatgctgtacagccgggatgttgtaccaacagatgtatatgctgctattgcaaccattaagatctaacttaccatccaattcgtatactgttgtctaactggtttcacagtacgtatcaactatcatccaccatcatgttgtacctggacgtgatttggctaaagtacaacg

SEQ ID NO: 3474 - DNA, 220 bp, Diabrotica virgifera
  Clone ID: LIB149-025-Q1-E1-H4
atggtgatggtacaattacgactaaagaattaggaacagtaatgagatctctaggacaaaatccaacagaggctgaattacaggatatgatcaatgaagtagatgccgatggtaacggcacgatcgatttcccagaatttttaacgatgatggcacgtaaaatgaaagataccgatagtgaggaagaaattcctgaagcattccgagtgttccacaaaga

SEQ ID NO: 3475 - DNA, 420 bp, Diabrotica virgifera
  Clone ID: LIB149-016-Q1-E1-E2
ggcacagtcaaacgtgaagacatctacatcaccagcaaactctggaacaccttccacagacctgacttggtagaaccagccgttagaaccacattgaagaacttgggtcttgagtacttggacttgtacttgattcactggccttttgctcttaaggaagacggagaccttttcccagtaaatgccgatggcagcacagcctacagtaccgtggattacgtggacacatggaaagccatggaggctctagtcaagaagggtcttgtcaaatcaattggtatttccaacttcaacaaacgtcaaactgaacgtattctcgccaactgtacaatcaaaccagttaccaaccaggttgaaatccacccatacttaaaccaacaaaaactcatcgactatctcgaatccaaagacatcgtcgtc

SEQ ID NO: 3476 - DNA, 402 bp, Diabrotica virgifera
  Clone ID: LIB150-049-Q1-E1-C5
aggttatatatttacatttttactaatttttagcatcatagaagagtgtttagcatttagttcagttgtaagttataattcatttttaacattaaaaatgtctgaacgtaaagttttaaataaatactatccaccggacttcgatccttcgaagatccctcgtatgaaattaccaaaaaacaggcagtacacagtgagattaatggccccatttaacatgagatgtgctacttgtggagaatacatctataaaggaaaaaagtttaatgcaagaaaagaagacgtcgagaatcaagattacctaggcattagaatatacagattttatattaagtgtactagatgtttgcaagaaatatcatttaaaactgatcctaaaaatactgattacgacatagaagc

SEQ ID NO: 3477 - DNA, 192 bp, Diabrotica virgifera
  Clone ID: pGUT1681
atacaactccatcttgaccacccacaccactcttgaacactcagactgtgcctttatggtagataatgaagccatctatgacatctgcagacgtaatctagacatctagcgcccaacttacaccaacttgaacagacttattggccacatcgtatcctcaatcacagcttctctaagattcgatggtgctct

SEQ ID NO: 3478 - DNA, 366 bp, Diabrotica virgifera
  Clone ID: LIB149-034-Q1-E1-C6
agctgttagcaggaatgcaacatcccaacatcattagatcattggctttgttcgacaatgctccattacctggcatcgatacgatcatattggaattagtcaaaggacctttattatttaagtatattagtgataaagaaacttacagtgagtcagatgtaagaaactacacgtgtcagttaatatctgccttaaaatggctgcaccaaaaaagtattgcgcatctagatgttaagcccgaaaacgtaatgatcgatataaccgttcccatccccctattaaaattagtagacttcggtgactcagtcaacacctccaagaatgtcatcttgccaccagcttgcctcgaattcgcctcgcccgaac

SEQ ID NO: 3479 - DNA, 363 bp, Diabrotica virgifera
  Clone ID: LIB149-027-Q1-E1-D6
cgtcctgataatgtgaaagccaagatccaagataaggaaggtatcccaccagatcagcaaagattgatctttgcaggaaaacagctagaagatggtagaactttgtctgattataacatccagaaagagtccactcttcacttggtactaagattgagaggaggtatgcagatttttgtcaagacattgactggtaaaactatcacattagaagttgaaccatctgatactattgagaatgtgaaagctaagatccaagataaggaaggtatcccaccagaccagcaaagattgatatttgcaggaaaacagcttgaagatggtagaaccttgtctgactataacatccagaaagagtccact

SEQ ID NO: 3480 - DNA, 419 bp, Diabrotica virgifera
  Clone ID: LIB3026-002-Q1-E1-B10
agcactttgacgagaggcgttgttagttacttcgttgtgtcgacatttttctgtttagtgtaccgattaatcttcaaatattacaatggctgaccaactcaccgaagaacaaattgctgaattcaaagaagctttctcactattcgataaagatggtgatggtacaattacgactaaagaattaggaacagtaatgagatctctaggacaaaatccaacagaggctgaattacaggatatgatcaatgaagtagatgccgatggtaacggcacgatcgatttcccagaatttttaacgatgatggcacgtaaaatgaaagataccgatagtgaggaagaaatccgtgaagcattccgagtgttcgacaaagacggcaatggtttcatctcagcagcagaattgcgccacgtcatgacca

SEQ ID NO: 3481 - DNA, 416 bp, Diabrotica virgifera
  unsure (1)..(416): unsure at all n locations
  Clone ID: LIB149-044-Q1-E1-G12
ggtaacgtcaaaaaccgaattttctgtcattggtgtgggttaaggcaaccgaattataaaattaaactttaaaatagaaaaataattccaaatggcttcacaaaacctttgaatggctgtccgcaacttcacaacaagtaaccctgcttcaaaattagttaaagccccactccaaatctttggaattgaaggtangtatgcttcagccctatactctgcagccagcaagcaaaaatcattggaaggtgtggagaaggaccttttgaagcttcaggctgctttaaaaactgatgccaaacttcgaggatttgtagataacccaacaatcaaaagaagtcttaaatcagaggctcttaaagcagttgctcaaaagaattccctcaaaacagaatctgccaaaccttttgcaataacgg

SEQ ID NO: 3482 - DNA, 440 bp, Diabrotica virgifera
  Clone ID: LIB150-040-Q1-E1-F8
ctcgcgggtcgatacaagcctctacacagacgtcgtattaacgcgtccgccaaaaccgacaagttttcccgaacggatttgttgctctcaggttggcaaatggtcgaagagaatttccctcttccgattaaaggattaatggaacgaaagtatcagggatacgtgttaaccaaggaaaagtacaaagatgccacgtcgttcagtcctatgtttgctgtcgattgtgaaatgtgtcggacctctacaggtgatttggaattgactaggatttcttgcgtgaacgaaaagctagaagtattttatgacaccttggtgaaacccgacaacgaaatcatcgattacttaacaaaatggtccggtataaataagagtatgatgaaaaacgtgtctaacaaactgaaagacgttcaagaagatctaccaaaagccgtaccacggga

SEQ ID NO: 3483 - DNA, 412 bp, Diabrotica virgifera
  Clone ID: LIB150-042-Q1-E1-E10
gcctccagtgcagagatagtgatttaaatgtaaatctaagagacgaatggaaattgaacaaggttaacacgtcaagagattcttttatgcccacaagaagacccgcaaatatcttcatgcacggagtacttggttgggatcaactgcaaatgattatttccaaatctacaacagccgatctgctcaaaatgtttaacaaactagaagaattcttttcccagcagtttaacagcagcaaaagagcatttagtagttttgctggatccggaagaccttcgagagtaactccacaaaaaaatcgagaatcgtcagtacctccccaacttcctgcagctccaactacggatgccagacaccacaggcattggcaaaaagtcttggcacacgtagcaagacttcaattgaaaactaa

SEQ ID NO: 3484 - DNA, 434 bp, Diabrotica virgifera
  Clone ID: LIB149-043-Q1-E1-C6
tcgccggtcgatacacgcctctgaattaagtctgccggctttacagaagaacgcagctacagatactgggacaataaaacccgtggtctagacttcaatggtatgatagaggatttgaaaaatgctccagagggcgctgtcatcattttacacgcttgcgcacacaatcccacaggtacagatcccactcctgaacaatggacagcaatcgcagctgttctaaaagaaagaaaattgttccccttcttcgactgtgcctaccaaggtttcgcctctggtaatttggtcaaagacgctgctgtggtcagaaaattcgccgccgaaggctatgagttcttctgtgcccagagttttgccaagaacttcggtctttacaatgaacgtgttggaaatctaacagttgcggttagcaaaccagaccttgtggcccctgt

SEQ ID NO: 3485 - DNA, 386 bp, Diabrotica virgifera
  Clone ID: LIB150-036-Q1-E1-A9
caacactctataatgagtcgtattaaatttaaatttttactcttatagttagaatcgatgggtgctcataccgaaggccaacaaccacctatgatgtcttttaaggcttttttagctactcaagatgataacatttctgatagcgaggctatagaaaagtacaatgattataaactagaatttcaacgtcagcagcttaacgaattttttgtggctcataaagatgatgagtggtttagacttaagtatcacccagaagaatctgtaaaacgaaaagaagagcaaaaggcagctttgaagagaagagttgacgtctttatagagcttttaaatgctggcaaaatagaatgtgttaaggtggattgtgcggaaaccaataaattact

SEQ ID NO: 3486 - DNA, 431 bp, Diabrotica virgifera
  Clone ID: LIB3026-009-Q1-E1-H12
tccgagccaagaaaggtttcatgacccctgagagaaagaagaaacttaggttactgttgagaaagaaagccgccgaaaattaaagaaagaacaagaacgcaaagcagccgaaaggaggcgtatcattgaagaaaggtgcggtaaacccaaacttgtcgatgacgcaaatgaaggctcattaaaacaagtatgtgagggatatcacagacgtattgtagacctagaaaataagaaatttgacctcgaaaaggaagtggaattcagagattttcagatctccgaattgaacagccaagtaaacgaccttagaggcaaattcgtcaaaccaaccttgaagaaggtatccaaatacgaaaacaaattcgccaaacttcaaaagaaggcagctgaatttaacttccgtaacaaactcaaagttgtcaagaagaaag

SEQ ID NO: 3487 - DNA, 429 bp, Diabrotica virgifera
  Clone ID: LIB149-048-Q1-E1-C7
agctaaaactaattcaagtacaaatagtcacatttcatatcaccacaagataaattaaaaatggaatttcagccactcattttagtttttcttgcattagttttggctgcaaatgctcttaaacccaatgaatgtgaagtatgtatcaaaactttgaataagttctcagccactttagacgaaagtacgcgaaaagatcccaaaaagattgagactgagtttaagaagtattgtaaaggattaaaaaataaggaacatcgactttgttactatttgggaggactggaggagagtgcgactggaattctaggtgagatgtcaaagcctctttcatggtccatgccttcagacaaaatctgtgaaaaactcaaaaagaaagacgcacaaatctgtgaactccgatatgatgtagagatagatttaaagaca

SEQ ID NO: 3488 - DNA, 372 bp, Diabrotica virgifera
  Clone ID: LIB150-035-Q1-E1-G12
acctgggtactcgacaaacttaaggccgagagagaacgtggtattaccattgatattgctttgtggaaattcgaaacagctaaatactatgtaaccatcattgatgcccctggacacagagatttcattaagaacatgatcactggtacatcacaagctgactgtgctgtactcattgttgcagctggtactggtgaatttgaagcaggtatttcaaagaatggacaaacacgtgaacatgctcttcttgctttcacccttggtgtaaaacaacttattgttggtgtcaacaaaatggactcgactgaaccagcatacagtgaatcacgtttcgaggaaatcaagaaggaagtatcctcatacatcaagaaa

SEQ ID NO: 3489 - DNA, 493 bp, Diabrotica virgifera
  Clone ID: pGUT2662
ctcctttatgatctttattcgtatatttgggatatgagaggtgtgatatcattgctcaattcgtacgtaaaatggcttgctggcggtcatttcccaccatcgatgccatcgtatactcagggaacttacacatggttttcgaaaggatggaaggaaacgtttatgagcggtgagcaggaaccgtgggtgttcagaggaggtttaactgcggatttacagcgtctggttcccgtagactccggaaacgatctcttcctgtacaaagtccccgaagtacccaccaatagagtgttcacaatacgtccttacctgccaaccgacgaagagaccatttacaatgtctgcatcaggacgtgcaaagacggtctcgaagatccgataccatatccagacaatcttaagcatctacacgccgataagatagtagggccttacttgacacttcatccagaattttgcttcgtaatggaagacgacgctggtgtaatcgggt

SEQ ID NO: 3490 - DNA, 478 bp, Diabrotica virgifera
  Clone ID: LIB150-029-Q1-E1-A7
gtggacgcacgcgtctagacaaattcatagtacaatgtccaactccaacttggttttttggtagtaatataaaataattagttttattccacttgctgatcgagacagagatttcattttatttttaaaatgtcagacttaagattcgacggacgtgtggtcgttgtcacaggagctggagctggattaggaagagcctatgctctactttttgcttccagaggagctaaagttgttgttaatgacttaggaggcggaagacatggagatggcagctcttccaaagccgctgatactgtggtagaagaaattaaaagaaatggtggcactgctgttgcagactataactctgtagttgaaggtgaaaagatagtgaagactgcaatcgataacttcggtcgtatcgacgttttgatcaacaacgccggaattttgagagataaaagttttgctaagatctccgattaagaatggggat

SEQ ID NO: 3491 - DNA, 359 bp, Diabrotica virgifera
  Clone ID: LIB150-009-Q1-E1-A12
tgtactttttgagtgaaaacttgttcccccaaaacctttgaggtgacacaagttacttcttactcgattaaatggagatggattccacagaaagaggtctcagccttgatcagaacctttcaatgggggcattgggtcctcaatcgccattggaaatcaaaccggacgcctctactctaaaccaattcagtccgcaaggaccaaacagtcctggatctttttctttaggtcatgcaaatttgctgagtccatcggctggatcgcaaaaaagcgaattctccttacccacccaatcatccacttaccgggtcgaaacatccttgctcgatatgtggtgataaggctactgggaaacatta

SEQ ID NO: 3492 - DNA, 393 bp, Diabrotica virgifera
  Clone ID: LIB150-023-Q1-E1-G1
caagcctctatactgacgtcgtagaagatgaacagtacatttgggaatcatctgcaggaggtagcttcacaataagaccagatgttggagaaccattgggacgtggtacaaaaattgttctgtacatcaaagaggatcaaactgaagttttagaagagaataaaattaaggagattgtaaagaaacactcccagttcagtggttaccccattaaattgcttgtagaaaaagaaagggaaaaggaactaagtgatgatgaagcagaagaagaaaagaaggaagaagaggaagattcagagtaacctaaaattgacgatgtaggacatgatgaagatgaagatattccagatcagaaagggagaaagaacatcacattatggaacagtacactga

SEQ ID NO: 3493 - DNA, 324 bp, Diabrotica virgifera
  Clone ID: LIB150-001-Q1-E1-H12
gcattactagctaatctgaacgtctgtcgtaattttgtttcatttgtggtgtaaaagttaaaactcatcaaccaaaatgcgtgaatgtatctcagtccatgttggccaagccggagtccaaatcggtaatgcctgctgggagttgtactgcctggaacatggcatccaacctgacggtcagatgccatcagacaagactgttggaggaggagatgacagtttcaacatattcttcagtgaaactggtgccggtaaatatgtacctagagcagtatttgtagatttggaaccaacagtattagatgaagtacgtaccggcacata

SEQ ID NO: 3494 - DNA, 551 bp, Diabrotica virgifera
  Clone ID: pGUT3335
atgacccccaagatattggtattgaagaagtactatacaacgaaggttataataataacaatgttcataggtacaatgacatagctcttattaggctaaaccgaaatgtcaagtttagtagatttatctatcccatatgcttacctcatcctaacgaagctgccagggtcggggaccgtgtgattgtagctggatggggaaaaactgaatcatccagtcgcagcaacataaagctaaaggttgagattcccatagctcagaggtcacaatgtaccagagcatttgcttctgctggaattattttgaaaaactcacagatttgtgctggaggtcaaagaggacgagactcttgtgcaggtgatagcggtggtcctttaatgaagaccgttgaagatgattcttctacttggtaccaagaaggaatcgtatcattcggtgcaagatgtggtactgaaggatggcccggaatctacacaaaagttgaaaattatttaggatggatccatagaaatgttagagaataggcaaagactggtaaataatttagatta

SEQ ID NO: 3495 - DNA, 418 bp, Diabrotica virgifera
  Clone ID: LIB149-033-Q1-E1-G5
aacggggtacagaacgaaatctttattgtgtatgcccattaaagacaccaatggtgatgtgataggagtagcacaagttataaataaagtcggtgaacaacccttcacaaaaaccgacgaagaagtattttccaagtatctgcagttttgtggtatcggcctcagaaacgcacacctttacgaaaagtcacaattagagataaaacggaaccaagtgcttttggatttggctagaatgatatttcaagagcaatctacgttagagcacgtcgtgtataggattttacttcacgcacaaagtcttattcaatgtcagagagtacagatccttctaacgcaccaagattcatcagctagcttttcgagagtttttgatttcgaagaaaatgacattaacattatagaggcaggagagagc

SEQ ID NO: 3496 - DNA, 387 bp, Diabrotica virgifera
  unsure (1)..(387): unsure at all n locations
  Clone ID: LIB150-003-Q1-E1-A10
ggatggtgcataaaaaagactgctgaaaattttctactccaagaactgaatatatttgaatgtaaaattgctgtgttaaaaatgatacaaatactttttttaggtctttttttccaatcatctctagctctctaccctagtagtggaagtgtagttgaattaacaccaagcaattttgacaaattggtgatcaaaggagatgaagtgtgggttgttgaattttttgctccttggtgtggccattgtaagaatttagtaccagaatataccaaagcagccaatgcattaaaaggtattgtgaaagttggagccgtagatgtagnacagcacanagaaatcggaggtcagtatggaattagaggatttcctactataaaaatttttggg

SEQ ID NO: 3497 - DNA, 281 bp, Diabrotica virgifera
  unsure (1)..(281): unsure at all n locations
  Clone ID: pGUT032
agtgaacaaccattcattccgttatggatctaaaaaaccgtttttgtcgtgcaggtgcccaagcgccgaagacgaagctgctgaggcagttcggacctctgttggtggccatggtcggattgccgggaagagganagagcttgctggccacgagattgtccaaatatctcaatttcaccggtgataacaccaaagtatatgacattagcgagtaccgtcgcaaacacatcaagcaatatggttctcacgaaatgttccgagcagataacttgccagcttgg

SEQ ID NO: 3498 - DNA, 684 bp, Diabrotica virgifera
  unsure (1)..(684): unsure at all n locations
  Clone ID: LIB150-006-Q1-E1-F9
atttatatttgtgttgtggatgatcgcagtgtgctgtgctcacaaaaataaacatagtaaccgtatccacaggcgtttctctttgtgtcattcagttcgagagagacagagctataattgagtgttaaaattctttagccgcgagtttttatattcacgaaaaaatgggttgtgccactgggattgttaaatatttggtgtttttggccaatctattgtttgctcttgctggattagctttaataatcataggaattttaatcaaattgaatgttagcgaagctaccaacgttctaccaaaagacttcggtctagctccaatcctctcgatcatcatcggttccatcgtcttcatcacagcgtttctcggatgctgcggagcagtcaaagaaagcacttgcatgttgaccacgtatgcaattatcctgctgacgatattcatcctgcaagttgccatcggagtttacgctttcttacaaatcaaagacaagaactcgtttaactccgtccttactaagagcatgcaagacacattcgacaaaatatatgtaagccaggaagccaacgagactatgatggtcacacagagattcttanaatgttgtggtgttcgtggacctgaagactatgacattgctggaagaaaaccactaccagttgttgccgaacataaatgttcagtgt

SEQ ID NO: 3499 - DNA, 339 bp, Diabrotica virgifera
  unsure (1)..(339): unsure at all n locations
  Clone ID: LIB149-028-Q1-E1-A4
aacaaaaattgtactgtacatcaaagaggatcaaactgaatttttagaagagaataaaattaaggagattgtaaagaaacactcccagttcattggttaccccattaaattgcttgtagaaaaagaaagggaaaaggaactaagtgatgatgaagcagaagaagaaaagaaggaagaagaggaagacaaagataaacctaaaattgaagatgtangagaggatgaagatgaagataaaaaagatgagaaaaagaaaaagaaaaaaactattaaagaaaagttcactgaagatgaagaactaaacaaaaacaaaccaatctggacaagaaatgctgatga

SEQ ID NO: 3500 - DNA, 312 bp, Diabrotica virgifera
  unsure (1)..(312): unsure at all n locations
  Clone ID: pGUT117
cttccacccaataaaattaaagacccagaagccataaaaccagaagattgggatgacagggctactattccagacccagatgactccaaacctgaagattgggacaagccagatcacatcccagacccagatgccaccaaacctgatgactgggacgatgaaatggatggcgaatgggatccaccaatgattgataaccccgaatacaaaggtgaatggataccaaagcaaatcgataaccctgcatacaaatgtgcctgagttcaccctgaaatccacaatcccgaatacactcccgatgcanacctttac

SEQ ID NO: 3501 - DNA, 353 bp, Diabrotica virgifera
  Clone ID: LIB150-034-Q1-E1-F1
gggtttaaaagtttatccagccggtagaataggagacgaaccagctataggtttagcaaagacattagaatctttgaatttgagaatgggcaggctgaaaacagggactccacccagattgatttgcccattcaaaaaggttcctgttgttataaccacactctttgaatgggcaaatcaatatgggtttaaaagtttatccagccggtagaataggagacgaaccagctacaagtttagcaaagacattagaatctttgaatttgagaatgggcaggctgaaaacagggactccacccaggattgacagcggatacgataaactatgatgtttgtgaagtacagtatgggga

SEQ ID NO: 3502 - DNA, 456 bp, Diabrotica virgifera
  Clone ID: pGUT2668
ttcggcacgaggtggtcttcgtgggagggagacatttctacatctaatagtacgtcactggcgtttacgtaaatagactgtggtgatgaagggcaggacgaatgattgctgtctgtctcactagctggttcatctttgatatttaaaggatcgtgttggagattattgcatgcggtcttcattgaaattactgggaaacattcatcatccatttcatcaactttgtggtgtgaagtaggcgaatctggtaaactatctccatctgatgtaagactgtaagaatgttctgtcttaataggtctggttcccaaagcggcgtccgtcatcagtctatcgtgaagaataactcccggcaggtccttggttggtatgtagctccattcgatggtcatatcccctgactgcatttttaatacctcttgcatcgccggatctaaatctgcctcccagagctcc

SEQ ID NO: 3503 - DNA, 381 bp, Diabrotica virgifera
  Clone ID: LIB149-035-Q1-E1-H9
ggacaagtttccaacgggtcaagcacaacgcctacatcttccaggagtaactttaggagtaatcctcgcgggaatccaccatattaacgaacaaattttcttgatagcctcagaaacagtggccaaaaacgtttcagatgaagaccttaagagaggtagtttgtatccacccctaagttcgatcaaggagtgttccatgcagatagcttgtgaagtattggaatatgcctaccaagaacgtatcgcatcagtatatcccaaaccaaaagacatgagaaaatatatcgagagccaccaatacaactacaactacgaaccatcgctaccccaaatctggccctggcccaaacccccttacatcaaaaccagaccaatggaacc

SEQ ID NO: 3504 - DNA, 425 bp, Diabrotica virgifera
  unsure (1)..(425): unsure at all n locations
  Clone ID: LIB150-047-Q1-E1-B3
ttcacgggccgacgacgcgtccaactaatccataatggagaacagattttattatattcagacggtgtaggcatagaatggagtggtcaacaaggtaatgccttctatggagtcaagaagggctctatttatctaacaacacacagagtcattttccttaacaaatctagtgcagatgagatgctcagtttcagctttccctttgttacactcagtgaggtcgagatagaacaaccagtttttggagccaattacataaagggaaaggttcgagcacagcctaatggcaattggattggtgaggccaagtttaagatgacctttaagcatggaggggccattgagtttgggcaggctctacttanggcagcacattttgcctccagaggtggtggttacgatgccctcctccatatgttctcctc

SEQ ID NO: 3505 - DNA, 422 bp, Diabrotica virgifera
  Clone ID: LIB150-023-Q1-E1-G4
cgtgggttattacacgccgccaaactgagtcggtttaaagaatgggagcctacaagtatatacaggagttgtatagaaaaaaacaaagtgatgttcttagatttttactgagagtgagagtctggcaatatcgccaattgactaaactccacagaactcccagacccagtcggcctgacaaggctcgcagaatgggttacagggccaagcaaggttttgttatttaccgtattagagtacgacgtggaggacgcaagcgtccagtaccaaaaggtgccacctacggtaaacccaaaagccatggagttaatgaattgaaacctgtccgtaacttacaagctattgctgaggaacgtgtaggaagaaggtgtggtggattaagagtcctaaactcctactgggtagcccaagattcaacatac

SEQ ID NO: 3506 - DNA, 352 bp, Diabrotica virgifera
  Clone ID: LIB149-027-Q1-E1-H6
gtccaagatgactcatatcatgtttgtaaccttcaacacacccgccatgtctgtttccatccaatccgtactctccttgtacgcttccggtcgtaccactggtattgtattggtctctcggagatggtgtcaaccagaccgtcccaatctacgaagtgttatgctcttcttcacgccatcttccgtttggacttggccggtcgtgacttgaccgactagctcatgaagattcttactgaaagaggttactcattcaccatcacctctgaaagggaaattgtccgtgacatcattggaaaactctgctatgtcgccctcgacttcgaacatgtatatggtatcgctgctgctt

SEQ ID NO: 3507 - DNA, 409 bp, Diabrotica virgifera
  Clone ID: LIB150-020-Q1-E1-F7
acgcaatccaacttaaaaggcgtaggaataaacgttttaagcgttaagcttctttttaaggttctctgccaatttgttgatgaattcgaaggtctccagataatcttctctggttacattgctcatgcccttgatgcagatggccaaatctttggtcatgctgccggattcgatggtttcaacgcaaacttgttcaagagcatgggcgaacgtattcaattcatggttgttgtccaatttggccctgtgaataagtcctctggatcaagcgataatggtagcgatcggattggaggatgtttcattgccatgttggtgaattcggaaatgtcttgttacagtaccgtgtgcaacttcggcgtaaactgttttaccgtcgggggaaatcagaactgatgtcatcagaccc

SEQ ID NO: 3508 - DNA, 405 bp, Diabrotica virgifera
  Clone ID: LIB149-006-Q1-E1-H12
atttatatagaaatcaaatactaacaaatcaacatgtgtgaagaaaaatttgccgcttaagtcgtaaacaatggttccggtaggtgcaaagctggttttgctggggatgatgcacctcgtgctgtattcccttcaattgttggacgcccaagacatcagggtgtgatggtaagaatgggacaaaaagattcctatgtaggtgatgaagctcaaagtaaaagaggtatccttaccttaaaataccccatcgagcacggaatagtcacaaactgggatgatatggagaaaatttggcatcatacattctacaatgaactcagagtagccccagaagaacaccctgttctgttgacagaagctcctctcaaccccaaggccaacagggaaaagatgacacaaataatg

SEQ ID NO: 3509 - DNA, 415 bp, Diabrotica virgifera
  Clone ID: LIB149-005-Q1-E1-C11
agcgcaagagccggaaagaaaaccgcttatcggaagagtcggtaccaacttgagggtcggtatagtcggagtaccgaacgtcggaaaatctacattcttcaatgtgttgaccaagagctcagcagctgcagagaactttcccatctgtagcatagatccaaatgagagtatggtgccagttccagacgagagattcgattttctttgtgaatattttaaacctcttagcaaagtgccagcttttctcaatattgtcgatatcgcatgtttagtaaaatgagcgtcggaaggtcagggactcggaaatgcatttctttcacacatcagtgcctgcgattccatatatcacttgtgcagagccttcgaggatgacgatgttactcacgtggaaggacaagttgatcctgtgagagat

SEQ ID NO: 3510 - DNA, 405 bp, Diabrotica virgifera
  unsure (1)..(405): unsure at all n locations
  Clone ID: LIB149-016-Q1-E1-E6
gttaacattcccgttatcggaggtcactctggcgtcaccatcattcccctaatctccagagccactccttcagtatcattccctgctgaccaacttcaagctttgaccgtaaggatacaagaagctggtactgaggtagtaaaagccaaagctggagcaggatccgcaaccctctccatggcatacgccggtgccagattcgccaactccctcctcagaggtctcaaaggagaaccaaacgtcatcgaaccagcctacgtccaatcagacgttaccgaagcctcttatttctccacacctctagtcttaggcaagaacggactcgagaagaacttgggtcttggaaaactcagcgatttcgaacaagatttgctcaaganagcacttccagaacttaagaagaac

SEQ ID NO: 3511 - DNA, 431 bp, Diabrotica virgifera
  Clone ID: LIB150-018-Q1-E1-D8
aaaagctcgctccctacaaaagaagatccaagccattgaaaacgatcttgaccaaactcaggaacaactcacacaagtcaatggcaaacttgaagaaaaagaaaaggccctccaaaacgctgaatccgaagttgccgccctcaaccgtcgtatccaattgttagaagaagacttggaacgttcagaagaacgtttagccactgccaccgccaaattggctgaagcctcacaggcagccgatgaaagcgaaaggcagcgcaaagtactcgagaatcgttccctggccgatgaggaacgtatggacgccctcgagaaccaacttaaagaggcccgtttcctagctgaagaagccgacaaaaaatacgatgaggtagcccgtaaattggccatggttgaagctgacttggaacgtgctgaagaacgtgccgaag

SEQ ID NO: 3512 - DNA, 412 bp, Diabrotica virgifera
  Clone ID: LIB149-011-Q1-E1-B6
aaaaaatagaaagcagctgtaacataaaaatattaatttaaatattgaactaaagtgaattatcgtattaacatgcacaacaacaacaaattcttcctttacgccgctggaatattcctgtcatacttttattttggaatagtacaagaaaaaattaccagaggaaagtatccatatgaactgactaaggaagatggtaccaaagttgtagaaaacgaaaaatatacctatgcggttactttagttctagtgcaatgtatactaaattatttaatagctaaaatagcggctactatgtggcctcaaggggaagataccacccgtacattatattatgcaagtatgtctttcacttatttactagccatgatctgctcaaatatggcactgcagtgggttgcaatacccactc

SEQ ID NO: 3513 - DNA, 430 bp, Diabrotica virgifera
  Clone ID: LIB150-024-Q1-E1-E7
accacgcgtccgcccacgcgtccgctcttcctgaaacctttgtaccgggttttcatgatgaagcagcggtgaggaaaatgcaatatactaaacttggaaacactgatatgcacgtttcgaaactgtcattgggtaccggcggattttcttatttttatggtgattacgatattgaagaatgtaagaaaactgtccatgaagctataaaaagaggtattaattacatcgatacaggtccgtggtacggacatggaacatcagaaacgatattaggaaaatgtttggaaggaattccgaggaaagcttactacctagcaacaaaaattggacgttatgagcaggatccaaagttaatgttcaatttttctgcccaaaaaactcgagaaagtataaatacatctttgaaaaggctgaaagtagactatgttga

SEQ ID NO: 3514 - DNA, 413 bp, Diabrotica virgifera
  Clone ID: LIB3026-008-Q1-E1-F7
agttatctgactacttccccagtccataccccaatgaagaagcagctcgtgctgccaacaatggttcctaccctccagatttgagctatattgtatctgccagacatggaggcgaagattacatatttgcccttttgacgggttactgcgacgcgccagcgggcgtggtcctcagagacggacaatacttcaacccctatttccccggtggtgccatttcgatggcacaagccctatataatgaaaccatagaatacagtgacggaacaccagcaactgccagtcaactcgccaaagacgtcgctgtgttcctaaaatggacgtcagagccagagcatgatgacagaaagaaaatgttaatcaaagtgatcggcatcttttctcttcttattggtatcacttactatgctaag

SEQ ID NO: 3515 - DNA, 396 bp, Diabrotica virgifera
  Clone ID: LIB150-045-Q1-E1-H10
ccacgcgtccgcaattctaaagttttctcgatcttttgcaaaattacctaaatacgaaactgcattaaaagcctgtagacaaaatattattagaggagcagccacccagccagattcacaaactgttgttctaaatgtaccaccaacaaaagtcagcactttgaaaaatggtatcagagttgctactgaagattggggatcccagactgccacagtaggtatttggattgatgctggcagtaggtatgaggatgataaaaataatggagttgctcacttcatggaacacatggcatttaagggtaccagtaaaagaacccaaagtcagttagaaattgaaattgaagacctaggtgcccaattgaatgcctacacaagcagagagcagacagtata

SEQ ID NO: 3516 - DNA, 289 bp, Diabrotica virgifera
  unsure (1)..(289): unsure at all n locations
  Clone ID: pGUT2116
agctctgccgctcctggccaaatccggaccaacctcgtgcccaaatccggtccagacaatttggatcttaaaaagaatatatttaaggcatcttgcaatggtaacttcaacttctacaccaaggttcaatgttgatgggaagtgatttgtttgacaattcagaaggggaatgtaagtcaataactctcttgngaaattctcatctggaatctatcccaaggtttggaaccttcttcacaaggtgtcttacgagtggtaattcttaagatcttgggtggcatacgtactg

SEQ ID NO: 3517 - DNA, 360 bp, Diabrotica virgifera
  Clone ID: LIB150-028-Q1-E1-F4
acggacgcgtgggcgtaaacttaaccacattatttactttgtgattgtgaatgccgatttattataagaaaaacttaatttaagttagtaaccccgtttaaaataatatataaatatgtattcggttttacacaaaaatgaaaatgctcatgaagaatgtatttggagttgtttttggggccgatatgcccccgaaaagaagaaaaaatccgaggacgacaatcaaggagacgatgagaaatccagagattcaattctatcagatgagcctccgactgactatattgttactggtggagtagatgatttagttaaagtttgggaattgcaggatgatcgtctagttcttaagcataacct

SEQ ID NO: 3518 - DNA, 397 bp, Diabrotica virgifera
  Clone ID: LIB150-032-Q1-E1-C7
accacgcgtccggagcaagcactttgattttggtaacaaccaactttcaatagtttcgtgtataaactgatcgaagaaaatggccctggttttaaagagagcaatattaggatatcgatggctttttgacgaattaggggattcgaggcctctagagcagaatttgtttctgatgtcatcgccatttcaagccctggcagtgatcgtggcatacttttattttatttatcgtttaggtcctcgacttatgcaaaatcgggaaccttttgacctcaaacgcatattacttgcgtacaacttggcgcagatagcagtagacgcgtttatagtagacgtggcttttgacgaagtatggtttaacatatattggcattgcgaagagatgagctatggacgt

SEQ ID NO: 3519 - DNA, 604 bp, Diabrotica virgifera
  unsure (1)..(604): unsure at all n locations
  Clone ID: pGUT3454
attcggcacgagagtacctgctccatggaccgaccctgaagttgccaagaaaactagagcaatctgggaagaagttggacaaactccagtttccctcaccaaggaagttcccggatttattatcaatagactacagtacgccgtccttaatgaagcctggcatctagtaactgaaggagttttggacgtaaaagacgtcgacaaagtcatgtctgaaggtttgggtatgagatatgcctttttgggtactttagaaaccactcacttaaacgaacaaggttttgtcaactactgtaagcgatatggtgatactatctacgctgtcagcaaagattttaaaccaacaccgaaattcgagggaccacatgttcttgaaattgcaaagcagctggaagctgatgttccattagataaactacaggaaagaagaaactggagagatctgtgcctcaccaaactgagtcagctaaagactgagatgaataaacttaaataatttgtctttgttctattaaattcattttcaaatatattattataataataatgttataaagaattgacaaacatgcaccacanaaaaagtaaattgacaatctaatga

SEQ ID NO: 3520 - DNA, 426 bp, Diabrotica virgifera
  unsure (1)..(426): unsure at all n locations
  Clone ID: LIB149-049-Q1-E1-H7
ctgaattccaagctatgttggcccgtcaaatggctaacaagccaaaacaaaccttcattggaaaacacgtagaagatcccaatgtccaagctgcagatgaagttgattggagatcaagcgctgacttgggagtcaaggatcaaggaaactgtggatcatgctgggctttcagtaccaccggatccctcgaaggtcaactcgccatccacaaaaatcaacgtgttcctctcagtgaacaagaattggtagactgtgacacagtaaatgctggttgtgacggaggtttgatgacagatgcctttaactatgttaaaggccatggtccctcttccgaatctcaatatgcaaacaccggcagagatggtcgctgcaagaatgttcagaacanacaagtctcttccatcagtggctacgtagaacttgcaa

SEQ ID NO: 3521 - DNA, 414 bp, Diabrotica virgifera
  Clone ID: LIB149-037-Q1-E1-D3
atgacacgtggggggaagactagatggcagtcccattccaaaatacaccataaagcctgttgctggagaactggaatcattactgagcaagccaatccacttcttacctgactgtgttggttccgatgttgaaaacgagtgtgctgatctcaagcctggttctgttattttgttagaacacttgagataccacattgaagaagaatggaagggtgtagatgccagtggtaacaaagttatagcagatcctgccaaagtcaaagcttttagagaaagtcttcgtaaattgggagatgtatacgttaatgatgcattcggtacagcacacagagcccattcgtctatgatgggagaacgatttgacaagatagcttcaagatttttgcctaaaaaggaactgcagtatttcgctaa

SEQ ID NO: 3522 - DNA, 409 bp, Diabrotica virgifera
  Clone ID: LIB149-023-Q1-E1-E6
agccattatggatgaagttgtgaatgtcactggcaaaggagccatcactattattggtggaggcgatacagcaacctgcgcagccaaatggaagaccgaagacaaagtatctcacgtttcaaccggaggtggtgccagtctcgaactgttggagggaaaagttcttccaggagtcgccgcgttatctgatgcctaagaaccatcgttttcttcagacgtttctagaagaactcagaccaaacgttactcatacatattccaaagtctgcataaatctgtgttcaacatgggaagacgcgttatcaaatttgtggtctgaggataaattcctgcaaaattttgagtgtctgttactgtatgttcatataatgttccacaatttatttatgtagatatatttcatttgttt

SEQ ID NO: 3523 - DNA, 417 bp, Diabrotica virgifera
  Clone ID: LIB149-047-Q1-E1-F8
acaacaatctatagtgactcgtactaacgcgtggggtactgagtacccaacagttagtagattgttccggtgattacgacaatgaaggctgcaatggtggttggccccattgggcatataactacattaaagatcatggcctctgtctagagtctgactacaagtatcaaggattagacggtgactgcaaacagtgtaatccggttatcaaaaccatcaatggctatgcatctgtagatcaaaccgaagaagcacttaaggaggctgtaggtactgttggcccaatatcagtatgtgtcaacgctaattgggactggcaactgtatagcgggggtatccttgatagccaaagttgtccaggcgacattttaaaccatgcagttttagctgttggatatggttcagaaaatggtaaag

SEQ ID NO: 3524 - DNA, 310 bp, Diabrotica virgifera
  Clone ID: LIB150-004-Q1-E1-C5
agtaggacattaccaatcggtctagcgagtctcttcatgttttattaaacgaattacagtatgcaacaaaataaacagtctatctatctaatgagccctaaacatccattcttggatataagcctcctcttccttcttccatgcctctctatattgggcaatttgcatccaatttgacccagtgtgtttcttcaggtcatccgaccatcgcatctgtggccttcccctttttcgtttgtggttccacggtctccattgtataatcatcttagtccacctttcatccttctgccgtagggtgtgtccggcc

SEQ ID NO: 3525 - DNA, 397 bp, Diabrotica virgifera
  Clone ID: LIB149-037-Q1-E1-C5
gttaaattgagcgagttcaaaaatacctggtatgttaatattagagagtactacaatgctgacggtgaacttaaacctggtaaaaaaggaatcatgctaaccatggaacagtggcagaaattcaagggtttcgttgacgaagttgatgaagctattaagaaaaatgtttagatgtacctatatgttttcgaggaatttgcagttacaaaaaagtgcatttgattttatacttaatgtttgtttagttatattttgataaattggttgttgcgttttatgtaaaagggtttatgttaggtttcctatgtttttataaaacattggtttgtaagttttgtggcaatgttcctctgacttgtttaaaatgatttgttttgtataagctgtgcttttgaat

SEQ ID NO: 3526 - DNA, 397 bp, Diabrotica virgifera
  Clone ID: LIB149-048-Q1-E1-B3
aggacgcgagggcaatatttgaccggatgtaaaggaattagcgaacaaaccaccactggagttcacaacttgtacaaagtgtacacggaaggtacattgaatgttccagctatcaacgtcaaccattcagtcacaaagagtaaattcgacaatctgtactgctgtaaggaatctctcatcgatggaatcaaaagagcaacagatgttatgctcgctggtaaagtcagtgtcttacctggatacggatatgtaagcaaacgctgtgcacaatctttaagatcatttggtggacgagtattgatcacagaaattgaccctatcaatgctttgcaatcagctatggaaggttacaaactcaccacgatggaagaagcctccatagaagcccaaatctacg

SEQ ID NO: 3527 - DNA, 451 bp, Diabrotica virgifera
  Clone ID: LIB150-022-Q1-E1-H6
cggggccacccacgaatccggactagtcaagtatttttcctgcgagtgctaagagtcatcgttcaaatcaggaactctattaaggaaaatttaaaatcagctgagaccgctacatacgaactaccagcacttagtgagcaattaaatagtttaacgagtttttgggaaactttaagtcagtgtctttctgaattagagcatgctccagatcatcatgctgttcttgttttacagcctgctgttgaagcatttttcttagtccattctccacaacaaggccctattaaatcggaagagaaagataccgccaaagagactgaaatggaagaacacagtggagaatcaaccgaatcacaaggtagtgttccatccacttcagatgctgctgcacaagctacagttactcctgctgaagaagaacagcagccttcgagacctgctagtgaaataa

SEQ ID NO: 3528 - DNA, 417 bp, Diabrotica virgifera
  Clone ID: LIB149-044-Q1-E1-B5
acccacgcgtccgtaattaagcaaaaataattctttaaaaatttgatattaaatttataataatacaaaatgaatcgtttattcggaaaaggaaaaccaaaggaaccaggtccaagtataacagacgttatatcaggggtggatcaaagagctgaaggtgtagagaaaaaaattaatgccttagaaaatgacttgcgtaaatttagagaccaaatgtctaaaatgcgagaggggcctgccaaaaatgctgttaaacagaaggccctcaagattctcaagcagaaaaagatgtatgaaggtcagctagagaatttaagggggcagtccttcaacatggagcaagctaactttgcacatcaagcattgaaagatactcaagtcacagtagtagctatgagagatggtatgaaagaaatg

SEQ ID NO: 3529 - DNA, 453 bp, Diabrotica virgifera
  Clone ID: LIB3026-023-Q1-E1-D11
ccacgcctccgtaaaggaagatgcagtcaatgcagtaaatcctcatctatacaccatagccaccttgactggacacgctcatagaactgttggcgaaggttactcaattgctatggacaatgggccagcgaaaaaaacacagaatgcagaaaagttgcaagctgctggagacaagatcggagacatgtttgaaatttccagaattcgtcgagatgattttaagcatcacaaaggagaatgcgaaggagacgatttgatccaaagtgctgcaaaaccatcgacgctggtttcgagaggacatcaaggtcctggagcatttctcatggtggcttcgggtttggacaagcatggctcagcaagtgatgtgcctctaaggtacactcatctggatatagcaggttcccccggtacctttcctcttcctggaacaggtgctccagtactcgcattggc

SEQ ID NO: 3530 - DNA, 485 bp, Diabrotica virgifera
  Clone ID: pGUT2698
gtataacagattatctatgatatcgttataaattatttaaattttttatcatataatttagaagccttttctccaccccaagagggtccgagcatcgttgaaacaatggcacccttagcagcaaaagttatcccaaaagcaaatgaagtggaagaaggaataagagctgtattgctgggtccaccaggctctggtaaaggaacccaggctccattacttaaggaaagatactgtgtctgtcatctctctactggagatatgcttagagctgaagtacaatctggatcatcattgggaaagaaaatccagcaagtaatagatgaaggcaaactagttaatgatgaccttgttgtgaacatgattgataagaacttggataagccagagtgtcaaaatggtttcctccttgatggtttttcaagaactgtagtacaagctgagaagttggacgacttgcttgaaaagcgcatctctcaacttgatgc

SEQ ID NO: 3531 - DNA, 395 bp, Diabrotica virgifera
  Clone ID: LIB149-011-Q1-E1-B2
cacacgcgaccgatactctcattcttaaaggtaaaggtaaaaaggaagacattgacagaagagccgatcatctccgtgaccaaatcgaaaccacaacttcagagtatgaaaaggaaaagcttcaagaacgtcttgccaggttagcatcaggtgtagcagtattaaaagtcggcggaagcagcgaagtagaagtaaacgagaaaaaagacagagtaacagatgctttaaatgcaacaagagcagctatcgaagaaagtattgttcccggaggtggtactgcacttttaagatgcagtcctagtttggatgcactcaaacctgcaaataaggaccaagaagtcggtatacagattgtaaagagagctttaagagtaccttgcatgaccattgctcgt

SEQ ID NO: 3532 - DNA, 455 bp, Diabrotica virgifera
  Clone ID: LIB150-001-Q1-E1-E4
ggctaccgtcacatcgattgtgcccatgtctacggaaacgaaccagaagtaggagctgccttgaaggccaaacttgccgatggtacagttaaacgtggagacatttacatcaccagcaaactctggaacactttccacagacccgacttggtagaaccagccgttaggaccacattaaagaacttgggtcttgaatacttggacttgtacttgattcactggccttttgctcttaaggaagacggagaccttttcccagtaaataccgatggcagcacagcctacagtaccgtggattacgtggacacatggaaagccatggaggctctagtcaaaaagggtcttgtcaaatcaattggtatttccaacttcaacaaacgtcaaactgaacgtattctcgccaactgtacaatcaaaccagttaccaaccaagttgaaatccacccatacttaaa

SEQ ID NO: 3533 - DNA, 361 bp, Diabrotica virgifera
  unsure (1)..(361): unsure at all n locations
  Clone ID: pGUT371
tgcatgaggctgctaaagctttggataaaagacaagccgtactttgtgtgctcgctgaaaactgtgacgagcctatgtataagaaactagtctcagctttatgctcagaacatcaaattcctcttattaaggtagacaataacaaaaaattaggcgagtggtcagggttatgcaaaattgataacactggtaaagcacgaaaggtcgttggctgttcctgtgtantcattagggactatggagaagataccccagccctagatgttcttagggattatcttaagaatgctnagtaatgtttcacattttgtatttaataaaatttaagattcacaacaatataaaaaaaactcgatggggg

SEQ ID NO: 3534 - DNA, 304 bp, Diabrotica virgifera
  unsure (1)..(304): unsure at all n locations
  Clone ID: LIB149-026-Q1-E1-C3
aagcgtccgaagttaatccttccaatatggttccgcaattaggctaaaggtccactacacaccttcattggaaaacaggttgaagatcccaatgtccaagctgcagataaagttgattggagatcaagcgctgacttgggactcatcgatcaaggaacctgaggatcatgctgggctttcagtaccaccggatccctcgacggtcaactcgtcagccaganttatcacagtgttcctctcagtgaacatgaattggtagactgtgacatagtagacgctggttgtgaccgaggtttgctgacag

SEQ ID NO: 3535 - DNA, 403 bp, Diabrotica virgifera
  unsure (1)..(403): unsure at all n locations
  Clone ID: LIB3026-013-Q1-E1-A2
atttacataatggcgaacgcaattgctttaaatgatcaagaacagtttgctgagtttaaacaaaagttccagaaagcttacgaatcttcagacgaggaaaacaataggtttaagatattccaagacaatttgcgaaaaatagaagagcacaataaaaaatatgaaaagggtgaaactacatataccatgggtgtaaatcaattttctgatttgtctcctgaagaatgggctaatagaaaccatggatataggccaagaccaaatcatcaataatacaaaatgttattaaaaatgaaaaaaattctcttatttgaaatgaaatcttctgttcctactttaaaccaaaaaccaattttattattgatgtactccaaatacttttaataanatagtatacatatac

SEQ ID NO: 3536 - DNA, 427 bp, Diabrotica virgifera
  Clone ID: LIB149-041-Q1-E1-F5
actcgtgggtcgatacaagcctctaaaatgattcggtacgaagcaatgttatttgaaagagccccgtctgtttcttctcaacacgagaagcttttaaaattatccagggattcagatgatgaagatcaaaatattgtcaataaagaacaagacatccttaatcttggtgagaaatataaaaaggagggcaaggcataggaactcgcagagcttataaaggccaccaggccttttttgagtttaataagcaaagcaaaagctgctaaattggtaaggtctctagttgactacttcctagatttagaagctggtattggtatcgaagtacaactctgcaaagaatgtatagaatgggcaaaggaagagagaagaacttttctacgtcagtcccttgaagccaagctgattgctccttagtttgagaccg

SEQ ID NO: 3537 - DNA, 374 bp, Diabrotica virgifera
  Clone ID: LIB150-030-Q1-E1-E2
gcaaattggaaattaaattttggtaatccaatggtaaaccttataataataagtgacgtgtccctttgaaaaatctgaaaaaaggttttttaacacatttaaacctttaattgatacgagtaaggtgcagcatgctgttcctccatcattctggaattatgtaacaacttttctgaattacggaacaatggtggagattggttgatcaaaatttatgctccttggtgtggacattgccaaagattggagcctgtatgggctgaagtgagtgaagcacttgatgactcaaatattcgagttggccgagtagattgcagtcaatatccagccattgctaccgaatttggtatccgtggatatccaacaatcaagtt

SEQ ID NO: 3538 - DNA, 486 bp, Diabrotica virgifera
  Clone ID: LIB150-031-Q1-E1-G5
tcgcgggtcgacacaagactctatagaaattcatactattttgcttcagaattccaagttacaggtctgcaattcttcgtagcagccccgtcgtggtactgccgattgtgcgatgtttggatcggagatctgcattgtgcttctcatcatttaaaatcaaaagtccatcatcaaaactttgagatatttacgactcagaatccacattgggaaatggaatggctgaaggatcgggaaaagtccatgaccagaaaaagagacgaagcttcttcttctgattccgacgattcagattctgaccgaaaacacaaaaagaaatccagcgaaagctcatcagccaaagataaaaagaagaaaaagaagtcgaaaaagaagaaaaaagcaaagtcttcggattccagttccagttcttcgagctcagatagttcggatactgatcgtagtaagagtatcagagtggccatgcgcaatatgaatgagaaatgg

SEQ ID NO: 3539 - DNA, 430 bp, Diabrotica virgifera
  Clone ID: LIB149-044-Q1-E1-A6
agatagtttctagttggggcattcatcatataggggagaaagttgaagttactggtgatattaaatttgatatatttgtattaggcagtgttgcagtttctaaagatggatatcgaattggtaaaggaggaggatttgttgatttggagttcgctatttataaggaaatgaaagcaatcactgaggataccattattattacaatcgttcatgattcgcaggtatttgacactcttccccaagaattatttaaaacgcacgatattcctgttgatgtcataataacgccaacccgcgtcataacgggtggaaaataaattgtcaagccaagtggaataatttggaatgaaatgaccggcgcacagattagaagcagaaaaatatgcagactttaaaaacaaaatgtgaaagcgaaggaagggatacaaca

SEQ ID NO: 3540 - DNA, 399 bp, Diabrotica virgifera
  Clone ID: LIB150-012-Q1-E1-A3
attataattttgcttccgaaatgtctacaaattctctagaaaatgagatcgacaaaaacgaacagaaaaacgacaacgatttagaaatacccatggacttttctataaaacatcccttacaaaatgcttggactctatggtattatgaaaatgatagaacccaggcatgggagaaaaaccaaaaagaaattgccactttccaaactgtggaggacttctggagcctttacaaccacatcaaaccttcaagtgaattaaggcaaggaactgattattccttattcaagaaagggaattagaccatgtgggaagatgatgccaataaacgaagaggcagatggctgctcagcttagaaaagaaacaaagaaacaatgatctagatagatactggttagata

SEQ ID NO: 3541 - DNA, 376 bp, Diabrotica virgifera
  unsure (1)..(376): unsure at all n locations
  Clone ID: pGUT654
ctgagctggaaaataataatgacgaagaaccaaaactcgtaataatagatttcgaatactgctcctacaactacagatctttcgacatcgcgaatcacttcctagaatgggtctacgactacaccctcaaagaataccccttctacagcgaggatcacagcaaatatcccacagaaaaacaaagactggcgtttattaaagcctatttgcgtgaaaggggttcacgagagaacccgaagaaaattcttaaagaagtggaggtgtttcacttggcaccgcatctcttctggagtgtgtgggcgtnaattaatgccgaaacttcaagtattcctttcggatattgggaattcgcaacaacagactgaacagctatttc

SEQ ID NO: 3542 - DNA, 424 bp, Diabrotica virgifera
  Clone ID: LIB150-037-Q1-E1-F5
agtacattagtaggagtaccacaacctgaaataaaatggttctgtaatggtagacgtgtaactgaaaacgtcagtattgtgtcaacttctgagctatatacttacaaaaccactctaaaaatcaagaaaatcaagaagactcaggaaggcaagtttaagatagtcgccaggaacagggaaggagaagcctcagtaacatttactctgaaagtaattacttcagagaaagaagcacctgaggtcttatcacctctagaatctattaccgtaaggaaaggagaaccagttacactttccactactatatttggaaacccggaacctactatcgaatggttgaaggatggtaaacctttaaccagaccaaaattcaaaaaagacggaaacacatacactttaactaatcccaagacatctacagatg

SEQ ID NO: 3543 - DNA, 410 bp, Diabrotica virgifera
  Clone ID: LIB3026-001-Q1-E1-B10
agcttttgtagccgttttagcctatgtaagaagcgatgattcgtcgaagaaaggcccaaaagtcaccgataaggtttggtttgatatcaccatcggtggagagcccttaggtcgtattgaaattggattgtttggaaaaacagtgccaaggacagtaaagaatttcagagaattagcaactaaaccagccggtgaaggatacaaaggcagtaaattccacagggttattagagatttcatgattcaaggtggtgacttcactaaaggagatggtactggaggtcgcagtatttacggagaacgcttcgccgacgaaaacttcaaactgaaacatttcggtgctggttggctgtcaatggctaatgctggaaaggacactaacggttcacaatttttcatcaccacgaaac

SEQ ID NO: 3544 - DNA, 428 bp, Diabrotica virgifera
  Clone ID: LIB149-035-Q1-E1-H2
ctctgagaaaaatgaagttagtttggctgccttttaatggtttttgaccttgttggcccttgaagctgcagatggagacgatgaatttgctaactacacaataaccaaccgcaaatttccaaaaggttttacttttggtgttgccacggctgcttaccagattgaaggagcttggaatttggatggaaaaggagaacaggtctgggatactttcttccacgaacatcctgaccgcgtagatgatggaactaacggtgatgtcgctactgattcttaccatctttataaagaagatgttcgttgtatggaagaagttggtgtggactactatagattttcaaatagcttggtccagaatccctactgacggaacccttgacaatgttagtcaagaaggtgttaactattatgtaaatttatttaaggaa

SEQ ID NO: 3545 - DNA, 430 bp, Diabrotica virgifera
  Clone ID: LIB150-026-Q1-E1-H6
acgcgcgggtcgatacaccccccaaaattgagtcatcttacgcatatgttgaaggcgaatctctactaatggccctgaaagacgtagccctttctagtggatcagcgtgcacttcagcatccctggaaccttcatacgttctacgtgcgatcggaacagatgaagacttagcgcatagttctatcagattcggcattggccggttcaccacagaagctgaagtagattacaccgctaaaaagtgcattcagcatgtaactagattaagagagatgagtccgttgtgggaaatggtacaagagggtgtggacttgaagacgattaaatggtcgcaacattaattgaatgagattgtactctgaataatgaattactttatggcgtaaaaactgttacgggttgtaattattagatgttagtgtttaatttt

SEQ ID NO: 3546 - DNA, 290 bp, Diabrotica virgifera
  Clone ID: pGUT399
tggatttcgtcgtctcgtcataagttgaaatacaagtgaaaatatttgtgatatttagttttagtgtgccaaaataaaaatggatgacgaccaacaattttgtttacggtggaacaaccatcaatcgacattggtagccgtttttgacacgttattggagaacggcacattagtaaactgtactttggcagcagaaggaatatgcctaaacgcacacaaagtagttttgtctgcatgtagtccatacttcgaggcgctgctgtcaaagcactttgacaagcatcccattc

SEQ ID NO: 3547 - DNA, 346 bp, Diabrotica virgifera
  unsure (1)..(346): unsure at all n locations
  Clone ID: pGUT1275
gtttcatcatccgacgacggccagtggtcagagggtctaatatcagctgccaggttagttgcagctgcaacacacagtcttgtagagagtgcaaatgctctagttcaaggactgggcagtgaaaaaaagctaatagcggccgctaaacaagtggcgagctctactgctcaacttttagtcgcatgtaagggtaaagcagaaggtgatacanaagcaaccaaaaaattgcacgctgctggtaatgctgtaataagatctaccgataatttggtaagggccgctcaacaagcgaaaagtgtggaaaaaaaagatacttaattttgaataaaaaaatggttggtggaat

SEQ ID NO: 3548 - DNA, 400 bp, Diabrotica virgifera
  Clone ID: LIB150-026-Q1-E1-B9
gactcaagggtcgatacaccactctaaactgcgtcgcatgagatagcgaaggtaggacgtgttaggtgttagtagctcttaggctaagtataatattagttttttaatttatcggcacacaggcagttctaatggagaacggtgaagatttttcaaaagatgtctcagcagagcatcaaaatggatcaggtgatgctccagccgatagtggaagtgcagaaacgcccggccgtgacgatgatagaaaattatttgttggtggcatgtcttgggaaaccactgatagggagttacgagaacattttggccaatatggcgaaatcgaaagtataaatgtaaagacagatcccaacactggtagatcaaggggatttgcattcatagtatttaccacaacaga

SEQ ID NO: 3549 - DNA, 383 bp, Diabrotica virgifera
  Clone ID: LIB3026-005-Q1-E1-D10
ggcagcagaaggaaaatgcctaaacgcacacaaagtagttttgtctgcatgtagtccatacttcgaggcgctgctgtcaaagcactttgacaagcatcccattcttattcttaaggacgttaagttccaagaactaaaagccatgatggactatatgtacaggggggaagtgaacatatctcaagatcaattaggcgcgcttttaaaagccgctgaatctttgcaaattaagggtttatcagacaataggaaaggggaaactgaacgaaaacccactcctgctcctccaccaaagagcccacagccaacgaacctggcgaaggtccacggttttacaattgagcaaagaactcgggaagattccagggaagggaagcatgtca

SEQ ID NO: 3550 - DNA, 339 bp, Diabrotica virgifera
  Clone ID: LIB150-036-Q1-E1-H5
ttcaaaaataaggatccgtttttctcaaccgcgtagttggagaatgctggtttatgtattctcacaatgtaaggctcggtttgaacactcccagagaggcatttgaatgttcggacattgacaagaaatgtcccttcactgggaatgtgtcaatccgtggccgtattctcactggaattgtccaaaatatgaagatgcaaaggactattgtcatccgtagagattatttgcattatatcaggaaatacaatcgttttgaaaagaggcataagaatatgtttgtacatttatcacccggcttcagggatgttgaaattggggatgtagttacaattggtg

SEQ ID NO: 3551 - DNA, 432 bp, Diabrotica virgifera
  Clone ID: LIB149-036-Q1-E1-D12
cgcgcgggtcgatacaagactctatagtgagtcataagaatgacttggaagaaaggcaaaaacgtcaagactacgatcttaaagaattgaaagaaagacaaaagcagcagttgagacacaaagccttgaaaaagggtctagaccctgaagccctcacaggcaaataccctccaaaaatccaagtagcctccaaatatgaacgtcgtgtagacactaggtcgtacagtgataagaaacatctctttgaaggaggatttgaaaatatcgttaaagatctcaacgaaaaatcttggaaagagaaatttggacaattcgactccaggcaaaaaacaagacttccaaaatggttcggtgaaagaccaggcaagaaatctggtgacccagaaactccagaaggtgaggaagaaggtaaacaagctgctgatgatgatg

SEQ ID NO: 3552 - DNA, 403 bp, Diabrotica virgifera
  unsure (1)..(403): unsure at all n locations
  Clone ID: LIB150-036-Q1-E1-E3
aggggaaccaaaaaggtcaaagcacaaggaatgggagttcattcggcggaagaaattaacgaattcggccaggaggatttgaaagtgctgtcagaaatgttagccgacaaaccattcttcttcggagacgaacccactacattggacgtcgtcgttttcgcacacctggctcaaatctacttcatcgacaaagaagtgagctatccattgagagatttcatgacagaatcctgccccaacttggtcggtttggttaaccgtatgaaggagcgatgcttctctgactgggacgacatttgcacaacattggacttgaattctcatttacccaaacccaaagcggaagaatcaaaagacaacaaagaggaaagcaaagacgagaaaganagtgacaaagaaaaag

SEQ ID NO: 3553 - DNA, 434 bp, Diabrotica virgifera
  Clone ID: LIB150-042-Q1-E1-C6
accacgcgtccgcccacgcgtccgggcgattatcaagtaacacaagttcaacaagatgctcttggggctgtccagctagagttaggaggaaatcccaacactctagcattacgccggccgttcgaccctttggcccatgatttggaagctagtttcagattgacgcgattcgccgatttgaagggccgtggatgcaaagtaccccaagaagtacttaacaaacttgtagaggggctccaacaggattataattcggcagaacatgaacatgctcactttatgcatatggcaattccgcgaattggaatcggccttgattgttcggttacaccccttcgccatggaggactgtgtttggtacaaaccactgacttcttctatccattggtggatgacccctacatgatgggaaaaattgcttgtgctaatgtttt

SEQ ID NO: 3554 - DNA, 398 bp, Diabrotica virgifera
  Clone ID: LIB149-024-Q1-E1-B10
acccacgcgtccgcccacgcgtccgcccacgcgtccgcccacgcgtccgttcagtagaattttatcggctgctttttattataatttgctattaattttgtgagatggagtatacattttgtttattatttctttgggtaggaagtacaacgtcggcaaaacttcctatgtatgatttccccaaaaaattctcgttcggcgtagccacgtcagcatttcagatagaaggtggttggaatgcttccggaaaaggagtgagtatttgggatcaccttgtacatgatacgaacgaaatcatcgtatatgggtcaaacgccgacgttgcttgtgattcttacaataaagttgattatgatattctattgttaaaagcccttggagtaagccattaccgtttt

SEQ ID NO: 3555 - DNA, 406 bp, Diabrotica virgifera
  Clone ID: LIB149-004-Q1-E1-H10
aaaaaggcatttctgtaaacctacatcaaccgctattgcctctacaggagagatcttcattgctgacggatactgtaactcaagaatactcaaatataatgctgctggtgttttacttcgaatatttcctactgcaccagaaattctatcccttcaagtgcctcacggactggccctcatagaatcattggacaggatttgtgttgctgacagagaaaatatgcgggttgtatgtcctagagcaggattatacaccttgcaaggaaagaaggaaccgcctctaacgatcactttacccgatatgggacgagtctttggagtttctgccaaaggcaagctcgtttacgcagtgaatggccccacgtccactcttcccgtccagggtatgaccatcgacccacagaca

SEQ ID NO: 3556 - DNA, 404 bp, Diabrotica virgifera
  Clone ID: LIB150-033-Q1-E1-B6
gtggggctatgcgaagatgtcgtcattccggtgtcagagtcatcgttcccccaagatgcgcttctagtcctacaagaattacttgccgctacgtcagacctcaaagaactccaactccaccaccactgatggaaggggaagcactggctagcagactgctagagcttggtcctgttggcgctaaattcttaggaccagtgatacttgaagtgccgcattttgcttcactaagaggtaaacaaagggaaataatcgtcctgagatccgacaacggtgaaacatggaaagaacatactttggaggctagtgaagaagctatacaagatgtattaaatcatagttttgatggagaagaacttagtcagatagaagatctacacaccagtcgcataactcgcatccta

SEQ ID NO: 3557 - DNA, 444 bp, Diabrotica virgifera
  unsure (1)..(444): unsure at all n locations
  Clone ID: LIB150-044-Q1-E1-A4
aatgagaggttaacgttaaataaaaacgactgaaccggtaaaacgtanaaattaaaaatgttgcgagccattagaaatacgattaacgttgtacanaaatgtaattacagtgcatatgctctacctaaacctcaaccaaacccaaatgtcctgtattctgggattttcatcaataacgaatggcacaaatccaaatctggaaaaaccttcgagagcataaatccctcgacggggcaggtaattacggaaattcaacagggatccaagcaagacgtcgatttggcggtggaagctgccaatgaagccttcagattcggctcgacttggagaacaaccgatgcatcggaaagaggacgtttgttgaataaattggcggatcttatggaaagggatggcgcttatttggcaagtttggagacattggacaatggcaaacattcacac

SEQ ID NO: 3558 - DNA, 399 bp, Diabrotica virgifera
  Clone ID: LIB150-046-Q1-E1-G8
acccacgcgtccgcccacgcgtccgtttctcagtcaggtaacttcgaaatggaacttatcttaggagatgctttgatcaccaatcctattcgctggggcttgggcactattgaggttaatttggggccaaatgctaaagaagatgttaaagtagtcagaggacccaaacccgagatccagcatttattccgccctgcagaaaaaagaccaccagaagcagtgtctctattcttcactgctttaactgcagctccatttttgatccttctaatttgctggggaagaattggaatcaatttaagaaactttacagtactagcgttacctttccactcaggttttggatctatattggcactattcactctattctggttgaagttagatatgttcatgaca

SEQ ID NO: 3559 - DNA, 388 bp, Diabrotica virgifera
  Clone ID: LIB149-040-Q1-E1-H1
agttccacaggcagtgtgttgggtccggtcctatacctactatacacgtgtgatatacctgtactggaaaacaacacagttgccacctttgctgatgatacagctattcaagcagtagggacgacaagtgaagaggcgaccaacaaggtccaaatagcagttaaccaaatctataagtggacacaaaaatggagaatcaggctaaatgaagctaaatctgtccatgttaatttcaccaacaaaaaaatacaatatataccagttataatcaacaatatccaagtaccatatgcagatactgctaagtatttgggtataacattagatgcaaaactacgctggaaggtgcacgttaagaaaagaaagggaagaactaaatataagatat

SEQ ID NO: 3560 - DNA, 464 bp, Diabrotica virgifera
  Clone ID: LIB150-031-Q1-E1-C2
tacacaagactcctactaacgcgtgggaaaaatgtcttcaatcggcggcgataacgacgatgcattcatcgcaaagttgcggggtttaccttggtcggcgactccagatgatattcttaatttttttgacgattgcagtattttggacggaaaagatggtgtacacatgactacatctacagaaggacggcctagcggtgaagctttcgtagaattcgaatctgaagaggatttagagacagctttgcaaaaggatagagaacacattggaaatacgtacattgaggtttttaaggtgaacaacgctgaaatggaatgggtggtaaaacggtcaggcacttcatctggcttgaacgatgatggatgtgttaggcttagagggctaccctttggctgttctaacgaagaaattgctcaatttttcacagggttggggaatgttcccaacggactaaacccttctc

SEQ ID NO: 3561 - DNA, 219 bp, Diabrotica virgifera
  Clone ID: LIB149-032-Q1-E1-C11
agggattatctggataacggcatcttggtcgtaggttatggtgaagaaaacaacgagccctactggattatcaagaactcatggggtgcagattggggtgaagaaggttacttcagattgaagagaaatgctaaattgtgcggtttgtctttaatgacaagttatccagttttgtaaacataagtattcttactcttataatagaataaacattttgat

SEQ ID NO: 3562 - DNA, 291 bp, Diabrotica virgifera
  unsure (1)..(291): unsure at all n locations
  Clone ID: pGUT1924
cgccgttaatcaatttgccgattggtccaacgctgaatttaaagctatgttagactctcaaatggctcagaggccaaaactattggttgctgaaacattcgaagccgattctaatttacaagttccaacagaggttgattggaggaataaaaaggctgatttgggagttaggaaccagggaagctgtggatcctgctgggctttcantgccgtcggagccatcgaaggtcaacttgctattcacaaaaagcaacacgttcaactaagtgaacaagaattggtagattgtga

SEQ ID NO: 3563 - DNA, 332 bp, Diabrotica virgifera
  Clone ID: LIB3026-006-Q1-E1-A5
cacttagattcaagaaggcccatgtcacccatccagaacttaaagcaaccttctgtttacctatcattgatgtcaagaagaatcctagttcgccgatgtttacaagtttaggtgttattactaagggtacagttatcgaagtcaatatttcggaattgggtttggttacgcaagctggtaaagtagtttggggaaaatacgcccaggttaccaataatccagaaaatgatggatgtattaatgctgtactgttagtttaagtctgttcttgtaggttaggtgttctttataataaaaatttatatttttgaaaaaaaaaaaaacaaattaaa

SEQ ID NO: 3564 - DNA, 404 bp, Diabrotica virgifera
  Clone ID: LIB149-048-Q1-E1-G2
aacagctcataaagaatccttacagaagcttcagctggactatgttgatttgtacttggtgcattctcccatatacatgaaatttgttgaagctggaaagccaatggaacctctacctactgaccatctggctgtttggaagaaaatggaagagcaagtagatgcgaaaagaaccagaaccatcggtctctccaacttcaacgtaaaccagatcgacagaatagtgaagaattgtagaattcaaccagccaacactcaagtggaactgcacgtttactaccagcagaaaaaacttagagattattgcaagaagcacaacatcgtcgtcgtatcttacggctcactaggatcacctggattaaacgtatttatgaaaagactcggcaaggaagtacaaatcccca

SEQ ID NO: 3565 - DNA, 315 bp, Diabrotica virgifera
  Clone ID: LIB3026-018-Q1-E1-B2
acgctacaaagagatcgaagaagaaatagcctttctcagctgatgatttacattcttccccagctgataatatagctgaaactactcatgatggagctggggacaatgatgggggtatggatgataactttgatttacatatggactttagtcccccgatcacgaacaagaccaagaaacctaagagtttacacgaacttattgcacaaactgaggacaacgatgatgatcaggagaatgtacatgaaaattcaacacattgggtcaattccgatcgggactacacatatgacgaattactaaaccgtgcctttg

SEQ ID NO: 3566 - DNA, 398 bp, Diabrotica virgifera
  unsure (1)..(398): unsure at all n locations
  Clone ID: LIB150-045-Q1-E1-B3
gttacaacagccgggtggtgtcgggtttcaatgatttggggattatatactaactaatattaaatctaacacagattatcaaaatgttgaatttaaaaatgatttctaaatttgcgcctcttaaatcaaggaatgcggaagttagcacattacttaaagccttaccagcagcatgcaaccagctccagggaaggacttacgcggatcatgtcattccagacagactaaaggatatgcctaacaaccctaatcctaagtttttcgacatggttgaatatttcttccacaatgcctgcgttttagtataggataaattggtggaagacttgggaaacgttaagggattcangttgaatttggatcaaagaaaagccaaagtaaaaggtattttaaccttc

SEQ ID NO: 3567 - DNA, 289 bp, Diabrotica virgifera
  Clone ID: LIB3026-015-Q1-E1-E5
tacggtcgaattccggggcgcccacgcgtccggatagctattgctgctgttactgatgttgagttcaaggaagccaagaccatcaaagaatacatcaaggatcccagcaaatttgctgctgctgctgctcctgtagctgcagccgccgctgcaccagctgccgagtctaagaaagaagagaagaaggaggaatctgaaagtgaagatgacgatatgggcttgggtctctttgactagaaagttttatatttttgatacgttatttgctgttttgtcgagtcagactgtc

SEQ ID NO: 3568 - DNA, 225 bp, Diabrotica virgifera
  Clone ID: LIB150-005-Q1-E1-H9
gttaaatataattatcatttaccggtaaaatgggacaggtcgcacttttgaaagattaagggaatcaagcactttccgcaaataagatatatgacgcacttaaatattacactgaagcaattaacctagatccacagaatgccgtcttaaattcgaatagatctgctgcttatgctaaagcgaatcaatatgatctacccctaaaagatgctgaaaaagctgttg

SEQ ID NO: 3569 - DNA, 443 bp, Diabrotica virgifera
  Clone ID: LIB3026-005-Q1-E1-A10
ggcaccatcgacaaagccaaacagagatccaatccactctgtccaagtttttggcagaaagaaatcagctacagccgtagcttattgcaagagaggtagaggagtcttgagggtaaatggcagacctctcagccaagtggagcctaaaatgctccaagacaaacttcaagaacccattcttcttcttggaaaggagaaattctctgctgttgacatcagagttagagtaaatggtggtggacatgtttcccaaatttatgctattagacaagctatctcgaaggctttggtagcttactaccaaaaatatgttgatgaagcatcaaagaacgaattgaaggatatccttatccaatatgaccgtaccttgttggtacctgatcccagacgctgcgaacccaagaaattcggtggtccaggtgctcgtgcccgctaccaaaaat

SEQ ID NO: 3570 - DNA, 324 bp, Diabrotica virgifera
  Clone ID: LIB149-035-Q1-E1-H10
gtattaaaggttaccccttcggcaaagtccactatggggacatagttttccaaccgggtcaaggtaccaacgcctacatcttcccaggagtagctttacgagtaatcctcgcgggaatccaccagattaacgaacaaattttcttgatagcctcagaaacagtggccaataacgtttcagatgaagaccttaagagaggtagtttgtatccacccctaagttcgatgaacgagtgttccatgcagatagcttgtgaagtattgggatatgcctactaataacgtatcgcatcagtatatcccaaaccaagggacatgagaaaat

SEQ ID NO: 3571 - DNA, 404 bp, Diabrotica virgifera
  Clone ID: LIB149-028-Q1-E1-A8
acaccgacctagtttaaacatgcatatgacaacacatactggagtaaaaccatgttttgcatgtgaaatatgtaacaaacaatatttaacaaacgcttctttaactagacatatgagagtgaagcgacatttaactgttaatagggatgtgaacacggaagaaaaacattttgaatgccaaatatgcttcaaaaaattaacaacaagatttaatttaaaaatacatatgagattgcatactggtgaaaaaccatttggatgtcaaatttgcaccaaacagttttcaacgaaacaaattttaaaatcgcatatgagagtgcatactggtgaaagaccagttaaatgtgaaatttgcgccaaacagttttcaacaaacccacagctaactagacatatgaaagtgc

SEQ ID NO: 3572 - DNA, 659 bp, Diabrotica virgifera
  unsure (1)..(659): unsure at all n locations
  Clone ID: pGUT3339
ttntttttacgcggaatagtcatctgtgcgcgttgctgaacggaaactgctctccagaattaaaaataatgattttataaggatataaatactttgttccggtgaccacttacatattgtatttgtttctctaattgttgcaggtttttatcttgaaaccgaatccaaaacaacatgcattacaaaattttcatagttttcgttgcgttgctcggtgcctgtgtagctactgatacggtgaattggtctgattgtggatcaacagctggtgaggtaaaatctgttgttgtagctaattgccattctgacagatgtatcttaaaaaggggaacgaatgcaacattggccattacatttgattcaaaagtcagctcaaaaaacctaaccgcagtagtatatggtgacgttttgggttacaagaccaaattccccctaccaaattcaaacgcatgtaaaggagtaggagtggagtgccctctanaagaggaaaaacctatgtgtatactgatacctttgacgtaaaacaagtatatcctanggtgattgttgagaattggtgggaactcataactgacactggagacanagcagtatgtgtcatcatacccagcaaagataattaaatgtatttatattttagtctaagaataagtacctat

SEQ ID NO: 3573 - DNA, 403 bp, Diabrotica virgifera
  Clone ID: LIB149-021-Q1-E1-H9
gaagatcatgcctgcattcccattaagaaatctgaccctgttgtatcctaccgtgaggacagtaagtgaagagtctgatcagatgtgcctctcaaaatcacccaacatacacaacagattgttcatgaaagcttgtcctatgcctgatggacttgctgaagatattgatgatggtaaagttaacccacgtgatgacttcaaagtccgtgcccgttatcttactgagaaatatgactatgatataactgaagcccgtaagatctggtgctttggacctgatggtactggacccaacatccttgttgattgtactaagggagtgcaatatcttaatgaaatcaaagactctgtagtagctggtttccaatgggcaaccaaagaacgtgtcttgtccgaagaaaac

SEQ ID NO: 3574 - DNA, 508 bp, Diabrotica virgifera
  unsure (1)..(508): unsure at all n locations
  Clone ID: LIB3026-011-Q1-E1-F2
acgcctgtcgngtaggctccgaaaattccagggaaaataagacagcagtgtttcaccaactggatattaataaccaagccagtgtagacgaattaagggattttattaaagatagacatggcggattggatctgctaatcaataatgcagcaatagcctttggtagagcagctacagaatctccatttgtccaagcatcaaaaactatagaagccaattactttggaaccctaagagtttgtgaagctttgtttcctttgttaaggaataacgcaaaagttgtaaatctttccagcgctgcaggacatctgtctaaaataccgacagagaagctcagaaatgaattttcgagaaaggatttaaccataccagaactcagtaaattacttgaaaagtttgtaaaagctacagaaaataacacacacgtagaagatggctggggaaactccacctacgctgtttccaaagtgggtgtaactgcactggacattatccaacagagactatt

SEQ ID NO: 3575 - DNA, 429 bp, Diabrotica virgifera
  Clone ID: LIB150-045-Q1-E1-C5
accacgcgtccgcatttttgtgcccttaacaagtgcgaattatcgagttcagacgatttgaaaagtagaaaactgaagagaatattgatagacacaggagatgaaggaatacctcaatacatcaaccatttgaaatctgttttaacctatgaaggcatcgatttggctcatattttcataactcactggcatcatgaccatattggaggactcaatgacatattgacagaacttagagaaaaaacaaaacattgtcaagtttggaaatacccaagccttaaagatgacatcaacaagaacgaattgatagaatcatttaaagatggtcaagagtttgctgtagaaggagcaacacttagagtggttcatacacccggacatacagatgaccacatagtgctccatttactaaaagacaatgtcatcttt

SEQ ID NO: 3576 - DNA, 383 bp, Diabrotica virgifera
  Clone ID: LIB150-048-Q1-E1-C2
gccaaacagttttactaaacgacttcttcctaatttcctgtttagacgaattcgtagaaaacgccagacttatgatcttcgagacattctgcagaattcatcaatgcatcaatataagcatgttaaccgaaaagctcaacatgaatccagacgaaactgaatgctggatcgtgaatttgatcagaaacgcacgattggatgctaagatcgattctaagttagggcatgtggttatgggtgctcaacctttatcgccataccagcaacttatcgaaaaaattgattccctttcggtcaggtcagaaactctgtgtgctcttatagatagaaagctcagagcgaggactgacgtaagtttctaaaggtacgttaacgaaatgatg

SEQ ID NO: 3577 - DNA, 421 bp, Diabrotica virgifera
  Clone ID: LIB150-047-Q1-E1-D4
accacgcgtccgattaaatacctgttttctttgtttttaacgtatcatttagtacaaggtgatgacgttatagtaactataccaaatggccaactacgaggaagattagaatattctctgagaaagaatgtcaccttttatgctttccaacaaattccttttggaaagccaccggttggagaattaagatttagggaacctcaaccagccgaaccatggagtggaatattacatgcaaatcaaaataccaaagcctgctaccaagttaatgatttccttaacataagcagtatacagacagaagactgtctgtttcttaatgtttatacaccataatacccatcaaccactaactcctatcctgtactgtttttcctctatggaggacgatttatgggaggagcctctacctttaccgcag

SEQ ID NO: 3578 - DNA, 247 bp, Diabrotica virgifera
  Clone ID: pGUT2870
ctccaccgcggtgggcggccgcttctagaaactagtgggatcccccccggtgctgcagagaatttcgtccccggaaggagaaaagaaaagaagaagaagaagaagaagaaaaaagaaaaaaaaggggagaaaaaaaaaaaagaaaaaagaaaaatataaaaacaaaaaaaaaaaaaaaaaaaaaaaaaaaaaaaaaaaaaaaaaaaacacacttcccttctcttttttttttttttttaattccata

SEQ ID NO: 3579 - DNA, 446 bp, Diabrotica virgifera
  Clone ID: LIB150-016-Q1-E1-G8
cacacgcgtccgcccacgcgtccgcctgttcccatatatgggcggccggcgtgttatttttaagtgcactcgacaatccctataaaaacgacgcttcgcgtcattagcgcactcgttgttaacgtcgctgagcgtcgagtccatacacttactcagagtcgctgtaccaccaaaccagaaaaccataaatcatgtgtgacgacgatgtagcggctcttgtcgtcgacaatggctccggaatgtgcaaagccggtttcgccggtgatgacgcccctcgtgctgtctttccatccatcgtaggtcgtcccagacaccaaggtgtcatggtgggtatgggtcaaaaagactcctacgtaggagacgaagcccaaagcaaaagaggtatcctcaccttaaaataccccattgaacacggaattagcactaactgggacgatatgggaaag

SEQ ID NO: 3580 - DNA, 292 bp, Diabrotica virgifera
  Clone ID: pGUT764
aaaaactatgccattttaagtattatacttgtaagtggttgtcagggagctggtaaatcaggttttatcgtaaaccatatggatctggctcctaatttttcaggagccatgatgggaattagtaatggactttctgtcgcactttcttcgtttgctcctgtcttggcgcaaattattgtaaaggatgaacacaatattaaccagtggcgattcattttctacttcacgatgggattaaatctacttggtgttataagtaacacattatttacatcggggaaacgataaccat

SEQ ID NO: 3581 - DNA, 220 bp, Diabrotica virgifera
  Clone ID: LIB150-014-Q1-E1-E5
cagacgcgtgggtcgtggtagagaggtgtggtgttgactaattttaatgttgagaatagaaatagattaatagataattggttttcctagtaataattaaaatggatagtgaaagtagaaaagtaattggaagtgataatggtactgggttcgttaagtgtgggtatgccggcagtaacttccctgcctatatattcccttcaatggtacgaaggcccat

SEQ ID NO: 3582 - DNA, 430 bp, Diabrotica virgifera
  Clone ID: LIB3026-017-Q1-E1-D2
caccacgcgtccgcggacgcgtgggtttttctgatcagacactaagtcacgtcagtttcaagttaaataacttaccaattttattaacgcaaccatgggagtaatggtagacacaattacacccggtgatggacgtaccttccctaaaactggtcagtttgtttctgtgcattacactggtaccttggaggatggacaaaaattcgattcctctcgagacagaggagctcctttgaagttccacattggaagaggagaagtaatcaaaggttgggacgaaggagttgctcagttaagtcttggacagagggccaaacttacctgcaccgctgattatgcatacggattcagagtgcatccaggaatcattcctcccaacgcaacactcatctttgatgtagaacttattgcaatagagtaaacttaagat

SEQ ID NO: 3583 - DNA, 383 bp, Diabrotica virgifera
  Clone ID: LIB149-026-Q1-E1-E7
aatttagttcaaaatgcctttctgtggtcccaaattgtccctctgcggcctgattatcagtgcatggggtatcatccagttgggtttcatgggtgtattctattacattggggctgtggctttagcagaagatattccagaggttgagtttaagggcgatttagacaaattttatagcgacgtcaacacgggtttcacacagaatgcttacaactgctggattgctgctctcctatacctgataacattagcagtatcagctcaccaattctgggccaacaacagatcatcattgaacgtctaagaatcttttaatttgcttttgtatatatttatttacattccttctccagctgtagattttaaatgtatagaccctcaaa

SEQ ID NO: 3584 - DNA, 405 bp, Diabrotica virgifera
  Clone ID: LIB149-037-Q1-E1-H3
acaaagcgtccgatttaattgttggcaatatccaaggttttttgtaaaaacactactttggatgctattggaaattttataagaaactataggaaatcttttaatgttagcgatgccgtcttcgaaccatattctgatctaggacttgatatttataaatttttggccaaatataactatcccgtagaaactcattgggtaaaaactgaagatggctatatccttcgaatgcaacggctagtaggaggccaaaatggaacgcacgttaacacaaaagataaaccagctgttcttcttatgcatggtcttctaagtagtgccatggattttgtaaattatggcccaaatagatcaattgcattgatgttagcagatgaaggatatgacgtttggttaggaaataac

SEQ ID NO: 3585 - DNA, 383 bp, Diabrotica virgifera
  Clone ID: LIB3026-005-Q1-E1-F6
cccacgcgtccggagttatttctaaggagattgaggcttattaaactgtatatttattcattaattaattgtgactacaattacaatgtctgcatatattttatgtggtacttccagtggaggacttccaatattatccagaaaaaaaggaaattctgagccgcttccattttctataacaggatcattaaacggaatccacatgttcggaaaaccatttggcatagaagttttagaaaccttaactgatgattatgctgttagttggaaggaatttgaagacagcataattataattggagcagcaagtggatgttcaatagacattttaaacagactattggaagatgtttttaatacaactagttatgataatttggaat

SEQ ID NO: 3586 - DNA, 390 bp, Diabrotica virgifera
  Clone ID: LIB150-050-Q1-E1-A7
ccaccagatcagcaaagattgatctttgcaggtaaacaattggaagatggaagaaccttatctgattataacatccagaaagagtccactcttcatttggtacttagattgagaggaggtatgcagatcttcgtcaagacactaactggaaagacaatcactttggaagtagaaccatctgataccattgagaatgtgaaagccaagatccaagataaggaaggtatcccaccagatcagcaaagattgatctttgcacgaaaacagctagaagatggtagaactttgtctgattataacatccagaaagagtctactcttcacttggtactaagattgagaggaggtatgcaaatttttgtcaaaatattgactggtaatactatcaca

SEQ ID NO: 3587 - DNA, 431 bp, Diabrotica virgifera
  Clone ID: LIB149-008-Q1-E1-H5
caattattcacagaacaacaattatacagaatagaccactatttgggtaaggaaatggtacagaatttaatgacacttcgatttggtaacagaatctttaaccccacatggaacagtgaccatatagcttccatccaaataaattgtaaggaacccttcggaactgaaggcagaggagggtattttgacgaattcggcattattagggatgtaatgcagaatcatattttacaaattctagctctagtagctatggaaaaaccagcttcagttcaaccagacgatataagaaatgaaaaggtaaaggtattaaaaagtatagctccaataaagctcaaggacgttgtattgggtcagtacgttggaaatcctgatggacaaggtaatgcgaaattgggatacttagatgatccgagtgttcctaaagattc

SEQ ID NO: 3588 - DNA, 389 bp, Diabrotica virgifera
  Clone ID: LIB150-002-Q1-E1-H12
ccatcttaaaaaatagattaaaatcagctgctgatgctaatgtgaagttgagtttgacaaatatttaatttaatcaagtttaatttaaaaaggcattcaaataaactccttatttgtaaacatgccagaagacgcagctccacgaaatattcttgaaaaattcatttttttctgtagcgaacacattagaagccccaactatatgggtgagagaaaagatcgtagaacccaatcaaaaacaatctgcctggtaccatcaaaagtttcgaagagtacctaccattgatgagtgctacactgatgatatcgtttgtatttcagaagcaaatatccaatttaaaagagacaagcttgttgatagtgaaatactaagcattatgagggaacga

SEQ ID NO: 3589 - DNA, 412 bp, Diabrotica virgifera
  Clone ID: LIB149-023-Q1-E1-A8
acccacgcgtccgcggacgcgtgggcttttgcaaaactattgcttgaacagttctaaaacatggctcctaggaaaggaaaacaacccaaagaagaagtccaactatctcttggacctcaagttcgtgaaggtgaaatagttttcggtgtagctcacattttcgccagtttcaatgatacatttgttcatgttactgacttgtctggtagagaaactatctccagagtcactggaggtatgaaagtcaaagctgacagagatgaagcttctccctatgctgctatgttagcagcccaggatgtagctgaaaaatgcaaaacattaggaatcactgcactccacatcaaattgagggctacaggtggtaacaaaaccaaaacccctggaccaggagcccaaagcgcactcagag

SEQ ID NO: 3590 - DNA, 260 bp, Diabrotica virgifera
  Clone ID: LIB3026-032-Q1-E1-B12
ttccccttcaatgcaacgtcaaaccccttcaaaagtgtcaccaaatttcaattcatgggccttcttttaaaaacttcataactggaaaaacccgggggttacccaattaaacccccttgcagaaaaaccccctttcacaacctggcttaatcccaaaaaggcccaaacctttcgcccttccaaaaatttgcccaccctaaatggcaaatggaaccccccctgtaccggcccattaaccccggcgggtttgctggttaccc

SEQ ID NO: 3591 - DNA, 409 bp, Diabrotica virgifera
  Clone ID: LIB149-021-Q1-E1-B12
agatcctttgactggacatctgtttaacttggaagacgagaaatggaaaatcattagggctaaattgacgcccacttttacatcaggtaaaatgaaaatgatgttccaaactatggtagaatgcaccgaaggtcttcaagaactcttaaaaaaatctgcagcaagcaaagaacccgtagacataaaaagcaatctctcctgtttcaccactgacgtcatcggttctgttgcattcggtgtggatataaacagcatgaagaatcctgactcggattttcgaaagttcggtaacagaatattcgtgcatacaactttggtgagactaaaattcatcttcttgtctatctggccacaatggatgattaaaaaaagtggtattaaactattttccaaagatatggaagacttt

SEQ ID NO: 3592 - DNA, 233 bp, Diabrotica virgifera
  Clone ID: LIB149-013-Q1-E1-E12
tgcatctcgggacaagggacttgaaatattagctgtcaacgataccttccttgatgtcaaccacatggtatacttattcaaatttgactctatacactgtctctacattggatatgtcaatagtgaatataaatacttaattgttgatagcattcataattcagtggaacactatagagactcatctgatattccatcttgcaaatctcgtgcagattacgtattacaattta

SEQ ID NO: 3593 - DNA, 262 bp, Diabrotica virgifera
  unsure (1)..(262): unsure at all n locations
  Clone ID: pGUT945
atcatccccaaaagaatcaatctccgtattgaacatgtaaaccactccaagtgtcgtcaagacttcttgcaaagagtaaaatccaatgaaaagctacgtaaagatactaaagacaagaacattaaagtagatctgaggagacaacctgcccaacctaggccagcacatattgttagcggatatgttccagcacaggtgcttgctcctaacccatatgaattcattgcttacgtttgtntatcttanaatataatcctttatt

SEQ ID NO: 3594 - DNA, 379 bp, Diabrotica virgifera
  Clone ID: LIB149-047-Q1-E1-A7
gggaacgtatcggaagtaatgtgtctgtgataaatagtaaaaaatattaaagcgatattttcgtcgaaactgatatgtattaaatttatcttttgtgttattaaagagagttaaacgtagctaaagaagaaaaactattagtgatttaaacatgagtacgaaagatgatgaatacgattatttatttaaagttgtccttattggtgattctggtgtaggaaaaagtaacttattgtcaagatttactagaaatgaattcaatttggagtctaaatctactataggtgtcgaattcgctaccagaagtatacaggtggatggtaaaactattaaagcacaaatatgggacacggcaggtcaagagagataacgagcaaac

SEQ ID NO: 3595 - DNA, 336 bp, Diabrotica virgifera
  Clone ID: pGUT2068
tcggatttgactttttattttattcatgaacgaacataattattgcagtaatttttgaactgttaccaaaaacgttgtttaacaattgaaaaattgtgtaaaaaaagtaattttaaaaagctttgtctgcaagtaatactgcacaacggttaacaaaagtttaaaaaatggaatgaatagtttaatcgacttcttcaatggttggtccagcacctccagcggcgcctgcagctcctggagctgctccacctgggaaaccaccgggcatgccacctggagctccaccggcaccttggtacaacttggtgatgatggggttgcagatgttttcgagct

SEQ ID NO: 3596 - DNA, 523 bp, Diabrotica virgifera
  unsure (1)..(523): unsure at all n locations
  Clone ID: pGUT3647
aaaaaaaggaaaatattccgcaattttccttcaaaaatggaggtttcaaaaaacccactagtgttcatagtggccatttttgcttatagttatggtttagaagacagttgtccatctatgtgtaactgtacagaagaacaagttgattgtatgagcagagacatagaagaagttcccgattttgaaaccttgaccaatcgtccgcaagttatcgatttatctggcaacaaaatagcaatgataggtgcatatgatctatcgttcgagaagagctatatggtcaaagagctatatctcaacaactctgaagtgatagacgtcgaggacgaggcgttcgatgatttcgaaaatcttcagatgctctacttgggagagaatntattgcgagtggtacctgaagaattcgtcggcgatttaacggaattaatcttattagatctctctggaaatcccttntgaggtaaaatgcccataatacgatctgactccttagaagtactagncttagcccagtgtcaaataa

SEQ ID NO: 3597 - DNA, 291 bp, Diabrotica virgifera
  unsure (1)..(291): unsure at all n locations
  Clone ID: pGUT428
aattcggctcgagctcgtgccgaatcagcacgaggattccggttcctattcctgaacccggtagcggaaccgtcaaaaagtcgggtcctcgcaagatagttcgtcggggtaaccctaaatgacctgcagacgtcgtcaagagatccgggaagattcttcttttctgtataagcgttcgagttccatggaatcctctagcatggagatatggtttggaacgcgaaaagcancgcagttgcagcggtgtccggatcttctcctcgaaccttgaatatccangagagggccacg

SEQ ID NO: 3598 - DNA, 406 bp, Diabrotica virgifera
  Clone ID: LIB149-022-Q1-E1-A11
ggtccaggacgcgtccacggacacgtgggcgaatttggaggcactgtactagctaacgcttgcggaccttgcattggtcaatgggacagaaaagatgttaagaaaggagagaaaaatacgatcgtaacatcatacaatcgtaacttcacgggacgtaacgatgctaaccctgcaactcactgctttgttacatctccagaacttgtaactgccctaagtatcgctggtagactcgacttcaatcccttaaccgactcactaaaaggttctgatggcaagagcttcaaactgactgcgccattcggggacgaacttcccagcaaaggattcgaccccggccaggacacctacgcagccccagttgccgacggttccaacgtaaaggtcgacgttgatgtcaaatctc

SEQ ID NO: 3599 - DNA, 417 bp, Diabrotica virgifera
  Clone ID: LIB150-045-Q1-E1-H12
ctcgcaggtcgatacaaccctctacattgagtcgtattagtgttgattgagtgctttatttgcaagtttcagaagttgtctttagaagctaattaccacaatgaattttgaagaaatggcagtcattgaagaacacagtgtttgcgaagggcctgcccgtaaggaatcagggaagcggggacgaaagccaggcaggaaatcggctgaaaaagtggacatgaaagccaaattggaacgtagtagacaaagtgctagagaatgccgagctcgtaagaagttgcgctatcaatatttagaggaacttgtagccgatagagagaaggcagttatcgcactaagaaaagaatatgagcagtacattttttgggcaaaggaaattgatgccggcagaattccagaaggtattcacaaagcact

SEQ ID NO: 3600 - DNA, 353 bp, Diabrotica virgifera
  Clone ID: LIB150-049-Q1-E1-F1
agaggatgtctacaaaattggtggtattggaacagtacctgtaggtcgtgttgaaactggtgtattgaaacctggtatggttgtagtattcgctccagccaatttgacgactgaagtaaaatccgttgaaatgcatcacgaagccctccaggaagcagtacctggtgacaatgttggtttcaacgtcaagaatgtctctgttaaagaattgcgtcgtggttacgtagctggagacaccaagaacaacccacccagaggagcttcagacttcactgcccaagtcattgttctcaagcaccctggtcaaatctcaaacggatatacccctgtactcgactgtcacacagctcaca

SEQ ID NO: 3601 - DNA, 398 bp, Diabrotica virgifera
  Clone ID: LIB149-036-Q1-E1-A9
tgatacatcctatactatttgtgtaatagagtaattatttaacggtatgtcttcaactagtgtaaataaaatgtctaaagatactcatattgaccgagatttggatttatcaaatgccaacagaggtgtttggctggttaaagttccaaaatatgtttctgaactatgggaaaaggcgtctggatatatggaagtgggtaaactaaaaattaccaagcctgttggacacgcggctcagctttcgcttacattatcttcaacaattcggaatttgaatgagcctgtacaagaatgtatgcgacatgatcagagaattgatgtatccacagttacttaacaccctttggggatcattgctcatgttacaccagctaggcattatactgtgttagctcact

SEQ ID NO: 3602 - DNA, 411 bp, Diabrotica virgifera
  Clone ID: LIB149-034-Q1-E1-B7
ggttgtctgtggtgtagatttaattttttaaatattataaacatcccttgaggatttaatttccaagatggtccaaaagaaacctaagaagaaggtaggaaagaaagtagctgcagctcctcttgcagtcaagaaaattgaacagaaaaaagaaattaacccactttttgaaaagaggcctagaaattttggaattggtcaggatattcaacctccccgtgatttatctcgatttgtaaaatggccaaaatacatccgtattcaaagacaaaaggctgtacttcaaaagagattgaaagttcctccaccaattaaccaattctctcaaaccattgacaaacaaacagccacccaattatttaaagtcttgggaaaatacaaggccgagaaaagcccttcaaaggaaaaata

SEQ ID NO: 3603 - DNA, 392 bp, Diabrotica virgifera
  unsure (1)..(392): unsure at all n locations
  Clone ID: LIB150-006-Q1-E1-F2
caataaacttactcaaattcgctgtacaaccaaaccaaaaaaccataaatcaggtgtgacaacaatgtaccggctcttgtcgtcgacaatggctccggaatgtgcaaagccggtttcgccggtgatgacgcacctcgtgctgtctttccatccatcgtaggtcgtcncagacaccaaggtgtcatggtgggtatgggtcaaaaagactcctacgtaggagacgaagcccaaagcaaaagaggtatcctcaccttataaatacccattgaacacggaattatcactaactgggacgatatggaaaagatctggcatcacaccttctacaatgaacttagagtacccccgaagaacatcccattcttttgaacgaagctccacttaacccaaaa

SEQ ID NO: 3604 - DNA, 366 bp, Diabrotica virgifera
  Clone ID: LIB150-004-Q1-E1-G6
agaccagatgtagtcaatttcgttcaccaacaggtttctatgaagcatcgtcaaccctacagcgttagtgacaaagctggacatcaaacatctgctgaatcatggggtactggacgtgctgttgctcgtattccccgtgtaagaggaggtggtacccaccgttctggtcagggagctttcggtaacatgtgtagaggtgggcgcatgtttgcaccatccaagccatggcgtcgctggcacagacgtgtagacatcaatcaacgtcgttatgctttggcatccgctgtagctgctagtggtgtgccagccttagttatgagcaaaggacatgtcatcgaccaaatccctgaattgccattggttgtc

SEQ ID NO: 3605 - DNA, 420 bp, Diabrotica virgifera
  Clone ID: LIB150-013-Q1-E1-C1
agaataaaaaatttatttaaaaatatatattgtatacataacaacattcaacaacaaccccccgtcttttaatacaccttaagcatcgtaagtggaagcagaaacgtttccaccgtggcccgtccagttggtgtggacgaatttaccttctttacccaataattcatatgtgtgtgccccgaagtagtctctttgagcttgcaaaagatttgctggaagacgctcagatctgtatccgtcgtagaaggccaaagcggtacttaaagctggagttggaatacctaaagtgacagcagtagttagaacattcctccatccctgttgagctttggtaatagcgtctaaaaagaatgggtccaataacaaggagttaaagttcatgtctttggcaaaagcttccttaatctttcccaaaaatac

SEQ ID NO: 3606 - DNA, 416 bp, Diabrotica virgifera
  Clone ID: LIB3026-028-Q1-E1-B1
acgagaacaagaaggttcgcaagaaggagcaaaacaagaacgctgctaccaggtatcgccaaaagaagaaggccgagattgaggtaattcttagtgaagaaaagggtcttctggacaagaacgttgatttgggaagtcaaatagctgatctaaatcgcgaaattaagtaccttaaggggctcatgcgtgatctcttcaaggccaagggtctcatcaactaacaaacacagaagatttaattttggatttttttatatcttttttacagtaaatagggataaacatacaacttcgaggattttgttgattctcttatatagttttggcaatttatagcgtgtttttgacggcacaattgtttttatatgttgcatttaaattggacgcctggagggagaatcatcaaaatgcttgct

SEQ ID NO: 3607 - DNA, 384 bp, Diabrotica virgifera
  Clone ID: LIB3026-001-Q1-E1-A12
agcgtgtttagttttgtattttattcggcgttgagctttgcagtgttcttaaatcaaaatatcccggttcaggagaaacaccatgtctagacatcgagaatgggagctttcttgtaaagtttatgtaggcaatctgggttcgtcggccagcaaacacgaaattgaagccgcgtttggcaaatatggaccgttaagaaacgtttgggtagcccgaagtcccccgggatttgcatttgtggagttcgaagacaccagagacgcggaagatgcggttcgaggtttggacggaacgcgctgttgtggcacaagagtaagggtagagatgtcaaatggacgttctagaagaggtggtggcggtggaaggagaggaccttcccgatattc

SEQ ID NO: 3608 - DNA, 326 bp, Diabrotica virgifera
  Clone ID: LIB150-042-Q1-E1-A3
gcgtccaaggacacgtgggcggacgcgtgggaactgtactgattatggaacttattaacaacgtagctaaagcccatggtggttactcagtattcgctggagtaggagaacgtacccgtgaaggtaacgatttataccatgaaatgattgaatctggagtaatctccttaaaagataagacctccaaagtagccttggtctacggacaaatgaacgaacccccaggcgctcgtgctcgtgtagctttgactggattaactgttgctgaatatttccgtgatcaagaaggacaagatgtactgcttttcattgacagatcctgcccc

SEQ ID NO: 3609 - DNA, 413 bp, Diabrotica virgifera
  Clone ID: LIB149-035-Q1-E1-F10
agtgaacttgcaacagcagtaagggctaagaatctcaaattcggtttataccactcatattatgaatggttcaatcaactatatctagctgacaaagccaatgggtataaaacacaagattttgtagaccgtaagacagatcccgaattacgggagcttgtgaacacatataaaccttccgttatatggtctgacggtgactgggatgctccagacacttactggaaatctaaagaattcttggcatggctgtacaacgaaagcccagtcaaagatgaagtagtagtaaacgatagatggggatctggaattccttgtactcatggaggatttttctcatgccaagatagatacaatccaggtactcttcaacaacacaagtgggaaaatgctatgacaattgatcacaaatc

SEQ ID NO: 3610 - DNA, 287 bp, Diabrotica virgifera
  unsure (1)..(287): unsure at all n locations
  Clone ID: pGUT4136
gaaggacgttacgtaatttgttgaacggcaatcagcatggctaatgtacccaatgtggagttcaacaacggagaagtatttcccgcctatggtctaggcacatggaagtcaaagcctggtgaggttacccaagctgttaaagatgccctcgacatcggctaccgtcacatcgattgtgcccatgtctacggaaacgaaccanaagtaggagctgccttgaaggccaaacttgccgatggtacatttaaacgtggagacatttacatcaccagcaaactctggaacac

SEQ ID NO: 3611 - DNA, 184 bp, Diabrotica virgifera
  Clone ID: LIB150-033-Q1-E1-H5
tgacgtcgtattatgatctccagaacaatcagataaaagcaacaaatatgaccggcagttaaggttatggggagatcatggacaggcacttttagaacattccatagtttgtctgataaatgcaactgcactctgcactgagattccaggaagtttaagtttacctgatatcgggtcatttacc

SEQ ID NO: 3612 - DNA, 410 bp, Diabrotica virgifera
  Clone ID: LIB150-041-Q1-E1-G9
acccacgcgtccgcccacgcgtccgcccacgcgtccgataaattcaaatttttagagttggaatctacaaagttagtgataattagaaccattgtggcattcagaaacggtctaaactttcaatgttagcaaccttttgtatatagctacaataccgatataacagtgaactgaaaaactctagtgtactgatacaaagcatttaccatgggtcttaccatatcagcagtgtttaatatgttgtttagtaaaaagcctatgataattttaatggtaggattagatgccgcaggtaaaaccacaatcttatacaaattgaagcttggtgaaatcgtaactacaataccaaccatcggcttcaatgtagaaaccgttgagtacaagaatatatctttcacggtatgggatgt

SEQ ID NO: 3613 - DNA, 438 bp, Diabrotica virgifera
  Clone ID: LIB149-042-Q1-E1-B11
gggccgacccaagcgtccacccacgcgtctgattacttcgtaatttgacagcaatttttttagtaaaattaaataaataaatttggatttgactatcaaaaagaaattcttaatcatgttacataggctacaatataattagtcaatctgaagaaacctaacaatctataaaaaatacttcaacgaaataataataattgaattttgtttgaataaaaattcttcaggttggctagtatttgaccgatttctaatatgtcctttcttatttagatgttgagggtataaaatatgttgtaaattacgattatcctcactcctcagaagattacattcacagaatcggtagaactggtcgttctgacagtgccggtacgtcctatgcatttttcacaccttccaactataagcaagctagagatctgatctccgttctca

SEQ ID NO: 3614 - DNA, 455 bp, Diabrotica virgifera
  unsure (1)..(455): unsure at all n locations
  Clone ID: LIB150-041-Q1-E1-F1
cacacgcctctatatagaatcaaaggaagcagttttaatgcctattcataaaaaaacagttcgcaaaacatgttaaatatctaaacacttcctgaaattccagaaacacaagcaacaaaaagtcagtcttggaataatttaagtagtgtattcgaaatttacaaacgggaatgtagagactgtacaaaaaacatgcttaaataaaaaataaaatgagaggagacanatataaaagttataaagctttgatttcagatccaaaattaacgtatgaaatttagttctcgtcgacttcggcttcctgatcttcgtcgaattcggcatcttcgtcagctgtggcttcttggtactgttggtattctgataccaagtcgttcatgttggattctgcatccgtgaaattcatttcatccataacttctccggtgtaccaatgcaagaaagctttcctcctg

SEQ ID NO: 3615 - DNA, 401 bp, Diabrotica virgifera
  Clone ID: LIB149-046-Q1-E1-H10
attttcactttctatattttaataaaattctttagaatggacgttatgaataaaagatatttttgcataaactgtggaaatgaagtcaaaagtttatatagagaatacagcaaaactgtattaaaattaacagaatgtgataattgcaaaaatattgctgataaatacgtggaatatgacaccgttatagtagttattgacttacttttacttagaataatggcgtataggcatattttacttaattctgaatttaagaatttttggaaattacctataggtctgatactgttggaaacatatatgacctggatattaaccaaagaattcccactagaaagacacaaagatatttctaacatcacttcttttgaataagctgataattaactagatgatat

SEQ ID NO: 3616 - DNA, 432 bp, Diabrotica virgifera
  Clone ID: LIB149-005-Q1-E1-H4
gacccacgcgtcagccaacgcgtccgcttatttaaatatttgtaatctttctttatgtggttttccttttatgtctggattttattctaaagatttaattgttgaaattttatcttttagttatttaaatatttatatttatataattttttatatttctattggtttgacagttgcttatagatttcgtttaacttattattctttaacgggtagatttaattatctagctttaaatatattatctgaaactggttatttaatacttaagggtataagaggattaattttatttgtagtttttagtggaagattattttcttgattagtattttctactcctatttttatttgtcttccttttttaataaaaattataactttgatttttattatagttggagtttgattaagttatgagttagctaaatt

SEQ ID NO: 3617 - DNA, 417 bp, Diabrotica virgifera
  Clone ID: LIB149-010-Q1-E1-G2
cccacgcgtccgcttactagaaggcaagttagcagttatactaacacaatgtccgatctaagtgccagagacgttgaaagggccaactttgtcttttccatctacgactttgaaggaaatggcacagtcgatgctgttaacttgggagacatgctcagggccctcaaccttaacccaaccttggtcacaatagaaaaagttggaggaaccaagaagaagaacgaaaagaaattgaaactagatgaattccttcccatcttcagccaagtaaagaaagacaaagaacaaggtaacttcgacgatttccttgaatgtctcaagttgtacgataaagaagaaaacggtaaaatgatggctgctgaactttcccacacactcctttctcttggtgagaggttagctgacgcagaaacagaa

SEQ ID NO: 3618 - DNA, 313 bp, Diabrotica virgifera
  unsure (1)..(313): unsure at all n locations
  Clone ID: pGUT3023
ctttttcatctacgactttgaaggaaatggcacagtcgatgctgttaacttgggagacatgctcagggccctcaaccttaacccaaccttggtcacaatagaaaaagttggaggaaccaagaagaagaacgaaaagaaattgaaactagatgaattccttcccatcttcagccaacgtaagaaagacaaagaacaaggtaacttcgacgatttccttgaatgtctcaagttgtacgataaagaagaaaacggntaaatgatggctgctgaactttcccacacactcctttctctttgtgagaggttagctgac

SEQ ID NO: 3619 - DNA, 372 bp, Diabrotica virgifera
  Clone ID: LIB149-033-Q1-E1-A9
aagaggaactagaagagatgttaacgagctaactacatgcttacagaggttaggatttaatattgataaagaaaatatattaacggataagacaactgaagaagttgagcaagtattggagaaagcttcccagatagactttacaaattataattgcctaatactgtttttcctatcgcatggcgaagaactgaacttcttacataccaaagatggccaaatattagcaaaagatatttggttaaaatttaaagatagtccaggtctcaacggtaaaccaaaaatgtttgtgtttcaggcttgtaagggagaaaactttaccaccgttggaaatgaattaccaaaatcagcggttttaacaacctcttcaac

SEQ ID NO: 3620 - DNA, 421 bp, Diabrotica virgifera
  Clone ID: pGUT4126
gagacttcaaatcagctgctaacttgtttttggagggagtaagcacttttacatgaggacgaactaatggactataaagcatttgtcaggtatactgtatacacctctattattagtttgccaaggaaccaattaagagataaagtggtcaaaggttccgaaatattggaagtactgcattcagaaccatttgtaaaagattaccttttttctttatataattgtcagtatgctgaatttttcacaaatcttgcagaagttgaaacagttctcagaaaagattatttcttgaatcctcactatcgtttctatgtaagagagatgaagatactcgcttatacacaattattggagtcatataggtctcttactttacaatacatggcagaagccctttggagtactgtgattacattgataa

SEQ ID NO: 3621 - DNA, 400 bp, Diabrotica virgifera
  Clone ID: LIB150-034-Q1-E1-A12
taggttgcgtaagtggagcaacaagtccaagcaaatgctaacaatgatactctaattttggtagcagctactatttatgttaacgaaggcaatcttgatgctgcgtacaaagttctgcacgctacggaaagcctcgaagcaatggcctttattatagatatacttttgaaattggatagagtagatttggcaaggaagaagctgaaagagatgcaagataaggacgatgatgcaactttaacacaactggctcaagcttggattaatgtatccactggtggagataaactccaggacgcctactatatttaccaagaacttgtagacaaatatggatccactccattgttgctaaacggacaagcagtgactttcattggccaagccaaatatgaggaag

SEQ ID NO: 3622 - DNA, 425 bp, Diabrotica virgifera
  unsure (1)..(425): unsure at all n locations
  Clone ID: LIB150-037-Q1-E1-H1
acccacgccgnntccgttcgggtcccttcagggattcaattcaagaaagcaatgacgcccctcctgccgttgttagcccttggaacattcctcaaacgaggaagatttaaaatttcctatggttctggtttaatattttagctatactgtccggtttggctattgtgtattcggcagctgttgtattactacctagtacaagagaaacgattttgaagaggagattcagattcaaggtacccaatgctgttgagactattgtcagaaaaacacaggttggtgatttccttttgattcacttactgggacaaaacacaaaccaattggtatttggcgaaattttggacgaattcgntagaagactgaatttcggtagtaacagcaacttaccgtctgctcccagcacgttagaactgagtccaatg

SEQ ID NO: 3623 - DNA, 446 bp, Diabrotica virgifera
  Clone ID: LIB150-045-Q1-E1-H4
gcgtccgagtagttcatattatagaagaagtaattataattatacctatccaataactaggcctataaagacgaaatccatgcacactttccgaataggtataatcgcagatttagatcaaagttcacatagtaaaaaagaaacagatacttgggattcctacttcaaaactggatatttgacgtacaatcctcaaacacatcacatagtagttaattgggatcaaaaagaagcagacatgctgaaaacgagttatgccctcaaaggtagaggattagagctgtcagaattggctacgttcgatggtaaattactaacgtgtgatgatagaactggcctagtgtttgaattagtgaataacaaaataagtccatggttaattcttatggatggtaatgggaaaactcaaaaaggtttcaaatcagaatgggctaccgttacggatg

SEQ ID NO: 3624 - DNA, 369 bp, Diabrotica virgifera
  unsure (1)..(369): unsure at all n locations
  Clone ID: pGUT1235
attcaaaatttccagttctataaaattcctattacaaaatgtacattgatgagggcctctgtgggacagtaagtgtatntttagattgtgtgtttttgagaaaccctttttgcagtaactgcagtgataggggcgatagcctgtgtgaatatactcgtgacaaacaacctctccttttgaagaaaactgtcttccacaatattgacatntatacggtttctctccagtgtgtgtcctgacatgcctgttgaaggaattgatcattctanatctnntagggcaatattcacaatgggtattcttctctcctgtgtgcagtcgcatatgatatgttagagcatncgcataattgaaatctttaccacatac

SEQ ID NO: 3625 - DNA, 396 bp, Diabrotica virgifera
  Clone ID: LIB150-048-Q1-E1-D9
ctcgcgggccgatacaagcctctacactgacgtcctacctaacgcgtccgcccacgcgtccgcgaaaacgaatttttgtcggcatttggactttactattttattttttgatttgtaacggaatatgttcgggttcaggcaattagcaactgtaacaaggactacagcccgaagtgctgtcagagccaagcataccctacctgagcttccatacgaatatgctgctctcgaacctattatttcaagagatattatgagcttacatcattctaaacatcataacacttatgtaaccaatttaaatgctgctgaagaaaaattacaagctgctgcttctaagggagatattagtactgttatttccttggcacctgctttgaagtttaatggaagtgg

SEQ ID NO: 3626 - DNA, 436 bp, Diabrotica virgifera
  Clone ID: LIB3026-009-Q1-E1-F4
ccacgcgtccggaaagtcattccagtggaggcgaggaagctccaacgaaagatgtgcaagaaccaaagcctgggccttctcaggaacctggtgataaggaaaatgatgaggaggaacctgcagatgaggaagcagctaattcatggctgaatgagtgttttgatgcctatgaagctggtggatatagtcccaagtttcttactcctgacgaaatagaaccaggaactattgttgttatagaagaagatgatctgaaaagattggaatttgcaagaattcaggttgtcggtaaaggtaagactgtggaaaatgttataacgaaggaggagttgatgctacaaaaagaggctcgtaaaggcatggatggagacgaggcacagttctctgtagagcaagctttggacagccaagttccaccttggtccgacaaataccg

SEQ ID NO: 3627 - DNA, 449 bp, Diabrotica virgifera
  Clone ID: LIB150-022-Q1-E1-D11
agcccacgcgtccgcccacgcgtccgctggacttcaaggtttcttgattttccactccttcggtggtggtactggatctggtttcacttctttgttgatggaacgtctatctgttgactatggtaaaaaatcaaaactggaattcgccatctacccagctcctcaagtatctactgctgtagtagaaccatacaactccatcttgaccacccacaccactcttgaacactcagactgtgcctttatggtagataatgaagccatctatgacatctgcagacgtaatctagacatcgagcgcccaacctacaccaacttgaacagacttattggccaaatcgtatcctcaatcacagcttctctaagattcgatggtgctctaaatgttgacttgacagaattccaaactaacttggttccttaccctcgtattcacttccctcttgtca

SEQ ID NO: 3628 - DNA, 418 bp, Diabrotica virgifera
  unsure (1)..(418): unsure at all n locations
  Clone ID: LIB149-004-Q1-E1-F8
atcagcaagatgtctggactaaaatatttcgttctcttcgcccttgtgacagtcacttgcgctcgccacgtgagccgcaaaagtactggtttgaaaatcaatggtggtagccaagccaaaagtggacaatttcccttcgtagcatctctagagttgggaatcttcggtatctacgaaaacgaatgtgaaggtgttatccttaatgaaaattgggttctaacatcaggtgaatgcgccaaagaagtatccagggttgtagctggtgttacagacttgcatggcaatgaaacaagcagacaggtggctgaagtcgaacatgcttatgtacatcncgaatacgacagtaatgggcctagtccaaacgacatcgctcttgtcaaactgaagacacctttggtatttaaccagttcgtcggta

SEQ ID NO: 3629 - DNA, 345 bp, Diabrotica virgifera
  Clone ID: LIB150-049-Q1-E1-H1
agcccacgcgtctgggaacagacagctgatgccgcaactgaaacggcatctacagaggtacacaaatcaggtgtcaatggcacatatgtatcattacacagttctgggtttagagattttcggtcaatatcagcatatcgcataactatatgggcctgcgggttcaaacatccttcagaatttcaacatgaatgtgttcctcaagctgtcattggcattgctaatctgtgtcaatctagatccctgatgggaaaataggctgtttttgcataacctaaactccggattataaatcccacagaatatgtcgctaaagttctcatcatatgccataccacagagtta

SEQ ID NO: 3630 - DNA, 305 bp, Diabrotica virgifera
  Clone ID: LIB150-036-Q1-E1-C10
caacaccctatagatgagtcgtagtatgtccggcttccgtttgcataccgccacgcgatctgtcaatttgactaattgtatcgcttcgattggtaagcgctacacttggatgcattctcaatgcagtcgttgaggtctgcgatcgtaccacaaccatcaggagacttgcgcatcatgtggatactcaatctctaaagtgcgatcctacaactgggtcgagacagccaatatgaggaggactaccggaactgggcgcactgttcatttgcgtgatgtcgagcgtcctttccactttgggttccgtc

SEQ ID NO: 3631 - DNA, 401 bp, Diabrotica virgifera
  unsure (1)..(401): unsure at all n locations
  Clone ID: LIB149-022-Q1-E1-F4
accacgcgtccggccatatgtaccttagtttatttcgagacacaaacttcacaaataaccaggaaaatatcgagcaagtcgaaggcgagttcatatacaaagaaggatctgttaaaagtggtagatgaattgccatcttgggttacctttcctgatagagaacgtgctgagtggctgaatgagattattggacaactgtggcctagcatctccctatatgtgataaagctgtgcagaacaaaattacaagcgaaaattaaaaagaaattcgattctttcagatttgaagatatcgattttggagtttcgcctccaaagattgatggcgtanaagtttacaataagactattactaaggatgctataattatagacttcgacgtatactacgatggtgactg

SEQ ID NO: 3632 - DNA, 398 bp, Diabrotica virgifera
  Clone ID: LIB3026-016-Q1-E1-B10
acccaatcgtccggctctgtagattccctgccaacatcaagtctttctacatgagcaaatgtccagaggatgccagattgacggaaagtgttgatgttttgttgccaaatgtaggcgaaattgtgggaggatcaatgaggatatgggatcaagaagagctattagcgggatacaaacgtgaggaaatagatccacctccatatttctggtacacagaccaacgtaaatatggtacatgtccacatggaggttatggtttgggtttggagagatttgtatgttggctgctcaacagatatcatattatagaagtctgtttgtacccgcggtatctgcatcattgtaaaccttaaggtgattcagctaaatatacagacagctaggcatttaagagtttg

SEQ ID NO: 3633 - DNA, 400 bp, Diabrotica virgifera
  Clone ID: LIB150-050-Q1-E1-D8
gccgacccacgcatcaatatagatattgatggatgaagttctgcttcaaaaccgccaaatattgtttttattatggctgacgagttgggatggaacgatgtgagttttcatggatctggccagattccaactcccaacatagacgcgttagcttaatcaggccttattttacaaaactactacgtaaatccaatatgtactcgttcccgaagtgccttaatgactgggaagcatccgatacatacgggtatgcaacacacagttttgttctgagcagaagctcgtggattaccgcttaccgagaaacttctaccgcaatatttggaagagttgggatatgagaatcatattgttggaaaatggcaccttgggtcagataaactagagtatacagcaatgt

SEQ ID NO: 3634 - DNA, 404 bp, Diabrotica virgifera
  Clone ID: LIB149-031-Q1-E1-E12
cccacgcgtccgagagctgtacaactgcttgctcaagagttatctattccacttactctgaagaatgtgaatattccagccaaggaacaattcgctccagagtttttaaagataaatccacaacacacggtaccagttttagatgacaatggttttatattaatcgacagtcattctattatgacttacttcgtatcaaaatatggaaaaaatgattctttgtatccgaaagatttacaaaagagagccatcgttgatcagagacttcactttgattctaatatcctctttgcaagaggtgctcgtattgtgaaaagagttttctatgaacaaaaacgagacgttgtaccagaagacctggcagcattggtggaagcgtatgaaatagtggaaaaatttttaaa

SEQ ID NO: 3635 - DNA, 429 bp, Diabrotica virgifera
  unsure (1)..(429): unsure at all n locations
  Clone ID: LIB150-024-Q1-E1-G2
cacacgcgtccggtacagacaagcactcgaagatatgattcagttattggaaggtccattaagtataccagtcgatagaaacgataaaaatgctcttgcccaagtcgtgaaaggctgcattggcacaaaattcataagtaaatggtcagatttggcagtaaatattgctttagatgcagtaaatacagtattattagaagaaaatggcagaactgaagttgatatcaagaggtatgccaaagtcgagaagattcctggaggatccattgaagaatctaaaattttaagaggtgttatgcttaataaagatgtaacccatcccaaaatgaaaagatatatacagaatccgagaataatacttttggattgtgcattagaatataaaaaaggggaatctcanacaaacgtagaaatttcagcagaaacaga

SEQ ID NO: 3636 - DNA, 348 bp, Diabrotica virgifera
  Clone ID: LIB149-006-Q1-E1-B8
aagttgatgctgatacatggcaattttatggaggtggagttttcaacaacagaaactgtggaaccgccctcaatcacggtattcttgctgttggatacactaaagatgtattcattgtcaagaactcatggggaactagctggggtgaaaaaggttacatcagagtagcccgtggtcacaacttgtgtggtattaacctcatgaactcttaccctaaattgtaaatgatttaatgtaaatgaaacaccaaatagaattcaaaattaaagataaataaacaactaaaaaaaaaaaaaaaaaaaaaaaaaaaaaaaaaaaaaaaagaaaaaacaaaaaaaaaaaacaaaa

SEQ ID NO: 3637 - DNA, 438 bp, Diabrotica virgifera
  Clone ID: LIB150-018-Q1-E1-B11
cagacgcgtgggttagagacaactaatattgaagctaaattcttcaaagaggtacataatctagaatgtaaataccacaagttgtaccagcctctttacgagaaaagaaataccattgtcagcggccaatacgaacccactgatgaagaatctcaatggtcgtctgatgatgagtctgatcttccagaagccattaaagaaaaaattaagttagacgattctaaaaaagaaacagaacctcaagacgaaaaaggcgttcctgatttctggctcacaattttcaggaatgtcggcctactgtctgaaatggttcaacctcatgatgttccaatactcaaacatttgaatgatatcaagattatctgcaaagaggatccaatgaaattcattctcgagttccacttctccacaaatgaatacttcactaataccgtgctc

SEQ ID NO: 3638 - DNA, 408 bp, Diabrotica virgifera
  Clone ID: LIB150-028-Q1-E1-B11
ctacaattagagcgatgagagtgatccacaaattcaaacacgacaacaatcaacatctagaagctaatctgaaagctcaattcgccagtcaagcggcagctcgatggcttggtcttagattacagtttataggagtgatcataattacaggtgttagttttattgccgtcattcagcatcagtatgatatcgcggatccaggttttatcggattggccatttcgtacgctctgggaatcactggatcactcagcggcgtcgtcaactcgttcacggagacagagagggaaatggtggccgtcgaacgcatcaaccaatacgtagaatccattccaatggaaagtaaatattttgttatggatcctccattcgcttggcccagtcaaggtgttatctcttttgaacatg

SEQ ID NO: 3639 - DNA, 432 bp, Diabrotica virgifera
  Clone ID: LIB150-018-Q1-E1-D10
gttatattctctctacgcatttgagtataagtggtttaatatgggatgggaattacacaaaagactgtctttcatagaaactcattggccttatttcatgggatttggtttaccaatggccattgttacccagttatctgactcgtgggtgataagtggctgtgtgttctctgtattatttccctttttcataattagtggaaatgaggctagtcctatattgaataccagtgggtttcctctacacttctttgcgccagtgattgctatatcaaacacgttgtttagcaaaacaatcggcagttctaagaggtgaaaaagattgaaatgctcaacaatgattcattgtaaatatatgattaagaatttatacataagtgacgattttattttaattctttttgacaacttggaatttatgtttttcttttt

SEQ ID NO: 3640 - DNA, 426 bp, Diabrotica virgifera
  unsure (1)..(426): unsure at all n locations
  Clone ID: LIB149-031-Q1-E1-G7
acccacgcgtccggggatgtgatgtatcatgtgttgcaatgcaaatattagagaagcgcttttattagagttacttgaagacgatattgatttaaacgtagtaggtgcagctgtagaaatcttagctcagtcagttgatattgatgcaatggacatggacacaccagatgacttccataaccatgttagactgtccaaaggaagatttcagacacaaaaaattgatgttgatggacaaactattaactatgttaaagtcgggaatggtccgaagacagtgttgtgctttcctggagccttaggaacaatttggagcgattttaaacctcaagtggaaaatttagatagagaaaagtttactatagtagcatgggatccccctggttatggttacagtcgtccttcanatagaaaatttggaattca

SEQ ID NO: 3641 - DNA, 421 bp, Diabrotica virgifera
  unsure (1)..(421): unsure at all n locations
  Clone ID: LIB150-005-Q1-E2-D2
gcgtccacttaaaagttcgttgaagatggctcccactttgtacctgatcatagccagtcctgctgtaaggtcngtaactctatgtgccaatgctctcaatgtagaacttagcgagacacaagttaatcttcgtgctggagaacacctttcaccagaatttctcaagatcaatcctcaacatactgtacctgtgttggatgatgatggcttcgtaatagtggacagtcatgccatcaatacatatttagtagccaaatacggaaaagatgactctctttatccaaaagaccttaaaaagacggcgattgtcgatcacagacctcactatgattcaagtactttgtttgttagaggagtcgcaatttctagaagtcatctcttcgaatgtgagacagtaattgcccctaaattactaacagcg

SEQ ID NO: 3642 - DNA, 433 bp, Diabrotica virgifera
  Clone ID: LIB149-008-Q1-E1-B6
cccacgcgtccgcggacgcgtgggttggattattggatgtccaaaagtttgtaaaagatgtgggcagatacccttttaatagtatttatttctatatgcacggcattcttaggtgaaggtttaacatgggtgatggtataccgcaccgaaaaatatcaaaaattaaagactgaagttgaaaagcaaagtaaaaagttagaaaaacgaaaagaaattcatggagattcgttagataaacaacataagaagaaaatagaacgtgaagaagaaaggcttaaaaacaataacagagacttgtcttttgtcaaaatgaaatcaatgtttgcaataggttttgcatttacagctttattgagcatgttcaatagcatattcgatggaagagtggttgccagattacctttccaacccctgacttggatccaaggattga

SEQ ID NO: 3643 - DNA, 443 bp, Diabrotica virgifera
  Clone ID: LIB149-033-Q1-E1-B1
gcgggccgacacacgcctctacgatggttaccttgatattcacaaaaagcaacacgttcaactaagtgaacaagaattggtagattgtgacacagtaaacgagggatgcaatggaggtttaatgacagatgcctttaactacgttaagcgccatggtctagcagcagaaagtaaatataagtacacaggtaaacgtggtagttgcaagaacgtacacaaacaagtctcttccctcagtggattcgtaaatcttgctagaactgaaactgcactagttaatgctcttgctaatgtcggtccaatatctatagctgttgatgcagatacatggcagcattatggaggtggagttttcaataacaaaaattgtggaaccgccctcaatcacggtattcttgccgtaggatacactaaagatgcctttatcgttaagaactcatggg

SEQ ID NO: 3644 - DNA, 428 bp, Diabrotica virgifera
  unsure (1)..(428): unsure at all n locations
  Clone ID: LIB150-003-Q1-E2-F8
cggacgcgtgggcgacgccaggatataaacgagctcagcagtcatggctaaacgtaacaaggatgtcgaagccgaagtcctcaactggatcttcggttgcctgggtgaaccagttcccaaaggagaattcgaagatatacttaaagatggcgtcgtattgtgcaaccttatgaacaagcttacacctggatgtatcaagaaaatccaatccaaagggaccaactttcagctgatggaaaacatccaaaggtttcaagctgctgccaaaaaatacggtctaccggaagaagaaattttccagactgctgatctcttcgaaagaacgaatatcgcacaggttgctatttcattgttctccttgggtcgtatcacccaanaacacccagaatggaatggccctacactgggacctaagatggccgaagaaa

SEQ ID NO: 3645 - DNA, 388 bp, Diabrotica virgifera
  Clone ID: LIB149-037-Q1-E1-E4
accaagcgtccgccttcaccaagtattttccaataggatttatcatactatccttaagtactcttattgacagcttatgtcatgggtctcttttaatatcaccctatgggtttttaaagttaaatcttcttgagaatttgagctcattttatggagaacaaccttggcattggtatttatcctctggtttgcctggcatactaggtatacaagtgctaccttttcttctggctacagtggttgttttgaaaaatagaaaagtacatcccaatgagttagtgatgcttgggacaattgtttttgccgtggctgtgtacagttatttacctcacaaggaattcagatttttattacctctattacctttggtgttctatatatcatccag

SEQ ID NO: 3646 - DNA, 335 bp, Diabrotica virgifera
  Clone ID: LIB150-049-Q1-E1-H5
agcccacgcgtccgccacgcgtccggaactatagtggacattgttcggaacagaatatacctgagccaaaagaacccatgatattcagtaaattttcatctgtgattgtgggaccatacgacaatatagaaattccaccagtcacggacagtgttgattgggaagtagaactagcagtagtcataggaaagaaagcagaggcaattagacaagaccaagccaacgactatatattcggctataccgttgctcaagacattagtgcgagggactggcagaagaagagaaacaacggacaatttttgttaggaaaaagtatggacacgttttgtcct

SEQ ID NO: 3647 - DNA, 345 bp, Diabrotica virgifera
  unsure (1)..(345): unsure at all n locations
  Clone ID: pGUT638
ggcatacgcttaggggtttattcatcattgataccaagggagtggttcgtcaaatcacaatgaatgatctaccagtaggaagaagtgtagatgagaccattaggctggttcaagctttccaatttacggatcaaaatggtgaagtatgtccagctggatggaaaccaggacaagatacaatcatccccaatccagttgagaaaaagaaatacttcgaanaacactgaagagtgaatccanattcatgattttatcactgtaaacttanataactagactgactgaaatnttcttagaaccatcatctgacatcacatctntaccctgtgttactgactgttaatt

SEQ ID NO: 3648 - DNA, 343 bp, Diabrotica virgifera
  Clone ID: LIB150-010-Q1-E2-B6
cattaccttgttcaaatttagacattttaaacacctttcattgatctccaccgattgatgagtactgttcggctattcttcaaaatatggatacgatattgtgtgaactagaaaccagaaagttgtaatcaacattccttaatttacacattgtaacttctttgtaattgcaactttttacactacaatgccaaagtttttttctgattcaacaatctttaattacacctgggaccaagttgcacaaggtttttggaaaagatatcccaatcctaatagtaaacatgtgctgactgaagatacagtagaaagagaagtaaggagtggaaagttggtttccaaa

SEQ ID NO: 3649 - DNA, 414 bp, Diabrotica virgifera
  Clone ID: LIB3026-006-Q1-E1-F1
cccacgcgtccggattttgaaacggtgtttgaaaattatcattaaatatttaaaatctctatcagtctgatataacagcagcaaattatcacatcattttataatttcatcaatatcatggctggattaattaaaaatctggttaccagggttccacaaattctcaaaacagttccactgaaacaaataactcacagaaattttggtgtcacgtcatcgttatttattccaaaagtacaagaaccagctccaaatttttgtggaacagcagttgtgaatggttgcttcaaagacattaaattagctgactttaaggaaagatttgttgttctatttttccaaccctttagattcacatttgtttgccccacagaactagttgctttaaaagacaaacttgaagatttcaaacca

SEQ ID NO: 3650 - DNA, 397 bp, Diabrotica virgifera
  Clone ID: LIB150-007-Q1-E1-B9
agaagaacatcccattcttttgactgaagctccacttaacccaaaagccaacagagaaaagatgactcaaatcatgtttgaaactttcaatacccctgccatgtatgttgccattcaagctgtattgtctctgtacgcttccggtcgtaccactggtattgtacttgattctggagatggtgtatcccacacagtacccatctatgaaggttacgctctcccacacgccatcttgcgtttggacttggccggtagagacttgactgactaccttatgaagatcttaaccgaaagaggttactctttcaccaccacagctgaaagagagatcgttcgtgacatcaaggaaaaattgtgctatgtagctttggacttcgaacaggaaatgggcacagca

SEQ ID NO: 3651 - DNA, 383 bp, Diabrotica virgifera
  Clone ID: LIB149-030-Q1-E1-G10
agcccacgcgtccggttttaattatcagagttccgaacattcagtcagctttattttatttagtcattttgaataaacggtaggagtctgacgtctgactgtgacctagacctagagaccactctcgaaacatcactatcactggtctggtttacattttacattcagctgtctgatgcttgtctaatcctcaattttggaaatatttctagaaaacataacccataaccatgaaaatttggacaagtgaacacacatttaaccatccatgggaaaaagttgccactgcagcttggaggaaatatccaaatccacacaacacagctgttattggcactgatgttgtagaaagaaaagtggtggatggagtattgcacacacat

SEQ ID NO: 3652 - DNA, 404 bp, Diabrotica virgifera
  Clone ID: LIB149-012-Q1-E1-G3
tactttcaatgggtctaataaccctcagggcccttataaatttaaaaataaccccggtacaccaatctgtaagaaacagcggtcacagtgtaaattaccgaaaacgagctccagaagcctcaagaactgttatctgagctgctgaaggcgttcaaggtttcatgtggtggtggatcctttggcatttgtggacagaacctgaccacattcttggcaaatttccataaccagatccttccacatggtcagatgaagaactgggtatacaacagtaaaatgtgtatatttgttaatagcttcagttagttgtaataaatttttaacactacattaaattcgctcatcacagaaatcttcaccactcaatcttagagctacaggtattgctgtatccatggttgctg

SEQ ID NO: 3653 - DNA, 427 bp, Diabrotica virgifera
  Clone ID: LIB149-048-Q1-E1-D9
ctcgcgggtcgacacacgcctctaaattcactcatatcactacactgttctttggcttgtagatagcggacgtgatataaaatacaaaaatgtttgcctgtgctagactgattgcccctgccaccagaagcgcactcgttgccaacacaaaacaatacttgaggccactgagcagtgtagtaaaccaaagtcaaatacaggtacagaatgtgcaacaacacaagcaacctaccctcctccccgctatccgcagtttccaaactacaccagtcagcagagacattgactctgcagctaaattcattggtgctggtgctgccacagttggagtagctggatcaggagctggtattggaacagtgttcggttcactcatcatcggttacgccagaaaaccctgccctaaaacaccaactcttctcatacg

SEQ ID NO: 3654 - DNA, 476 bp, Diabrotica virgifera
  Clone ID: pGUT2727
tttaggcacaaacttattaaaggaatggagcgtttggtggccagttgtggaggtctttggacaactccttccaatcctggtacacttttagttgatctcttatccgacgacaagaattcattaccgtagaggaagaaatgcaaaatagtattagagaacatagagacaacggccatgccggcggcattttcgccagatacaatataattaggatacaaaaagttcaaaataaaaaattatgggaacggtatactcatagaaggaaagaagtttccgaagaaaacactaaccagtcatgcgaaagaatgctgttccatggttctccgttcatcaacgccattgtacaaaaaggttttgatgaaaggcacgcctacatcggaggaatgttcggcgcaggaatatattttgcagaacatttcgccaagagtaatcaatacgtgtatggaatatgaggaggcactggatgtcctacgcat

SEQ ID NO: 3655 - DNA, 357 bp, Diabrotica virgifera
  Clone ID: LIB149-037-Q1-E1-C6
accacgcgtccgtgaaagagttatagatagcgcaactgtttggtggccagctagagaaattgtagaaaaatctatagagagcagaaatcaagtacatgaaaacggacagatagttttactaaacgagagatgtccatggaaagatcatcttctggctttagaagaagatttggggatttccggacaaattaaatttgttatttttcatgatgctggcgattcatggagagtacaagctagacctatccaacctgatagttttatatgccgagtttttctacataaagattggcgaggcgttcgtgatgaccaactcagcactatatcgggcataaaagattgcatattttgtcatgc

SEQ ID NO: 3656 - DNA, 387 bp, Diabrotica virgifera
  unsure (1)..(387): unsure at all n locations
  Clone ID: LIB150-026-Q1-E1-A8
tacaagactctatagtgagtcgtattattcatcatttgttgcccaatttgtttcaatattgttctgattttatttaaaagcgatacttaaacatagtatataaccatggttgagaacagtacattaattatagatgaaaaatttcacctaatatccagaaacctgcaggaaatattaggtgaagatagaattaaagcagtattgaaagaacgtgatttgaagttgtattggggcacagctacaacgggtaaacctcacattgcttacttcgttcccatgtccaagatagcagactttcttagagctggagtagaagttactattctttttgctgatcttcatgcgtatttggataatatgaaggcaccctgngaacttctagcgctc

SEQ ID NO: 3657 - DNA, 443 bp, Diabrotica virgifera
  Clone ID: LIB149-014-Q1-E1-G1
ggaagctatggatattgtcataccagaacaagaagaaggtagtccttcggcagtaaaacaagtgctgcaagatgtggatactgaagatttgtacactaaatataaaaaacttcaacaacagttggagttcttggcggttcatgaagagtacattacagatgagcatcggaatctcacaaaggagtatttacatgctcatgaagaagtgaagcgtatccagtctgtcacgcttgttattggacagtttttagaagctgtagatcacaacactggcattgttggctcaactacaggttcaaattattatgttacaatcttatcaacagttgatagaaaactcatataaccttctgctagtgttgctcatcataaacacagcaatgccttagtagatgtcctaccaccagatgcacattcttcaataagcatgctccatgctgatg

SEQ ID NO: 3658 - DNA, 464 bp, Diabrotica virgifera
  Clone ID: LIB3026-016-Q1-E1-B8
taccggtccgaccattccgggtgcccccacgcgtccgccaacgcgtccgccaccatgtaccctggtattgctgacagaatgcagaaagaaataacctccttggcacccagcacaatgaaaatcaaaattattgctccaccagaaaggaaatactctgtttggattggtggttcaattttagcttctctttctactttccaacagatgtggatttccaaacaggaatatgatgaatctggaccatccattgttcacaggaagtgcttttaatttttatctatgtttaagtatattctttatatatcttgttttttatatcccccatcttggggcaagaactgcctatgttatatgagtgatcttgtgatttattacacgttcagcataagacttaatgagctttaattttaagaagtgtaagttgaatactctgtttcatatttattttacctttgtaatataat

SEQ ID NO: 3659 - DNA, 443 bp, Diabrotica virgifera
  Clone ID: LIB3026-009-Q1-E1-B6
cggacgcgtgggagactattaagattttcagtttttatttactaatataatttgaaatttttattttaaaaatgtctatttcttttaaaggaaaagttgtcctagtcagtggtggcagctctggcttgggtggagctacagccaaacgtttcggaagattgggagccaatgtcgccattgcccacaagaacatacctggagataccatcgaggaagtcgtagctgagatttccaaattttcgacgccactggtaatcgaatgtgatttgactgattccaaacagattgagcacgttgttaaccagaccgtaaagcattttggaaaaatagacgtactagtaaatgcagcaggtattttgcagaatggatccatcgaaaatacaactttggaaatgtttgataaagtgatgaatattaacgttagagctatgtttgaaatgatt

SEQ ID NO: 3660 - DNA, 457 bp, Diabrotica virgifera
  Clone ID: LIB150-013-Q1-E1-G7
gtaaaatacgaacgtatttctgatttttgtttcatcatgccccctaatcaaacatattgttatgaaaccataagctaatctgttattacaaataataaattattgaccttgaatactctcaacactacacattcttcagtatattacattttccagggaacggtaagtccccatcatgaagtgctttttaaaatatcctaaatattgtgatttccccatcgaataccttccatatggagtatttaccactccccatgagccttctccaagaattggggtggcaatagctgacctcattttagatttaaatgaggttgctcacttgtttacaggtccggatctgaggaatcatcagaatgtatttaaagaagccacattacacagcttaatggcactaagtccacaggcatggatagaagcaatggatacaatacagagccttctctctgaagataat

SEQ ID NO: 3661 - DNA, 456 bp, Diabrotica virgifera
  Clone ID: LIB150-045-Q1-E1-G8
tcgcgggtcgatacaagcgtctaaacacacgttctgatgacatcaatttctaaaaatgttcgcaaattcctaccaaagcggcttcatttcaatattctacagcgtaggaagtaatccactagcattatgggacaagcaggtaaagaacggacatatcagacggattatggacgatgatgtgaaatcattagttttggaaatatctggaactaatgtagctactacttatataacgtgccccatcaaaccacgagcttcacttggaatcagattaccttttctgattatgattataaagaatatgaagaagtactttacatttgaaattcaaatattagatgataaagatatgcgtagaaggtttagaatatcaaatttccaatcatccaccaaagtgagaccgttctgtacaacgatgccaatgggactcagcagtggctggaatcaagttcaatt

SEQ ID NO: 3662 - DNA, 297 bp, Diabrotica virgifera
  Clone ID: LIB150-044-Q1-E1-G10
gcgtccgagttcacgtcgtcccgtgacgtgtctttggcatatggtactaatcggtcaacatgtgtgaagaagaagttgctgcttgagtcgtagacattggattcggtatatgcagagctggttttgccgtggatgatgcagtgtgagcggtcagtccttggattatatgatttccaatacatcacggtgtgatagtaggattgggcctgctagagtcatatgttagtcaccatacgtagagcgtgtcaggtatgtctatgtcaaagttgccaatccaacatgataactttgcaagtg

SEQ ID NO: 3663 - DNA, 224 bp, Diabrotica virgifera
  unsure (1)..(224): unsure at all n locations
  Clone ID: LIB3026-003-Q1-E1-G7
cccacgcgtccgggagcattcaggtgttacttggacacaggtttaaaccgtaccagtactggcgcccgtgtctttggagccatgaaaggagctgtcgatggaggcttaaacattccccactctacaaaaagattccctggttttgacagcgaatcgaaaagcttcaatgctgaaggcgacantggtcgcattttcngtcgcggggggggggggtatatgaaatc

SEQ ID NO: 3664 - DNA, 383 bp, Diabrotica virgifera
  Clone ID: LIB150-032-Q1-E1-H11
accacgcgtccgcccacgcgtccgcccacgcgtccgcccacgcgtccgcaacaacataacataattttttcacgttataagtttaatcttcaatttaatattaatattgtaataaactcataaatatttcaattatggcaggatctgcactgcgaagacttatggcagaatataaacagttaacactgaatccacctgaaggtataatagccggtccaattaatgaagaaaacttttttgaatgggaagcactaatcacaggtccggaaggtacttgttttgaaggaggagtgtttccggcaaaacttatttttcctcctgactatcccttaagtccaccaaagatgcaatttacctgtgaaatgtttcatccaaatatatac

SEQ ID NO: 3665 - DNA, 208 bp, Diabrotica virgifera
  Clone ID: LIB3026-008-Q1-E1-H6
ataaaacatgtccttctgtattaaatataaagtctcgcctgcgcaatgattaaattgaatgggcgcggtagtttgaccgtgctaaggtaacataatcattagtttttttattgaaagctggaatgaagggttggatgaaaaaaaaaactgtctttatttaatttataaagaattttacttttaagttaaaaagcttacatttttttaa

SEQ ID NO: 3666 - DNA, 423 bp, Diabrotica virgifera
  Clone ID: LIB149-031-Q1-E1-D5
acccacgcgtccggtaggttaccagcctactttggccactgacatgggtagcatgcaggaacgtattaccaccaccaagaagggttccattacatcagtacaggctatctatgtacctgctgatgacttgacagatcctgccccagccaccacattcgctcacttggacgccaccactgtattgtcccgtgccattgctgaattgggtatctacccagctgtagatcctttggattccacctcacgtatcatggaccccaacattattggagccgaacattacaaagttgctcgtgatgtacaaaagatcttgcaagattataaatcactacaggatattattgctatcttgggtatggatgaattgtctgaagatgacaaacttactgtatctcgtgctagaaagatccaacgtttcctttc

SEQ ID NO: 3667 - DNA, 419 bp, Diabrotica virgifera
  Clone ID: LIB149-003-Q1-E1-A11
aaaaatatcaaatttttcagatatttaaggcaaatttacaaattactataaatttatttttaatgttttctaaactcataaaaatatacggagtttaatttgttttaaaccccattgttttgaacaattaatttcagatgcaaatatttttgcatatatattttgaatttttcaatatattgtcgatctagtatcacttcgatattatgcttataaaattttttgtagacgaaatttatgaacatcctaaaaatacttccagaggagatagtacagtatagctccaagaaaaactgacttactggaaaagttctagttacttgtagaaatattcccgaaaagacattctactgctctacaggattgtcaatactgttaagttatatatatttgaataggtataataaaattgttctgta

SEQ ID NO: 3668 - DNA, 346 bp, Diabrotica virgifera
  Clone ID: LIB149-003-Q1-E1-A2
aatttgaaaaagtggatccatcctgacaattagccgccaatgcatctccaaaatcaaaactttaaattagctgatctgttcttattcatgttcatgccaattattggttttcatcaaaatatgttttcactattcaatcattaaaatattttttcactattcaatcattggactgagtaatcaaattttacaaatagttaaattttttttagttgctatggatgcattggtgcttcgggaccttaatttatttttgtagttatttttgtattaactacatcactaataaatatttttatttaaaaaaaaaaattttttaaaaaattggaattacgttaagtgaaaa

SEQ ID NO: 3669 - DNA, 450 bp, Diabrotica virgifera
  Clone ID: LIB149-003-Q1-E1-A3
ggtcagggattcccgggcacgacgtacacccacacgtccgcccacgcgtccgcccacgcgtccggtgtctagttcttctttccctagtaacccttagtgtagctgcctactacccaagtactggtaggcaggtgacagtaggagtagctggaaatgtgaaactagtcggctctcaaggttcccagattgacattcgtagaagtccttacaacccaagaactgtcgacgtcaccctcagaagtccaaatgctccaaccagaactctgcaaattgatgaagccaggaacggccaacaacttggttattccaacctccaaggtgtcaacaaccaaggtgtcaaccaggctgatgttcttgctgatcttttcagtcaatatgagggtattgtagatgaccagaccttctacagtttgttgaacaaacttcaacatttggtacaagctggagtca

SEQ ID NO: 3670 - DNA, 341 bp, Diabrotica virgifera
  unsure (1)..(341): unsure at all n locations
  Clone ID: LIB149-003-Q1-E1-A4
agaggagtttacataatttgcaaaattccaaacttaatccgaacattccaataatttaacttcagtaaccaaaaattggaattttaatgggttcaataattccagaattaagaaaactttgccggtaagcacatttaatcataacctaaggggcccgtacttaaaaccgaacaagaacgacggttgttgtgctcttttnaagtttgtttttcgattggaacaaatcacggtcaagtagtttagtttgtgtgatatattatatcaacagtataattcataatttattttgttgttaatatgtatagatctatttcaancaatatttgcaataaacaacaagt

SEQ ID NO: 3671 - DNA, 404 bp, Diabrotica virgifera
  Clone ID: LIB149-003-Q1-E1-B10
agtcctcttcttctgcgccatcattttggcttcagcagctgctttaccaacccaatcagctgacggaggtgttgtcgacatcatcaaaaaggtcgtgcacaagcttgaagacataatggaaaaggtttttactgaaggtcccaatttcatcgacactttccctgacaagtatgacgaccgccttactaaagtgctagatgttacaagggccgtgcttactaaaatcgctcaagcacttaaagttgttatagataaagttgctgaacaaagtaatgatgctggaaagaaattggtttcctgtgtcgaacaacacgaagctgatctcgtcaatatccgcgtcgctctcgtcgaaggtgccggcaaatgcgtaaaagatagcgtcgtcgctttggttaacactggcg

SEQ ID NO: 3672 - DNA, 438 bp, Diabrotica virgifera
  Clone ID: LIB149-003-Q1-E1-B11
ccgggccgacccaaacgtcaactttttctgaaaaacaaaaaatttatatatacttataatcataaaataaatatatataaaaaaataaaaatttgcattatggatcgaacacgtgtatattaggttgtgaatcaagcacgttaaaatacacccaattagacacgccaactgcatgttttaaactttttgacagttggtcatatttgcttattgtctgaattaatcaaattagtttaatttttatggaattaaaatattaaaatacaacaaaatatagagtaagaaaacaatatattagatggagattggtagaaattttgttggaaatcaaattgtgtaaatcgaagcacttcaacattttacatttcccaaataggtttataatttttattacaatactaaaacatttacagttacagctcccggaacaaaccatga

SEQ ID NO: 3673 - DNA, 293 bp, Diabrotica virgifera
  Clone ID: LIB149-003-Q1-E1-B3
cgcgtccaatttatatttattttaaaataataaaatattttttagtaaaagtaaagaaaaattttatttaatgatagttaattagtattgtgagagaatattttatttttataaaagaaaaatttattttttgtaccttgtgtatcaaggattattaattaataattatatatttaataatttcgaatttaaaagagcttaaaaatttaaatttttaatgtgaaataaatattttatataaattttttgtgatgaaatgttattcccctttaaaaaaaacccacaattttttt

SEQ ID NO: 3674 - DNA, 118 bp, Diabrotica virgifera
  Clone ID: LIB149-003-Q1-E1-B5
agatttattttaaaataataaaatattttttagtaaaagtaaagaaaaattttatttagggatagttaattagtgttgtgagagattattttttttaaaaaaagaaattttttgttcc

SEQ ID NO: 3675 - DNA, 202 bp, Diabrotica virgifera
  Clone ID: LIB149-003-Q1-E1-C10
acccacgcgtccggttgaaattgtttaaatggtacaaaaaataaggttttgatttttctgtttcttaagctgacattttggttataaaaacgttaaattatataaataaagatttaagtttgtcttaaaaaaaaaaaaaaaaaaaaaaaaaaaaaaaaaaaaaaaaaaaaaggcaaaaaaacaaaaagataaaaaataaaaa

SEQ ID NO: 3676 - DNA, 269 bp, Diabrotica virgifera
  Clone ID: LIB149-003-Q1-E1-C12
agtcgtagtactctgacaacgtgattgaaaacaaacttcgtttcgctgtattccaagacaacctcgtagagatcgaggtacacaatgctaagtacgaaagtggtgagagagcctactacatggctgttaagaggggcgccgattggtcgagcgcggatttccaggcaaggttaggtcgtcagtatggatttatgcttatccaatctattatagctaaacacgtagccgttctcatggtccatgcagtatttgaatttgtttgttgagat

SEQ ID NO: 3677 - DNA, 407 bp, Diabrotica virgifera
  unsure (1)..(407): unsure at all n locations
  Clone ID: LIB149-003-Q1-E1-C6
cttggaaggattcgctttatttttcgtttgattaacttttccgattttgttaaattattgataatatttttagaataaaaaattctcctaaaactttatatactcgcattagaattcgaaatatttttacgtaaaatatacttacctacctacctacatataactaaaactcacaattaacaacaatctattctttcaaagaggccaacaacttatacaacaacaacaaatataataaattaactatcaataaacattactttcctatgaaaccacaataacgaattcttaaattaacacactactgcactgaacagatatcgataaagatgacagaacagattagagaaaatatgacgcaggtttgtcanaatgacagtgataatttctctatgttgccgaattag

SEQ ID NO: 3678 - DNA, 413 bp, Diabrotica virgifera
  Clone ID: LIB149-003-Q1-E1-C9
actcaaagatttgttctaagcggcgcgttgtaattctcattgtcggttcatacttttgtgaagtgtgtaccctttgagtcgaaggttctaaatctcaggatcctaagggaatattgacctgaagaagtttttgtagttacgctcatgtctcaacaacagaaaattcgatctggtagagacgcgtgctaaatgagtcatctatcgattagaggtagcgaacagcgcccctttagcagacattgagtagagttagagctagcttgtggataggatactcagagtgtcagtggtgcggacacccggcaacaaatatacaatagttcaccggagacagtgctaaaatcagtggaaaactggaagggctatacagtaggtctgaaaagtgaccagaagggcgtcacctaacacacatg

SEQ ID NO: 3679 - DNA, 298 bp, Diabrotica virgifera
  Clone ID: LIB149-003-Q1-E1-D11
gtgcgtcgtcataaactgatttcgttggtgggcgaatggtccgacatcgataggaactacgccatatctctgatcgcctgttcgaaaacttggaacaatgccatccagaatggactattagtacggtactatgggcgcggcttgggacggatcacgcatcgatgtctagaggagatgctatcgtcactctcgtctacgatacagtttaaccaacgaccttataaatatggttaagcagtggtagacggatagttatcatcgctctaggatgaatcttacagatatcaaagatatggac

SEQ ID NO: 3680 - DNA, 316 bp, Diabrotica virgifera
  Clone ID: LIB149-003-Q1-E1-D2
gcccgggccgatccacacgtcaacggacgcgtgggcggacgcgtggggactcttcctgcactctccgatttaaccagagtattatgcagctgctgcattttcgtgttgcaaagaaattgaaaatgtttatattatattctttttatcaatttatgtatagtaagtgaactgacagccctgaaatcaattgtatataggttgaacaccgctaaaatgaagataagagaagcttaggtttaaattttcgcattttcgaaataattaacattattaactaaatcggacattgttccatttttacctgaccgggaatttt

SEQ ID NO: 3681 - DNA, 420 bp, Diabrotica virgifera
  Clone ID: LIB149-003-Q1-E1-D6
acggacgcgtgggcggacgcgtggggactcttcctgcactctccgatttaaccagagtattatgcagctgctgcattttcgtgttgcaaagaaattgaaaatgtttatattatattctttttatcaatttatgtatagtaactgaactgacagccctgaaatcaattgtatatatgttgaacaccgctaaaatgaagataagataagcttatgtttaaattttcgcattttcgaaataattaacattattaactatatcggacattgttccatttttatctaatcggatatttttgtaattaatatatgaacattctgataccacatgggtttttccaaatattgttttggtctttattggacgttaattaataataagtctatttgcgaatatattaaagtacaaatgtttgaaagacg

SEQ ID NO: 3682 - DNA, 379 bp, Diabrotica virgifera
  Clone ID: LIB149-003-Q1-E1-D7
agtttcttagaaatgggttctacaatgtggttggtttccactcgggtaaaatcagttttatttttcaatccggtgcccaaatttatgttttgacaagtgtattttgcttaatcctcaaaatgaaaaaacaatctataaatttgtaaaatggtggaaactggggattacgtcaataactataagacagttgaagaaccatttggatatcttatccaataactccagaacagttgacaaaccatttgacgacatttggtatgtcccttcaacctggtaccgtatcacgtatcttcagtacgtttgaagagctgtagtttttgggtacttcatgttcgtcctcttttaacattaacaatttggtataaattatctccaaaaa

SEQ ID NO: 3683 - DNA, 303 bp, Diabrotica virgifera
  Clone ID: LIB149-003-Q1-E1-E10
acacaacgtgggacactgttgcatgccgttgcatgctggttgtgactgctggttgtagctgcatacggataactacgtgttgcgcgatggccacacgtccgaagcgcagcatgcttcgaccggcatacataattgcgtgactggtgttaacaacgtaccaatctcttctaatagtggcatcatagaacatgtgttgtcagcagaagtacactcggcagctgttgcactcgtaggtctagtttccaacacagcagatcatggaccatggcaattcacctgctagagggatatccacaacaaggt

SEQ ID NO: 3684 - DNA, 417 bp, Diabrotica virgifera
  Clone ID: LIB149-003-Q1-E1-E2
agttaactgcaagtttgttcatgtgtaattaattcccagaatcgtttcaatattaatttatatatccttattcatcctcatttgtattgtggaatcttgcattgacacacacttacctaatttttaaagagacaaacgataatttcttctttgtccgtcagctcctatattttttgaacatcttcaataccatatttactcgttggaaaatggactgcaagaagttatgtttgtctccttatttttattctagagtacctatatgtaacctaagatatctatatcgaaagtgatgtgagtgtaaattatatgtttttatgtaaagagtttactatatatatttttatgaaaaatttaaatctagtgatattaaatataagctgtgagtctctattgaacgccattttttgacttgct

SEQ ID NO: 3685 - DNA, 393 bp, Diabrotica virgifera
  unsure (1)..(393): unsure at all n locations
  Clone ID: LIB149-003-Q1-E1-E7
agtaacaaacaaaaacgaattgtccaaaatgctgcttaaaattgtcgtcgtttgctgctgcatttcaattgcactcagtcaagctgttggaaaatgtcccagtgtagatggtagatatccagtataccttcctgatgcaacatcctgctcaacattttatgaatgttctaatggaacaccataccaattcaaatgtgcgtatggaacatatttcgacagccagagcagaatatgcagacataaacgagacgtcaattgtggcagtagaaggagagattagtactctagttaaaaaaatgtaaatttgttttaattctcgtagtacctgtgatacacatattttttatattgtgttaaaaattaanaaataataaaaaagtgattacatctaaa

SEQ ID NO: 3686 - DNA, 328 bp, Diabrotica virgifera
  Clone ID: LIB149-003-Q1-E1-E8
atgaaaatcaccgctagaaaacgccatcccgaattaatcacattcaagtatggcgtacccgatggcgagaatttgaaaatatcggacatggataggtttcttataccgaacgcggataaagcaacgaaagtagtgtctgatcaaattcttaatcaattaaaagctaaagagtgacctttttagaataagcaaaacctcctaaataattggtaaagtgcaataagaactaaattaattaataatatccaaaataatttaactgtgttaaaaaaaaattttaagaaaaaaaataggattaagaaagaaggagtctaatgaaaaataaagg

SEQ ID NO: 3687 - DNA, 377 bp, Diabrotica virgifera
  Clone ID: LIB149-003-Q1-E1-E9
atgaattgatggttaatgatgctaatggagaaaggagggttatgatatttaactaaaaaaataaactgtcttaatagttaacaattattgttaactcttagttttaatttcgtctttccaaataaataaaaataattcaaaaaaaaaaaaaaaaaaaaaaaaaaaaaaaaaaaaaaaaaaaaaaaagaaaaaaaaaaaaaaaaaaacaacagaagaagaaaaaatttgtataaggaacaaacgattataggggcgataaaaaaaaaagggggggccccacaaaaaggataagccaaactttgccatgtaggatacgaaaaagccttcaaaaagggtcccaaaaattcttccacggggcttcctttaaaacatgggta

SEQ ID NO: 3688 - DNA, 396 bp, Diabrotica virgifera
  Clone ID: LIB149-003-Q1-E1-F1
aaaaataaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataatattaatattaaaaaattgtatatttagtaaaaatatataggtttaataaa

SEQ ID NO: 3689 - DNA, 414 bp, Diabrotica virgifera
  unsure (1)..(414): unsure at all n locations
  Clone ID: LIB149-003-Q1-E1-F10
atttggaatgaagatcgcaaagcttgtgactttgctgcaaacaccgaatgaaaatgttggccatttccagaacccgactgctcggatggcaaaaattcttactggagatatccctttgattgtgccctattctgggagtgtatgaataaccaattgtatcttttgccatgccctgatgattatttctgggatgacgccattaaaaaatgtgatattaatgaagctgttgattgctctggcatcattcctaatccaaatagcacaactactcaagctccagtcaccacaactagtgaaccttttccatatacaactcctgaaatgatctgtactgatgacaacacctatttcncttacatttgtgattgctcaaagtactacgaatgttccaacggaataccagttctaatggat

SEQ ID NO: 3690 - DNA, 386 bp, Diabrotica virgifera
  Clone ID: LIB149-003-Q1-E1-F11
gaacgggctaaatagatggtttgttcaagtttcaaaactttatgtggacaaataaagtactaagaggacaaataattacacattccaaagaaggatagcgtttttatttgatgactacattagatgtgtatttagaagctgaattattttttaacttactcactaaatttaatggtacaacatacgcgcataaattctcaatttgggacatacagaatattccgtgttatatagaatactttttaatgtatcccataatcgacgtatttttcctcattacatttattaccatgattttttaattcctgtcacggactaaagctcgttaggtgacttcactatgggcacagagttgtgtgaggttaaaaagacttttgtcaagttcg

SEQ ID NO: 3691 - DNA, 392 bp, Diabrotica virgifera
  Clone ID: LIB149-003-Q1-E1-F2
agcgacatcgaaccaaaatggcaaaaatcgtcctcttcttctgcgccatcattttggcttcagcagctgctttaccaacccaatcagctgacggaggtgttgtcgacatcatcaaaaaggtcgtgcacaagcttgaagacataatggaaaaggtttttactgaaggtcccaatttcatcgacactttccctgacaagtatgacgaccgccttactaaagtgctagatgttacaaggaccgtgcttactaaaatcgctcaagcacttaaagttgttatagataaagttgctgaacaaagtaatgatgctggaaagaaattggtttcctgtgtcgaacaacacgaagctgatctcgtcaatatccgcgtcgctctcgtcgaaggtgccggcaaa

SEQ ID NO: 3692 - DNA, 305 bp, Diabrotica virgifera
  Clone ID: LIB149-003-Q1-E1-F3
cacgcgtccacccacacgtccgcccacgcgtctgcttaggagtctttcgcagcgtcattgggaacctttttttacaagtggtcctaatatctaaagtttgttcgctaaccaggttatttaacggggctggaacagctacgtattagataagtttactgtggacgtggcaaacttttcactaacaggagattgcctagtccagttactacactgagatgggtctgctaatagacctatggttttgatacgttcaatcgacatgctggaaatgagtgatatacaagttgacacgaaagttgtattta

SEQ ID NO: 3693 - DNA, 399 bp, Diabrotica virgifera
  Clone ID: LIB149-003-Q1-E1-F7
agtcagatttctcccagcccttcgcactctttctcagcgtcattgggaacctttttttacgaatgcccctagtatctaaagtttgttcgctaaccaaattatttaacggggctggaacagctacgtattatataagtttactgtagacgtggcaaacttttcactaacaggagattgcctagtccaattactacactgagatggctctgcgaataaacctatggttttgatacgttcaaccgacatgctggaaatgatcgacatacaagttgacacgaaagttgtatttattttatgtaaatgaagtgaacaatgtttatcgggctaatttttatataatagcttatctagtagtcagatttggtattacttaaggaagtatgtgatttatagttatga

SEQ ID NO: 3694 - DNA, 416 bp, Diabrotica virgifera
  Clone ID: LIB149-003-Q1-E1-F8
aacttttccaataacctatttgttcatcacacatctgtcattctagctatgtgtcctgcccatctcaaatttcctgctcccttcatttgctgcccaggtgccccgcacccccggccatatgtctaaatatactatagtaaacattttttttaatacacaagtgccttgggtaatattatcttctaatacttttgatactttgtgctcaccattaccaaactatttttaatgtttgtcgatcccaacattacaattaaaatatatttgttttgagattatctgtctacaaattacaatttattgaaatgagattgcatttctcatttcaaacctaaaatgtgatgttaaagtgattgaagatgatttcaattttaaattgaaaaagtaatatatattatgttagtaataattttaac

SEQ ID NO: 3695 - DNA, 412 bp, Diabrotica virgifera
  Clone ID: LIB149-003-Q1-E1-F9
acccacgcgtccggttggataataacacataagggttacaattgtaatcagaatagtgttgtactttatttaaatggtatatcactgacttaatatatgctaggatcgtatttattcttatgacatatgcattgacatatgggaatcttatttcattttgagttccaaattgaaagtttttaataacatttagctattatgatttagcatcaggaattcgatttatgtttgatgaagcttttctgatagtattgattatgtctcttcaaatttatatgtggtattgactacgacaaacgtatacattcatgtccaaagaaatgagactgacctttttcgggtgtagtgagaatgtcttcacataagacccgtttccagctatccttggctgcaatcagaacctcggtctggc

SEQ ID NO: 3696 - DNA, 399 bp, Diabrotica virgifera
  Clone ID: LIB149-003-Q1-E1-G10
acccacgcgtccgcggacgcgtgggttcgtacataacaggcaccacagtctaaagatagattttgataatcgcgcagtgtacaattacttggaattccacataatagacggtattttacgagacatcaacttcagaatagattttttattcgtataatagagggaatttttttatgtcaacatatgaggaactcgagaatgggagtaacgtcaggtaaccaatactgagttaaaacttgataagacctttgactttattactgagtacatacgccggggtccacatttacccccatggtcatccgcatgttaactagtttcaccgtgatcgcacgttggtttttgataagtcacgcacaagtgccacgaaaactgctagcacggatgacaacgtgagag

SEQ ID NO: 3697 - DNA, 342 bp, Diabrotica virgifera
  Clone ID: LIB149-003-Q1-E1-G11
aagagtcggacctacccaaattaaaattattgaaatgacagttcaatttaaattttaaaaaagatagaagattaaatttgacaaaatggcaggtggtacttctgactacaggggtccatcaattaatcccgatcagcaaaacattacttattctaccatcactaagcaacaaccattaacaaaattcccaataaaaaaccaaggccataattttaccggcagtagacggaataagaacagaagagtacaccattgcactacgaactatagtccatccaaaaaatgtactgttctcatccaaaatgtcactcggaagaatatgcatctacctttcaagcatac

SEQ ID NO: 3698 - DNA, 352 bp, Diabrotica virgifera
  unsure (1)..(352): unsure at all n locations
  Clone ID: LIB149-003-Q1-E1-G2
aacgatcgcaactcattacagaacactcaaataaaaatgtgtagttctttaacagctgattatgacatgtatgtgataacctacaacttttttaataataaaaataatataattattaatatgagttagaacgagatcttttatatattaagaagaaaacaagagtttgaaataccaaattatgacgacatgcaatttttaagaggcacacatgtgttacataatccaaataggtttaaggcagttagtacttccacctagggaaaaagttacaaggcaagaaaataataggattcgcanatcaaggatattatgaagtaatagctgacgtaagaaactatganaaattttt

SEQ ID NO: 3699 - DNA, 390 bp, Diabrotica virgifera
  Clone ID: LIB149-003-Q1-E1-G7
atgcagagtataaaaatgaaccaaatacttattcgttcaattgtgtgcgtacttgcagtccattttgtaagttccgttagtctccaaaagggtacacttggtatcagagagggcaattgcaccagtcgaaatccaaaacaggcagtattgaaagattatgtccacaagactagcattccttttgtcaaaagagagtaaacagttgaatggcacggtgatcaaaaaatttactgcgtaacagccatcagtcttaagagcgccgacaaaggttcaactgcttggatctcagatggtggcgttaaccacacctacatcgcagtcgaactggaatctggtacatggcatggcttgcgatacaacgtatacatttatgctacataatgttattga

SEQ ID NO: 3700 - DNA, 232 bp, Diabrotica virgifera
  Clone ID: LIB149-003-Q1-E1-G8
aggaagagctgttggatatcttagatcatttctttgatcctgaaaagaaagcaattcagccaaaacctaaacctagcccccaacgttatccgtatggtcggaggccaaaattcgtgaggaacaaaaacaattcacagagcaagaacccaaaaacaaactcgactgcaaacgacaatccaaccgccagcgacgattcttctcctcgaagcgaatctgaacaacctgcacaaga

SEQ ID NO: 3701 - DNA, 406 bp, Diabrotica virgifera
  Clone ID: LIB149-003-Q1-E1-G9
acccacgcgtccggacgacttatttcaatttaaatctttgttttttatttgttaattcttcttcttcttcctctttataagcaattctgcttgttcactgtgtaattgttaattatgcgcaaaaaaggtgatttttggaatttgttttaaaaattgtttaaacaatttgtgcccaaaaacttcgcctgactcccttcagatttgattaaagggcatattttttaacatgaatccgcaaagacaccgaaacatttttcttaagggaaaactcctcataacctggacaagtagtagaactgtagtaatgtctttcgcttctcttgcttaaatttttttaagtttctgtatcataaaaaaactttcttaatataaacctcaattagtaaatcaagcctagaaaagaatg

SEQ ID NO: 3702 - DNA, 416 bp, Diabrotica virgifera
  Clone ID: LIB149-003-Q1-E1-H2
gtccgataattaaatgttcaattatatttatattattaaatcaccctttaacttgtggtttaatattattaatacaaacaattttcacatcaattattacaagattaataaattataattaccgaatttcgtaaaatttaattttaaatataattcgagggacaataaaccctttaaattaaaaaccccagaattgctccaaatgaaaaatttaaattaaatttaaatataactttaataataattagaatttttattattatttctatattaagatttattttagattatttttattttaactcttttataaaaattatagaaatgaataaccaatttaatattattaataataaattaacttaaattaaatattttaatttttcaaaataatttaatcataataataataaatt

SEQ ID NO: 3703 - DNA, 386 bp, Diabrotica virgifera
  Clone ID: LIB149-003-Q1-E1-H5
aaaaagattgtcattgaaaaaaatactaaacatcaatatttcccattctaaaataattaaaattgtaaaaatgccacaagaaaatggcttcagaactagacaggttttaatgtaaatactaaaagcccatgcggcaattgtgactgtgtctatctttagattttgtatacatagttgtcatatttcaatttgcattccaaaaggtatttttgttttttggccaaacggctgactttggaaaggggtgttatggcttttttgctctacatggtgccttctacctatgcctttaacgaacgcactattttcggagacaccctgtatttataactatattaaacacagcaacacagtcctctttagttgcctaaatgtcttcgggtttc

SEQ ID NO: 3704 - DNA, 397 bp, Diabrotica virgifera
  Clone ID: LIB149-003-Q1-E1-H7
attctgttaaatgttgatataatctgtatactattaataataaacggattatacgacatatgacagaagctcgaaacaagtgacgttcgttgaaaagccctattgaggatcgctaaatatctaggatggccctctagtatgttaaatcaattaatttgtagcaaaatatacaagatatcagttattttacacctcacttaatctggaagaataattttcttttattgataatataaacaggatctacgccgattttaaaaagtcaattttgtgaaatctgcgctgtgctgtatttaaaagatgatacaatgtagtgtgtatactgtatacctataacattttctagaagaaaatgtttactgttgttactacggcaatagttctctacacgtagttt

SEQ ID NO: 3705 - DNA, 192 bp, Diabrotica virgifera
  Clone ID: LIB149-003-Q1-E1-H8
acccaaacgtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggcggccccccaaaaggttcaaacctaacttacccttgaatgcaacttaaaacccctccaaaag

SEQ ID NO: 3706 - DNA, 371 bp, Diabrotica virgifera
  Clone ID: LIB149-004-Q1-E1-A1
ccgggcggacgcacgcgtcagaaatctttctagtttttaagtaaatacagtgacatgtatctaaagaatccggtccaatggtgtggtacttaatattttaagagactatcaaatatagatgtctataaaatgtcccaagatacaacagcctacctaccacataaaacatcatccagaattttagatatggatgttgcagtttagtttaaattttatcatgaccttggtctctttaattacatttcccttttggtcttaattttggtcgtaaaatttgtaaaatgacaagaagctacaattaattgcagttctattatgagacattttatatgagagaaactttaattggacgaaaatccagtagatttttt

SEQ ID NO: 3707 - DNA, 436 bp, Diabrotica virgifera
  Clone ID: LIB149-004-Q1-E1-A11
actcgcgggtcgacccaagcctctagttttagtctcgtaagcaactacgaagcaaccgttaaagagcttttccttacacagcactacaaaggaacctacaacataaccatgattaaaccaaaatggactggaagaatcagcgcacaaaaagtccccaccgtcttaacacctaagcccattgtagacagttttaccgtcgactggcaagttgcagatgtaaaatgcaaaatcactggtatgggaataattggagacacttatgctctcgctattcaagaaggtattgaaacggccctcaaccatggtcttatcggaaataccgtcggagacttccttaaaatgagattcaacactgtctggtatcccactggcaaagtctggcaaatgatggactggtgcaacggcggctccaccgacgccccaacaacagctgcac

SEQ ID NO: 3708 - DNA, 417 bp, Diabrotica virgifera
  Clone ID: LIB149-004-Q1-E1-A2
agaaaaatttcagtactattaaaaaaaattttttatgatgaaaaaataattatttttctattcaatcaagaaacagaaaatacgaatagtgaaaatgtccgaaacattcattgaacacgaaaaatcctcccaaagtgtaatttcctccgattccggcaaagacattctagaagaatctgacgtacccgatctagaacccattagctcaagtgaagacaatatcagtaaaaacgatgaagttgaaaatatacccgaagaagagaaagaaaaaatcaatgaacctgaagaacctaaaccagaatgggttgatcttcttggcagtggggctattatgaaaaagaccattgctgaaggtaaaccagacactagaccacaaagaagcgaaaagtgcattataaattacagttgctacctcga

SEQ ID NO: 3709 - DNA, 411 bp, Diabrotica virgifera
  Clone ID: LIB149-004-Q1-E1-A5
atcagcggacgcgtgggttcggagccaaataccctcattgactgccctatatgttagtgcaccatagattgttgcgcatactaccgaccgcacatcgcacaaataattcaatactagcagaacttaatataaaagctagaatcaccacaactttcgatcgaaatatactgggatatgtattattatgctctgtattttctctctgttatgagattgatcggcatctcattatttcgattaattaattaattattttgattgctactcatgaaaacaaaaccaatttcagtaaaactttacaatagaaaatattctcagggctaattaattttaatgtattacctttagtttgtggcttgtagtatttctcgttgcttactttatccaggacaaaagagggaaaacaaatat

SEQ ID NO: 3710 - DNA, 416 bp, Diabrotica virgifera
  Clone ID: LIB149-004-Q1-E1-A6
atcagtttttttttttttttttttttttgaacatttacgttttattgaaatgtacaaaagatatttatttcgaaaataaacttatgacgcacaacttaaaacacaggtgaaaatatatgtatatataatttatgaaatatgaaacttttggaatgcttatagataaaagcaatctgaatctcttttgcaatacatctagtttgcaaaatctggtcattaacatttgatacatgaatggctgtaagagtagaaaatactgtccaccaattaggcaagaataagatctaaacaaaaggtacctatgggctttttacaatatttttgatgactaataattttgatgcaatgataattattattcacacagatatctgctgatcttatcatcactagattatagaaatgtgatgttgaac

SEQ ID NO: 3711 - DNA, 292 bp, Diabrotica virgifera
  Clone ID: LIB149-004-Q1-E1-A9
aatttttatttattttaaaataataaaatattttttagtaaaagtaaagaaaaattttagttaatgatagttaattagtagtgtgagagaatattttatttttataaaagaaaaatttattttttgtaccttgtgtaaccaggaataataattaattattaaaaaattaataatttccaatttaaaagaacttaaaaatttaaatttttaatggtaaataaataatttaaataaattttttggaatgaaatggtaatccgttttaaataaaaccaaatttttaagaaattaa

SEQ ID NO: 3712 - DNA, 204 bp, Diabrotica virgifera
  Clone ID: LIB149-004-Q1-E1-B10
acaagcctctaaacagacgttctgatacaacactgtctggtatcccactggcaaagtctggcaaatgctggattattgcaactccctcgtgtccaccccagatgcacgacaagcctagttttaatcaaataatcaggttaaataagaaggtattttcctttgtaaccataaaatacaattaaatggtaataattattattcacc

SEQ ID NO: 3713 - DNA, 409 bp, Diabrotica virgifera
  Clone ID: LIB149-004-Q1-E1-B12
actttgataccctctcagtagaacctttgttctgcgtttcgcttgaccgaccgcagtgtgtttctgtacacaatcacagtggtcagctgtgaagggtctagctttggtaaattcaaggagatttttcaaagctgcctctccgtctataaccctattatactatattcgtgcattttaaattgtgtatgattataaaaatgctccatcattttttcattagggcatatttgtctgttgttgttttagtatccagtcaataatggaaacaatattgctgttacgtcaaataaatatttaatcgagatatacgctgtgagctcgtacgtacagcagccattagctgtcatattactgtccaatcttgacaagaacacaattaaatattttttctttatagattcaattgttc

SEQ ID NO: 3714 - DNA, 411 bp, Diabrotica virgifera
  unsure (1)..(411): unsure at all n locations
  Clone ID: LIB149-004-Q1-E1-B7
agatttttccaaaccgtttttaaaatcgagaaagttttttttaatagtaactggagttgttgttggtattgttctccttattataattacagtagcagcgtccaaaacacatactggaacaaaaagtagcaaaatcgaagatcatacagacgaaccgaatgaaccttcaggtccctgtgaaattaaccaaattcagtacagaaatacccatcctcttctgctatctcctaacacagacaatgttatttatccacaaggaaaagcaaatacaatatttgccagtaaccaagaagtagaattttcatgttctcaatcagaagttcgagcaaatggagttaacttaggttctagtattacggttgtttgtaagttcaacgaaacatttatatacaatggaacanatatagagtg

SEQ ID NO: 3715 - DNA, 413 bp, Diabrotica virgifera
  Clone ID: LIB149-004-Q1-E1-C11
tacccacgcgtccggtctgaagcaagtctttttgctagttagaatatcaaattgataaacatgaagttcgtattggtcgctctagttttggccgtagtggtgtgccaagtgatatgtgatggtgatgatactggttcctccagcaccaccatcgcggtcaccaccagcgaagctccacctaccaccaccagttcgaatgcggaacaatcatcaacaacctcagcacctgagagcagcaccaagggtggtgcatctacggccattcccgcaataggacttgtattgggaaccgctttactgtgtctccactaaaagcagaaaggacgcttttgtatagtcactgttcactttaatacactcacttaaattattattttcgaaaaaaatatcaatttgctcaaaaaataaacatc

SEQ ID NO: 3716 - DNA, 366 bp, Diabrotica virgifera
  Clone ID: LIB149-004-Q1-E1-C2
aacagacgcgtggggggatccatacgttcaattagtcaatgtacgtacgatatcgctgtgatagacttcatgtggatccatactgttgactccaagttataaggcttcacattattatacacaatctgcacagattgtatcagtagataaactctacatgatttcacagatctagatctctttagcagaatagttctgcactgagaattatactcgcaccgattagatcatcgtcactttagagaattacggcattatgttgggtgcgaaatatcgcattttaactacaaccttagtacccaacgcactgtaatttcatgtgatgtagacaagtaattgatacatgtatctgacacattgcactct

SEQ ID NO: 3717 - DNA, 413 bp, Diabrotica virgifera
  unsure (1)..(413): unsure at all n locations
  Clone ID: LIB149-004-Q1-E1-C3
aagaacgtangtgtaataatacttgaaggttgttcaatcgaattggcagaggacgatgctcagtttagtttcaaaatagattttcatggaacgaataataggagctacatattgggggcagagtctcaagagtccatggaacaatggatgaaggctttggcttgtgctggttatgattacatgaaactaatggttgcagaactccaaaggcaattagatgatgtagaagaaactccaatgcccatttcatctccacagcctgttgggtcacctgtcccaccgcctagaacaaggcataacccttttaatagaccagagaataacccccatcagagatcatagtttaaggtctacaggatcagcagcaagtcggttgggtgagaacagaatctcagacaacaatgtagcatcat

SEQ ID NO: 3718 - DNA, 417 bp, Diabrotica virgifera
  Clone ID: LIB149-004-Q1-E1-C6
atcagcacaaatcttgtagatattcccattattcttaacaatacaaatacgcagaatataacattatttaatgaagaaactggtctctctacaacattacaatgttgtactgtaattagcccaagggaatgcgtctctagtcctcaacctcgttgttttcattatagaacaaaagaatgcggaagtttttgcacagcatctatagtccataaagaggaacaaaagttgtgttcagttaattacccaggggcggcaccatcttgctccaaacaaatctattatataccccaaccacaaccgaaatgtacctaccaatcagtttggccttatgtatcatgtggaatacagaaaaaagaaacctgtcaaggctgctattcccactacgtcaatggaggtactccaaattatctgacctgg

SEQ ID NO: 3719 - DNA, 412 bp, Diabrotica virgifera
  Clone ID: LIB149-004-Q1-E1-C7
agcggacgcgtgggtaccgcctttttccttttatatttggttatttctgatagtcttggcatttcgaaatttaccaagttaaataaacagcaataaagtaattaaaaaaaaaacaaaagtttataagttaggttaagggtaaaactttcaaattgcatgcaagccggattgcaagctgtaaaagaccatgcaatagacttgcatgaaagtcttgcatgcaaaaaattgcagcaagttttcttgcaagctgtaaagcagtcttaaccattacctgcacgcgtcctggccctagtcccgcatgcccgcatgtgaactttctagtcttccatgcctatcttgatatatacgaaaacagtttctttcaggtatatatattctctcaacaattttctttacctcaatttcccaagaa

SEQ ID NO: 3720 - DNA, 407 bp, Diabrotica virgifera
  Clone ID: LIB149-004-Q1-E1-C8
gagaaaatcaaacggaagttaaaatgcttgtaatattggcatgggtggcttttggcaaattgagctacatcctgaagaataagaaatttgcgcaaaatcttaagtctaaagtcttcaaccagtgtgtgttaccagtaatagacggagaggcagcgctgaaaaatctatttgaatttactaaagctagatttttcacagttgattactgtgagtgtgtagagaaacatactgcggtcggtcaagcgaaacgtagaacaagggttaacgagaaggtatcaaagtttgcttcctacgaaggtaattatttccatttactaaggctgaaaatcagtacacacattctaaattaaatataaataaaagttattatagtcggtcagctgtatgacgggacagagccggtcagt

SEQ ID NO: 3721 - DNA, 339 bp, Diabrotica virgifera
  unsure (1)..(339): unsure at all n locations
  Clone ID: LIB149-004-Q1-E1-D11
ataatcctttataagatatgccagttataataaaaaaagagaatccctcttccagcgatagaagcaagaaagccatggacgatgtagaaggagccaaatctgctataaaaagatttataggagatgttagcaagagctctgctactaagcaaataatcttgggggcctcctctggatgggtaaccggattcttatctatgagagtaggaaaaactgctgcaatggcattaggtggaggaattattcttcttcaaatagctaatgaaaagggttacattaaagtcaattgggacanagttaataganacctagatcaagttgcagataaagtagaagaac

SEQ ID NO: 3722 - DNA, 212 bp, Diabrotica virgifera
  unsure (1)..(212): unsure at all n locations
  Clone ID: LIB149-004-Q1-E1-D6
agattttgttgctggtacgtaacccctagnaagaatcctaatagaaacggaaaattttttaaataataaccgtaaagaaaggatattaccaaaataaaaatggatttccttaactttggcattggcatttacaccgtaaataattggaaaaattaattatcaagagagactcattttaaaacttttacaaaaacccgtaggctcaaaatttt

SEQ ID NO: 3723 - DNA, 288 bp, Diabrotica virgifera
  Clone ID: LIB149-004-Q1-E1-D9
aatttttccaaaccgtttttaaaatcgagaaagttttttttaatagtaactggagttgttgttggtattgttctccttattaaaaataacagtagcaaggtccaaaacacaaaacgggacaaaaagttacaaaatccaagattaaacaaaccaaccggatgaaccctcaaggccctgggaaattaaccaaattcaatacaagaatacccaacctcctccggcaacccctaacacaaaccatggtaattaaccacaagggaaagcaaattccataattggcaattacca

SEQ ID NO: 3724 - DNA, 311 bp, Diabrotica virgifera
  Clone ID: LIB149-004-Q1-E1-E1
cacgcgtcaggcaacctcctcctgagcgcgtcaaatagaagtctgggatttcgatttacactgattacgatgtgagttacggaatgccaatcgaaacacgaaaacgaggcgataaactccaacattccgatttcgggtaataaggcttttcatcgattgtgatttgtttcgagcttctgtcatgttatgttgtatagtcagtgtagaatacgaatatacacggtttatacgacatttgacaggagctcgaaataaattactgaatgaaaagccctattacgattcgacttgggtatttcggttcgctttgt

SEQ ID NO: 3725 - DNA, 223 bp, Diabrotica virgifera
  Clone ID: LIB149-004-Q1-E1-E2
aagaagtactgtaagcaccactgattatggactcaccgatcccgcactcgtgttcatgagatcagttttaatgatacaaaatatgcagttaatgaattcactacgtcaaacgctgccatcccgcacaaacgtggacacttcattgacatcgacgagcagttcaacttttacaaggaactgttcgatcacttcatgatgccatctggattgttagtgggactat

SEQ ID NO: 3726 - DNA, 405 bp, Diabrotica virgifera
  Clone ID: LIB149-004-Q1-E1-E5
aatggccgtagctgtgaatcggtgatcagtcaaccaacatggggtcacatttatagtataccataccattatgtactgacagcgtcagtactatcaagttcgattccaagttgttctctgttttcctccgcatttttgatttccacactgcaggataccaccggggtgacatatccatctctttggtgtgcttcatcactgagttgtcttcagaggatttcatcgctatccttaactccaattacattcacaagcctaaactagagagtacatcccgctttgtacatgatcctcatgtgaatgttactgactcacgtgactggcgagaaaaatgatcaattaatcgcgtgttggactataagcaattctgatcatgtcatgcatttaatgcagcaggttcacatg

SEQ ID NO: 3727 - DNA, 102 bp, Diabrotica virgifera
  Clone ID: LIB149-004-Q1-E1-E9
aaaattagtcggattataccaaaacttgcctcatcaatatttgttcggagtataactctacatacattacattgggaccatacatatcttaatccacaacta

SEQ ID NO: 3728 - DNA, 228 bp, Diabrotica virgifera
  Clone ID: LIB149-004-Q1-E1-F12
atagtgagtcgtattaaattgttcttgcttgcgttgcattttggcgttgcttggtggggtggcggtgagtaagtcgcgttgctcaggtgtttcctgtggctgtgtgtggtggcctccatagtgtcgtctaagaagcttctggggatctctcaagcacccagtctcgattacgatctgctgttaagtcatctgtttgctgggttggggcatttgaagatctcttggtag

SEQ ID NO: 3729 - DNA, 364 bp, Diabrotica virgifera
  Clone ID: LIB149-004-Q1-E1-F3
ccccacgcatcaagtaggtgtctatgtctcatattaccgaatcgacattaccgttgactttaatgtcacttgctaaacggtcctagtgaactatggtgggacggacatggtgaccacagcaataaagagcatcttcaattcacgtgaattcaagcatcatgcaaattcacttttaatacacattagagtagcgaattatcctcacacatccattggtacagatgcttcccataataatacacgtcagcaccgtgctatatcatgcccatttggacaaacctaacgacgaccttgtaccaatcaattttgtattgcactatcgtacattgtaccaatacaagatattagattagagactcaccat

SEQ ID NO: 3730 - DNA, 405 bp, Diabrotica virgifera
  unsure (1)..(405): unsure at all n locations
  Clone ID: LIB149-004-Q1-E1-F4
aggatcttttgtggcgcgtgttactttaagtttagcaaatattgtggcaaaatttttgaaagtagatctagaattttgttttcgatcaaagtgaagatgcatttttgcgccacgttatgttcatatccgctagctggagtattctgtgcgccgctcatttttacgacgtttagcggttctttattcttgtttacatgatacagtgtataatttacacatacatggaaattattgtaaatattattaaaatgcatacgacgcatttcctagataagagctatggtcatgtgtgagacagaaataattggttcctgagaagtacatttggctgacgaggtttactgtcagagaaggtanagaaaggaactcatatttgcggatgatattgtattagtggaagagagc

SEQ ID NO: 3731 - DNA, 376 bp, Diabrotica virgifera
  Clone ID: LIB149-004-Q1-E1-F9
agtgttgtgtgttccagttggattcctaggttaagatcgattaaaagagggcataacttttgaaattcaagtgtaaatatgttgtgaaacaacataaattcctctgtgagagactctgcctgaaatcaaccgaagatgtgtcattaaaagtattcgttaaaaaaagatgacgttggcgttagtctacaccagaaaaattacttacgtgtatatgcatagatgattaccagtgatgattccaccaaaggattggagaaaagctctaaaatcacaaccagcttatagaattgtaaataggacaatatgttgccagacgttctttgtgtattcagtgggactaacaggcataattttgttgtttttcttgtacacacat

SEQ ID NO: 3732 - DNA, 379 bp, Diabrotica virgifera
  Clone ID: LIB149-004-Q1-E1-G10
ctctaagcatgtgcacttaatatctttgctgttcgcggtattttgaccctgactgggtcccatacgcattaatttttttcatgtgggcagttctacagggtttggtaacgattcgtctgtccttggttaatttagcctgccttttaatttcacattaggaatcttcgttttatttaggctcctacaatagcccataggcttgtagctggttcttatatagcttgtcttaatgtgtccatcattcatgtaccatatttatttacttgctgtgcttagatttaccctctaacatttattagctgcatgtcttaatctcagatttgctggtccagttgtattgctgatagatcatagattaccttacggatcactgcgttca

SEQ ID NO: 3733 - DNA, 350 bp, Diabrotica virgifera
  Clone ID: LIB149-004-Q1-E1-G2
ccacgcgtcaggaaaaatttactctctttcttttggcagctgtctttgtagctgttttagctaccaaagaagtcagctcaagtgatgttaaagttgttgatgatccagacgatgaaccaactactacaactactgctcccgctacgtgtgactgtgaacaatgtaacactcattgcacagaggaaagcaaattagacccacccaaaaactacgctggaggagtctgtgtagataataaatgttattgtgtcgaaattgttgaaattacattcctttatattatcaatagatgtttttaaatgaaacaagtggctgaaatcgaacatgcctaagtacatcccgaatacgac

SEQ ID NO: 3734 - DNA, 412 bp, Diabrotica virgifera
  Clone ID: LIB149-004-Q1-E1-G3
agcagacgcgtggggttttaattgtaaagaaaactgcatcttttcgatttctgactcggatgacgtagaatattattcaagtcctacacataatgattttctttgtttttgttgttttcagtggttaacccatgaaaatagaatcaatgacaatcatttatacgtgaaacattcgattatctcaacttttctgacacgtttttgcaaatggaattgtggtaaacatttcaagtattcagaaatagtatcacatgaaatatactgtaacaagagaaatcgttcttataattgtccttacacaagttgtggaatcgataataattctgcgttagcactaccggatcatttgaaaatccatgattctattaaagtatgtgcttctttttttaaattggtgaagccgccatttgcg

SEQ ID NO: 3735 - DNA, 408 bp, Diabrotica virgifera
  Clone ID: LIB149-004-Q1-E1-G5
agattttatgtcatcacccatgtctgcatccataactcgcattataatgttttcgttaataagtccaaatacattcctcagcacttttcattcaaagacttccagctttctttttgtattttctttcatcactgatcacccatgtctgcatccataactcgcatactattggtctgataaaaatttttagaccctaaattttaatctccagtgtgtgtttttgaagcggaatacatgagtgaaaagcaagctttatttccctttactattattctttaaaatgtcctgttcttctgttttatgcatttcaactctcagttatgtgaaactttctactatttcgatatcgtcctctaattcaactgggcgtctgtttcccctagctcttgcctgtgttagcttttttgt

SEQ ID NO: 3736 - DNA, 408 bp, Diabrotica virgifera
  Clone ID: LIB149-004-Q1-E1-G7
agatctgcaagtaccgcgatacatacctagtagagagaaagaaaccatttaactacatcaccaagttcagcatagaatccctacaagacgaaagtactaagtatctctaccgtaagagacttgagaaaaggatcaatcttagccctattgaaatcacagacaatataaacgaagcatgggaattaataaaaaatcatataaccactagtgcatgagaaggcattggagaaagaaagatagacttaaacagcggcaaaaagcaaaaaccaaggttcacacaggaagtcaaagagttagcattagagaaaaaagatgcataattaagatatattaacaataggaccccagaagagtatcaaagatatacatcagaatgaaatagatcatctaacagaatcagagacctaa

SEQ ID NO: 3737 - DNA, 413 bp, Diabrotica virgifera
  Clone ID: LIB149-004-Q1-E1-H1
ggagccttgcgcgcagtttcgcggttcggccccagaacgatgactcttttttatcctggtcattggttattcagttaatcattttatcctggtaattcagttaatcaaagtaatccagttcatggtttgacatcgttatcatcaaatagtatcaccaaataggagaatgtcagttccggggacaccagaaatacggatccagcggcctttatatgaaaacgatcaactaagacaggatttgaattatgaaaaagaccaaactaactttgtgaacaaattatgcaaggaaaaagtttccccaaaaagtattataaaatcaaccattcctgtcctgggatggttacctaaatatgaatggagaacggatatattatcagaccttgcttctggatacacagtggctatcatgcaca

SEQ ID NO: 3738 - DNA, 424 bp, Diabrotica virgifera
  Clone ID: LIB149-004-Q1-E1-H12
tcacgggccgacccaagcgtctacttcgtatgccgtccagaaggcatcaaaccacttccttcgtggtctccctcttctttccttctcttattctactgcgtgcgtctcttaggacgtttctttcttttggcattcgtaaaacatctctcaaccatctagcagtctgtgccctgatatttgtgttactttgggtcgtttatatatccattagctcctggtttgtttttctgcgccattccccgtcagccttcattattcaaacaaaaactttagatctgcagaatctgacaatcccatctgcttcaagtgccaattgagcttacagtgccctgttaacagcccttctgtggctttgactgttttcttgtctttgcttattaggtctgccatatattttggtgaatgttctgtaatgaactgttcc

SEQ ID NO: 3739 - DNA, 73 bp, Diabrotica virgifera
  Clone ID: LIB149-004-Q1-E1-H3
aactcccaatcaatgagtcctactacccacgcgtccgatttaattggggtgcttccaacaatctagtatctaa

SEQ ID NO: 3740 - DNA, 164 bp, Diabrotica virgifera
  Clone ID: LIB149-004-Q1-E1-H6
cacgcgtcagacttttagttaatttcggctactgtaatattctttagtgtcagtttacatacattttactgaatggtagctccatagtattgtgagagcaaatcataattgtacaacggctaaatttaattattgatacttgtgttacctggagtatcagttca

SEQ ID NO: 3741 - DNA, 186 bp, Diabrotica virgifera
  Clone ID: LIB149-004-Q1-E1-H8
tatttttatatattattacttttattttttataaattttttattaaaatataaatttaaattatttaaatttagtaatgatgataatattagtattaaaaaattgtatatttagtaaaaatatataggtttaataaaagaattccgcaacatttttttcacctgtttattaaaaacatgtcctttt

SEQ ID NO: 3742 - DNA, 367 bp, Diabrotica virgifera
  Clone ID: LIB149-005-Q1-E1-A1
agcaaatttgtaaggggactccagctgtcggacgtaccagaatttagaaaaattattagtatgattattattactattaaaataatatttatttattttatttacgaaaattttccgaaatagaaaagttctccaactcgacattaataactgagtaaaaaagtctcattatggaggtaatattttttttaatggtggtccaaagacctgtaaatttacctccaaaatatttaagaatataaaaatggttctaaatatataaattctaattagattatctgcacccgggggctctcctataagtcattggtacttttgcatatatattctataaaataagcgtgcatagattgtaacatgtatgtat

SEQ ID NO: 3743 - DNA, 410 bp, Diabrotica virgifera
  Clone ID: LIB149-005-Q1-E1-A2
agcggacgcgtggggtcaagtgaagttatattaaatatatttataataatttatcctatcgtcatcatgagaagtttaatagttgccacgattgtacttttcgccgtttatcaggcagtagatggtctcattgcctgtcacgaaaccttttgcgacaatcaaaaatgtacagaaaacctcgtttgcaaagattctgaagttctggttcccaagggaaccatttgcggatgttgcgacgactgctacagaaaactaaatgaaggcgatgcttgcaggtcacgttttattggaggaggtccattcagaggaaaatgtgtagatggattagtatgtaacgctgaaggaaaatgcgccaaagcctaaattataaacaaaaactaatatgtagataaataaatgatttcaatgat

SEQ ID NO: 3744 - DNA, 273 bp, Diabrotica virgifera
  Clone ID: LIB149-005-Q1-E1-A4
aaaactacaaaaaatgctggtaaagaaaagaagattaaagaaaattttgatcaagttctaaaaattgctttagagttatgcaatcgaggtgtatgtgaaattgaagaaactgtttatgttgaaaattaatgtataagcctaatcgcaatcgcctaatggcctaatgcaatacatatttatatacctataatttttttaagttttatgaaattttcttaggaaaaaatttaaataaatctaaatttttaagaaataaaataaatttaattaata

SEQ ID NO: 3745 - DNA, 389 bp, Diabrotica virgifera
  Clone ID: LIB149-005-Q1-E1-A5
agaacaaattcactataaaactccactttaaccctgataaaacaagaagagaacaaaataaaaaatgacctgaaacgtcaaacaggtaaacagtaacactatgagaatggcgcgcgcttggggtatgcaactagtgacgtcaggccaatagagaagcgttcttgaaatttaaaataatgctagatttctaataaagattttttatagaaaggctttttcagttttgttgaaattttggacaattattcctagggtgtttcttaatcgttttacatgtttgaaatgactttttaattttttgtgaacatccctattgtgcagctcttacaagaaaagagatattccgataatgccaggaacaaaatcttagtgatgccccggggataata

SEQ ID NO: 3746 - DNA, 353 bp, Diabrotica virgifera
  Clone ID: LIB149-005-Q1-E1-A9
aagtgtctttgcagcattttggatgtatgtaccgatacaattgttacatgtattatttcggagtatctaataaggataacaattacgaggattttcggatactgttaaaattggtaataatatatggtgatgccatagttggcccaagtgcgttgtgtgcacatggcagtgtttgctgtatccatgatactcatttttgcatgcctatcgtatctcaatacgaatcagctatatccatcagcaatctcacaacatacctatgaagtataactagtccaaagtaatcaaaatgtgatccatttagattcagaattgcagctgtcactgggtgttccctcgaatcctgccacaaa

SEQ ID NO: 3747 - DNA, 397 bp, Diabrotica virgifera
  Clone ID: LIB149-005-Q1-E1-B11
gacccacccgtctacccacgcatccgaaaaattttaacgcagtgttaaatatctttgtagtattaaaatctcaagaggctcttcaatcaaagtctccagaacctaagtaactcaaagttttagtattactcagataattacaatttctaaaatggttaagttgatattgagggcctttgtaagaacttcaagaactagtcttttcaagaattctcattttgttacttttcacatacctgttgatataaaaacattttagatactttagtgtactataatgttgttattacatagatggagtatgaataatatattaaagaaaataattttccattaaggaaagggcggccgtacaaggactgttgaagcagtttaccactgagaaacatacacggac

SEQ ID NO: 3748 - DNA, 420 bp, Diabrotica virgifera
  Clone ID: LIB149-005-Q1-E1-B8
agagttcttctttctttagtcgcattcagcgctgctctaccaacacttcttggtagaaccgctctggtcaaagaagatggaactgttactctcaccgactctagaggacaccaactggtaatcctcaagagtgttaccgatcccagacaagtcgaagttattctcaggagtccaaacacaagaacccagatgttccaagttggggaaccacttagaactagagaaactatcgaccgtactctcgttggagtttcagcttaccaaaactacaaccaagctgatattcttactgatattttccgtcagtatgaaggtactcttgacgacaccaaatactacagccttcttaacagaatccaaatgttagttgaagctggactcattaatgaaaacatctacgatatcatcagagactgggat

SEQ ID NO: 3749 - DNA, 363 bp, Diabrotica virgifera
  Clone ID: LIB149-005-Q1-E1-C1
agggtggaaacataaggattatccgaattactcgactgaatcaattaagaagaagaaaaaatgtgtcaagtgtacgttgcatctgcaatattaattctcgcgattgttgattgcggttttgcactgcaatgttgggattgtaagtctgaattcgatgttacatgcagagattacttcaacgtttcaaggatagaagaaaacaacagaatttatgaaaactttaatttccaacaaagtaatagcagacaattttcaattggtaacagaaacaatcctcgaaaaatacattgtgatggaagttacgtcaatagttataatcaaaaaaccgtctgcttaaagacagtgtccagaggtttttccggc

SEQ ID NO: 3750 - DNA, 367 bp, Diabrotica virgifera
  Clone ID: LIB149-005-Q1-E1-C5
agaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccctcaaggttttaggtttttttttccgttgtttatgccttttattccctttttttgggtgtcctttttttttttttcggggcccttttttttaattcctgggggggggaatcccccggttttccccggtattcccccttttgaaaaaactccttttttcgtaagggggttctcccttttaaggggctcgcatttttcccttttcccaaattttgttcccctttatgggattttggaccccccttt

SEQ ID NO: 3751 - DNA, 366 bp, Diabrotica virgifera
  unsure (1)..(366): unsure at all n locations
  Clone ID: LIB149-005-Q1-E1-D1
agccaacgcgtccgcattgttttagctattttagcttgcgtcggtttaaccgtcagcgctcccccaaagaacgacgtcctgtgtgatggctgcgtagcattgacacaagtgatccaggaccacttagaacaagacttgccattggacgaacttgaagaaatagtaagggaagggtgcagtgcattaccagatccacttgcagatatatgcaagaataaactgattccagcagtctacaacatataccaccgatttgaggacgcctcgcctgtagaaatatgcacagttttagacttatgtgagacaaattaatatgaaagtcagaataaactcaaaagtttaaaataaatttttgaacaatanaaa

SEQ ID NO: 3752 - DNA, 405 bp, Diabrotica virgifera
  Clone ID: LIB149-005-Q1-E1-D10
gaagacagttacggcgctaataaaacatgaaagaatagaactaaattatcccagagcaaatgaatcaaggatgtacgctgaaaggttaatatctgatgcaattcgttatggagactgtcacaaaacaactatggagatggcagactactggttgacagaaaaacaactgatccacaaactctttaaagtgttagtttccagatacgaaaattacaacataggctacactagattggtaagagctcccaaacttaatggagaaaccagagagcgagctgtattggaactaagaggtaacccatatccttccttgtggccagagaataattcaaatcgagatttacttcataatgtgttactagatgaggctaaaaatgcatacacgatggtaaaatataatgaaat

SEQ ID NO: 3753 - DNA, 405 bp, Diabrotica virgifera
  Clone ID: LIB149-005-Q1-E1-D11
ttctattgtctgatctgccagttgtggtggggtgcgcgagtccctcttccagcgatagaagcaagaaagccatggacgatgtacaaggagccaaatctgctataacaagatttataggagatgttagcaagagctctgctactaagcaaataatcttgggggcctcctctggatgggtaaccggattcttatctatgagagtaggaaaaactgctgcaatggcattaggtggaggaattattcttcttcaaatagctaatgaaaagggttacattaaagtcaattgggacaaagttaatagaaacctacatcaagttgcagatcaagtagaagaacaactaactggagaagcagtatcctggatggataacgtaaagcattttgctagaaataacactccttttt

SEQ ID NO: 3754 - DNA, 293 bp, Diabrotica virgifera
  Clone ID: LIB149-005-Q1-E1-E6
cgcatcaaccagcccgtgggcggacgcatcgggtgttgtcataccagtgaagtcacacacattctgcagatattgtagatgatgcagctagatatgccaccgaagcaagctaaccgggatgcacacggtgccgtcctatattcgctcggtgagctgcgtatgctataccgagtcaatatgatctagccctatgagatgcttggacagctgtcgagatcattccggactggtcaaaggcttattctatgcagcgagctgctttgtcccatttctgtgcacgcggtagagcgatt

SEQ ID NO: 3755 - DNA, 412 bp, Diabrotica virgifera
  Clone ID: LIB149-005-Q1-E1-E8
gacgcacgaatcagccaacagccagaaaggttatggcctctgtattttggttgcgtcattgtatctttctcagggtgctgtttacgcggatgactgtcgatttgattccggactgaagtgactgatccatgtttcattcattgtaacatatcggcagcatctccaattagacatgtccaaacctgctccgagattcatcactttgttgccgtttttgtcctggtgtgagaaaacggaggactcatttggaaaacagctttctcagactcaaatgtgcatgtgtaatactcaaaatgctaccctttgataaatgttgagtgtcagttatctcatgcaacatcacttagcaagtttcagcattgtttcaacgtattcggctataattgcaccatcttgtccttagcagtactcg

SEQ ID NO: 3756 - DNA, 297 bp, Diabrotica virgifera
  Clone ID: LIB149-005-Q1-E1-F11
acggacgcatgggttagccattgcaatagcaataaattttgctactgccaaatatacatataagctaggagacacagaaatagattttacagcaactagcaatggaatagaaatatacatccgagacgctgaaataggaagccaactctacggtacaattggcgttggtaaaaatgccagttgtatcgattttccccgatgcaaagtaggagataatgatgtcgctttaagattcctgcctggaacttcactgtcagtcatatcgaccaccaccaacacgcaggaggtgcttaaaga

SEQ ID NO: 3757 - DNA, 224 bp, Diabrotica virgifera
  Clone ID: LIB149-005-Q1-E1-F7
aggaaataaatcccaatgttttgttaataatatttttttattaatatgtaattgttttgatcgaagcttattctttgggctttactccctgagtttataagacacttagataaatttaataacaattaagataagggaggaacttaaaaaaaagattaaaaagagcaatgaaattgtcgaaaaaaaattaggattagcaattggcagatattaaacatatgggg

SEQ ID NO: 3758 - DNA, 253 bp, Diabrotica virgifera
  Clone ID: LIB149-005-Q1-E1-F8
agcagaattatcgtagggcatgactaaatttatttttctgcattcacgacgtttgttgcacacaatgtcattctctccacacgcaaattttttcccgacgatgggctaagcatattgaaatccatacctgatagcagtcacacatgtctgataatactcgtgatcgatataggatacggtctcaccagagcgagcacatgatcatagtccatacattatacaggtatcgtattgttataactgtaacgcttgc

SEQ ID NO: 3759 - DNA, 410 bp, Diabrotica virgifera
  unsure (1)..(410): unsure at all n locations
  Clone ID: LIB149-005-Q1-E1-G12
cgtccacacacgcatccgcccacgcgtccgcccacgcgtccgaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataatattagtattaaaaaattgtatatttagtaaaaatatataggtttaataaaggaattcggcaacatttttttcacctgtttattaaaaacatgtcnttttgtattaaatataaagt

SEQ ID NO: 3760 - DNA, 356 bp, Diabrotica virgifera
  Clone ID: LIB149-005-Q1-E1-G6
agtgtagatttgtctgtactgttttgctatacgtcactcattatcaggattgtcttacaaatgtgattagagcgagtatgtctatgtcatggataaagtattatgcgccaacctgagaaacattgattactgctgctgacaatcttaggaccatagcattcaaatgactatagcatccaaagtgcgacactgtatatacgaagtatccagattgacacacattgtagaaaatggctcaatctgtcagtgattgtagttcgtttgagcgagtagttaatccagataagcatttcatggggttgaaagcgaggtgatcattgatacataaagctatcgcaaaggcacaatatatgcgc

SEQ ID NO: 3761 - DNA, 387 bp, Diabrotica virgifera
  Clone ID: LIB149-005-Q1-E1-H10
gtccaaaacattagacgaaaacggcaaagaagagactttacatggtgttgccaaaaccttaccacaacatgagatgatgaggcaagcattcaaagtacaggtcacgtatacaaatgaaatggccttttacgatttaataataccgacattacaagcttttcaaaaagaactaggaattaagaacgtaattgactgctttcctgaatgctatgccactaggaagaacctaaacgcatctgatattattgacgacaatgctgtaattgttttagaaaatttacaaatagcaggtttccaaaatatagaccgacatatagggtttgatttagaaacaacaaaactggtgttaagggatctagcaagtttgcacgccgtgcctttggcact

SEQ ID NO: 3762 - DNA, 323 bp, Diabrotica virgifera
  Clone ID: LIB149-005-Q1-E1-H2
gcgtcagtaatgaatcgtattaaaaaaaaaaaaaaaaaaaaaaaaaaaaaaaaaaaaagacagaaatacaaaaagatataagaattaaataaaaatggtggtgacaccatagatgggtggctgtcactttggttatattcttctttggccgtggatgttacttcttcctccttgcaaatcccctgctgttttcatttaacttcccgtcgttttaaaacttcctgtcgggaaatattttcgtgttgctcaagttaacccctttgctagatagccacctttggcaagcggtgatttttattcataggcccacagttttggccctt

SEQ ID NO: 3763 - DNA, 411 bp, Diabrotica virgifera
  Clone ID: LIB149-005-Q1-E1-H3
aggaagtatataaaaaatatgaatttcgatcaagagtaaactacctttatagttcataacatttaaattagaatgatataattgcacattaaaacataattattaattctaaaccacttttcataatagcaattttccatattatgaactaaaatgcgtatataaacaaagttttcgttatgataatgctcgcattttcagcttgtttatcctgaattagaattatcattttaaagtagtaaaactactgttaatggtagattatatttattttaagaaataattttcaaaatagtatatttctccgcgaaatatgaaaaatgttttaacctgatgctcgttcgttaaattgacaaaacgtaatttcaattttgtaactgtaataaaagttattttccacgtgaacaaaaa

SEQ ID NO: 3764 - DNA, 96 bp, Diabrotica virgifera
  Clone ID: LIB149-005-Q1-E1-H8
aggcttgcggctatccacatagttgccacctttctttacgtggttttccctttaagtccgggatttaatctgaaggatttaatggtggaaatttaa

SEQ ID NO: 3765 - DNA, 134 bp, Diabrotica virgifera
  Clone ID: LIB149-005-Q1-E1-H9
cgtccaattctagatcgcgagcggtcgccctttttttgtttttttgtctgttttaatatttatctacatggagcaattattttagatatgtgggcctttcgtacgagtatacagggatagattaatgattgtca

SEQ ID NO: 3766 - DNA, 384 bp, Diabrotica virgifera
  Clone ID: LIB149-006-Q1-E1-A1
aaaaatcaaaatcaataaaataaaaaaaaaaaaaaaaaaaaaggtaacaaaaaattaaaataatctttaaaaataatgaatttcgctagaaaatatactagacttatgtcctcattaacaatcaattcaaaaggggggggtcttctaaaggttttcaacttcaatgcccatgtcagtacattcaatacctctcctaaaggatccataaatttaattacaagggcctttttttaaaaacttcttccctggaaaaaaccttgtgtttcccaaatttaccccttttggtaataccccctttttcccaatttggtttttctgcaaagtgccccaagtttttgccctttcaaaaagttttccactcgtgatggcacattggaccccccc

SEQ ID NO: 3767 - DNA, 365 bp, Diabrotica virgifera
  unsure (1)..(365): unsure at all n locations
  Clone ID: LIB149-006-Q1-E1-A2
agtctagttcttctttcccaagtaaccctaattgtacctgcctactacccaagtacgggaaggcaggtaacagtaggagtagctggaaatgtgaaactagtcggctctcaaagttcccagattgacattcgtagaagtccttacaacccaagaactgtcgacgtcaccctcagaagtccaaatgctccaaccagaactctgcaaattgatgaagccagaaacggccaacaacttggttattccaacctccaaggtgtcaacaaccaaggtgtcaaccaggctgatgttcttgctgatcttttcagtcaatatganggtattgtagatgaccagaccttctacagtttgttgaacaaacttcaaca

SEQ ID NO: 3768 - DNA, 318 bp, Diabrotica virgifera
  Clone ID: LIB149-006-Q1-E1-A4
aaacaagcgtccggcaagagcggttgaattaaaaagtaacttccacacttccagtaaacttcgtttttgtcagttcttctaattttatacaaagaatttaatagcaacatgagtaaattcgttgttttaatggggggtgctcccacttggtgtctatgcttcatcattagagtatgaattctgcgacccttgtcaagggtccccaaacatctgttcaaggaccgcttgttaaaaagtccaacccggaaaaaacctggaatttacctatttataacctttttaaaaatccacccctttccacaatgatgccgtaaacaa

SEQ ID NO: 3769 - DNA, 231 bp, Diabrotica virgifera
  unsure (1)..(231): unsure at all n locations
  Clone ID: LIB149-006-Q1-E1-A9
tacaccatcgacgacgagcatcaaaatatcgtgcagattctgcagcaatttcctttggctagnaaaattcatcgtcagaatgttgggggattactcaatggatttttgaacaaataaataagatttatccaaatgatatggccaaaatgggagtatacactgttggacgaatagctccacttacacaactggttgaatcttctcgagtgaccatactacgtatatccaaag

SEQ ID NO: 3770 - DNA, 417 bp, Diabrotica virgifera
  Clone ID: LIB149-006-Q1-E1-B12
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaagaaaaaaaaaaaaaaaaaagggggggccccccaaaaggttcaaacctaatttacccttaaatgcaacttcaaaccccttcaaaaggtccaccaaatttaatttcacgggccttcttttaaaaactctcaaatgggaaaacccttgggttaaccaatttaaacccctttgaaaaaaacccccttttcccaaattgggttaaaaccaaaaaggccccaacaattcccctttccaaaaatttgccaaccttaaagtggaaatggaaccccccttttaccggccaataaaccccgggggttttggggtttaccc

SEQ ID NO: 3771 - DNA, 287 bp, Diabrotica virgifera
  Clone ID: LIB149-006-Q1-E1-C10
atgccaaaaaggtgatcgaaatgagtatatacctgattgccacagattttttgaatgccaaaacaatagatgggtaggtcctttccaatgtccagctgatctttactggagccaagcaaataaacgatgtgtagtactagcgcagtcagattgcaataaacattaacgagagaagatattaacacataaaatgaatttgacattacaaccgaagactttacttgttatattgtaatataattttgtctgttgttataatgagcttaataaaataattactaatattt

SEQ ID NO: 3772 - DNA, 416 bp, Diabrotica virgifera
  Clone ID: LIB149-006-Q1-E1-C11
cttttgcgttatttttccggttattggcgcgctcgccactgtatagtaataaatatgtgtactctaaattagatattattttaatttttttataataaactaaattactacattttttttttcatattatacagataaattaataacttatgtatgcttttcagttgtgacatcacctgcataaaataaagacataaaataaactaaacttttgttctgtcatatacagtgatgagcgcgctaataaccggcaaaatagcgcaggggatggaaggcatcatgcattgtgacataaaaggagatgaaactattagaggtggaagtggtcgatataaacgtgtaaattaacataacattacagagtttttcacttttagacgcatcggaggagtatggcaactgtcgctgtgacagaa

SEQ ID NO: 3773 - DNA, 442 bp, Diabrotica virgifera
  unsure (1)..(442): unsure at all n locations
  Clone ID: LIB149-006-Q1-E1-C2
aaataatanaatattttttagtaaaggtaaagaaaattttaattaatggaaaagttaattagtattggtgagagaaatatttttaattttttataaaagaaaaaatttaattttttgtacccttggtgtatcaggggattatttaaattaataatttatatattttattatttttcgaaatttaaanagagctaaaaaaaattaaaattttttatttgtaaaaataanatatttttaaaataatttttttttggtaaatgaaatggttattccgtttttaaaatatatctaaattttttaaagaaatannattaaaatttatttattaacaaataatatttataattaaatatnttttaatattaattaatattaaaataattttaagggaatgagcttaaaaataaaatttttatttaaaatttaattttttaaataaaaa

SEQ ID NO: 3774 - DNA, 190 bp, Diabrotica virgifera
  Clone ID: LIB149-006-Q1-E1-C7
atgggacactgcactatcagtaaccactgttgcaggtatcatctcattacccttcgagactgtccttcagcgtatagtcactcagtcttagacgtacataagacgggattcttcaacattggcaatgatcagtgatgagggacaatctacatgaccatgtgtaactgtgacttcatgaacggaactttca

SEQ ID NO: 3775 - DNA, 389 bp, Diabrotica virgifera
  Clone ID: LIB149-006-Q1-E1-D4
acggaagcgtgggttcacatttataacttaaatgataagcatgttatttgaaaaaatacctgtaatgttagaaaccataatctttaaacgcgatttcccaacaatctactttgagttgtgcttctatattgctgagggtgcgatatatgttaaaattcctaaaaagggctatatcatagcactagttttcacagaacaaaaaactttgcattatcttatcaggttatacgcattttaggtaagcactgatgatggtcggccatccgatcgaaaactagatctgtgatgtagccctttttatggattttaacaaatataccttttataaaggattttttttcgtttttgtttatagagtattgttaagtttgaaaaataattaaataaat

SEQ ID NO: 3776 - DNA, 394 bp, Diabrotica virgifera
  Clone ID: LIB149-006-Q1-E1-D5
actcgtatccccatcgataaccattatctggtattttacatagataataacaaatacttaacaataatgatttttaaagtatttttgtttgctttgttcgtagcagtggtaatggcggaacaaactgcagaagaggcatggccacaatataagaaagatttcaacaggtcgtacgacgccgctgaagatgccgaaaggttcgccatattcaaggaaaagtacaaccaaatacaagaacaaaacaggcaatacgcagctggtaaatcaacatggacagcaggagtgaacgactttactgacagaaaacccgaagaacttaaacacctccatggtctcagggttcctgagggaaacgccgctggactccattaacctattactacctgaatgtttt

SEQ ID NO: 3777 - DNA, 423 bp, Diabrotica virgifera
  Clone ID: LIB149-006-Q1-E1-D9
acaaaatagacagttgacaaagacaaaaaaattatttgcttttttcaattttcaacagctcaataatttgtactgtaatctatattaaaatttaatatttaataccttcttaaaacttacaaatcatccataaaatgactgacaaagccaaactggatcttggagttttggaagaggatgacgaattcgaagagtttcccgtcgaggattggtccggcaaagaaaaggacgaacaggatattagtgtatgggaggataactgggaagacgataacgttgaagacgatttcaacaaacagttaagagcccaactcgagaaacagaaagcaaagcctccagcaaaatagaatttataagtgatctaattccatctaaaatgtatatttatctctaattaatgtgtttgtaataaaataataaaaa

SEQ ID NO: 3778 - DNA, 373 bp, Diabrotica virgifera
  unsure (1)..(373): unsure at all n locations
  Clone ID: LIB149-006-Q1-E1-E1
acccaagcgtctgcacatacgtccggattaataaaattgagatattttaatttgatgcttcagaataattataaaggtgattccgctgttacatctgttgataccgtattgttctggactaagaatggngatagttacacattcatctgatgaagtcactaactctaaagagcttcatccactatctgatgaattcattaactctatcaatgcagcataatctacatggactgcaagttgaaattttgctcaagacaaatcaatggactatatcattaaattgatgggggtattacctgaccataagaactatatgcctcctgtattgacacataaactagaagctctagaaattccagccgaattcgatgct

SEQ ID NO: 3779 - DNA, 277 bp, Diabrotica virgifera
  Clone ID: LIB149-006-Q1-E1-E11
agacacaagtccgagctttatgtcagtaatctgaagtacttcaagggatgatgcataggattaacatatcatatgcgatttaaattgtaccgtatggactaagttcacaacgtctcatatttgagaatatgtaagtacatacgttgatacaacaatggatttagttgttacaactttttgtaggacaatacgaatttaaactagttaaatttactagtgatgattgtactacgattctccaattgaatagatacgtgcattcaatacgtttaccaat

SEQ ID NO: 3780 - DNA, 377 bp, Diabrotica virgifera
  Clone ID: LIB149-006-Q1-E1-E6
acggacgcgtgggcacaaacataaattaaattcctctgaagtggttagtgtacgataaaagttcacgataatttaattatgtttatatttgtaatcagtatcgatgtaacatatccgtgtcagctggataaatagcagatagcaccatataatctcgccagtagttttgtgagaaaagtagcagcggaataatggctttagcagcgaatagtttgccaactttgtacgaatattacactggtaatggtattacgcatggtttatcggataaccagccctattttaccctcaacgagatcaatattaccctgtacagtggggcattccactatttcagagtgacgaggtagtactggcgggacacgctgacgaaaatg

SEQ ID NO: 3781 - DNA, 401 bp, Diabrotica virgifera
  Clone ID: LIB149-006-Q1-E1-E9
acggacacgtgggcggacgcgtgggttttttttttttttttttttttttttctagtaaataatggatacgattttattgtattctatcgttacaaagctggaggaaaatatattcttggttattttttaaattaattttttgcttaaaaaagggctggtgctgcataagtgtatggtgcagctgttgagggtgcatctgtctatggtgcagctgttgagggtgcatttgtgtatggtgcagctgttgttggggcgtcggtggagccgccgttgcaccagtccatcatttgccagactttgccagtgggataccagacagtgttgaatctcattttaaggaagtctccgacggtatttccgataagaccatggttgagggccgtttcaataccttcttgaat

SEQ ID NO: 3782 - DNA, 142 bp, Diabrotica virgifera
  Clone ID: LIB149-006-Q1-E1-G4
agaagtaacacgacatatacagtcatttctactacggatgttaaaactgtcattgtggtaggcccgcatagatgttaaatgaaataatataaactcttatgatatacctctttatatgtaatataaataataaattatattg

SEQ ID NO: 3783 - DNA, 181 bp, Diabrotica virgifera
  Clone ID: LIB149-006-Q1-E1-G8
cacggcatatctagtcatttctaccatggctgttaaaactgtcattgtggtacgcccgcatatatgttgaatgacataatatgaactcttatgatatacctctttatatgtaatataaatactagattatattgatacatttttagtataccgattttctcttctctggtaaattagtcat

SEQ ID NO: 3784 - DNA, 407 bp, Diabrotica virgifera
  Clone ID: LIB149-006-Q1-E1-G9
acccacaagtccggaaagggctaatagatggtttgttctagtttcaccagctttatgtggtcaatgaagtactaagaggaaaataattacacattccaaagaaatatagtgtttttattttaagactaaattagatgtgtatttagaaactgaattattttttaacttactcaataaatttaaaggtacaaaataggcgcataaattctcaatttgatacataaagaatattctgtgttatatagaatactttttaatgtatcccataatcgacttatttttcttcattacatttattaccatgattttttaattcctgtcacggatagaagctcgttaaatgacttcaatatgggcacagagttgtgtaaggttaaaaaactttttgtcagttctcctagacgttt

SEQ ID NO: 3785 - DNA, 417 bp, Diabrotica virgifera
  unsure (1)..(417): unsure at all n locations
  Clone ID: LIB149-006-Q1-E1-H11
agtctatctatatcatagtaatcttttgaatatcaaggatttttatgttaattggaattttttctataggataagctcgtttctttataagttgaacattttcattgttgactttgtagaacaaaggaactgcctagtgctccatcgataaacttcaatgcttcaacaagtctttttttgtattgtgattgtagtggaactccataaagctggaaacagcgaatgggaactttgaatagatgtagcggaaatttcaacagaatagcacgtttttttgttatatttggaccaccaatttttaaaatccagaatgtcattagttcttaccatttgtacagtaaatttctgcctctttggaaaactacagattgcttcanaaacttccattggtgtatacagcctatccatgtgattgag

SEQ ID NO: 3786 - DNA, 378 bp, Diabrotica virgifera
  Clone ID: LIB149-006-Q1-E1-H4
taaaataataatatattttttagtattagtaaaggtaaattttatttatagatagtgaaatagtattgtgagagagtaattaaattttatatttgaaaaatttatttttagtacctggtgcatcagggactaggaattaataattatatatatattattatcaaattcaaaatagctagagctttaaaatttttattgttaaagaaatattttaaataaattttttgtaatggaatgttaatcgtattcaaatatatctaaatctttatgatatagattaaatttatttataaacaatatcattataattaaatatttttatattaataatattaattatttttagggataagcataagcttaaaattttaatattat

SEQ ID NO: 3787 - DNA, 408 bp, Diabrotica virgifera
  Clone ID: LIB149-006-Q1-E1-H5
aagtccacccacgcgtccgactgatcccattagtttattacaaacatacacaacggatatacccaattttatttacatgttaacaacaattaagccatattttacagaaaaaagcatgaaaaccaaatgcactaaattaataaacaaaatcgaaaaaatgctagacgatcccgcttatcaagatagtgattgttcgacaaattcagctccagaaataaactaaaatcttcgaaccgatactacaaactcctccgccctggacctttcctcccgcaatatgtgatctaactctttctaaatacaataagcttgataccccttatgcaacaattaatcaatcttttctcaacatacttgcttctttcccagatcattgttatatttatacagattcatctaagactgctg

SEQ ID NO: 3788 - DNA, 189 bp, Diabrotica virgifera
  Clone ID: LIB149-006-Q1-E1-H6
ccgggccgacccacacgtccggttttacttactgttgaatgtacaataaatttttattgagaccaataataaaaataaaaaaaaattttaattaaagaaaaaataattaatattgtgaaaaaaatattttatttttaaaagggaggccgctcaaaaggtgtcaacttgtatatcagggagcatgaaata

SEQ ID NO: 3789 - DNA, 276 bp, Diabrotica virgifera
  Clone ID: LIB149-006-Q1-E1-H9
aatggatattcaactctctatgaactacaatgcaaccattaaggaacttttcctttcacagcactactcaggaaccatcaagataaccatgaaacaaccagtatggactggaagaatcagcgcacaaaaaacccccactgacttaaaacctaacaccactgtagacagttttaccgtcgactggcacgttgcagatgtaaaatgcaaaatcactggtatgggattacttggagacacttatgctctcgctattcaagaaggtattgaaggtgccct

SEQ ID NO: 3790 - DNA, 365 bp, Diabrotica virgifera
  Clone ID: LIB149-007-Q1-E1-A11
cccacgcgtccggaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataatattagtattaaaaaattgtatatttagtaaaaatatataggtttaataaaggaattcggaaacatttttttcacctgtttattaaaaacatgtctttt

SEQ ID NO: 3791 - DNA, 346 bp, Diabrotica virgifera
  Clone ID: LIB149-007-Q1-E1-A4
aaaaaattcatatttgtatagtaaatggtatattttaaagtattttattgtaatcaaacgtaaaacgtttccatcaatatcgtggtctttatgaaatgaatgaatatcacatgattattaactatatttacaagctccgtatttgtatcttagatctacaaaatacatatacggatgcacttaactgtaatattttaataatatttaaggtttatatataagctaagattcattcatttcatatactgcaatatgttatgactctagctttacataggagtatccattaatggatatacaatcatgaatgcaatatgtcttttagctatatcagcttattggggag

SEQ ID NO: 3792 - DNA, 166 bp, Diabrotica virgifera
  Clone ID: LIB149-007-Q1-E1-A5
cattattcaacaaatgtctataattatgttttttaaatagtaaaataaatacatctccgataaaaaataaaaaagaaaagagaaaaaagaaaaaataaaagaaaaagagaaaggaaagggggccgtgtgaaagagagaaggagtaaggtgggcggctggggggggg

SEQ ID NO: 3793 - DNA, 398 bp, Diabrotica virgifera
  Clone ID: LIB149-007-Q1-E1-A6
gatatgttcagttttggttcctgatcttactatcaacttcggagctgccgtcaacgtactggttctggagctggtaccactttacggtagtggaaaacaaaacatcaatattggagatgtgaaactatcaataaatgccgtagccgatctctcaaaaatacccaaaattcaagtttcgaaggtggacgtagttttgaacgtaggatctattacattcaacttgaatggtctcttggacaacccagaattcacagctttggtcaatactcttctcaacgacaacgtggctaaattcatcgatgagcatggtaactttttgatgccaattatccacgatgccatcaaaactctcattaactctctttttgcctaggcactgccaagatgcagtcacaaac

SEQ ID NO: 3794 - DNA, 363 bp, Diabrotica virgifera
  Clone ID: LIB149-007-Q1-E1-B12
cccaagacgtccggtgtttttcttttctgaaaatcatccgaatcaatatggtaacaaatttgtttaaagtacactggctaaatttgacaatataactgcaattttaaagatccgtgtataaattggtcctctgtactttattaatataaataagatgttcatctacaaaaacaataactaaagactaaaagaggccttttccaaagctgcatctaatgcggttctagccctaaaatactttttgtactcacttttttactgtcgtttatataaaacacttgtattgaagaaatataataatatacatcctaaaataaataaaaagaagtaatactacgtaaattgtcaggaagaacgtaaagg

SEQ ID NO: 3795 - DNA, 364 bp, Diabrotica virgifera
  Clone ID: LIB149-007-Q1-E1-B3
cagagtagtaacataatagttgaagactattcgttgacaagatgaattcaagtattttggtagttttaaagtgtttgtgcgctgcacaatttgctttcggctcacagcatgagattaaagatggaaaatgttccatcgcatctcaggatgatggagtatttcgtgatcatataatcaaagcttcaattcctttcattaaaagagatgagaaggttgaatggcatggagacacaaccatttactgcctacatgtcaccaccgatcatgatcaatcataaggtgctacagctactgtaaaggaaggatgtgttggtcaatcatttgtgaccgtcaaagtagagtctggtatatgacatagtttgga

SEQ ID NO: 3796 - DNA, 311 bp, Diabrotica virgifera
  Clone ID: LIB149-007-Q1-E1-B4
tattcttcgagaaatctcaatgtgactgtacatgtctgcttctgcgtcaacagcgtgaacaccagtgattcgacgcgcaatcaccattgggaacactttaaaggtaaccatggcaaagcctaaaaacgtccattcgaagaaacatcccgcctctgagttctccaatccactcaaaaactcatcagtgcacactgcgcaatatacgagcagagaattgttggataaactgtgggaatacatcatctcgcagagatcaatcgataagatctcagctccattcgacgtacacatgcatataacatccctaacat

SEQ ID NO: 3797 - DNA, 385 bp, Diabrotica virgifera
  Clone ID: LIB149-007-Q1-E1-B8
cacatgcgtcaggccccatcacaacatcatggcagacgcatccaacgcacaaactctgaagttagcaaattcacggacaaggtttaaacaattacaaccgcttaaaacctagaggtctgccacagcgtcagttgaaaactccaaacaagatctaccttcaacaactacaattgataacccatcagattcatcacacagttcaattaacacataaagtgaacttccaaatgtaacacacactcaattgccaacctatttcatgaacactgcacaatccgatccaggatcattttttgagaatttgtctacggctaagaccaatgctggagactttgggaacatttctgaagtagtatcaagtccaaggtctgcacaacatgtaacc

SEQ ID NO: 3798 - DNA, 430 bp, Diabrotica virgifera
  Clone ID: LIB149-007-Q1-E1-C1
attttacgatagtataatattttttagtataagtatagataaattttatttaatgatagataattagtattgtgagagaatattttatttttataaaagaaaaatttattttttgtaccttgtgtagcagggattattacttagtaattatatatttattaatttcgaatttaaaagagctaataaattaacatttttattgtaaaatatatagtttaaataatttttttgtaatgaaatgtgattcgtttttaaatatctaattttttaagaaataaattaaatttatttattaacaatatatttataattaaatatttttatattaataatattaaatatttttagggatgagcttaaggataaaattttattaaaatttaaattttaaataaaaattaagattaaaaattttcatattttaaaacat

SEQ ID NO: 3799 - DNA, 376 bp, Diabrotica virgifera
  Clone ID: LIB149-007-Q1-E1-C10
cttacactccagcatacgcatgggccattgtgcttagaaccggtacaattcattacccggtcatggcaatacattggttacggttgatgagtagaccattcatgtaccacatgacattccgtgtgaagtcgcacttgaagattgtgaacctcctctcaatgatatggactgtcttgtacatcactgagtataagatgggtcaagaggtagaattcaccatcacattcatcatggtgatacagactctccaaaaggctagtgtatgtgcatcgttacatgtttccaagggatgtagaacaataagtttcgactaaggtatgcccaacaggaactgtctaatcttactcctacagaacagattatgggcacaacgaca

SEQ ID NO: 3800 - DNA, 381 bp, Diabrotica virgifera
  unsure (1)..(381): unsure at all n locations
  Clone ID: LIB149-007-Q1-E1-C11
cccacgcgtccggaagtgtctagttcttctttccctagtaacccttagtgtagctgcctactacccaagtactggtangcangtgacagtangagtagctggaaatgtgaaactagtcggctctcaaggttcccagattgacattcgtagaantccttaaaacccaagaactgtcgacgtcaacctcagaagtccaaatgctccaaccagaactctgcaaattgatgaagccaagaacggccaacaacttggttattccaacctccaaggtgtcaacaaccaaggtgtcaaccaagctgatgttcctgctgatcttttcactcaatatgagggtattgtatatgaccagaccttctacaatttgttgaacaaacttcaaca

SEQ ID NO: 3801 - DNA, 371 bp, Diabrotica virgifera
  Clone ID: LIB149-007-Q1-E1-C12
aataccctatagagagtcgtattattatctaggccgacttttgtgtttatttttattgcaacctctagtaaattataaagtatcgattcacataataataagtcatgatgagtttagttgcactgtgggagaacgaagtatattgcaagcatgtcgatgggatcccgcattctttaagactgtcaaagcaatttccagaaggcaactaccactaataaaatgtcgtagattttgcaagaaagaacaaggccattatttaagcatagctcaacaacttcacatataaaatgatgaggaatgggcgcaacagaagtatgccatgtatgaaggtataagggagacacagttatgaagtggctttagtcaattta

SEQ ID NO: 3802 - DNA, 77 bp, Diabrotica virgifera
  Clone ID: LIB149-007-Q1-E1-C2
atagtgagtcgtattatacactcggtagtgcacgtgaagaaaagtttgatttaacggtaggtcactagtattgtgag

SEQ ID NO: 3803 - DNA, 145 bp, Diabrotica virgifera
  Clone ID: LIB149-007-Q1-E1-C7
cgttcgagagagagaattttatgtgtatatatccatttgtttgatcgtctgtcgtgcagttgtaatcccaacatgagcctttcgagttttctctgggttagttcgattgtggttatgttgggctttggtaatgtcacgggttttt

SEQ ID NO: 3804 - DNA, 330 bp, Diabrotica virgifera
  Clone ID: LIB149-007-Q1-E1-C8
aaaataatacaaaagaaaaaaatgatgcagattaacaggaagctgcttcccattaagggccattacttcttttttatggcagcaatgggcccaatccttccacagctcaacgtcatcggtaaagaattgggagtatcctcctttgtgatgggtataataacgggtaatcctccaatgttgtttctcctggctaaaccagtattcgggctgatcttggatatatttagggactacaggaaatcaatttttatcgcattaatcgttgcaaacacagttagcgtctggggcccggagtacatttcccagaaaactggactgcgaatagcgttt

SEQ ID NO: 3805 - DNA, 111 bp, Diabrotica virgifera
  Clone ID: LIB149-007-Q1-E1-D11
ttttcacataaaacatattcataatcttaagaaagtgtacaatctaacaataagtgattaaatctaaatcgtatgaatattgaaagtactttcaagatccagggttttaat

SEQ ID NO: 3806 - DNA, 371 bp, Diabrotica virgifera
  Clone ID: LIB149-007-Q1-E1-D2
cccacgcgtccgaaaaaaaaaaaaaaaaacaataaagaaatactaaaaatacaacaaaaaaaaatgttgagaaacaaaaaaaaaaaaagggggggccgcccaaaaggttcaaactttactaagccttcaaggaaactcaaaacccctccaaaagggccaccaaattcaatttcaagggcgttcatttaaaaacttcgtaatgggaaaaacccggggttacccaaccttaacccccttgaacaaaatccccttttcccaaacggggttaataccaaaaaggcccgaaccattgcccttcccaaaaatttcccaaccctaatggccaatgggaaccccccctttaccggccattaaaccccgccggttttggg

SEQ ID NO: 3807 - DNA, 436 bp, Diabrotica virgifera
  Clone ID: LIB149-007-Q1-E1-D3
aatagtgaattaaaatacatcagtaattgtgactaaatccaatataaacatcattcttaaaaaaacttaaatttaaaagaaatgaaattaaaataaattaaaaatacattaatctgaaataaaataaattcaaataaagtaaaataaaaaattaaattataataaatgtttctatattcaaaattctgcaaatccttttcaaaaaaattatttcagaatttttttatattgttttttttttaattgtttttagaaagcactgattctgtaaagaaattgatttcttgcatcgaagaacaagaaaatggcatcatggcacttcgcgtcaatttcgtagcaggcgtcggtaagtgcataaaggacgatctcgtcgctttggttaagactgtcgcacctttgctcaaagatctatctggtatccatgaagatgccaaaa

SEQ ID NO: 3808 - DNA, 328 bp, Diabrotica virgifera
  Clone ID: LIB149-007-Q1-E1-D4
aagacgattgtcgctcatttttaaccgttggagaaccattcgggaaattgtccatcaacaagtttatgccgaataattagtcacacgacgacattttttcaatacggccgagtcagcaaaagaactactcaagaagaacaggactttgaaagagttcacttctcgtggactggatgtagactaacgtctggacatgccacatgagcaactcactggaactcatgcattgccgtgccagaaggcgttttacagtgtgattgaaacgtacaccaatggctctaatgaaaacactgcgtgcagccaagaaacatgcccctccactagaaga

SEQ ID NO: 3809 - DNA, 406 bp, Diabrotica virgifera
  unsure (1)..(406): unsure at all n locations
  Clone ID: LIB149-007-Q1-E1-E1
cagacgcgtgggttgaatttgaatttataagtttaagattaacacattcctcagaggtaactcacctcagaaggcaaagcgtaaatatgtttttcaaacgacttcttttcgttcgtaatgaagtctgttgtaatacccctatcattaaacgttttagttgatgttgttgtacttactgtangagtttttattatttgacctgttactatcttttctgaatttttagagtcgggtgctagttttccttcgctgatagcttgaactattggaatgacctcatgagtctgaggatctgtgtaagtctgctgttcgttattaatcaaacctaacctcaaagattcggtatgtgtcatgatttcttttgtaacatcttgactagcaacagtactagagtacgtgtaacttt

SEQ ID NO: 3810 - DNA, 450 bp, Diabrotica virgifera
  Clone ID: LIB149-007-Q1-E1-E10
cgattatcgaaatctaatttcgacagggtaaatggtgtcgaagtcatttctattcactattccgattgtagagattccgagggagttatggaatatcgattttgactatttctattcgacttggccacttctattcgattttcctgacttctatcatcgaaatgagttacagaataggcatgattttccaaaagcagcaatattaaatccaaaatggatatgcggtatagaaagtaatgacgcaggtaactccaataagcggtagatgaagagtatggtagagataaagtctcacggctcgatgatcggtcgttcattagtccctactgaatggcgttaaggtatttaaaaaccgaaacacacataaattatgagaaacgtttaaagaaacggattattttatttgtcatagtcattggacattaaaaggtaaaataaaaaaagtattgc

SEQ ID NO: 3811 - DNA, 305 bp, Diabrotica virgifera
  Clone ID: LIB149-007-Q1-E1-E2
gtgaagattacagaactactcgctcaagaaatcctgagagatgttgatgttgaattattactaaaggaaatggagacaatttaattatttgaaaaaaagagttctggaaatataacggcagtgttgaatgagttcatagacaaagttttggaaaatgctggaaattacctcatagatcatggatatgattcatgccatattccagacacagttttacatcttccactaacagggaccgtctcgttaaagaaaggatgggtacgaagattgggccatgattaatagatacaaagatactgatgtag

SEQ ID NO: 3812 - DNA, 410 bp, Diabrotica virgifera
  Clone ID: LIB149-007-Q1-E1-E4
cccacgcgtccggcaaagtataaaaatgaagcaaatacttattctttcaattgtgtgcgtacttgcagtccattttgtaagttccgttagtctccaaaagggtacacttgatatcatagagggcaattgcaccagtccaaatccaaaacaggcagtattgaaagattatgtccacaagactagcattccttttgtcaaaagagacgaaacagttgaatggcacggtgatcaaaaaatttactgcgtaacagccatcagtcttaagagcgccgaaaaaggttcaactgcttggatctcagatggtggagttaaccacacctacatcgcaatcgaactggaatctggtagagggcatggcttggaatacaacgttaccatttatgctaaataatgttattgaggtgtttaaa

SEQ ID NO: 3813 - DNA, 424 bp, Diabrotica virgifera
  Clone ID: LIB149-007-Q1-E1-E5
cacacgcgtccgcccacgcgtccgtaatggaggagcttctggagcaggagatgatagcgactggataaatggtggaaacagtcctggaaagagaagtttaaacgtcatggatgatcataatgttccctttgttccatatagtgacagaataacacctggtaaacgttgtgtgaatcttttagatgagagctgtagtaatggaggagcttctggagcaggagatgatagtgactggataaatggtggaaacagtcctggaaagagaagtttaaacgttatggatgatcataatgttccctttgttccatatagtggcagaataacacctggtaaacgttgtgtgaatcttttagatgagagctgtagtaatggaggagcttctggagcaggagatgatagtgaccggataaatggtgggaacagt

SEQ ID NO: 3814 - DNA, 354 bp, Diabrotica virgifera
  Clone ID: LIB149-007-Q1-E1-E7
cgcctgcagtaacggtcctagatctccgggtccacccacacgtccgcacacgcgtccgtttttttttttttttttttttttttttttttttttttttttttttttttttttttttttttttttgatttttttttaaagcgagagggggcccacaagggggcaagatgacggaaacgtgcaaaggacgccaaaaaactcctaaagagtaacgcaaaaacaaatcactgggggtggcgttaaaaaatcgagacagggaaaaacccggggaaaaaccactcaaaagccgcgcggaagaaaccccattcgccagaaggggaagtagccaaaaggcgcccgcaaatagcccccccaaag

SEQ ID NO: 3815 - DNA, 308 bp, Diabrotica virgifera
  Clone ID: LIB149-007-Q1-E1-E9
cccacgcgtccgaaaatatttcagttgtttatggctccatcggtacccaaacaaatgcggcttcaatttaattttcaaaaaagggcgggtttaataaaatttaatgcctccttcaataattccttggaaatgggtggcctttaattttaatggtccactggtggcttaaagtttaaagttgacagaaaaaaattataaattattaaaaaattcctaaagaccaaatacaataaggggggccaaaaaacccttgaacctcccctggatccgcgcctgggaacaagtttttttcaaaagaaattaataat

SEQ ID NO: 3816 - DNA, 112 bp, Diabrotica virgifera
  Clone ID: LIB149-007-Q1-E1-F11
cccacgcgtccgatcatccttatcatttagtagatattagaccatgacctttaataagaacttttagagcaatattaacaatattaagaaaaattaaatgatttcaattata

SEQ ID NO: 3817 - DNA, 311 bp, Diabrotica virgifera
  Clone ID: LIB149-007-Q1-E1-F2
tgttcttcgagaaatcatcaagtgacactacatgtctgcttcggcgtcaacagcgtgaacaccagtgcatcgacacgcaatcaccattgggaacactttaaaggtaaccatggcaaaatttacaaacacccattcgaagaaacagcccgcctctcagttctccaatccactctaaaactcatcagtgcacacagcgcaatatacgagcaaagagttgttggatacactatgggaatacatcatctcgcagacatacatcgacaagatctcagagccattctacgtacacaagcatataacatccctaacat

SEQ ID NO: 3818 - DNA, 428 bp, Diabrotica virgifera
  Clone ID: LIB149-007-Q1-E1-F3
aaacttttcatatattatacgaacgcataccagctgatgcagtttttcaaaaactaagtcagcatccaagatgtggaaaatgtaaccaagaactgatgatatctccctactttgaaaaggaaaatccaagacatcaatatgagaaggatttaaaagaggctggatttcccgagttttatttccaagagcacagaaatttgacatatacttttccaaacgaaaaatctcttaaagatctgtttatttctataaatgcaaccttaccgtatgtacctgaaagcgaagttgaagaatacaagaaggattatctagatatagtaagacaacgtatgaagcgtgctgcagaagaaaaagtcattcccaatgatcttacagctaaatatactttatttgtaatatctgcacacaaacaataaatacattatttt

SEQ ID NO: 3819 - DNA, 436 bp, Diabrotica virgifera
  Clone ID: LIB149-007-Q1-E1-F4
cggacgcgtgggcggacgcgtggggcaatatgctaattgagcgttttaaggcccttatttgacattatttccaaataatgttagagcttaaaacatagatgtgtatagagtaagcttcgaataagaagaattgacgtcgggcaagttctttggataccatatagagatctgacatctgctttgacatattctgtgctttctctatacattcatagactgaaatactagtgtagtcttaaaaacttgcaaaattttacttatttggggcttactgtactgtcaatattggtgtatgtattgacaatgatattgtagttcacatggtgtaagcttattaacattgttctttgaagtgtcatatttaggcatctatgttttaacaaacaatgacttaacttgattgtttaattgtgaattaaagattttttacaatagt

SEQ ID NO: 3820 - DNA, 405 bp, Diabrotica virgifera
  Clone ID: LIB149-007-Q1-E1-G12
cccacgcgtccgaaaagagctaaaaaattaaaatttttattgtaaaataaatattttaaataatttttttgtaatgaaatgttattcgtttttaaatatatctaattttttaagaaataaattaaatttatttattaacaatatatttataattaaatatttttatattagtaatattaaatatttttagggatgagcttaaaaataaaattttattaaaatttaatttttaaataaaaattaggattaaaaattttcatattttaaaatatgttattaattacttttaaatattaataattttaatttttataaattttttattaaaatataaatttaaattaattaaatttagtaatggtgataatattagtaattaaaaattgtaaatttagtaaaaatata

SEQ ID NO: 3821 - DNA, 417 bp, Diabrotica virgifera
  Clone ID: LIB149-007-Q1-E1-G6
cacacgcgtccgaaaaactattatatctgatttaaccaaaaaaaaagatcaacattttgagttatgtcacttttctttaaaacagttggtcacttttttaaatattaaagaaacatactagggagcttctctaaatacaacggttttcctgataaataccgattcgttctcgtcaaatgtcttaaaaccgtcaaatgtcttacgaagttggaagtaaacatctatgtgacacttttcctggtaaaagtatcgaattttcggagccaatttaacaagataactgcaaataactggacttatgcatttttgagttgtgtctttttcttccggaccagcgataggtaaatgttcacaaacgacacacgattttatcaaattatttttatttaacttagactccctttgcagatcaaaatt

SEQ ID NO: 3822 - DNA, 307 bp, Diabrotica virgifera
  Clone ID: LIB149-007-Q1-E1-H1
gcaggtcgacacaagcctctagacggagtcggaagatgatgtccccacataccgacgtcacaactgcaactcaaggtcccccttcttagagatgtttatttgacgatccaagtcaatccaatattattaaaagttagctctcttagtttagttacgaatgtatccatatcagtaatacaatgtagcgcagtgatatccgcgtacatttatcctctcaaatcacagtacaactaataattagctttagagggacattttacgacacttttatcggagtacctaagggatcatagctgcatcataatgg

SEQ ID NO: 3823 - DNA, 434 bp, Diabrotica virgifera
  Clone ID: LIB149-007-Q1-E1-H11
aaaatatttttgcgtttgcttgatttgagtctgctcggtatggtaaacaaaggcattagaagctgttacaacaataatgggcaacatttttcttttattataactgtctataaaaatgtttattatttacttgttgtggaactgtagtttcctggaatcagtcggagtatgatattatattttgaaaggttggcaacgttatggaaacgtatccaacatcgatgttgccaaatttccaatgtgatctgggattgccgcgcaatctgcacattcttgtcgagtttttgtactaaggggaaacgaaaaatgaaaacgaaaaaaacgatctaaagtgtctggaccgtgtctccatatatgcatacttgtcgcatatcattgtgttatcaatatattttatatttatattttttgaacttttaaatatttttatttgt

SEQ ID NO: 3824 - DNA, 414 bp, Diabrotica virgifera
  Clone ID: LIB149-007-Q1-E1-H2
accagcgtcgccagcgtagcttcaatcaatttgcttcaagctgaaaatagaaaccttggcagccgatggtggtggcctcgaatcgaatttaatctaaagctatatttccttaaaaaacgtgtattattcttttgggatattcttaaggcaatgccttatctctccattatctatattatatcaaaatattttgatcggatttatgttgggtatttattgcgattacttttacatttaacattacatttctacatttaacattactctatgagctattgaagtatatcataacccaactttttgtaaatggtgctattcccgctctttcactgcggcatttttttggaaggcatgcccaggtgctcactttctactggcaatgaaagtttgaatgcgcatgtgtgacacgcacac

SEQ ID NO: 3825 - DNA, 376 bp, Diabrotica virgifera
  Clone ID: LIB149-007-Q1-E1-H3
catacaagcctctatacagactcatgctacgattcagttcgcttcagacgctgaaaattagaaaccttggtcagccgatggtggtggcctcgaatcgaatttaatctaaagctatatttccttaaaaaacgtgtattattcttttgggatattcttaaggcaatgccttatctctccattatctatattatatcaaaatattttgatcggatttatgttgggtatttattgcgattacttttacatttaacattagatttctagatttaacattactctatgatctattgaactatatcataagccaactttttgtgaatggtgctaatctcgctctttcactgcggcatttttttgggaggcatgcgcaggtgct

SEQ ID NO: 3826 - DNA, 422 bp, Diabrotica virgifera
  Clone ID: LIB149-007-Q1-E1-H4
cccacgcgtccgaatttttgtttgaaattttttgtttaatattatttgaattgtacttgaaaatgtaatcgtaaattgtcagttttagacaattcagtcattgcttaccgtaattaataattttctctgaaaaatgaaaatatctcagaaactaataaacttagacatagggaatgttattaaaaaattaaagtacggtaatagtacttttcgatagtgatataaaatacagggtgtttcatttaaaattactgagaaaataatgtatttgcgttttgactcaccctgtattcaatataaagaaaattaggaatatcaataatttatgaaaattttgacaaataaaaaaatatggcatcaataaaccattgccgttgtgcttatttttatttatacagggagttgaacttgttacgattttc

SEQ ID NO: 3827 - DNA, 419 bp, Diabrotica virgifera
  Clone ID: LIB149-008-Q1-E1-A1
cccacgcgtccgcccacgcgtccgcccgatctttcaacgcatagcaaattttgaaccttagaattgttttctactcaaaattttcggtattttactcttgactttaggatgcaggcaattttctaacctcaaaattatttcctgttaatctgttttttattattataaggaagatgtggctatatcacatttgccttgaattcattcatgttctaatgaatgaaatataagtatgaattaaacagagttcgtatttcgatacagctccaatgacaaatgacatacgtcaaatagtgcagccaactgaaataatgagggcgctctatggtatgacgtacatcgctatttgctatgcttttgcgatatagatttgaaaacgcttcgatgtataaatcacatctaatgattgcatcaataat

SEQ ID NO: 3828 - DNA, 412 bp, Diabrotica virgifera
  unsure (1)..(412): unsure at all n locations
  Clone ID: LIB149-008-Q1-E1-A10
cngatatttttcgaacgatcatcggataatctagagaaatgcgattggcaacactgccattgacacaggtacataagcgttttgagtattacagtgttggtataaagacagtaacttacatcagatgaatacagttatttcgtaaagatacagttgttacaatattattttttttaacgaacaatgatacaatttttttttttatatacgatgatatattttgcaatcttttaaaaagtctattagggcactgtacacatttggcgaactaagtatttgcttgaggttaccgtttatgttatgcgctagtctatacgagctgtaataactacactcaacaagtaagtgttccactgtaagccggtgagagttacaatgttcacaaacaggtggattttcggaagtcatcaag

SEQ ID NO: 3829 - DNA, 432 bp, Diabrotica virgifera
  Clone ID: LIB149-008-Q1-E1-A6
gtgcgcttgaaccattttaccacaaaactatttttagtattttgtaatgtgtaaacacatgttaatacaggatattttaagtaaataaatattagatttgtgaccaattttgaagactaattaagtattatgcaacgtgccagttgtagttacactgtggataacagctggaacaaaaatgattagtaatatgtagttaacatctgcaattgaaccgttttaccagtaacatttatcaacaccatgtaccgattcaagtacatttttttaataattgaaaaaagggaaggatatagtaagtgtaatacccttatatttttatcactttatagtacattgtacactagacaaaatttagtctaatgactcctagaatttataaaactcaaacaactttgaagatgattatctcagaactacaaaacctgcact

SEQ ID NO: 3830 - DNA, 328 bp, Diabrotica virgifera
  Clone ID: LIB149-008-Q1-E1-A8
aagaggcctatgttcattatgaggatcattagtcaatttgaacttaatgtcagctattccatatttagggaatacattaaaccattgaatttgatgagggtatgcaattcaaaatgctactttaatgctaatcaatacattacaatcttacttaaccttttacaatttctgcgctcaaaagtattcatcttttcattgtacaacaatcatgatcaatcattcctttgggaagtaaatgcaatatcactgataaaattccacttcatccttatgatacgtttaacgctcacctcggactcatacctttattattaattatatcaacatt

SEQ ID NO: 3831 - DNA, 252 bp, Diabrotica virgifera
  Clone ID: LIB149-008-Q1-E1-A9
tcatataggcatggcaaatttaagaatgggacgattcccttccggtggttttcaaggcatgcgaaccttttttcagccaacatttcagggaggtcatggcgtaaccccctgatgtgagtctaggaggcccgatcagggaacttatctaatcatttccatcaaatccgggacaatcttctccagttcacagccatcatattacaacctcgacatcgttcaccaccatcgacgcgttatgtgactacatctccc

SEQ ID NO: 3832 - DNA, 367 bp, Diabrotica virgifera
  Clone ID: LIB149-008-Q1-E1-B1
gttggatttttaccaagataaattgacgtatcgtgcaatgcatattgtagactccccatgtctatccatttatcgtctgttgctttgtaaattgtagaaggctcgtatataggttgtaaccagaatttgttttccagcgtaacgaatcttttgttctccggttccttggatttattttggctctttatacattttaagttgttattaaatttattttttttattgttttaggagaaatcttgtttacgacaatcttttatcgggagtgtctatcaatgttcgtatgccaccgggaggatattttaatagacccataacgtgccttcaactaattgatcgacagggaaactctgtttctccaaaagat

SEQ ID NO: 3833 - DNA, 65 bp, Diabrotica virgifera
  Clone ID: LIB149-008-Q1-E1-C11
aacataaaaggggaggccactccaaaggtcctaaactaaggtccccgtgattcagatcatcaaac

SEQ ID NO: 3834 - DNA, 380 bp, Diabrotica virgifera
  Clone ID: LIB149-008-Q1-E1-C12
tgcaatgttggtgaattaattaaactgatttttgtgtttatttttattgcaacttctaataaattataaaatatcgattcacataataataatcaagatgattttattttcattgtggaagaaggaaatatattgcaatcatgtagatggaatcccgcattctttaagaaaaaaaaagcaatttccagaaggaaactaccaataataaaataaagtagataatgcaagaaagaacaaagccattatttaacatagctcaacaacttcacatagaaaaagatgaggaaagggcgcaacagaagtatgccaaataaaagggtagaagggagacacagataagaagtggatttattcaatttaaaaattaaactgcaaatgac

SEQ ID NO: 3835 - DNA, 309 bp, Diabrotica virgifera
  Clone ID: LIB149-008-Q1-E1-C2
tattttttaacggagttccagttgtatattgatgagtatcaatttacattctaaaatatctgacataacgaggtactcaacttgtaagtatcaagattctcttagttgtagacaatcaaactttatttcttactaattgaattacagcgattactcatttctggttatagatttattagttacatattatagtgagccaattatattctcaattttactgctaaatacatattttaaataacttttatgtaatgcaatgtatattcgttattaaatatacctaattttttaggaagtacattccattta

SEQ ID NO: 3836 - DNA, 250 bp, Diabrotica virgifera
  Clone ID: LIB149-008-Q1-E1-C3
caaaacttacactcgttctcttggcagccgtctttgtagccgttttggctacccaagaagtcagcgccggtgctgtcaaaggtgcagaagctcctcgtgctgctggacttggagcagactgcgaatgtaacgcatgcagtaaagaatgcatatccgagagctccgactacattggaggtatttgttaccaaggccaatgtgtttgtgcctcccttggctaaactaaataatgtgataaagtttaattaat

SEQ ID NO: 3837 - DNA, 418 bp, Diabrotica virgifera
  Clone ID: LIB149-008-Q1-E1-C5
cattttcctagtactcaaatttttgtccaaatatctacgcttcgaactttggtgaatatattgtaagaccatggttggtacagactcaatatgagccttcacaatttttcggttttcagtgcttgttttatttggcagtatatgcttgcctcttttgcccgtatctgcataacaacatataatattcatttttcttacaacatcttgcatttttttacgctgatatacaaagtgtcttacataaaaacttctcacatacctgtacctcttgactattcaaagaaacatagtcgatactatctattttaccagtcgatatgaatgagaaattttaataaaacatacatgtataatgtattaaagacatttatcacctttttactaaatatggtatacagcagtagatatatatttttgt

SEQ ID NO: 3838 - DNA, 415 bp, Diabrotica virgifera
  Clone ID: LIB149-008-Q1-E1-C7
cacacgcgtccgattgactttctagatagagaattttatgtgtatatatccatttgtttgatcttctgtcttgcagttgtattcccaacatgaagctttccatttttctctgagttatttctattttgtttatgttggcctttgttaatgtcacgggtttttaggtactgttgcatctttatgctttttagtatccatcttaactttccaaacgctgcccacgccaatctgattcttctttgtacttcaattgtttggttctctttattagctttgattatttgacctaggtatatatattcgtcaacaacttaaatatttacgttatttatatttatatttattctctcatttggtatgccacattctgtcatttggtcaacgtaccacatgcattgctaaaatctcctcgatg

SEQ ID NO: 3839 - DNA, 433 bp, Diabrotica virgifera
  Clone ID: LIB149-008-Q1-E1-C8
cagacgcgtgggcggacgcgtggggtaaaagtgttttatataaagtgaagaatgggcgaggtattgaacaaagatgcactgcattcttggattcagcgtgcgataggtacagaaaacttcaattttactgtggaaaacaccacccaaaaaggagagggttacgtaggggacttatttttcgttaaaattgatttacaacaaccgattaacggactcaacgttctttatctggtcgtaaaaaccaacaagagggatcctggatcgattcgtctcatgcaggatttttgcaagagagaagtattcttttacggcacagtttttaaagaataccaggaatttctaaataacaagaagcttccagttcttttagacatggtacccaaatgttataaaactttttcagaaaatggcaatgaagttattattttagaaa

SEQ ID NO: 3840 - DNA, 322 bp, Diabrotica virgifera
  Clone ID: LIB149-008-Q1-E1-D10
ccgctgagagtaccggatgacactgtgaggaagtgtgctgccggttgcttaggtgccctctgcaggtagctaccaccggatgagttggagtccactctattcgaacatattttatgtgatgagtagttcagctaacaataccctgaaagaaggcagaggttcagcactaacggtggctttaagagaagctgctgtaagtttatgggacgagcaatacagagcaaagttgattcaaacgttacgaagtcaattatcttctcaatcagtcgttatcaatcgaatcgccatacgatcctgtggttatctcttacagtttttgttg

SEQ ID NO: 3841 - DNA, 166 bp, Diabrotica virgifera
  Clone ID: LIB149-008-Q1-E1-D11
cgggtaaacccacgcgtccctaataatactccatagataggttagaatcacttttcgataaatgtatcatcttcgtgtgattattagcgagtaagaatgtttgtacattattcaacaaatgtctataattatgttttttaaatagtaaaataaatacatctccgat

SEQ ID NO: 3842 - DNA, 430 bp, Diabrotica virgifera
  Clone ID: LIB149-008-Q1-E1-D4
cccacgcgtccgcaaaaatgaagattgttttattagttttgttcgctgcttgtttgtcacaagccaaaataaatcaagatatacatttcgattgggtgcagtataccggagaaataccagagaatgctataataggcggatcaactgctgatggtgatccaacgtatgtagcccgttccttcctcagtgcagatgaagatgatgaaaattattctggaagtgactacaatggttatgtagctggtggtgtgttacctggaaaattgtcgatcgacctttgtactccgcagagtatatacacgctcacaaagaacattgagatactgactgtggtcaatggaacaaaaatcgaatggattaaatcttaccagcacacattcatggacctcttcaactcagacgactatcgtcctgtaaggatcggctggct

SEQ ID NO: 3843 - DNA, 345 bp, Diabrotica virgifera
  unsure (1)..(345): unsure at all n locations
  Clone ID: LIB149-008-Q1-E1-D9
cgtccgattttgtaaaaattaaacatcctacaagcaatatattccaattataaaaaccaaaacaaacaccatgtgtgaatttctgctttgtttggaaatcatttcagagtagccaacattgatttgacgtcacgactatcacggtccattgctcgtccgacataagagtgacacaactcanaaaatgcacaattccagttatcttgttaagtttactccaaaaatcctataggtaattttaccagaaaagtgtcacatagatgtgtacttacaacttcgtaagagagcagtaatgtcattaatcttttagcgctaaaatgaataattttaaatcccgaacaatga

SEQ ID NO: 3844 - DNA, 243 bp, Diabrotica virgifera
  Clone ID: LIB149-008-Q1-E1-E11
cggtcaaccacgcgtgtcatataatgccgatgtatttatttagcgactttattttatttttgttattggttacgtattaaatacattagatagtaagagtattttatctagtcttcgtagactgaagttttggcaactggtgtctagggttcgagatccatttcagtacaccattagtcgatttccgtgtttgctgattctacggcgtctgaactagtggcagatgttacgtctgacttggat

SEQ ID NO: 3845 - DNA, 439 bp, Diabrotica virgifera
  Clone ID: LIB149-008-Q1-E1-E2
atattttcgcgggcaaaagaagtgatgatttgaatttgttaaagaatatattaaacactttctgcccaaaaatttcgcccggcacccttctgatatgtttataggggatattttttaacaagaatccacatagaaaccgaatcagaacagtcagacacaggcagcataaatcctgaccccggaagtatcataggttttcgaaacggaccctcagggaaactaattggtgacccctgccctagagcacctgttgcccagggtcatcttctggagtttcgagggattgcggcactaaagtgatactaactcaggggattttttgggggttgctcgacacaaatatgacatcagaaccgactctcagagcaccagtgaccagagtgaatgatatgcacgtcattttctggaattttgaggccttccgacactaaaatgatgc

SEQ ID NO: 3846 - DNA, 435 bp, Diabrotica virgifera
  Clone ID: LIB149-008-Q1-E1-E8
aacaaaacgaccttgatgttgcttttgatcttttgcagccaattaaatatgacatagttaatgaagaaactccttttggaaaagaaattgattttaattggttagatgttccattggaagcaaatccaaatggaggggcactgccaaaaagtagagctgatagaaagtgtgaacagttagaaaacttagctaaggcagtaatgaagatagctgctcaaaaaagatatagcatagtagacttttgtagtggtagtggacacttgggaatacttctggctactttactcccgaattgtgaaattgtccttgtcgaaaataaagaaagatctttattacgagccaaggaaaggattgaaaaattgggattaacgaatgtatgtattgtgcagtcaaatttggattattttcaaggcaacttcgacataggtgttgctc

SEQ ID NO: 3847 - DNA, 384 bp, Diabrotica virgifera
  Clone ID: LIB149-008-Q1-E1-E9
ccgggtagaccacgcgtccgatcatagcggctaatataaatacgatgtatattgttccaagcatcctgtttgccctctttgcttctggagttcgtcaaaagtgggatggatcaaatgatgaagaagaaagaaaaatatctgaagttagaataaagaaagtctctgtatggtctattatgtctgtgtataatttatataaatattacacagacataatagaccatacagagactttctttatggtctattatgtctgtgtaatatttatataaattataatttatttattttttaaaaaaaaaaaaaaaaaaaagaaggaaaggagagaaaaagggagaaaaagacaagagagtaaaaacaagaaggaaaaaaaaaaggggggac

SEQ ID NO: 3848 - DNA, 439 bp, Diabrotica virgifera
  unsure (1)..(439): unsure at all n locations
  Clone ID: LIB149-008-Q1-E1-F1
aacagaatacacgcttgtgttcttgatcaaaatccatcctcgttagactacgttactttcatatatcaacatttgtccaagactgacgaacgcgatcgcaacgaaagacaagaattagaactagcccaaagtttgttgccaagcagcctttcctgggacagcgttagtgattgttatcatggtgaacgtggaactgaacttttattaggatatgagaaaagacaagcagagcttaatcccatattaccttgggtaccaaatataagatttaacggcgtctacgatgaagacgtagaagatcaagctatgatggatcttacagctaccgtttgcaacttactagaagataacaaaccagacgtttgtaaagatcatgcgacaaaggctcatccaaaaatgcttaaaaataataaatgtgaaaagtaatgtntgttgaggg

SEQ ID NO: 3849 - DNA, 351 bp, Diabrotica virgifera
  unsure (1)..(351): unsure at all n locations
  Clone ID: LIB149-008-Q1-E1-F11
cccacgcgtccgggcaattccagacatatttaatggcgtacccattggagatatacaaaaagcagcgacctctgctaatgatctggtacaaaaagttccagatacaatcaattctcaaatccaaactgttacggctcaagttgatacagagatagataaggctggagcaaccataaaggacaacacanaaaccatggatgatctcgtagataaagtaaaggagcatatgaaaagtgtttattcctctttcggcgacagggatgattatctggaaaagtactatccatatttttactaagtgggaatagtaatttcgtgcgttttgcttttaatccttgtgtttctaatttt

SEQ ID NO: 3850 - DNA, 149 bp, Diabrotica virgifera
  Clone ID: LIB149-008-Q1-E1-F12
agcaacgacctctgctaaataatctggtacaaaaaagttccagaatacaatcaattctcaaatccaaactgggacggctcacgttgatacagagatttataaggctggagcagccataaatgacaccacaaaacccatggctgatctcg

SEQ ID NO: 3851 - DNA, 433 bp, Diabrotica virgifera
  Clone ID: LIB149-008-Q1-E1-F3
cacacgcgtcagcaggtttttagcgcggatcttttatccgattgtttagagttgggttaatgtttctaatattttatttctagatttttttataaattacttctatagttcaagtcacagtttagtactggtacagaatgttggggctatttcgttgctgtttaatcattatcttgttgtactaataccatataggcctaatactcaattcaaatctgacgtgagctaaggcagccttcaatcttgtttggttttgtacctaaattgattctaaaagaaaaggctagcgctccttgtcgcatgtacaaaaggaaagaagttgagtttgtaaacgccattttactatataactaaactatgtatgttgttatcccgcatttattaaagtattgtataatagcagtaaccacttatatgtatatataaatattca

SEQ ID NO: 3852 - DNA, 445 bp, Diabrotica virgifera
  Clone ID: LIB149-008-Q1-E1-F4
cccacgcgtccgcccacgcgtccgcaggttatgtagaatttcaaaataaattttataaataagtagttgttaagtgattaatgattcaaatagataaaatcaagtaaaatgaagcgaacaccattgataatttcacatatccaacgactattttacaatacgtcaactcattcaattataaggaaaaatcaaaatgtaaatgtttcctttttaggaacctctagctcacaaatatctttaaattattgctggcaatgtggtgcagagcgaaaggggtctaacatattttgtgaaaaatgtaacgttatacaagtaccaaatgagaagaataattattttaaggtaatgggagttcaagagacctttaatgttgatcagaaacttttaaaggagaaatttaggagttttcaaagttgtatacatccggataagtttagtaatagta

SEQ ID NO: 3853 - DNA, 339 bp, Diabrotica virgifera
  Clone ID: LIB149-008-Q1-E1-F5
cggacgcgtgggattttttaagaatcataagatcgaacactaaggaacaccatacctacaagtagtttttcatgcatttgtattctttcttactagcactaggtgcttaacatggaaaattgatcgaaatgttactttttgtatatgttctatgaaataaagattatttcaagtttaaaaaaaaaaaaaaaaaaaaaaagaaaaaaaaaaaaaaaaaacaaaaaaaaagaaaaaaaaaacaatagataagggaggtcgttctaaagggtcgaaacttacatacccgtgcatgatacgtcaaagatctattttaggggcaattaaattaaatttactggc

SEQ ID NO: 3854 - DNA, 429 bp, Diabrotica virgifera
  Clone ID: LIB149-008-Q1-E1-F7
caatgttccagtgcttgattttagttctcgtatctactttagcattcgatagtgcgattgcaaatgatgtaacaaaaccgtgtgagtctgattcttgtacgatcggcaacaattgtagatgttctagtcaagcgtcacctctaggtggaaatctcacagagtagcctcagctgattagtttaacatttgatgaagctgttacacaacacatctacgacaacagttggattacattgctcggaaatatatataatccagatgataagccaattagtggaacattctttgtaccacatgagtatacgagctatcaaagagttaatgatttgtacaactttggatttgaaattggtgtgcactcaattacgaaggattttagacaaaattactggagatatgcaactctagacacactaacacaagaattta

SEQ ID NO: 3855 - DNA, 78 bp, Diabrotica virgifera
  Clone ID: LIB149-008-Q1-E1-F9
ggtcgcgattccgggtcaaccacgcgtgcgaaaaaaaacaaaaaaaaaaaaaaaaaaaaaaaaaaaaaaaaaaaaaga

SEQ ID NO: 3856 - DNA, 422 bp, Diabrotica virgifera
  unsure (1)..(422): unsure at all n locations
  Clone ID: LIB149-008-Q1-E1-G10
ccgggtcaaccacgcgtcngcggacacgtgggcaatgctagctgctaaagttgtcttgtttttgggccttgcccttttcgtctcagccggtgaagatcttgacatgggttatcaaattgtggaatgtgccaattacgtaatgagagcaggagtacccgaattgggagtaccacaacacgacccctacgtcaaactcagggacctacaatggagtggaaacctcggtgttgccaacgcccatatcgagctccatgataatagatggtatggtcttgccgactgggaaattcaagcttaccaaatcagtgctgacactgacaacgaggctgtctttgactacaccacatcatggtcaaatggatttcaactctctatgaactacaatgcaaccattaaggaacttttcctttcacagcactact

SEQ ID NO: 3857 - DNA, 429 bp, Diabrotica virgifera
  unsure (1)..(429): unsure at all n locations
  Clone ID: LIB149-008-Q1-E1-G2
aagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataatattagtattaaaaaattgtatatttagtaaaaatatataggtttaataaaggaattcggcaacatttttttattaaacctatatatttttactaaatatacaggtttaataaaggaattcggcaacatttttttcacctgtttattantaacatgtcattttgtattaaata

SEQ ID NO: 3858 - DNA, 379 bp, Diabrotica virgifera
  Clone ID: LIB149-008-Q1-E1-G6
atttattttaagataataaagtatcttttagtagacgtaaagaacaattttatttaatgatagttaattactattgtgacataatattttatttttataaaacagaactttattttttgtaccttgtgtaacagggattattaattaataaatacatacttattactttcgaatttaacagagctaacaaattaacatttttagtagtaaataactattttaaataatttttttgtaatgaaatgttagtcgtttttaaatatatctaattttttaagaaataaattaaatttatttattatcaagatattgataattaaatatttttatagtagctaagatcagatatttttatggatgatcttaaaaatcaaatttt

SEQ ID NO: 3859 - DNA, 385 bp, Diabrotica virgifera
  Clone ID: LIB149-008-Q1-E1-G8
cacgggtccagaacgcgtccgaaaagattccaactaattgctttgatagtgaagcagtctttacgtgacgactacaagcatagttttaaggcatatgttttactcacacaatagtcttgagatcaagtaattttaataataggttttattagtcatattaggagaatcgttaaaactaaaaggtaacaaacaagaatctaataataccaaacagtccggaagttctttagaaaactgattagttttaaagtgaagtgtgaataaaccattttaaagatagaataagacaaattatctattaagattaattagtcttagttgatactattagatactttaaaactagtggcaaatgcttaacagttttaaagttctggtagtatat

SEQ ID NO: 3860 - DNA, 312 bp, Diabrotica virgifera
  Clone ID: LIB149-008-Q1-E1-H10
acccaagcctccgcgtaaattcagttgcaaataatccacggaaattatacatgtggaccgcaaaatactgttgccatatccttgccatcttaatgtggcatcattacgcgcattgtgagaccgttcatcacgtaatggtcaacacagcatactgtcgattgtactccagtgtcgtaagataatcccatgtttcatccattgtgagatatctactcagaaaatctgttctctaaagattgatgagcatcaaacacttcgtcaaagcacctaatggttagcgattttgattaatattgcacaaggttatcgtat

SEQ ID NO: 3861 - DNA, 343 bp, Diabrotica virgifera
  unsure (1)..(343): unsure at all n locations
  Clone ID: LIB149-008-Q1-E1-H11
cggacgcgtgggcgaacgcgtgggcggacgcgtgggcaaacatgaaaactgcactagttttggcacttttgagctgcgttgctctcaccgtttacgctcaacatgagcctacacttgggcctggtcctcgccctgaacctacccgtggaccgattcctgatgaacttaggtgcgacacttgcgtaactttggcagatataattaagggctacgctgatgagcgtattccactggatgaagttagacatgaagcagagaaattgtgccgtgatttgcccgaacaattgagagaagcttgcganagagaattgctaccaaatcttgacaaagtctacgaggagct

SEQ ID NO: 3862 - DNA, 444 bp, Diabrotica virgifera
  Clone ID: LIB149-008-Q1-E1-H2
gagctttgattttaaatagcctactaattgcttttaagtaagcaactttaaagacaactacaaaaatagttttaaggcatatgttttactcacacaatagtcttgagatcaagtagttttaataataggttttattagtcatattaggagaatctttaaaactaaaaggtaacaaacaagaatctaataaaaccaaacagtccggaagttctttataaaactgattagttttaaagtgaactgagaataaaccattttaaaactacaataagacaaattatctattaagattaattagtcttatttgatactattagatactttaaaactagtgacaaatgcttaacagttttaaagttctggtagtatatctacaaggtaactttaaaaccattatcttcttatttaccacaattaaaactttataaaactaaaatgttttta

SEQ ID NO: 3863 - DNA, 358 bp, Diabrotica virgifera
  Clone ID: LIB149-009-Q1-E1-A11
ctctaaattgagtcgtaatagcaggaattattatattaatggttttaaaagttgacaagtgcggacatcatgtaaatttttatgcgagagtatttgagatacagctaagccagtttaatatcatgtaccatgtgataccaggatgaatctcagttgcggatcaaggactaaaattcacctaatttttactttcaatttttttatcgtgatatgctggtataattttatttgcagttggtgcgattagacatagtctaccatacataatatgatctaatccttaacagcgatatatttttcattaccatatatgattattgctactggaacatttatcattcttatatgctttttggga

SEQ ID NO: 3864 - DNA, 121 bp, Diabrotica virgifera
  Clone ID: LIB149-009-Q1-E1-A12
ccagatatcttttagcatgggtgtcgagcgctttgactgagtgatagctagttcatattgtgcgagagtatttgagtttcagctgacacatcttgggtttatgtcccctgcgtagccggga

SEQ ID NO: 3865 - DNA, 398 bp, Diabrotica virgifera
  Clone ID: LIB149-009-Q1-E1-A4
gatgaaaacagtttcagttataacattttttgtgtgtattggtcttgcgctatcagcaacacttttcaactcagagaacattccaacaccagatagagatgagccaagctgtgaagtttgccttctggttgtgaattttgtcaaaggttacaagaatagaggctttagcaagaacgacataaaacaagaaaaagaccatgtatgtaatctcttcttacccgatctgaaagaaatttgcttgcaatcttatgaggacgatgttgattttgtttatgctgaagatgatgataaaacagtcgcaaaaatgtgcttagatatgaaacagtgtacttctaagaaaaactaataattaaattttgtttgtagtaaaataaaattttactaaaatttaattttta

SEQ ID NO: 3866 - DNA, 364 bp, Diabrotica virgifera
  Clone ID: LIB149-009-Q1-E1-A6
cacgcgtccggaagatcacagtttcagttataacattttttgtgtgtattggtcttgcgctatcagcaacacttttcaactcagaaaacattccaacaccacatagagatgagccaagctgtgaagtttgccttcaggttgtgaattttgtcaaaggttacaagaatagaggctttagcaagaacgacatagaacaagaaacagaccatgtatgtaatctcttcttacccgatctgaacgaaatttgcttgcaatcttatgaggacgatgttgattttgtttatgcgtaagatgaagataaaacggtcgcagacatgtgcgtacatatgagacagtgtacctctaagaaacactaactaactaa

SEQ ID NO: 3867 - DNA, 273 bp, Diabrotica virgifera
  Clone ID: LIB149-009-Q1-E1-A9
ctcgcgggtcgacacacgcctctacaaagatttcaattatcacataaaaacttcttatatcctaatataagaagtgataaagcgttaaaaaatatacacaatgggctcaagattgggatcctttgtgaatcacatgggttcaacaataacagctgatggaaaaaaattcacaaggacattataagggggtgtgcaaactatcaacataatattatatgaaacgcacgaaaaagtttattcaactacaccacgagtataacaagttatgttggg

SEQ ID NO: 3868 - DNA, 362 bp, Diabrotica virgifera
  Clone ID: LIB149-009-Q1-E1-B2
gagtcgtattactcatccgctcacgcgtccggttgttctttcagtcgctcaatcagattgccgctgttcatccctgcctctgcccttatggtggacacaagtgcccctctaggtgccttctctcaatcgcccatttctaaggcatcccagaccacatcttatcaccttattgaagatcagcttcggttcgctgttttccaagacaccctcagggtgatccatgaacagcctgccacacactatggtgtggacaaggcatagtacttggctgtcaccacattcgccgattgggccaccgctgacttctaagctatcgttggccgtcacatggttaacatacccattccgtcctttattgcaat

SEQ ID NO: 3869 - DNA, 436 bp, Diabrotica virgifera
  Clone ID: LIB149-009-Q1-E1-B3
tatcaacgaaccatctatgttatagatgtacatatgtttcgtaaaattgacgaaaagctggaaatagattacatataatttgtcataaaatatttgcgtcagagacttgaggttgtgatacaatatatatttactcctacagaatatttgttgaatgttaccgacaccattaaaataccttatccgttatgattgtagataaataatttactctgaatttaatacaaaacgatgtcataatttcaattgtacttgttctaataatataactacttatcgaaaaagaatagaaatttattataaaattgtgtgaaatgactgggtattataggattgccccaacaaaatattttagatgtagtatgatgcttcatcagtgacaatatatttgacgtgttttattatgggccactctttaatgtaaaccagtattgat

SEQ ID NO: 3870 - DNA, 435 bp, Diabrotica virgifera
  Clone ID: LIB149-009-Q1-E1-B5
ttgtgttattatttcttcctttttgcttcggcaaaagtgtagaagtgacttttaaagatgtcacgttcaaaggctttagtgtttttacagaaaagttcaagaaaaagatcccatctggaaacaaactagcagattttttgcccccgaaaactgtttatgatgccattgaaatgaaggaacaacatatacctgtacttgccaaaggctcgttggcagatctagaccagttggacgaattggttattgagtactgtggtgttgaagaagttgaatctggagctatcagtaatgtacctaacctaagaaaactgtcacttaaaggtaatgccatcaagtcgattgcaaaggacgtattttcccatttaggaatatctacactagaccttagcctcaatcagatatcaacaatccatccacaggcctttgacaacatgc

SEQ ID NO: 3871 - DNA, 434 bp, Diabrotica virgifera
  unsure (1)..(434): unsure at all n locations
  Clone ID: LIB149-009-Q1-E1-B6
cccacgcgtccgcccacgcgtccgacttcctagtcagctgattgttaatttacgttttcaattagaatgtctaattatagcacgccgtgtaatattgaaacaaaatgaagtgatgcagtgaaatatcgagtgacaataatggaagtgaacaaattagtgtttaccaatatcagctgtgaaaatgccattaaactgtcataacaatggttgaaaaaaactagaaattctttgtgatcggtgtgttcaacaccttttaggtatgcctagaaaaattatacttgcataaatctgagagcaaaaccagttcaaaatgctgcacgtattccatgtggactcagggcgtatgatgacgtttgacatgagcttagctctagaaagcgtcgacaacctgaaacgatacgtccaagaggaattcanaatcccagctgagaaac

SEQ ID NO: 3872 - DNA, 215 bp, Diabrotica virgifera
  Clone ID: LIB149-009-Q1-E1-B8
tgactcgttaactaatatcgagagcctacaattatcacatggcactgggctgtaagtgccatataacattctcttcagttggaaccttcagttactatggagatcagatgtgttaccataactttgtgatcaaacagaatcgttcaactattatcatcttgtcaatcacgtggcatgctacatcacatgtgaacaatcacatggatgaattaact

SEQ ID NO: 3873 - DNA, 433 bp, Diabrotica virgifera
  Clone ID: LIB149-009-Q1-E1-C1
aatttttctaagtatttttagttcaaaacgtctgagcttttcttcgtttgatttggtcatggtccacgtttcgcatccatatgttagtacaggtgtgacgatggatttatagattttgatcttggaacttcttgtaagattttttgattttataagcttatccagtgcgaatagaaaaaaattgattagatagtcaattaaaccactccctgagattgcgccgccatggcactgcactttctttttctggctgaccacacatcgctatgtgctatttgttatgcgtcttcgctgtatgcgcccaaatatttgtcctttgaagtgtgtcaaaaccgacaaccgggcggatggcgtatttactatgcgtgcttgctggctatgcgcgcgcatcaagcgaatattgacgaatgaaccctccatacttcgtcctatg

SEQ ID NO: 3874 - DNA, 108 bp, Diabrotica virgifera
  Clone ID: LIB149-009-Q1-E1-C11
gtgagtcgtattaaagcctactgcttctatcactagtaacgcttagtgtatctgcccacgacacaggtgctggtaggcaggtgacagtacgagtagctgggaatgttc

SEQ ID NO: 3875 - DNA, 363 bp, Diabrotica virgifera
  Clone ID: LIB149-009-Q1-E1-C8
ctcgcgggtccatacaagactctatagagacgtcgtattaacgcgtccggttcgaatggagagataaaggagctgtattaagtactccaacagtaccaggaatattttgtgctaaatctgattgggcatatgcaatcttacaagaggtattcgcaaagtagtgttaaacggttcatatcttcgtagctatacaggaggaatatggttgtctgccgaatgtaatataaagtaatcctgacctttggaccgtatacttagtatgatatggcagagataatatagtcttctattggagtcctaaaaaatgggttatcagttcactgggatagggaggatttcttagagtaagtagtaatcaaaatg

SEQ ID NO: 3876 - DNA, 401 bp, Diabrotica virgifera
  Clone ID: LIB149-009-Q1-E1-C9
gggtaaacaacgttttatttgttccttaaatctcccatttttgttcctcaactctacaatttacgaacaggttatgggctcaaacgattaagtggaagattttctggtcgttcaaatcaaaacagtgtgtgttcattcgataaaaagttagttagtcggtttgttggttaacaacgtggttattaacagtatcgaaaatggcggtgaattatcttacaagtgtgccgcgtttaaccggtagagataactaccaggactggtcgttcgcggttgagaatgtctttgttctagaaggactatcaaagtgtattcagggaactgaacaagacacaacgcttgttgccaaagccaaagctaagttaatattgactttggatccatccatatatttgcatgtgaaa

SEQ ID NO: 3877 - DNA, 431 bp, Diabrotica virgifera
  Clone ID: LIB149-009-Q1-E1-D1
aataattaataattatatatttattattttcgaatttaaaagagctaaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataatattagtattaaaaaattgtatatttagtaaaaatatat

SEQ ID NO: 3878 - DNA, 393 bp, Diabrotica virgifera
  Clone ID: LIB149-009-Q1-E1-D10
ctcgttcaacctcttttaactacagccccttcaaaaataaggactttgaaccgatgaaatttgcagatcatataaataatacatacacgattcaagaaacttgtgaagtcgattaagttcatttgagacactaattgggaggtgattttcccgatttgtttgccaagaaaaaggcgactaactttattttgagagtaactttttataaagcaaaagtgaagcttttttgaacacttcgaatgagttgaaatgacttttccccgaaatgtgcttcaattttggttatttcacgtcgaagtattccatttggaatttgaagagtgtgaacctgtttttcattggctgttactctgcatctactaggtatagagacgtgctatatacacctttttt

SEQ ID NO: 3879 - DNA, 272 bp, Diabrotica virgifera
  Clone ID: LIB149-009-Q1-E1-D12
gcgtttgacaatgcaactccctaaagtgagtcgtattaaaagactgttgtgtctttgggtgtagtttatcgatggaagaacatttgctctgagttgttttgacgagaacaatcgtgatgtagattggattgttgcatagatagtatctatccatagtgtgcgtggagatattattagtgctgggcttgggcatatttatttaacgtctaccttttcatcagcttggaccttttctaatagttcaatttgggataatagttcccttattggga

SEQ ID NO: 3880 - DNA, 430 bp, Diabrotica virgifera
  Clone ID: LIB149-009-Q1-E1-D3
gacatgacttcacacttcacttgtcggccttaaaatcacttcgtattttgctatagtattaaactatcttatgttagtatatcagatattctctaccatatacagcagctctagcaaattgctactaatgtgttgctggattaacacaaaattattgggacagtttgaaacactcgcttggttgtataaggcacacatcagatcggcctccgcgtcatcatgagtgtgccacatgacttaacatcagagttaacgctcccagcggataaagattgagttttagtgattacactaagtgtgttctagcatgtagtttggtatgatttgacaccagattattgtactgcattacagcgcatgttcagtccagaaactgttgtttgacagaacgcttgtatagctgactagataccaacgtcgaatgtgatat

SEQ ID NO: 3881 - DNA, 53 bp, Diabrotica virgifera
  Clone ID: LIB149-009-Q1-E1-D4
acaagcctctatagtgagtcgtactatacgtttgaccgtctttcactcacttc

SEQ ID NO: 3882 - DNA, 440 bp, Diabrotica virgifera
  Clone ID: LIB149-009-Q1-E1-D8
tgaaagccagtcgacatctatgagaagctcctgacactcaattttaatgctggcccttataacctttcttaggacgacaagctgggaccttagaacattcctccgtcaataactgaatgacaccttgattatttctaatttccacttaattctaaagtatcttctatctatcaaaagtcattaatggcatgcaaaggacttaaaaggaaagaatctaaatattatttattgtatttgttacttattgtataggttcaaaattttaatgatatagatactttataatttataattttctatccaatccaaattcatgaagcgttcaatggatggataatttagacaaacttgaaaatatagttcaaggattgatgtcagaaaaataatatactaaataaaacacaaatagtttgaaaagtatatgaacctctccaatacgc

SEQ ID NO: 3883 - DNA, 293 bp, Diabrotica virgifera
  Clone ID: LIB149-009-Q1-E1-D9
gtttgtcaatacaacaccctaaagtgagtcgtattataatattgtaatgccagttgtccgagattctaagaatatctacagcatcgaaagacttatacaacttcacaaagtaaatctatgcagacgcgttttgctgtaatgcttgactttgaattgtttcataattaaactcacatctgtcacatatttgaaccttgtaacatgttgatgcaagtgtgttagataaatgtgcttccattttaaaactaagcgatgataagttcgatccgcccttttgtatattcaaaataacc

SEQ ID NO: 3884 - DNA, 406 bp, Diabrotica virgifera
  Clone ID: LIB149-009-Q1-E1-E1
aaagcggatgctaggatattgacgaaacatatgccacgatagtaaaaatcggcaggttgaataaaggtgatacggagcacgttttccaccagactatttaagagaggacattctgtaggacataaaaattcgctcatacccgctgatggattagaatgagccatgtaaattgactctgttatggtaagatgatcagtggatgaaatatcgaatgctgggataaagggatggatgatcataagcctgtcttaactgatgttagaaagaactaaatttataggttaacaggcgaaaaattttttagcataagatcagacggtaaagtgtataataaaatcacttttggctcagtttaatatggtgtttaattataaaattcaggtattaaagtggtgtgagcaaaatg

SEQ ID NO: 3885 - DNA, 436 bp, Diabrotica virgifera
  Clone ID: LIB149-009-Q1-E1-E3
caaaaatataattgaagaaggttttgtaacaacagatggatctgatagaaaaagttcacagagtttaaaaccatttgacattttcctgaggcaaatgtctttaaaattgaggaatgccactgaaagttttctaactgataccgaggtttttactaacttggacgatgtcgtccagtttacaagagctgtgtttagcgtcgctaacgtggattatagtaacgctgcaatattgcctatattgggagatgacctatatacagtaactcttgaggatataaatacttggactgaaaaacaatttaatgatactgttaaactaaattggattgaattcttccaacattactttgcaaacgctggtatagacataacagcagacaccaggctgctgaattattcagggttggacaaaattttatacggaatattgaacctg

SEQ ID NO: 3886 - DNA, 118 bp, Diabrotica virgifera
  Clone ID: LIB149-009-Q1-E1-E6
aaatataacaactggtccaagaaactatctggaagtaaaaaatatacgagagagatgtataatagaaccttatacaatatattaaatttcaagattgtaaatataatgtacctattct

SEQ ID NO: 3887 - DNA, 414 bp, Diabrotica virgifera
  Clone ID: LIB149-009-Q1-E1-E9
cgaaattttaaaacgacaacaaaacgcaacagtactaacagtattcaaccttatggccattattataaacaataatttgacttatcaaacaaaccgcttgactattaaggagttagtaggggaagtaacatggataaggagtgttgtagataagttgggggcttttacccatatcgaaaacgcggaaaaaggtgttagagaggctttaattacacacaacaacttaataagactagataagagaaagatgttgagactgataaagaataaagttagccaacaagtggtaaaccctaaaaaattaaagggacatgcgctcagtgattccacgatgactgaatctgtcccgtttgttatgttacagatatataccaacccagtacttcagtttttgattgatataaatataatttt

SEQ ID NO: 3888 - DNA, 402 bp, Diabrotica virgifera
  Clone ID: LIB149-009-Q1-E1-F10
acatcgaattcaacaaatacaaacagacacaaaatgaacaagtacatgattttagctgttcttcttgtaggcgctgtcctcgttcagggaaaaagcgtccaaaaagaagataaaaaagaggacagttctgaagaaaatgtcagagaactagcagaaatattgaacaaaaaattcaacactactcttcttctcgatatgatcaaaatggccgaacaaaccaaagctaaatgtcccgacttggaagaaaaacttgacgaagtttccgagaaaattgaaaaatgcgttgatgatgtcgaacttggatcagaaactttctgctcactcatcaacaagaacttggttaaatgtactaaacccgccatagacctaattgcttcttgtttaccagaagaatccaaagac

SEQ ID NO: 3889 - DNA, 403 bp, Diabrotica virgifera
  Clone ID: LIB149-009-Q1-E1-G10
atcgaaccaaaatggcaaaaatcgtcctcttcttctgcgccatcattttggcttcagcagctgctttaccaacccaatcagctgacggaggtgttgtcgacatcatcaaaaaggtcgtgcacaagcttgaagacataatggaaaaggtttttactgaaggtcccaatttcatcgacactttccctgacaagtatgacgaccgccttactaaagtgctagatgttacaagggccgtgcttactaaaatcgctcaagcacttaaagttgttatagataaagttgctgaacaaagtaatgatgctggaaagaaattggtttcctgtgtcgaacaacacgaagctgatctcgtcaatatccgcgtcgctctcgtcgaaggtgccggcaaatgcgtaaaagatagcgt

SEQ ID NO: 3890 - DNA, 358 bp, Diabrotica virgifera
  Clone ID: LIB149-009-Q1-E1-G11
atctaactcatattactaaaatcttcttcatcatcagtaccatcattttggattcaacaacagctttatcataccgtgcaacaatatgttattttgacaacatcatcatttatgtcttgcaccttctttaacacggattataaatgattaaatagatagtcactatttccgcgattcattcaccgacaaatttgacaattttattgctaaattgctatttgatacaatgttcttgcatacgaatgtctactcattctctaaatatatctaattttttaagatataaattaaatttagttactagcaatacatttataaccagagacttttatcacaatactaatctccacttttacgg

SEQ ID NO: 3891 - DNA, 433 bp, Diabrotica virgifera
  Clone ID: LIB149-009-Q1-E1-G7
cacaaagaggtgtaagtgggcggagtttaacactgaattcggttttacataaagatatgggctgtagtgccgcaaaaaatctaacagtagaacctttggatggcagtttagcaaatggacatacagaagcaagaactcttccagtctcaccgaaaaggcaaccaaatatccctccactggaagcggaagatcttcaagaagaattattagaaaatgccgctgtgaataatgttcaacaaggagatactagcacagagaattcagtcagctaaaataagaaatcaaatgaaaaaattgcacttagattccaacacagacgatgaagaagacggtgatttcctcaaggttccaaaagaagatatttcttcacgtaacaatacttacgaaataccttatgcttaaattttgttaacgataaatttaatatttatct

SEQ ID NO: 3892 - DNA, 410 bp, Diabrotica virgifera
  Clone ID: LIB149-009-Q1-E1-H12
cgtaggtattatagcatagctaacttcatggcgttcaaaatcctattttttattaaggtggattactcctctatgtcattaataccttgctgtgtatctttgctgctgttgtgactcttttccatttcttcctctccttgcacggaactttccagtttcattgctcttatgtcttcttctacgtcatccagccatcttcttttaggtattcctctacacctgggctgcagtggtgtccaattagttaccctcctcaacatatctatccattccaagcgaagatgttttatgtatcggactatattttcttctctttctcttcttcttcaatttcggcgtttgttttcattcttatttctcattctcttgttacattgtggcccagtatcgttcccattatttttctttca

SEQ ID NO: 3893 - DNA, 403 bp, Diabrotica virgifera
  Clone ID: LIB149-009-Q1-E1-H4
ctcgaatagtactcgtatccccatcgataaccattatctggtattttacatagataatatcatatacttaacaataatgatttttaaagtatttttgtttgctttgttcgtagcagtggtaatggcggtacaaactgcataagaggcatggccacaatataagaaagatttcaacaggtcgtacgacgccgctgaagatgccgaaaggttcgccatattcaaggaaaagtacaaccatatacaagatcaaaacatgcaatacgcagctggtaaatcaacatggacagcatgagtgaacgactttactgacagaaaacccgaagaacttaaacacctccatggtctcagggttcctgatggaaacgccgctggactccattaacctattactacctgaatgttt

SEQ ID NO: 3894 - DNA, 428 bp, Diabrotica virgifera
  Clone ID: LIB149-009-Q1-E1-H7
ctacttgtggcgccggcctgatgatgatctgagtggtgtggagatcgagaccggtcgtcgaagtgttgaatgattgtgaataggtctgtgtttctttacttcatttaatatggactaacatatgcaacccattcaatattttacgaaatgttctctcagtatcagtattattacatagacggtgctatcaatttttctgttattgtacctatatattcttagatttttcattaacattaccagtgttaacaaattttgttttattagttactttttagtttatttgttactctcttgtcatttttacataatttataaaataatgtattaaaaatatgaaaattgataaatttttgctgtatttactataaaacataagtttgatctgcttatctcacgcaactttagtgcaaaactatcaatcaaaa

SEQ ID NO: 3895 - DNA, 230 bp, Diabrotica virgifera
  Clone ID: LIB149-010-Q1-E1-A1
atgttaaaagactcgacatgtttgtataagtaattcttgtaaatatgtacctacatgtactatattatttctattaaatctcgtttgttttttaaaaaaaaaaaaaaaaaaaaaaaaaaaaaaaaaaaaaaaaaaaaaaaaaaaaaaaaaaaaaaaaaaaagggaaaaagaacaaaaggataaatgataaagaaagcaagaatagaacataatataaacttcaatagagt

SEQ ID NO: 3896 - DNA, 418 bp, Diabrotica virgifera
  Clone ID: LIB149-010-Q1-E1-A5
cggacgcgtgggcgattactacggtctttgtaatttttttaaaattttttcaaagcgtagaagtgagtttggagtacaggctaattatttacaaaaggatgtcgattatcggtttaatggttgtattttgattgaagattataaatatatttttttgtaatttacacgtgtgaaaatagactaatacagtactgtagctaaaattttcactcggagcgacgaccggccgcgcaacgtacacttttaataaataatgtatgctgcgtgtcagtcggttcgagtgaacatttcagctccgactctgtatcaggtaaaaattacaaaaaaagtatttttagtctttgattaaaatatgaccattgcactgatttttgacattctttgtgagtaattagtttgtaccatggactcacattta

SEQ ID NO: 3897 - DNA, 86 bp, Diabrotica virgifera
  Clone ID: LIB149-010-Q1-E1-A6
agttagattagacatttaaatattttttttattcaatgaaaaagagttagatgatacatttaaatattttaagaaacaatgaaaag

SEQ ID NO: 3898 - DNA, 329 bp, Diabrotica virgifera
  Clone ID: LIB149-010-Q1-E1-A7
aaaaaaaaaaaaaaaaaaaaaaaaaaaaaaaaaaaaaaaaaaaaaaaaaaaaaaaaaacaaaacataaatataattaaaaagtaaataaaacaattgggctgccaccctagaggttctaccacttagttttcacttacactatatcactttatcctactttaatttcctttaatttcaattcactggccctcgctttgcaatttctttacgtggaacaccttagcgttatcccactaatttccccttttaacaaaccggcctttcaccatctgggttccaaccgtttaggctcccaaaaattgccattccaaacattttaccatccttt

SEQ ID NO: 3899 - DNA, 401 bp, Diabrotica virgifera
  unsure (1)..(401): unsure at all n locations
  Clone ID: LIB149-010-Q1-E1-B1
acggacgcgtgggcggacgcgtgggcggacgcgtgggcggacgcgtgggcggacgcgtgggaaactataaaacttagtttgaactaaatgtcctgattattacacaaaaatattaacgtgttgtgatggtagagtaataatcacttgcaaataagtaccaagtgtccccaaaacaaaccctatattatggttcccaaaagtgtccttgttatggataccaaaatccctggtagtagaattagcacagggatggtgctagcttgtaccaattattaaaggtgcccttcggggcgaagtgcagaattcaacgctacgtgggaggagattctccaggctggtctccaagtgacctggcttggcatagaacggttgctcccggttgttangggagctgatggact

SEQ ID NO: 3900 - DNA, 394 bp, Diabrotica virgifera
  Clone ID: LIB149-010-Q1-E1-B11
ctcgggcgtcgacacacgcctatatatagagtcgtatgaagacttccattgttttagctattttagcttgcgtcggtttaaccgtcaccgctcccccattgaacgacgtcctgtgtgatggctgcgtaacattgacagaggtgatccaggaccacttaaaacaagacttgccattggacgaacttgtagcaatagtaggggaagggtgcagtgcattaccagatccacttgcagatatatgcaagaataaactgattccagcagtcctcagcatataccaccgatttgaggacccctcgcctgtacaaatatgcacacttatagacttatgtcatacaaattaatatgaccgtcagcatacgctcacctgtttaaaagaaatttttggacacca

SEQ ID NO: 3901 - DNA, 414 bp, Diabrotica virgifera
  Clone ID: LIB149-010-Q1-E1-B2
aaatttttataaggtctttatacctttctcataggccctgtttcttgcatactcaaggaaaactcaacggttattccaaagaacaaaaacaacatccaaattccatccaaaaaaaatccccaaaataatgctttattccataaaggttaagtaaattactttgtgacttaatttcctactgatcttcttccttccgtggctaaaatcataaaactttctatcagctggatttccttgagtatgcaagaaacaggccatataagaaaggtataaagaccttataaaaattttcagacaaaattacagaaaaaacatgagctattgacatttataagtaagtgtcattgaccttgaacaaaaaacggaaatgtaaggacatatgaaccaataagatatgtatacatattacaataa

SEQ ID NO: 3902 - DNA, 390 bp, Diabrotica virgifera
  Clone ID: LIB149-010-Q1-E1-B6
gcagaattttaaaatggcaattgaaaatctttagtttttaaaaggtaaaggtttaaaggccgcaagaaaggtgatactcgcgctatcaacctaacttaaagtagtgatttcactgacagtttttatgctacagtaatgaacaaaataaaaaattttgtcaaaaaaatccgatatttttatactgaatcattttttcgtttctctgatcatgatcgagttacacggagaaaaatgtaaatttttaagaaaatttgaaaaggcgctccattatttgatattacttttttcaaagaccatgcttattaaaccagtccaactttttgagcatggaaataacactaaaataaaaggtattgcagataaaaagcagcctttactcaatacaatttt

SEQ ID NO: 3903 - DNA, 374 bp, Diabrotica virgifera
  Clone ID: LIB149-010-Q1-E1-B7
gttttctcaggattcgaaaaaaatgaatccccatttgaatagcattgcaggcgaaaatacgtaccgatcctcttaataacattgcaatttttataagtaatttaatagatctatacagaaaaaaaacgtagaattacgtacaaaaaaaattatttacacaaaaatacgaatttacaaatacaaaaaatacaaaaacaaatagttttaagtcatcttcatcaagatcgatattatcttcgtcttctttcgaatttgcgggctattcgaatttttgaaaaaaaaattcgttttataaacatactccttcatttttgaagataaaaagtttttccacaaatgattttgtaggggttttgaagagctatcagaatatg

SEQ ID NO: 3904 - DNA, 379 bp, Diabrotica virgifera
  Clone ID: LIB149-010-Q1-E1-B8
tttatatgtatataagtatatttacatgcatgctaatagatgtaaagttgtgttttatatatcgatattggatatacattgtgatatttatcatttaatgtatcagtagactggttatatattgtcccatgtagtatcatggatcagtatttaacagtgaaagtgttatcagattcaatatttgaagatcgttatcggtatgcttttgagtgagttatcattctattacataatttgtgtggcgagcaatgtcattcgaattacaataaatctcatacgttaataggggacttatcttgaccaattaacatgctacatagtactatgtcatttaatgacattgcacataaatcaatttatggatgtgctcctgtattac

SEQ ID NO: 3905 - DNA, 454 bp, Diabrotica virgifera
  Clone ID: LIB149-010-Q1-E1-C12
aggctatgccgctaaagttgtcttacttttgggccttgcccttttcgtctcagctggtcaagaccttgacaagggcatggaaattgtgaaatgcgcccagcgagcaataagcgtaggagtacctgaattaggagttccatcacataatcccttcgtcgttattagaaacgtatcatggactggatcaatcggtgttgcaagcacccatatcgaactcaataccaataaatggtatggtcttgcggattgggatatctcagctaagcaaatcaatgacgacgaagatttcgaggctgtctttgactacaccacatactggcccagttttagaatcgtaggcaactacgaagcaaccgttaaagagcttttccttacacagcactacaaaggaacctacaacataaccatgattaaaccaaaatggactggaagaatcagcgcacaaaaagtcccc

SEQ ID NO: 3906 - DNA, 426 bp, Diabrotica virgifera
  Clone ID: LIB149-010-Q1-E1-D10
gagatatgtatacaagtatatttacaggcatgcagagagataaaaaattgtgataaatatatcaaaattggttagactttgaaatatttatcaaagatggtatcagtaaactggagatacatttatcccattacgactatatatctgaatttaacagtgcaagtgttatcagatttaatatttgaaaatcgttatcggattgctattggtagagttaccattctaatacaagatttggagggcgaacaagagcattgtaattacaactataatcttacgtatataggggacgaatcttgtccatttaaaatgctacaaagtacaatgtcatttaatgacatagcacaaaaaacaataattaaaaatgtaacctgtattacattgcgagacgatacgagatactatactttaataaagcattcaaat

SEQ ID NO: 3907 - DNA, 344 bp, Diabrotica virgifera
  Clone ID: LIB149-010-Q1-E1-D6
acggacgcgtgggatcgcgagcgccgcccttttttttttttttttttttttttttttttttttttttttttttttttttttttttttttttttttttttttttttttttttttttttttttttttttttttttttttttttttttttttttaaattttaaacccctaaataaaggaaatttttgggaaaattacaaaataaaccaaaaaaaaattaaaaaacccaaaaacggttggccctaccaaaaaagggcccgaaaaaaaaaatttggaaaaagggtaccacaaggggaaaaaattttagccaaacttgagccaggaaaaaaaataagacccccaaaaaca

SEQ ID NO: 3908 - DNA, 384 bp, Diabrotica virgifera
  unsure (1)..(384): unsure at all n locations
  Clone ID: LIB149-010-Q1-E1-D9
cccacgcgtccggtgtccgtcagcttcattccgatcagcctaaatagtttggacgacatttcaaattcacttaatattttgtataaatatgcactgtttattgagtcatatgcttgtttaaaatcgacgaaaatatagatatttaggtaggtatgtcatgtttccagactttacttgaaacttgcttaaccgtgaacagttggtcgaggttgatattccttgtccaaattctactattttctgacaaatacatcacatttttacaacgcttttatcatatttagagtttctaaatcgctgttggcatatttcaaaatttatgccgaagtactctgacagcanagtacgttatattatttaactccttcatacacttaatatgta

SEQ ID NO: 3909 - DNA, 397 bp, Diabrotica virgifera
  Clone ID: LIB149-010-Q1-E1-E1
cccacgcgtccgatttttttgagaggcttatacctcataatatgtgataatccgttcatccaagcagtgttgagccttcactgtaaatttttacctcacttatttttatgcaataagttcctatcaaagagtagtcggtcagagctatcagttatttttcgtccgctataacttttcccacgtgtagcgattcattttcaaacaaattaagtcaaaacataaagtgaaatgaacgttgatgtgtatatacattttgtatactaatatactaagcacatcggcgtacgtttcactttatgcctatatataactactatatcaattgcctaaaatactgttagcatccgtttaaatgatgtaacaaatttaacaattgaacatctaagtgaagagtcga

SEQ ID NO: 3910 - DNA, 448 bp, Diabrotica virgifera
  Clone ID: LIB149-010-Q1-E1-E10
agcccacgcgtccgtgagccagtaacagactcatcatctactgcacctacagattctccacctgagccagtaacagattcatcatctactgcacctacagattctccacctgagccagtaacagattcatcatctactgcgcctacagattctccacctgatccagtaacagattcatcatctactgcacctacagattctccacctgacccagcaactgatccatcatctactgcacctacagatactccacctgagccagtaacagattcatcatctactgcacctacatattctccacctgagccaataacagattcatcatctactgcacctacagattctccacctgagccagtaacagattcatcatctacagcacctacagattctccacctgagccagtaacagattcatcatctactgcacctaccgattccccacctg

SEQ ID NO: 3911 - DNA, 444 bp, Diabrotica virgifera
  unsure (1)..(444): unsure at all n locations
  Clone ID: LIB149-010-Q1-E1-E11
agatttcctaggcccggtttttcagcgagaggttaaaattttggttagctaacctagtttatattttaaccaatattttaaccctcctgacgtttttcagtgctttataccaagttaacaaaatctcggttagttaaccacttattttcttctgttggctgcagttattgtgcttgcgcatgtgcaattcgagaaataatgatcaatttgacagaaaaataaatagaaacaatttcataaccaaattaaaaaaaatgtttaatgcaatatcaagttcgaagtctttatttagttcattgttcataacatctacctcggtttcataacaaaagagaccattacaattactgggtgattgtaaattgtgtcttggcaggttgcagattaaattaaaaactttctacccttttctcaatgagtacacaatgggtcncaaccatctta

SEQ ID NO: 3912 - DNA, 171 bp, Diabrotica virgifera
  Clone ID: LIB149-010-Q1-E1-E12
acaactccctatagagagtcgtattaattttcagcgagatgatatacttttggttatctaacctattttagagttgaaccaatattttaaccctcctgacgtttttcagtgctttataccagctggggaaagtctcagttatttcactatttattttcttctgttgggtgc

SEQ ID NO: 3913 - DNA, 303 bp, Diabrotica virgifera
  Clone ID: LIB149-010-Q1-E1-E3
aaggtaatacatttttttaatggtgggcccaagacctatgtatatgaatcactctacatatttcagaaatattctgatgtgtatacattggtattaatgaactgctttatatgatatgttttatatttcttagataaatgagtaaaatatacatcttagtactaataaatcaccctgtatatcaaaatcaaatattttttaatattgtcaacttgagaagtagattagtatccaatatattttttctttatgtgaataaaaagtatatccaattaaaaaaaaaagaaaaaaaaaaaataaaaa

SEQ ID NO: 3914 - DNA, 421 bp, Diabrotica virgifera
  unsure (1)..(421): unsure at all n locations
  Clone ID: LIB149-010-Q1-E1-E5
gttttctttgatttgttcgtgtgttgtgcctaaaaacttcagtacaatgtcggctaccagactggagaacggtgcgggtgattatattcaaacagaattgatatcgggcatcgatttcgttaataaaaacaattctaaaggacattgcgccaatggagaaactgggttaaatgaacacactaaatacaagaatggatttaaaaagtcggtcatttccaatggacatgtcacatcatcagacgaagaaacgacaaaaaataggacaaaaaatggttacaaaacagacacatcaacagacgaaccaaaaatccgacaaatcaaagaatccttcgaaccgcctacgttgatcaccaaagcactcacccacatcagtttctacatcctcatgttcctagngatactcagccaagcgctgtttcaa

SEQ ID NO: 3915 - DNA, 386 bp, Diabrotica virgifera
  Clone ID: LIB149-010-Q1-E1-E8
aaaaaaaaaacaaaaaaaaaaaaaaaaaaaaaaaaaaaaaaaaaaaaaaaaaaaaaaaaaaagttccaaattcccaacgggcggcccaaagggttcaagccttacttacgctgcaaggcaagttaaaacccctccaaaatggccaccaaattcaattcaatgggccgtcttttaaaacgtccgtaatgggaaaaccccgggggtacccaacttaaaccccctggaacaaaaccccctttccccaaccggggtaaaaaccaaaaaggcccgaaccattgcccttcccaacaattggccaacctgaaagggcaatgggaacccccccggtaccgggcaataacccccggcggttgtggtggtaaccccaaccgtaaccgcaaaacttg

SEQ ID NO: 3916 - DNA, 71 bp, Diabrotica virgifera
  Clone ID: LIB149-010-Q1-E1-F1
cgcctctataatgagtcgtattaaaaaaaaaaaaaaaaaagaaaaatgaacaaaaaaggggacgacgctca

SEQ ID NO: 3917 - DNA, 434 bp, Diabrotica virgifera
  Clone ID: LIB149-010-Q1-E1-F11
cccacgcgtccggcgatacaattcttttttatatgcgtgtccgcgaagattataactcccaagatatttataacgaaacgatgtagttcataatagatgccgacgaaaacaattatttccctttctgtttctaccgacgaaacaattatttctgagaactttttagtaattataattttcgtggacccaaaaacaaaaatgatgttttttgcagatactcatcaaaaaataatttttttcgctaacactttattagggattataattttcataatcatataatcaaaaataatattcttcgcgacgttcattgaaagttctactcttaccggcatttttcggagttatacttttcgtatgcggcggcgaaatacttagatatttggtgtgcctacgggtggcgtttttctttgatgattaaataacttgttttt

SEQ ID NO: 3918 - DNA, 235 bp, Diabrotica virgifera
  Clone ID: LIB149-010-Q1-E1-F3
actccctatagagacgtcgtattaaaatttttagtaacgccttacgactcgctctatctattgcacaattccccattattgtgacatccaatttttgtcttacacgagaaaggattcattggtgaggcaatgagtatcagggactaggaatttcgcgtcccttcttgctcatggtcgggaattcgtacatacacctatccgagtaccaattgcctcatgccatacatctggagtg

SEQ ID NO: 3919 - DNA, 241 bp, Diabrotica virgifera
  Clone ID: LIB149-010-Q1-E1-F8
actatccttgtttcagcccttgtggctcttgcagtaactacacctttagaacagagtcgagaaattaaattcattgagaaaggcattagtggagagggaacaactacccgttattgcgagtgttggaaaccttcctgctcatggccgggaaacttcgatacgcctagcggtgtacgagttgcctcatacgagtagatctggagtgaacacggttgatgataatgcagaaccatgttgtgtt

SEQ ID NO: 3920 - DNA, 193 bp, Diabrotica virgifera
  Clone ID: LIB149-010-Q1-E1-G11
agcccacgcgtccgcaactacgaagcaaccgttaaagagcttttccttacacagcactacaaaggaacctacaacataaccatgattaaaccaaaatggactggaagaatcagcgcacaaaaagtctccactgtcttaacacctaagcccattgtagacagttttaccgtcgactggcaagttgcagatgtaa

SEQ ID NO: 3921 - DNA, 451 bp, Diabrotica virgifera
  Clone ID: LIB149-010-Q1-E1-G12
aggcaacgttccagtgcttgattttagttctcgtagctactttagcattcgatagtgtgattgcaaatgatgtagcaaaaccgtgtgagtctgattcttgtacgatcgacaacaattgtagatgttctagtcaagtgtcacctctaggtggagatctcacagagtatcctcagctgattagtttaacatttgatgaagctgttacacaacacatctacgacaacagttggattacattgctcggaaatatatataatccagatgataagccaattagtggaacattctttgtaccacatgagtatacgagctatcagagagttaatgatttgtacaactttggatttgaaattggtgtgcactcaattacgaaggattttagacaaaattactggagatatgcaactctagacacactaacaaaagaatttaaaggccaaaagcaaattat

SEQ ID NO: 3922 - DNA, 382 bp, Diabrotica virgifera
  Clone ID: LIB149-010-Q1-E1-G7
acatttttgtcgaaaagttaaaaatggcggagatattgagccaaacaggttctcctttaaaatcaagatggcggctaacgtaacggaggaattcattcgtgattttaaatttaggctactattgactcccttaaagatcataaaaataaaattttgggcagctcggcattcaaggtcaaatgctatcccgactggactaatatatacttttgagtctgatattactgcatgtaacttttttggtattgtaatatagttcaaatccttctaaccacttaaagttctgtcttttggatatctgtgggcgggttttcagccaaatcgatggtgatgtattttgggagtggaggaaagtgtgaaaaacggtattttggcgtttttt

SEQ ID NO: 3923 - DNA, 400 bp, Diabrotica virgifera
  Clone ID: LIB149-010-Q1-E1-H1
gtcaccgtccaaggagtacgtaccctccgccaatatgctgaacaagtatgagatgttatgcctcttggacaaaatttgcaatatggaaaccaaagaaactgggctcttgaccaacgtttgttgcaaacttattctccactcagacatttccaaactctgcacggacaaatccaacagcaacgtgtacttcaacaatgtttattgacccaacaacaatatttacctcaacaatatctatctggggaataccttcttgaagatcaaatgaacactaaccaaatcttgaaccacatttatagacaacaacttggacaatctccattgaaccgttatatggttaacatgagacttgtaaacggagagcaagtatacgaagttcctgaagaattcgataacgttc

SEQ ID NO: 3924 - DNA, 138 bp, Diabrotica virgifera
  Clone ID: LIB149-010-Q1-E1-H10
acacaagcctcaagaaagagtcctcaaagttttgttaataatatttttttattaatatgtaattgttttgatcgaagcttattctttgggctttactccctgagtttataagacacttaaataaatttaataacaatt

SEQ ID NO: 3925 - DNA, 472 bp, Diabrotica virgifera
  Clone ID: LIB149-010-Q1-E1-H12
acacacgcgtctgaaaagtgtcatcataatgtagaagggtttgattaatatattgtaatttaacgataatagaattgttgattcaagagagaataattaacgcaataatcatgtcgtcgagagtgttgcgagaactatgtggcgataggaagaaagaactcgccgataaaatttcggtcacagcaactgacacaccactaagtggaggagctatataaaggcagctaaatattaatcgctatgatttgcgaaatcaacagtcacactctgagagtgaagtcaaagatgacgacaatgaaacagaagcagcataatcttgtgaaggagagcatcacgagatatttagattattgatattgaagaagattaagtcaggaacacataccaatactcatagaagtagtgaagataatgctgatgtcgatgaagtagaaaaatccctgagagaagtaaataagattctaagggaaaa

SEQ ID NO: 3926 - DNA, 345 bp, Diabrotica virgifera
  Clone ID: LIB149-010-Q1-E1-H5
tcagcattaaggaatacatgatcattattaagtactttgatggcaaaattgacagcataatgaatatgtattctggtccatttaataaataattttattacaattaatttgcggctataaagtacatttactagataaacatcgatagatgactatcaagtgtacgatattgaaggtattcaatgcgttcatactcaaggatcatacaacaggtttacatagatgaataatcttagctaatacgtcatatctgttagtttttatagcaattttatgctgattttttcatatattactatcacgtccacatgtctcatagctactgtgacatcataaaggaattca

SEQ ID NO: 3927 - DNA, 418 bp, Diabrotica virgifera
  unsure (1)..(418): unsure at all n locations
  Clone ID: LIB149-010-Q1-E1-H6
cgaagatgaaggtactagttctgttttctttagtcgtactcagcgttgctctaccaacactccttggtagaaccgtaagagtcaaagaagatggaactgtatctctcttcgactctagaggataccaactcgtaatcctcaagagtgttgccgatcccagtcaagtcgaagttgttctcagaagtccaaacacaagaacccagatgttccaagttggggaaccacttagaactggagaagctatcgaccgtcgtaccctcgctggtgtttccgtttaccaaaactacaaccaagctgatattcttactgatattttccgtcagtatgaaggtattcttgacgacaccaaatactacaaccttcttaacagaattcaaatgttagttgaagctggactcatcaacganaccatctacga

SEQ ID NO: 3928 - DNA, 400 bp, Diabrotica virgifera
  unsure (1)..(400): unsure at all n locations
  Clone ID: LIB149-010-Q1-E1-H7
cccacgcgtccggttaaaatgaaagttttaatttgtggaataatctgtttattcgcattttgcggagctaatccagtaaatccatctgttcatgatgtagtgtcaagagctttagagaggattgattataataatatcattcccaaagaattgatcactagactgaggtttttaactgaagctgatatcttaggaggcagcgaaattacagtatttttaaatcaatatgcagatacaattttcaacaatttacaaaatttcataagacaacacaactggcagaatgtcgatattccagatacacacttgaagatatctggtggaagtgtggatttaactagaggtaatttanatgaccttgatacaatttccagaggcggagatgttattcctacatacg

SEQ ID NO: 3929 - DNA, 67 bp, Diabrotica virgifera
  Clone ID: LIB149-010-Q1-E1-H9
aaaaaaaaaaaaaaaaaaaaaaaaaaaaaaaaaaaaaaaaaaaaaaaaaaaaaaaaaaaaaaaaaaa

SEQ ID NO: 3930 - DNA, 262 bp, Diabrotica virgifera
  Clone ID: LIB149-011-Q1-E1-A10
acgacaaaaggaaatatggcgctttataagaggttagtagtaggtttaagaatggagttaaggaactgatagaaccaaaacatatagaaaaggccacatggattgactgtctagaaaaagcaagccctatgcagatgataaaataccagatataaccacaaatgaaaaagttaatataagtacacaaacagttatcataaaacacaattaaacaccaaaaaaaaaaaaaaaaaaaaaaaaaaaaaaagggggaaacactaga

SEQ ID NO: 3931 - DNA, 82 bp, Diabrotica virgifera
  Clone ID: LIB149-011-Q1-E1-A2
ccaggcgtccgtaaatttatgacccaaaataaaaaaaaaaaaaaaaaaaaaaaaaaaaaaaaaaaaaaaaaaaaaaaataaa

SEQ ID NO: 3932 - DNA, 322 bp, Diabrotica virgifera
  Clone ID: LIB149-011-Q1-E1-A3
ccatccagacgtccgaaaaaaaagaaagagatttgactgccttcgtaggaaaatagctttgctgcactcgcattaacaactgttctgcgtttctcatgatcggccgcattatgtttctctgcacaatcacagtggctaactgttggacgtctggctttggtaaagtcatggagatttttcagcgcatgcctgcgttaacgcagcttgacatcacggctaagcaattctgtcatcgtgcttgatcgaatctttatatagcggtcgcatatctgtgcacattttgatatcacttgcattgttcttactagagatggtataccaa

SEQ ID NO: 3933 - DNA, 401 bp, Diabrotica virgifera
  Clone ID: LIB149-011-Q1-E1-A6
agatgctagctgctaaagttgtcttgtttttgggccttgcccttttcgtctcagccggtgaagatcttgacaagggttatgaaattgtggaatgtgccaattatgtaatgagagcaggagtacccgaattgggagtaccacaacacgacccctacgtcaaactcagggacctacaatggagtggaaacctcggtgttgccaaagcccatatcgagctccatgataatagatggtatggtcttgccgactgggaaattcaagcttaccaaatcagtgctgacactgacaacgaggctgtctttgactacaccacatcatggtcaaatggatttcaactctctatgaactacaatgcaaccattaaggaacttttcctttcacagcactactcaggaaccatc

SEQ ID NO: 3934 - DNA, 396 bp, Diabrotica virgifera
  Clone ID: LIB149-011-Q1-E1-A9
ggcacgcatccaaaacctatattaattatatgacataacagcatttattggcaagcgtgatgctgtgttttaattctcaataggcgatttccgtcgttcgaaataaccacacatatagaaagttttcatctgagatgttgtgacttgccgttgacggataatctgattacaaattctatggtaattatattcgaatggaagagatcgacgtacttaacttttatatcgacgtcaatgtattttgttcaactattttgtaaggcaatgagaatcgatttaatatatatctaaatttatatgaatataagtaaatttaattattaacattcaatttctgttaaattatcagtatattaataatatttaatgtttttagggatgagcttaggcggacgc

SEQ ID NO: 3935 - DNA, 424 bp, Diabrotica virgifera
  unsure (1)..(424): unsure at all n locations
  Clone ID: LIB149-011-Q1-E1-B10
acaaccacgcgtccgcggacgcgtgggtttacagcacaatattattaacgagcagatccaacaattgatccaacaagttttgtaccaacaaactcacgtaaggcaacaaatccaagtattgattcaacaaggacaggttatcccacaggaactcgtcctctaccaaagaattacctaccaaaatgttgaaagagttcttcaagttttgattaaacaattcgtctatcaacaaacctacttcaaacagttgattcaacttttgggacaacaaagatacgccgttccccaagaattggtttcccaatacttcaccatttacagccaattacttcaattggttcaacacggagatgttgtaccccaagaattggtctaccaacanagacttatccaccaacagattgtacttatgctccaacaattg

SEQ ID NO: 3936 - DNA, 424 bp, Diabrotica virgifera
  Clone ID: LIB149-011-Q1-E1-B12
aggacgcgtgggcaatggtccaccgccgatttagacgtgtaacacagctcgaagttatcaaaaatcagtagttttggacttcctttttaatgtcctaatggtctgtgataaattggttgaaaagatagcgacgaattcgagaaaacgtaactgctaagggggaataaatctactgattgaagctgtgcgttacgaaatccattccaatgatttaattgaagattttaacacaccaatcactcgtgttttagaatctttaaccgttttttatatttgttttatatttgaacatatatttgtaaatatgtgacttatctctgaaaccgtcgattaaacacgattttgacaattttgtaatattctataaataattaggattagtttttttgtatcgttatcaaaaggaacatttcactatatatct

SEQ ID NO: 3937 - DNA, 386 bp, Diabrotica virgifera
  Clone ID: LIB149-011-Q1-E1-B3
atcaacgagtgcgaagctactgagattgaagcatattctgaagaggtcatcgagcttttggaacggtttaagattctgctggtcagggctaaagacaaggaagaaaaactacgagagcttagaactgctgcctgcgatgcttataacctattatgcacacacgaggccggtcgcatcctatgtccactctgcacgaaacgcaactgggcccaactagacaacgacctctggagactagaaaaatggttacaagtcgccgaaggtacccagaaaactcaaaagaacccaccgtctaacatacaatacctagaagatgttatccaagaacaccgagagttccttcttgacctggacagccacatgagcatcgtgacgtccttgaacat

SEQ ID NO: 3938 - DNA, 444 bp, Diabrotica virgifera
  Clone ID: LIB149-011-Q1-E1-B5
ggggccacccacacgtccgaaaatatggctaaaatagtgactgttttgtttaccattggggctgttgcagttttgtcggctgcaaaaaaaagaacctacagaatgttatcactgttcacttattgatggaacccgttgcaatgacccagatctatctaaaattacaaaacaaagttgctcagatatacccacaaacaagaatacaacctcagacgtggtatgctatactgttaccgctacctggttgggtcatccgataaccgaaagaggatgctactacacagagatggaaggagaagatgtttgttcgtatttctatagaacggaagctaatgttccctttacttacgattatacatgtaaattgtgttatgatgatctctgcaatgataagccaagataacttgtgtgatttatctgtctcactgttgtagtacttagatc

SEQ ID NO: 3939 - DNA, 429 bp, Diabrotica virgifera
  Clone ID: LIB149-011-Q1-E1-C10
aggacgcgtgggtttgaaaagaatatacacgatatccgtggtaatattttccaaatctatgtttgtcttagaacgcactcagtcgaatagaatattgtcagcatattgtcagtaagacagtgacaatcagtgacaattttaaatatttgacatggcatcgggaataaatttaagttgttggttaaataatattgatgcctatacagggtgttcagaggctctgccgacaagcgaagacgggagattttttatatagttttgagatagtttagcccaattcacctagtccgaaggtgcttcctgggggagctagggctctttgaagatggcgtcgtgtggttagtttttcttgaatgactccggaacgcttctatttggaaaaactaaaattggtaccatttcgtctgttgtggatttctagtaccggtc

SEQ ID NO: 3940 - DNA, 411 bp, Diabrotica virgifera
  Clone ID: LIB149-011-Q1-E1-C2
ccgcacacgcgaccggttgaataatatcatctccctgctttaatcgtttgaatcaaaagaccctacctatccaaaactactggaatttggtaaaaacatgctaagaaagaagtgcctgattcacattagtgagtagggtggtatttggacgtttcagttaaagagtgacacaccacgagtcaatattctcatcttttcttaacttctttgaagtcttgaaatattcagtagcattgatgtcgttttggtcatcaccttgaccagtaacatcccttttctgtcccaaaaatatgaacgaaatagtcactttaaagcctttgattgatgtggaattaactaagtcgttacagacgtacttaattttcatcttcagtccagaaatgatttatcacggtaaaatggaccacacat

SEQ ID NO: 3941 - DNA, 326 bp, Diabrotica virgifera
  Clone ID: LIB149-011-Q1-E1-C4
gtccggacaaactgaatagagttggctagcaagagatagaacaacttgacactcaaggatggatacggctcgtttgcatgcctgtcgaagaacagtagctcaaagtagataatgatgactagaaaaggtatatactaagataagaataatgttctgaaaataaataaaggagaataatttctaaagaagaacaaattaaataacactaacaaatcatgggcgccaagaaaatgatcttctatcattctcccaggtatcttacactgctgtcaaatattaaatctgtaaatgtgaacataaaggaacaataaaaataaatgatatat

SEQ ID NO: 3942 - DNA, 315 bp, Diabrotica virgifera
  Clone ID: LIB149-011-Q1-E1-C6
aactcattcatattgacccttcacccatataatgatctaatgtagccagctttaaaatgatatggccaataattaggattcacttcctgagacgacattaatggggaattggtcattcgattacatttttacttaacaatcacgggttaataatatcttgttcgagctagttcgtcttaccgtatacaaacgctattagatgctactagcttacattcctcaataatcttagtgataactgcaagagtgttgctagctacagttctatatttccgattcatacatgcatgatcagcatgttacgcattgtttcag

SEQ ID NO: 3943 - DNA, 177 bp, Diabrotica virgifera
  Clone ID: LIB149-011-Q1-E1-C8
gtccgaatgttcgctggcatgcgaggttgcccgatacagtttcagtctttaattaatttagttctttaattaatatttacatttatatgcttacacttttttaattgacgtgaataggctatacagttatctttttttataagactatattcattatcacatttttgctccaatttt

SEQ ID NO: 3944 - DNA, 251 bp, Diabrotica virgifera
  unsure (1)..(251): unsure at all n locations
  Clone ID: LIB149-011-Q1-E1-D1
agagccactgtctacggttacagatgaagaatatccaaaanacagataaatacaaataggtcacaatggttagaggagcagatgaacatattcaaaaataaaggtggaatgaactcttcatggatgacaataattagtctaagggaataaaaccgtgaggataaattacatggcccttcaagttangggttgaggagaaccggtgattcaccactcaaaaaaattaatagtacttactaataagcccaaac

SEQ ID NO: 3945 - DNA, 194 bp, Diabrotica virgifera
  Clone ID: LIB149-011-Q1-E1-D10
tgactcataatttttctgttaattctagccgctattctcactgtggccataattccaaatttatcttctctttgatcattgtaccagttttaaagcttcacataacagggttttttgcgttatttacgacttatttccgtcagctgttttccactcaaatctcagttgtatctactaacagagtgcctgatttg

SEQ ID NO: 3946 - DNA, 425 bp, Diabrotica virgifera
  Clone ID: LIB149-011-Q1-E1-D11
aacacgcgtccgcccacgcgtccggttactgtttatttacaacgagtttactagttttgacaactgaagcatttaaaaaaatgagccataataaactgttagatctgcagtcatgtgaaattaacaggaggataataaaaatcggcaattttaagcgctcgagtgtactttggtaacattatttcatgaataaaactgtattataaataatttttactaacatttgatttagatcttcatccgaataattgctaaactgtgctgttgacattgttaagttgaaaaatttgtgtcaaattaaatggaataaatgttactgcatgtatttacacatagacttgaaatttgtaattaagtattgaaaaataatatgtccaacatcatacgatagtaagaataggtttaaaaatattgctccaattttg

SEQ ID NO: 3947 - DNA, 428 bp, Diabrotica virgifera
  unsure (1)..(428): unsure at all n locations
  Clone ID: LIB149-011-Q1-E1-D7
cagacgcgtgggctaaaagttaacctcacaattttttttggaaatttatagatttaaatttaaaataatatttaggatcacttaaagatgagaaaaagccctgtattattacggcaacacattggttggcatttttataaacattgggttgtccaaggaaagcgtaaacctttggatactggtgctgaaaaaattcttaagagcaagaatatacctgtatatgattcaaaagacttcctaatcgagaagagagaatttgaaaaagtagaagtaataggttttaaggatcaacctaaaccattagatgaaacacacccagaatggaatgaaaaaccgttattatcatataaggaccatagtgtattattggaaggtcttgatcaagctagaattataacanatacagtacaactacaagaaggacttcc

SEQ ID NO: 3948 - DNA, 416 bp, Diabrotica virgifera
  unsure (1)..(416): unsure at all n locations
  Clone ID: LIB149-011-Q1-E1-D8
cccacgcgtccgcaatgttccagtgcttgattttagttctcgtagctactttagcattcgatagtgcgattgcaaatgatgtagcaaaaccgtgtgagtctgattcttgtacgatcggcaacaattgtagatgttctagtcaagcgtcacctctaggtggaaatctcacagagtatcctcagctgattagtttaacatttgatgaagctgttacacaacacatctacgacaacagttggattacattgctcggaaatatatataatccagatgataagccaattagtggaacattctttgtaccacatgagtatacgagctatcanagagttaatgatttgtacaactttggatttgaaattggtgtgcactcaattacgaaagattttagacaanattactggagatatgcaact

SEQ ID NO: 3949 - DNA, 419 bp, Diabrotica virgifera
  unsure (1)..(419): unsure at all n locations
  Clone ID: LIB149-011-Q1-E1-E10
acaaaaataactttcgtttaccgaaattgccgtgaaataaaataataattgcgcttgtgggaattgtcaggcagtagcttttaccgtctactactagatgaaaccaaaaaacaattttcgcaaaaaatggacttggcaatttgcgatttagaccgacgatttgtcacttttcttcctgatgagcgatatatcagtttaatgtgattacctcaatttccataaatttcaactagttcattcatcgtttaatctgtaatcagttctataaatagtttaattccttcaaatattaagaccataagaaactattaaatgttacattttcaactataaataaattattgtttaccaatagacaactgattactgattaacanataatcaacattgcacttatcttttaaaatgagactgatccg

SEQ ID NO: 3950 - DNA, 415 bp, Diabrotica virgifera
  Clone ID: LIB149-011-Q1-E1-E12
aacgattttttttttttttttttttttttttttttttttttttttttttttttttttttttttatttttttttttttattttttttttttatttttttttttttatttgtgggttttttttttattattattttttttatttggaaaaaaaaagaaaaaaaaaaaaaaaagggggcacaaagaaaaaaaaagagtcccaaaaaaaaaaaaaaaaggggggaaaaaaaaaaaaaaaaaaaaaagaaaaaaaggaaaaaaggggaaaaaaaggggggcaaaaaaaaaaaaaaaacaacgccaagttaaaaaaaaagagaacaaaacccttttaaaaaaaaaaagggaaaattcaaaaaaaaaaaagaagaacaaaaaggggaaaaagggggaaaaaaacgagaaaaaattcgtcccg

SEQ ID NO: 3951 - DNA, 403 bp, Diabrotica virgifera
  Clone ID: LIB149-011-Q1-E1-E3
taccgctaaagttgtcttacttttgggccttgcccttttcgtctcagctggtcaagatcttgacaagggcatggaaattgtgaaatgcgcccagcgagcaataagcgtaggagtacctgaattaggagttccatcacataatcccttcgtcgttattagaaacgtatcatggactggatcaatcggtgttgcaagcacccatatcgaactcaataccaataaatggtatggtcttgcggattgggatatctcagctaagcaaatcaatgacgacgaagatttcgaggctgtctttgactacaccacatactggcccagttttagaatcgtaggcaactacgaagcaaccgttaaagagcttttccttacacagcactacaaaggaacccctacacataccatg

SEQ ID NO: 3952 - DNA, 350 bp, Diabrotica virgifera
  Clone ID: LIB149-011-Q1-E1-E4
gtatggtgcagctgttgagggtgcatctgtctatggtgcagctgttgagggtgcatttgtgtatggtgcagctgttgttggggcgtcggtggagccgccgttgcaccagtccatcatttgccagactttgccagtgggataccagacagtgttgaatctcattttaaggaagtctccgacggtatttccgataagaccatggttgagggccgtttcactaccttctcgaatagcgatagcataaatgtctccaattattcccataccagtgattttgcattttacatctgcagcttgccagtcgacggtaaaactgtctacaatgggcttaagtgttaatacagtgggga

SEQ ID NO: 3953 - DNA, 356 bp, Diabrotica virgifera
  unsure (1)..(356): unsure at all n locations
  Clone ID: LIB149-011-Q1-E1-E6
aaaacgagcgaatgtgttaaaatattattaattaaaatatgtgtttaagaactaaaaattgtaacgtttttgataaatgtgtatggtgtattaaaatgttgttttgctactatatttgtccgaaattattcataatgatatgaagtagctacttaaaaaaaccacatacgcatagaaattgctttacttgtaagacctattacgtgaattaagattttgtaagatgaaaaataagtatgtagaaggaatttgtattacctcaggtcatttttcaacgagatatttttctttgtaaataaagtttttaatattacagctgatgaattcaataaatataattattattaattaanaaa

SEQ ID NO: 3954 - DNA, 354 bp, Diabrotica virgifera
  Clone ID: LIB149-011-Q1-E1-E7
ccgaaatcgagcgagtgtgtttgtgtattattatttatcatatgtgtttaagaactaaaaattgtaacgtttttgataaatgtgtatggtgtattaaaatgttgttttgctacgatatttgtccgaaattattcataatgatatgaggtaactacttaaaagaaccacatacgcatagaaattgctttacttgtaagacctattacctgaattaatattttgtaagatgaataataagtatgtacaacgaatttgtcttacctcaggtcatttttcaacgagatatttttctttgtaaataaaatttttaatattacacctgatgaattcaataaatacaattattactaatta

SEQ ID NO: 3955 - DNA, 435 bp, Diabrotica virgifera
  Clone ID: LIB149-011-Q1-E1-F10
acaattagcggcaaattctcattctattttcattcttttacgaaatccctaaaatcattttatggaagcgtgctttgccaactttatatcaagttagcaaagcacccaaaaaaacaaaaaaaaaattaatttagaaaattaattttttcacaactaattagcgactaattagcggcaaaaactaatcctattccgattctcctacgaacgctctaaagtcatttttcggaggtgtgctttgctaactttatatcaagttagcaaagcacctaaaaaaataaaaaaaaaagaaacgacaaaatcggtattttcacaactaattaacgactaattagcggcaaattatccacctactttcgaatcgatttgtgataggtgtttagctaacttgatgcgtgagaatgcggacgatcgtgtgttatttaatttccgtga

SEQ ID NO: 3956 - DNA, 122 bp, Diabrotica virgifera
  Clone ID: LIB149-011-Q1-E1-F12
acgagggcggctacctatgtaactatgtagatatttaacataacatccatatttaaataaaaaaataagaaatccaatttatttatattgtaaatatttatcaaataaattttcttcataat

SEQ ID NO: 3957 - DNA, 374 bp, Diabrotica virgifera
  Clone ID: LIB149-011-Q1-E1-F5
aacgaaatatatgtgtataaatagaacaacgggaagagacaggctaggacaaaatgtgacggtcaacaccttcaatttcaaagggtacaacgttttacgtatctgggggccgtaatcacagcttataacgatgttactgaagaaataaaagacagaatccaatcgggaaatcactgtctattcgcactggatgagcttataaaatcaaaaaaagttcaaagatcaaaatctataaatccattttcagacctgtactaacatgtggatgcgaaacgtggaccatgaccaaagccaacgaaaaagagctcagacgttttgaacgaaaatacttagaaaaattttcagacctcaccactacatcacgacaaaccagt

SEQ ID NO: 3958 - DNA, 214 bp, Diabrotica virgifera
  Clone ID: LIB149-011-Q1-E1-F8
ttttggtgtagcggttacttttcagtgcttgtccttacttgttttatttactgatagttagatatcattgtcttacaatactttatttttatgggatagggagccattttttgcaccgagtgtggctcgggggtttgcttatcagttttttctggattagtttcgcctctagatgacctcccttcttgtcatttataccgtttacccactgttt

SEQ ID NO: 3959 - DNA, 432 bp, Diabrotica virgifera
  Clone ID: LIB149-011-Q1-E1-F9
accgaccacgcgtccgcccacgcgtccgcaattatccagcaaccaggactaatataattggccaatataattaaaagtgcgaataaaagtacagagcgtagaaatagaggtcgctttgccgaacttgcacggtcccaattgtaattgaatcgttgagatgcttcccactccaatcctggagaacgaagaatcttatctctaatcctgcttctcgtcctatcgggaatagccccacctgttttccgtagacgaaacgccctggtaatagaacataaaaagatcaatgagaatcatgatacacaatgagaatccaatgataatgatacacaatgacttcttgttcttcctactttataaataggcccatgcctggtttacttcggtttttagcctcaattgacattgtctgaccattttttcctcggtcgtccc

SEQ ID NO: 3960 - DNA, 322 bp, Diabrotica virgifera
  Clone ID: LIB149-011-Q1-E1-G1
gtccggaatactcaatttgagactgtgaagtctatccgccattctcattgtggacaaagatgacaatttaactgcctctgctcaatgggccacttttaatgcaccatacaggaaatttgacaacgttattgaagacaaacttcgttttgctgatttccaatacaatcaccatagaatcgatgcacatactgccaaatacaaaaatggagaagaaacctactacatggctgttgacaaactcccagattgggccagcacacaattcgaagccatattggcccgtcagatggctaacaagccaccgcaatccttcagtgcagaa

SEQ ID NO: 3961 - DNA, 169 bp, Diabrotica virgifera
  Clone ID: LIB149-011-Q1-E1-G12
gagtcgtatttatttttgtttttttatttttttgttctccctttccttgttttataaattgtcttctttttttttttgtctcctcttttcttttttttcttttttcggggctttttctttcccctctcttcttcttggtgtgtttcttgtctttcttttttctattttt

SEQ ID NO: 3962 - DNA, 371 bp, Diabrotica virgifera
  Clone ID: LIB149-011-Q1-E1-G3
cccaggcgtccgaaaacacgaaagacttttcatcgcatttggctttggcttgtgccgttgtggcaatgccatctattgagtatcttaattcatgtgaatttgcacaacagtttgagacggaggagcatcatagagattttataggcgatattatgaacagtgagcaacatggggccatttctaagatgtctgatcccatgacatttgctgatatacacatggaccagttctctgatgcactgtccggtaccaatgatagtaaagacattggtaacgctgggatacacgagatagtatccaccgccgtatcaaccaatctcatcacgcatcatctgaacatatcagttttggatcctgatcttactatcaac

SEQ ID NO: 3963 - DNA, 375 bp, Diabrotica virgifera
  Clone ID: LIB149-011-Q1-E1-G4
ccgtacacgctaatgaaggaatatgtaccaatttctggtgtaacttttatctgttgataattcattaagctcgcgcttggagatttcacatcaattttggaagatggtatgttctgtaccgtgtagtgtatcgctggtaccggttccctcaggataatgatgtgcttacttgtttagctttttccctggattacaatttttctagctgccagcctcctcatggggaattcattgtcccatcatgttacacgcatgattatatgtcaagacttataggtattatgatgctattacctgtggattggacttcctatgcatcaatatatgatatttctataatacccgatatttctatggaccatctccacgcctgtg

SEQ ID NO: 3964 - DNA, 420 bp, Diabrotica virgifera
  Clone ID: LIB149-011-Q1-E1-G5
gagaaaagtgcgatacaccctacgacggtaaaaataaacataagtgcaagaaaacaccactatgcacgatttgtaaacaagctgagcatgacttgtcaactaaaaacaaagttctttgcgaagcttgtaatcgtttctgttttaatacagaatgctttgataaccacacagaagtttgtaaagaagtttttaaatgtccaagttgtaataaaacttgtaaaagagaacatcgtcatgagtgtggctactctgtgtgcaaaaactgtaaaacgtttgtagaaatagctacccatcagtgctacatggtcaaaaaacccgccaaaggaggattttgtaccgtatcctgtttatgtaataagaaaaccataactgttaataaaggttgtcaaatacacactaaatcacaaacaatatgcaatg

SEQ ID NO: 3965 - DNA, 425 bp, Diabrotica virgifera
  Clone ID: LIB149-011-Q1-E1-G7
agattcttaagcatttttgatgtgtgtgttttaatttcacttcttaaaatatacattaataaaaataattgtataaattcaaaacgtcagaaaattcatatttgattattgactagaatttttcacaaaatgcgtcagacaggtgttttatgaaagacaattttacaattgaaatataaacgtgaaaataagacaagttacaagttagtaccaacttaatcgatggtattttagtaaacttgttaaattgttttacctattttgacatattatttataaacgtaaagcaaattatcgtttttttattgttaaaaaaattgttttgaattcatcgttttggctatatagtttgttattgatcacgttagacggagttagtaggaaaaaagaaacaaattgtatagcccaatggctggtgtgacttt

SEQ ID NO: 3966 - DNA, 425 bp, Diabrotica virgifera
  Clone ID: LIB149-011-Q1-E1-G9
accacgcgtccgcgtgagatcattttttgattttttaattatgtttattagtgcctctgaggcttttagttttgattcaagtactgaaagtagtggtaatagtgacgaagcaatgcctgctataatgagtagtacatcgaattcgttgttaagtagtaaacgttccgccagtagcgcgtccgaggccgattgctacaacatgtctctgggagccgggcctctgtggtggtcctgatgcccctggggaaaccaggggcaattcgccgcccccgctgcggctgactttccgcaccgcccgccatccctgggaggcagtacttaagggacgcacgctctacgtcgcccttcccccgcaagtacttcccgagggatctcgcgaggcgttcgtcgcgctgctcgaggccgccgaggagcaacttaaatgc

SEQ ID NO: 3967 - DNA, 283 bp, Diabrotica virgifera
  Clone ID: LIB149-011-Q1-E1-H1
gcgtccggacccacgcatccgcccacgcgtccgataaaaaaaaaaaaaaatcgaaaataaaaaaaaaaaaaaaaaatataaaaattaaaataaaaaagatcaaacttaatatggaggtcgatctgagtgcggtaaatttctgtactcttgcatgaaagttctgaaaggggtggacgttgtaagggtttttcctttcattggccttggttgaaaactcatgctctttggaatatccccctcgttttacattcaatgcgccttttttgatatcctcctttcgggg

SEQ ID NO: 3968 - DNA, 381 bp, Diabrotica virgifera
  Clone ID: LIB149-011-Q1-E1-H12
acgggtttaggagagacgcgacctcaagaattacccattttttagggtgtcctatgacgcgcagtgtagataaccgtccatcttcctatttcagttatttacctaatatattctagtcagtcataatggtcctttaattgaccagttatacctagatacttgcattcttccacttcaacaaagcagtaaatactctgcttccattatctatatcttttcatgtttagagtttatattagctttaagtaataatcaattggtttaaatagtctcagtaagctgttgctcgttcttgtgatcaaagctacatcatggccttagtcggtgaagtaactcaacttctgttatcgtagatcgtcctttgtatcctgattttactta

SEQ ID NO: 3969 - DNA, 391 bp, Diabrotica virgifera
  unsure (1)..(391): unsure at all n locations
  Clone ID: LIB149-011-Q1-E1-H2
cgtccgtactgctaaagaataaggctataacatattaaaaaaatcacttcaatcggacaacaggtttaggaaattcaagacatcaaaaatgacccgtttttaaggtggtgcgttaattttttggagcagtgtatatcaccaacacaaagagtaacaaaagaccagtcgattgataaaacaaatgaccaatttaatttacctacagaaaaaactgcttttatatatgtgcttttgttttgcatacattttactgtaaatatttctttgttcaatgcctcggtagacagtatatcgttattaaatatttcgttattttgtttacacgttatctatagccgatattatctgcattaatgtatctcgttaataatacttttaagtantagccgca

SEQ ID NO: 3970 - DNA, 414 bp, Diabrotica virgifera
  Clone ID: LIB149-011-Q1-E1-H5
cgggtccacccacacgtccgaacccatactcctccttgcgagcatcaattggcaacgtgtgctgatatgatctcaccaactgtatcatgcgactcttaagaatgcattatatatccacctgcagtttacttcgtctattcattttacacgaatggctttaatgattacttcaaatggggtattgctgaacgcttcctccatgccgagaaaggttcccagcatcatcccattgtttgtcaggtggcaggtgtcaggacatacttcaccctctgtcctctgtactagatgaagtgctatttctgttgatacttctgatctatatgcatatttgtcttggtgcatcggtctttcaactagtattcagcctctaatatgtctgccgatcagttttaatgtcttcagtacgagacacat

SEQ ID NO: 3971 - DNA, 412 bp, Diabrotica virgifera
  unsure (1)..(412): unsure at all n locations
  Clone ID: LIB149-011-Q1-E1-H8
aagcaactctgttaaaaaaacaaaatacacgatgagatgaaattattatttataaacatttatttcaagttttttgtttgttacggtttgttgagtatttgttatactgaattgtatttaaaaaatttgattattcttttagtagctttcatgagtgttgagggactgtttattcacggcaatgttatacattgtactttatagtataggggcttatttaatatttaatctggtcttcaaaatttacgtgaagttaaatactatgtcgtgtaagaataaggtgtgtcttgtanggaaaactgttatagtcacaggagccaacacaggtatangatttgaaacagctttagattgtgctaaacggngggcaagagtaattttagcatgtanggatcatcttaaaggaactgta

SEQ ID NO: 3972 - DNA, 426 bp, Diabrotica virgifera
  unsure (1)..(426): unsure at all n locations
  Clone ID: LIB149-011-Q1-E1-H9
aaccaaataactatggctacgcaaagagacgcaggcgtctttaaacctcaaaaacttctaacaccacctccaccggagactccaccggcgacaagtagaagtccattcagagttgtagatgatttacccgtaaagaaatttgttgaacgtaaacatttacgtacagatcgatttgaatatgagaggaaaggagatgatcctggatacataataatttttaatcaagaaacattctacgataaagaattgggtacaaggagaggaactagaagagatgttaacgagctaactacatgcttacagaggttaggatttaatattgataaagaaaatatattaacggataagacaactgaagaagttgagcaagtattggagaaagcttcccagatagactttacanattataattgcctaatactgttt

SEQ ID NO: 3973 - DNA, 256 bp, Diabrotica virgifera
  unsure (1)..(256): unsure at all n locations
  Clone ID: LIB149-012-Q1-E1-A3
acgcgtccggaaaanntcnnnntgnggctgttcntcattgctgctggcttcattcaggtcgcacatgccaatctatctgctttcggacactgtagcagttttatggtatcacctaatcaatcgtattatgttcttgatgaagatctttctctcgggtttttcgaatagaaccttcgcaaaatcgtttcacattctacgtagtatgacttctgttagtatttctactatctctccgttaatcactttgccgattggt

SEQ ID NO: 3974 - DNA, 448 bp, Diabrotica virgifera
  unsure (1)..(448): unsure at all n locations
  Clone ID: LIB149-012-Q1-E1-A4
aatgtcaattaccattttttaaaaccatttgataaatttcgcttctggtgatcatatccttttaacctttcccacccccccacaacctttttgttttgctcaagaaaacctaggtttctacgacgtgggatttttgtgcacttcaatacaaaaacatatgtcatttttatgtcttcccattggtcaatttactgcgatgtttgagtagaccacaaaattgccgtaaggtancatgaggtcaactgaagcaagcaggataatatttttgctactattcctttaaatcgtttattcactcagatcacaactcatggaatttcctttgaaactggttagtatgtttttagttatgttttcttttactttttaattaatagaatactttaagaagacatatacatgttcgaatttgaaatcgtgttggatctataagacganacactcaaat

SEQ ID NO: 3975 - DNA, 335 bp, Diabrotica virgifera
  Clone ID: LIB149-012-Q1-E1-A5
gtacgcgtccggaaactctcacgagtcacatctgttaatgtttgtggacgcactaattggaccgttcgaaggtaatctcgacaacacatattttattgctggctactctggagggtcggcatcataccctacggtctgcacatccctacgtaagaactgtatctttatgttgaagtccataccatgctttattgttggagtgtccacatccagagtttgataaacatagtcacgctatttttccacttggatggtatatgtatcttcacaggttatttaattgaggagatttgtccttctattcaccttatggtagtaccccatgttaatcatga

SEQ ID NO: 3976 - DNA, 442 bp, Diabrotica virgifera
  unsure (1)..(442): unsure at all n locations
  Clone ID: LIB149-012-Q1-E1-B3
cacgcgtccngaaaagggtcctaagtgtagcataaatggttgaaaagcgtaaaatgcgaatacttgtttttgtatggttttttcgcaattattgctgttttgcaacaggggtgactattttttgaatttttgaccaattctataatgtgtgaaatttagttacgcaacttctatgtcggtacaacttttctcagaaatgaatagttttaaagttataatcaaaagaccaaggaaaaaatcgaaattttccttcagtttttgacattttgattaattaggcaatgttcccggacctttttgagtgggatgattaactcaataattgtaatttgagttgttttcatgcaatttctgcaaaaaaatttgagtcacctcaacgtccaaatgtactaatatttttacagatgcgccctggtctataagagcgatattgccaaaacaa

SEQ ID NO: 3977 - DNA, 399 bp, Diabrotica virgifera
  Clone ID: LIB149-012-Q1-E1-C12
attaacttcatatttgtaaacatatagcttaaaatgggttccaaagcttcttttgattgcgtattgatgttgttggttgttgtatccaatgcgtatgatgcaacatattgtccttcaaatacaagtcgcaaatcaaatcttgtttacgacagtcatttgacatgagtgtctatcaatgttcgtattccacaggcaggatattttaacagacccataacctggcttcaactaattgatcgacagggaacctctgtttctccaaggatactgtaaggcggatatctcgatacatacatggtaatcaatattacatcaataaatggccacatactttactactatgcacaaatatacattgattaatttaatttatttagttgaataatatttatgtcaaac

SEQ ID NO: 3978 - DNA, 436 bp, Diabrotica virgifera
  unsure (1)..(436): unsure at all n locations
  Clone ID: LIB149-012-Q1-E1-D1
ccggaaccccacgcgtccgccaacgcgtccgaccacgcgtccgcggtcgcgtgggcggtcacgtgggcgtccgtcattggttttgtgggtgcgtctgtctgtttcctgcntgtgttttattattttgtgtttcctgtgtccagggattatgtactaatcgttatttaggtagtacttccggacttaaccgagcttatttattgaattctataatgtaatgtcgatatcttagataattttgttgtgatgtcacgggagtcgcatctgaatatcgcgaattttttaagagatatcactggctttaattatctacatctacgattaatcctacatattcgtagatgcttccaacgatgtaattgttaggatcagactcttggatacattttattacaactaagattgcaaatccaagctgcgcatatgacatttcata

SEQ ID NO: 3979 - DNA, 364 bp, Diabrotica virgifera
  Clone ID: LIB149-012-Q1-E1-D10
gggctgactcgtgggcggacgcttttgcggactcctgtgcaatctggcctcaaaatctactaatgtttccttgaaaaaaacattaattttatacaatctgcttggggatacattttgtttcttaaacttaacggtcgttgttatcatatgatttgtatattaaatgtgaattttaaatgactaatgttatttcgttttgagaaaagttatttaacatttatcacaaatagtaattaaagcgtatcactatattatatgcatttaatatttcaataatgaactgtgagttgcctacatttgaccccactgaaatgaataacctacatactttattttaaaacctcttaaatacattttttttaat

SEQ ID NO: 3980 - DNA, 340 bp, Diabrotica virgifera
  Clone ID: LIB149-012-Q1-E1-D5
ccaagcgtccggaaagatgcgatggactctctgccgaagcacaatatgctgacaacggcagtgatgatcgctgcttcattgttgagaacacatcactctcgtcaacaaatggctacgtagaacttgtcccaactgatgatgcaatcgtgtgcgcagttgctagggtaggtcgagttgtcaccgctgtgtacgctgaaagatgtgaattacacagaagtggagatttccacaactaacgctgttgaaccaaactcaatcagcgagttcgtgctgtaggatagaccttcgatgcaatcattgtcaagaagtcatggggaactagctgaggtgatacacgtta

SEQ ID NO: 3981 - DNA, 129 bp, Diabrotica virgifera
  Clone ID: LIB149-012-Q1-E1-E1
taggccttcatcactgacgctatctaggaacacatggaatgtttatcgggcttcatgcatatacgccgtttgcattgggtatagatcatgagcaagttctacacatgcgtggggtacatttttgtccat

SEQ ID NO: 3982 - DNA, 428 bp, Diabrotica virgifera
  unsure (1)..(428): unsure at all n locations
  Clone ID: LIB149-012-Q1-E1-E2
ccccaaaaaattgcctccaggaaattattaccaattaattaattaatttaaaccagttctaagcctacacattacgaccagttgggaacttggttagtaaaagtaaaaattgatgatcaagtacataaattgaaaatagatacaatcaaaagtcgttacttgggccatgataacatgagttacgtgtggaaggaatgtgtgcatcgatttataatagatggaagagattgctttactttacgtcatacctgtaatccaatagttacttctcggtaggtttatgcctggttgcaccaacagatcttaagcttaagacgtgctttaagctcagcttacgnaacatacgcgttgaaccagtgagtcttacatcaattttcagcttaacacaatggattgccatgtggatttcttagataagtatcgaaaat

SEQ ID NO: 3983 - DNA, 449 bp, Diabrotica virgifera
  Clone ID: LIB149-012-Q1-E1-E3
acacaaattaattcaatttaaatttaaggtatcgatttctagatttaacataagctgtatttcataatatactaatgttttatttgttttttaccatcatcagcatcagtacaaaatttgaaaataaaaaattatagaattatttcatattttcacaagtggatatacatcgtagcagaaaaagaaatgaatccctccaattggctgtataccacaataaaaattactcaagaagtaaaaaatcttcctttgtagattgcatataattttattaaaaaaataattacacttcttaagggggtattagtacgctatagttaaaacgtgtgagagttaaacgaactaacgtttaacaattctttgagtagatggcagcacctgcgtcatattttattattttattattcacgaaattttattctctaaaaccgacattgatgcaaattttc

SEQ ID NO: 3984 - DNA, 317 bp, Diabrotica virgifera
  Clone ID: LIB149-012-Q1-E1-E7
gacagccatgtggcagaaatcaaaatttatgctcgatctttataccacctccgcgttttcttccaaaaacaccggatgctgataaggaccagtattgtttcattaatttaaaacagatggatgggtgcactgtcaagttcagagaattcaattcgattatggtttagcgatacggtgacaataaatttgaattattgtcacatttatcaagaaagtgtacttaatttataaacagtctgtgataatatagagctgaatatctagaccagttattaacatgacgattaagaatatttgttgccttggcgctggttacg

SEQ ID NO: 3985 - DNA, 360 bp, Diabrotica virgifera
  Clone ID: LIB149-012-Q1-E1-F5
caaacgtccgtaatacacattgtaagtgattgtttacaatgcttgtcatattgtcgaatttactgtccatatgtacaattgtgagaacagagtcactttcaaggctaaacattcaagtctttgtaacctagtatatcaggactatgattccatattttccaagatatccttctcgaattcaagtagcataacgcatgatactctataggatacgtgggatggttcaagggggtcactagattcgccgattggactcatgtataattcgatgctctattaaaacgccaatctgcttcaaaacccaaacttgacaagagtttgggaatgtatactgccgatccaaacgttaaagtgccttcg

SEQ ID NO: 3986 - DNA, 477 bp, Diabrotica virgifera
  Clone ID: LIB149-012-Q1-E1-F6
ggtccgaaacctccggggccacccaagcgtccgaaattacttacgatagtaatgtatttttgactcaaagtagtgaatggttttatttcatgatagttaattagtattgtgagagaatatttcatttgtataatagaaaaatttattttttgtaccctgtgtatcacggattactaattaatacttatatacttatgatttgcgaatttaggctagctaaattattaaaagttttattgtaaggtaaacatgttaaataatttttttgtagtgaaatgttatgcgtctctacatatatctagttttgtaagaaataaattaaacttatttattaacagtatatttataattaactatttttatattattactattaaatatttttagggatgagcttaccaagaaggttttagtagaatttaatttttaaacaaaaagtaggactaaaaattttcatattttaagatatgttaatag

SEQ ID NO: 3987 - DNA, 469 bp, Diabrotica virgifera
  Clone ID: LIB149-012-Q1-E1-F8
ggggccacccaagcgtccgcatcgttccgtaccaccattattgctaaagccatctcatgacatatttaccataaatattgaaaaagtcatgtgaaaaaatgcatccttgtctaacctctctctctctctgctctgcagatttttaatgtctgtaggtgtatcggtgcaccctgctgaaatggaccaaagatttattcagctgacacaatcaaatgccttcttatggtcaacaaagcatattgtcatacgtacttatataggtaactgagcgctctgtgccgtaatttgaaatttgctagcgcgcacagtatgttcaggtctattcctattctggttcaactggtaacgctgtgaattatgttggagcaggaaaaacagaactgattatcaatcaacgtacgattcacttttaagtggcgcgttgtggtaccggtgttgccaagttgtttaatttttaagtaattaatgc

SEQ ID NO: 3988 - DNA, 343 bp, Diabrotica virgifera
  Clone ID: LIB149-012-Q1-E1-G11
atcaacagttgtgacgaaatttggacacactgtatatttttgcatttatttatattttattgtatgccaaaataatggtttactattttgccacacaatgaaatataaataaatgcaaaaatttacgccagttatcacgcaattatggatacatacagttttgcatatatttatttagatttcattgtatgcaaaaaatggctattatttcatagaataatagaatgattaataaatttgattgaactaataataattgtatactctgtgttaacatgtttacctgtaattgattaatataatcagtaaataaaagcagccttaaacaagaaagctatatcac

SEQ ID NO: 3989 - DNA, 490 bp, Diabrotica virgifera
  Clone ID: LIB149-012-Q1-E1-G6
ggtccgaacactccggggccccccaagcgtccgcccacgcgtccgattcaatgacattaaagaacgaagcgcgagccctcccaagcgcattatagactccccgtctcccacaagggagcagaaggcgcgacaggcagtagccgaagctacggcctctgcgggggcccagaagtggaaaatgcaaattgccggcagttcgggcaattccaggttcaaaaagaagcccgaaagagcgcctcctgcttctgattggcagtctgatagagacatacgagagcgggagcgagaacgcgatagagagagggaaagagagagagaacgtgctaagagctcttctgcctctgacgattctccaccaccgaaaaaaatgtctttgcctccacttcctccagctgagaaggccgttagtgtgcgcaaggccatggcattgaaagaaccgccactcaaaaagcctgagtctcccaaaaagttaaaactgactccagctcca

SEQ ID NO: 3990 - DNA, 101 bp, Diabrotica virgifera
  Clone ID: LIB149-012-Q1-E1-G7
ggtccgcacctcccggggtcacccaagcgtccgaaaaaaaaaaaaaaaaaaaaaaaaaaaaaaaaaaaaacaaaaaaaaaaaaaaaaaaaattatagacac

SEQ ID NO: 3991 - DNA, 219 bp, Diabrotica virgifera
  Clone ID: LIB149-012-Q1-E1-H12
aacgaggtttacgtgaacactttcgataagtcagtctcgggattaagggtactggccaactatccactgtgtactatttactcactggtgcattgctgatcaataggtggttgacagattcgtagccaggaacttgtttccattagtcgtttcgtagttagcagctgtcatataatacgtgcccatcacgaaatacgcatgggtccttatattggtgct

SEQ ID NO: 3992 - DNA, 336 bp, Diabrotica virgifera
  Clone ID: LIB149-012-Q1-E1-H2
aacctgttttagcttgcgtcggtttaaccgtcagcgctcccccaaagaacgacgtcctgtgtgatggctgcgtagcattgacacaagtgatccaggaccacttagaacaagacttgccattggacgaacttgaagaaatagtaagggaagggtgcagtgcattaccagatccacttgcagatatatgcaagaataaactgattccagcagtctacaacatataccaccgatttgaggacgcctcgcctgtagaaatatgcacagttttagacttatgtgagacaaattaatatgaaagtcagaataaactcaaaagtttaaaataaatttttgaac

SEQ ID NO: 3993 - DNA, 357 bp, Diabrotica virgifera
  Clone ID: LIB149-012-Q1-E1-H5
ccatcgcgtccgatttttatctgggattattagttttactttatatcgtatgcatatattgttaagattattatgtttataatttattgtcattgctttatatattcaatttttttattatattaagaaatatatattatgaagaattattttctacaatttttttaacaataagagtttgtgaaggttctttatggttagcaattttacatataatagttcgtgttaatggtaatgattatatattaacattttcatctttaagatatgatttatatttatataaatttttttgattcctttatgttttagatgaaatttttgattaaatcaatgtgtaggatttgtttttacatt

SEQ ID NO: 3994 - DNA, 459 bp, Diabrotica virgifera
  Clone ID: LIB149-012-Q1-E1-H6
gcgtccgcataaacttgacaatgtagctaaaccgccatatcccaacgaaatgccagagagtaccagaaggctggcatcttattttaaactttcctctttcgtttatgagctgtggtataaactttggattgttttatgaaaatcacaaataactttatcaaaaagatcaattttattattagttccatgtttctcaccattcgggcagcttgagaatatttgttccaaactgccccaccatggggcacattgggaaaatgatgtatgtaattttatttcaatttttttcataaactatttaaaaatttatacctatttcacaaaaaataatatcgtttaacctcatactaactatttccatgtttactggacttgttaataaaaccaattccaaaatataagctcccgaaaaaaagtgttcaaactaccccaacctcccctatacatatgcccgccaat

SEQ ID NO: 3995 - DNA, 449 bp, Diabrotica virgifera
  Clone ID: LIB149-012-Q1-E1-H7
ccaacgcgtccgattctttacttgtttctcctcttaatgtcaaacctaaaataggcattccgacatactgtaatgtagtttaactggattaccaaagccactgttttcagatttaccggtaaataataataatacttactcttacgatattatggagaatgatttgcgttcagctgagcctgtagtatttatgccaacgaccatcgagaaaccaagaaggcttgctgataagctagaagttttaaagcaactcacgttttataaatcgcttttgacagtgttgactacgaaattttctatgttcatattttatactttatttccattgtatgtttaccaagaagtggaacgtttaactttaagagaaatgtcagtgatggttggactgctttcgattagtggtttactgttcactggagtctcccattggatcaatatcgacaaaaaga

SEQ ID NO: 3996 - DNA, 298 bp, Diabrotica virgifera
  Clone ID: LIB149-012-Q1-E1-H9
attaacaatatctttattttgaaatgtaacatatacctatgtgaaaacaggatgtgaagcatccctgtatattttttttataaaagacggttaaacttgggggcatgtagcttttttctttttgatatgaattttacaaatatgcacaaatgccagttaacatcttggccagacttaactttttcaaactttgtatctttggaattcaggtattttttcagatatttagattgacctcaatttttttagagtatgtgtacagtagtaaattatatttttaaataaaattgattccatt

SEQ ID NO: 3997 - DNA, 408 bp, Diabrotica virgifera
  Clone ID: LIB149-013-Q1-E1-A11
atatgctgatcaagaatatgtacttagtttttctccttttctgtcaggtttttaggaaaagtgtgttcgaaatttttcacagaaactgacaaaaatactaacaaaatatttattgaaactacagagtgtaacaaaaaggcatgccataaactaaatcacatattcttggaccaaaaatagttcgattgaacctaacttaccttagtacaagtgtgcacataaaaaaaattgcaaccgttgaagtcacagaatgaaaatcgattttttccaatatatcgaaaactattatattttttattgaaaatgtacacgtggcattcttatggcaggaagatcttataaaaaaagaacagtgaaatttgtgaaccccataaacattttataaatgtttttgttccctgcaacccc

SEQ ID NO: 3998 - DNA, 110 bp, Diabrotica virgifera
  Clone ID: LIB149-013-Q1-E1-A6
cccacacgtccgaaaaaaaaaaaaaaaaagaaaaaaaaaaaaaaaaaaaaaaaaaaaaaaaaaaaaaaaaaaaacaaaaacggacacgtggaccgcttccatatgccaat

SEQ ID NO: 3999 - DNA, 409 bp, Diabrotica virgifera
  Clone ID: LIB149-013-Q1-E1-A7
aaacagagaaaattgagaaaaaggaaaagaaaaataatataataataaagggaatacatattaaagaaatttaaccagaacatataaacaaggagatcgaaggctacataaacaagtatctgaacatcaatagtaaaataacagcagtaaccaaaataaacaatgaagtttgcagagtacagctagacaatacccaatagaaacgaaaaatactagcaaataaaaataaactaagaagaataagcgaagctaggatttatatcgatgaagatttgactttgaacgaaagatacatacgacagatcaaacacagggcccccgctaccatatgtgcaaagtgtgcaatgcacacgggcgccatcctttataggcgccaaaacccagggtcacaaattgaaaaataatttgc

SEQ ID NO: 4000 - DNA, 417 bp, Diabrotica virgifera
  Clone ID: LIB149-013-Q1-E1-A8
aacacgcgtccggccacgcgtccgcacacgcgtccgtttttatttattttaaaataatacaatattttttagtaaaagtaaagaaaaagtttatttaatgatagttaattaggattgtgagagaatattttatttttagacacgaaagagttaatttttgtatcatgtgtatcagggattattaattaataattatatatttatgattttcgaatttaaaagagctaacaaattacaatgtctattgtaaaataaatattttaaatactttttttgtaatgaactgttattcgttttgaaatatatccaaatttttaagaaatatgtttcatttatttattaacaatatatttataattaaatatttttatattattaatattcaatatttttagggatgagcttaaaaataaaatt

SEQ ID NO: 4001 - DNA, 388 bp, Diabrotica virgifera
  Clone ID: LIB149-013-Q1-E1-A9
gagacatgagatgacatctaacgacaatagtactgatcgtcctcatcttctgcgccatcattttggcttcagcagctgctttaccaacccaatcagctgacggaggtgttgtcgacatcatcaaaaaggtcgtgcacaagcttgaagacataatggaaaaggtttttactgaaggtcccaatttcatcgacactttccctgacaagtatgacgaccgccttactaaagtgctagatgttacaagggccgtgcttactaaaatcgctcaagcacttaaagttgttatagataaagttgctgaacaaagtaatgatgctggaaagaaattggtttcctgtgtcgaacaacacgaagctgatctcgtcaatatccgcgtcgctctcgtcca

SEQ ID NO: 4002 - DNA, 437 bp, Diabrotica virgifera
  unsure (1)..(437): unsure at all n locations
  Clone ID: LIB149-013-Q1-E1-B1
tccgaacctgtggaggnaaaacttctgtcggggtttctgttgagtgaaggtccgcattgggatgataaaaaacaatgtttatattttgtggatatattanaaagtacatcaatagatacgtacccagtactaaagaacatacttgggcaaagcttgatgatcataacgtctccctaataataccggtgaaagatagagaaaacattttcttgtagctttagacagatctgtctgtttggtaaattgggacggtcaaagcaagcaagtcaccaagattgagagacttgttgaagtagaagaaggtacagaacatgtattgaacgatgggaaatgtgattacactggaagattatggataggcaccatgggagcagctgcgaaagcattacaaaatctgcaagacggacaaggagcattttanagtanatctaataaaa

SEQ ID NO: 4003 - DNA, 356 bp, Diabrotica virgifera
  Clone ID: LIB149-013-Q1-E1-B12
accacacttccgtccacgcctacggtgactgctgtaaactatgcttgggctctactacggtaatgtttacttcgtccacagtatgactaatatcacgtgatatagatctagaatcatttgctatgcagcttatcaagttttgtatggccagtagtgtagacatgactatgtacatcataaggacgcatgactctcgatattgacgattgagtagaatctatacgggaacgtatagtggcatgcaattctaacaagtcctcaagatgatcgacaacacagataggctccagacaaattcttcctacctatcatgtaaattagctatagtaatattgcatcaagtgcatttgtggcac

SEQ ID NO: 4004 - DNA, 428 bp, Diabrotica virgifera
  Clone ID: LIB149-013-Q1-E1-B5
attttcctgattttaatgcgtcttatcgggttctctagctgtggttcttttccagctattctctagtctactggcataagatatatcgtgctgtttgttgtcacggcatataagtcggtgttactttcaaggctcttctttttcttccagttccacgaccgttatcgatagttggatataatgttggctaccaaattcgctacagtgcctttttggacagtagctctgaacaatgatgtcgattttccgtaccattgcctttttgaatttttgagccatgatgttctgcttctaccagaaccacgtttaccttggatcttagcgtgaccgaagtattctagcttgcgtctctttattatattgaccagttgtgttgtttcaatgctcaccaatagattttagcgtatctttaccgattcaatgatacg

SEQ ID NO: 4005 - DNA, 428 bp, Diabrotica virgifera
  unsure (1)..(428): unsure at all n locations
  Clone ID: LIB149-013-Q1-E1-B8
aaagaatcgataagtgttagaaaatattggaacaattaaatacttgcgaaatgacataaagcagggactttatttattaaaatcgatataactgtccaagtagagtaaatatttaacaaaacatttgaaaattccgccatgaagacgttttggaacaccccctataagtaaaagctgtacacggtaaagtttagtaaagacactccatcaacataacctacattctaagaatgacagcgcgatgttgccattactcttagcttgtgtctaaactacacatttatcggtacttgtttatattttgtttaatccgatggtcctaactattataaagggctttagtataattttatatctatctatctatccattatgatttttataaatatgttaatgttggtgatcaggattgcanggtgagtgttgca

SEQ ID NO: 4006 - DNA, 311 bp, Diabrotica virgifera
  Clone ID: LIB149-013-Q1-E1-B9
aggactctcgggtggcaatagccactctattttaatagtagatgaatctttcgggaacttgtccatcaaaaaggttatggggataaaatagctaccctgttcagtttatcgttatgggtgaatacgcataattccgatggataaagaagataactttcaggcacttcaatgtgcgtgaagtggctttacatgatggtgtcgcaaagccgatggatcaacacaagcaacgcatgcagtgccatgggacaaagggttttagatagggattgatacatacaccaatggtcctagcgttggaacttgatttagca

SEQ ID NO: 4007 - DNA, 426 bp, Diabrotica virgifera
  Clone ID: LIB149-013-Q1-E1-C1
cacccacccgtccggatttcaccaatagccagaagaaacttatcgcagattgggctagatatttttgaaaaaactctcattaaaaatggtttttaaagtatcccttttgtgtacactgctggtgttagttgcgtattctagtgcatacgattacagcaattgtcctggaaataccaacagacaaaaaaatctgatatacagctctttactgccaccaggatatagcgtgaaaactcgtatcccagcaactggatattaccaaagacctatcacctgcttactgctaatcgatcaaaaaggaagcgccagctcaccaaaaattatagaaggtggatatctcgacacttttgctgtagtaaatatcacttccacaactgcgcaaccagttagttactatgcaatagtatttattgattagcctattga

SEQ ID NO: 4008 - DNA, 431 bp, Diabrotica virgifera
  Clone ID: LIB149-013-Q1-E1-C11
accagacagtcccaagttcttacttacacatggtaagagtgaagaagctcttgcaatctttaagtacatttaccatgtaaacaccgggaatgatcccgaggactagccagtgaaacatctcatctacgaacaagaagagctcactcttgaacatgaagccaacagtgcaaagagaggcatgtataccaatatgattgttgatattttagagaatagtaaacagttgtttgtttcaccaattttgaaattcacagttatgtcagttaccatcagctttacatttcacattggacaccacggtcttatgatgtggttccccgaaatgtttagcagatttgacgaatacgctaaaattcacgatggtgcagaagctggtgtatgtgaagttgtggactacgttgtcagtagtggcagccacagtgccagtgttt

SEQ ID NO: 4009 - DNA, 358 bp, Diabrotica virgifera
  Clone ID: LIB149-013-Q1-E1-C12
agcagactttcgcaaattcttgcttacacatagtaagagtgtatcaactcttgcaatctttaagtacatttaccattttttacaccgtgaaatgatcccgaagcacgggccactggggttatctcattctaccatcatgcattagctcactcttgaacataatatccataattgcatgtagatgcattaataccactatgattgttgatattttagagatttatatacagatgattgtttcaccatctttgaaattcacagttatttcagttaccagtacctttacatttcacattggatatcaccgacttatcatgtagtgccctgatatgattaacacatttgccgcatacgcaaa

SEQ ID NO: 4010 - DNA, 382 bp, Diabrotica virgifera
  Clone ID: LIB149-013-Q1-E1-D5
aacagactacttacagagctgacatttcatcactatcatcacttgactgacagaacatcgcaaaggcgcagacattgtgtcattcagggttcactaacctacatgacttgagagtggttctagctcgactgagatcgcaggtgacctcgttgctatgtgctgtcgacatcgaccgcgacttaacttgtagcatccaacgcgacctacacctccacctcgacctacttgttttgttcttacccttacagtgtcatactgtgcatagacactccggtcttcgctacactctgtatcgtctgtcatcagacagcttacggtatctatgatccatctgtgaacattattattcgccattcgtcattattctgcaggacatgttcga

SEQ ID NO: 4011 - DNA, 302 bp, Diabrotica virgifera
  Clone ID: LIB149-013-Q1-E1-D8
cccaaacgtccgactattcatcagcccacacatctatttcattgaaaattattaatgattgatgatattatatatctacgacaatgttgagtctaatcaaaattgaggtgtttaataaaggcattcggttacatgtatctcaacagtataatatgagtatgatcattagtattgaagatgttgtctcgcatgcccattgattacattaagtggacgtagcattattaccatgctatgtatcataatcaagatttttggttacagatagcttttgtgcagggttggatgaattttttactgtc

SEQ ID NO: 4012 - DNA, 240 bp, Diabrotica virgifera
  Clone ID: LIB149-013-Q1-E1-D9
atagtacatgaactactacagtctgaaacaggtgaactacaaatcaagaaatcaatgtttacgaatacttcaggtggaattcctcttcataggattgatatagccaaagcattaagagaaggaaatggaacattagaagtcagcttttaatataatgttgtattttgtcaatattatatgagcttccatcattttttaccataaaatattccagtcattagaaaagaaatcacacaaagc

SEQ ID NO: 4013 - DNA, 420 bp, Diabrotica virgifera
  Clone ID: LIB149-013-Q1-E1-E8
gggtccacccaaacgtccgaatttattatacctctataatttttaattaatgtatcactaattattataccaagcccctcaaatagtactgcgagataatattttggttcaataataggactatgtataggatgtcacttgagtaccagggaatattaagcaatacataactgcccaatagtttcgatatcatttgagctagttgctcataattgctaatgtgtaatatatggttgatttaaatgatcagtacaggcatgtgagtcatcattaaatatatctaagtttatacgaccttattggtctatgaatattatcaatatcttaatatataattgatactagaatattatggagtaactatttttatgcatacacttacaactgcaattctaggataagttatatcatgaagtcaaa

SEQ ID NO: 4014 - DNA, 399 bp, Diabrotica virgifera
  Clone ID: LIB149-013-Q1-E1-F10
aggacgcgtgggttcgtttttaaatatatctaattttttaagaaataaattaaatttatttattagcaatatatttagaagtaaatatttttatatatattaatattaaaggggtttagggatgagcttaaaaataaaattttagtataatttactttttaactaaaaattaggattaaaaattttcatattttaaaatatgttattatttatttttatatattattattgttattttttataaattttttattaaaatataaatttagattatttaaatttagtaatgatgataatattagtattaataaattgtatatttagtaaaaatatataagtttaataaaggaattcggcaacatttttttcacctgtttattaaaaacatgtccttttgta

SEQ ID NO: 4015 - DNA, 71 bp, Diabrotica virgifera
  Clone ID: LIB149-013-Q1-E1-F3
cacccaggcgtccgcagacgcgtaggcggacgcgtgggaaaaaaaaaaaaaaaaagataaataaaagaaaa

SEQ ID NO: 4016 - DNA, 268 bp, Diabrotica virgifera
  unsure (1)..(268): unsure at all n locations
  Clone ID: LIB149-013-Q1-E1-F5
cgtctccttctttcgtgctttggtctttgtcttggttgtcgtcgtcctctcttttatttctccggctgtccttggccccgttcttnccttgcttttgtgtttggtggttgggctttcttttttgtcccttgtctgtcttgtctttgttctcttctgttcggctgttccctctgttcgcttttcgctttctctntccctttccgctttttcgtgtcctttttcttttttgtgcttcctttttttgtcttgcggtgttcttcgctttttc

SEQ ID NO: 4017 - DNA, 363 bp, Diabrotica virgifera
  Clone ID: LIB149-013-Q1-E1-G2
gattgataataataatatcattccaaaagaattgatcactagactgaggtttttagctgaagctgatatcttaagaggcagcgaaattacagtatttttaaatcaatatgcagatacaattttcaacaatttacaaaatttcataagacaacacaactggcagaatgtcgatattccagatacacacttgaagatatctggtggaagtgtggatttaactagaggtaatttaaatgaccttgatacaatttccagaggcggagatgttattcttacatacgaaggggataacaaaaaacttgtcatcgaacttccaataacctttggagatttaagattccactatcaccaacacaccaaagt

SEQ ID NO: 4018 - DNA, 431 bp, Diabrotica virgifera
  Clone ID: LIB149-013-Q1-E1-G4
ctccgcagacgcgaaggcggacgcgtgggaaacgagcgattttgtagaaaaagttataggcgaccttttttgtccagaatgttccaaaaactcaagaaaaacgtgttggggccaaagatattgatttttgcaatttgattagaaaaattgaaaaaaggatttggaccacttttcacgtgggcaactttttgaaccttgttctgagatgtctcacgaatgtgattatgcaaagtaatctcatggtaatattttctcaaacgaacaaggtttcgccttgtctatttggtcgttttctgttttaagagaatatatttttagtttattagtgcgtaaaatataaacgtcactgataagtatcatatagtaaatcgatgtttataagaatgtgtgatatagataataaagatgacattattatttcatatttaaaa

SEQ ID NO: 4019 - DNA, 236 bp, Diabrotica virgifera
  Clone ID: LIB149-013-Q1-E1-H11
agtctaaacccgttatttttaagttgcaatatattttaagctttgcttagcaaaggtcgacggtcggtgacaagtcatttattatatttcaatattatttgtagagttatttctattttacataaatgaactgtgtgcttttaaacatggagttataataaatattgtttttagtaaaaaaaatataattggaggattaggaaaaataaaatgtacccttaaaaaatgagagatca

SEQ ID NO: 4020 - DNA, 433 bp, Diabrotica virgifera
  Clone ID: LIB149-013-Q1-E1-H2
ccgaattttcaaagattgttatttgttttttcaggattcgaaaaaagtgaatgcatttaaaaggcattggtccgaaattttgcgcctgcacttttaattggttaacctacaccgaattttagtaagttttaattttgttttatctgagaatcagtcttccaaataattttgtttattaggttgcaagattagcgttttagcagactaaaccttatttttaagaaaatttatttctttttgatagttcatttttgttaaaggtaatgctattttaaaaaaaagttaggtgtttaaagaaaacatataatctgaaagtttaaaaggctgaaaaaagttcataggctaacatagaaacaaatttttttttgtaaaatttgattttattattcaatatagttcatttaagggcgtacaacgattatagcggtcatac

SEQ ID NO: 4021 - DNA, 453 bp, Diabrotica virgifera
  Clone ID: LIB149-013-Q1-E1-H6
gggtccacccaagcgtccgattacatttattggcaaagaaaaccaataataccaataaaactctgtactacagtacaaatttagcatttaatcccaacggagaaattgttgcaaaatcacgaagggcacatctttttaacgaagcaaatttgacgcctggaaaaccttccgaaaataataatacttttgaaactacatttggtgttacatttcaattattcgccacctacgatctgatttctgaaaaacgaaacaccaacgttaaggatatcgtttatccatcaacttggatctcgactctacctttctatcactctctagcaatgcaacatggatacgctgtggcgaacaaagtgaatcttttggcggcaaatttgaataatccttctgtggcacttgatggtagtggtatatttggatcaaatggtaccgcctaacaatcctacatttcag

SEQ ID NO: 4022 - DNA, 400 bp, Diabrotica virgifera
  Clone ID: LIB149-014-Q1-E1-A3
gattttaaatttataatgtgagagtttattttatgtaccttgtgtatcaaggaatattatgtaccatgtgtatcatggataattacgtatttattagagctttggtattatcgattttattgtagcttaaatattttaaataatattgttgtatagatatgttattcgattttatagatatctaatgttatacgatattaattatatctaattatttacgatatatttataatttaataattatcaataaatataagtatatatatttatggattaaccttattaaataattttagggatgatcaaattttaaataatttataagaatttaaattttcataatttaatatgagttaatatttacatttattaaataatgattttagttattattaaattt

SEQ ID NO: 4023 - DNA, 443 bp, Diabrotica virgifera
  Clone ID: LIB149-014-Q1-E1-A4
cgtccgcccacgcgaccggcgaatttttctaggatgtctcccctctcatttctgactgtattttatctccagctccaaacttggcactaaaatctctcataatgatgagaacttcctgtcgtggaattttctgtatgatctgttgattttctgtttactcaattactttttattcctctttatctgtagtgggagcatatacttggatattggtataaagttagtaaagtatttggcagccttagatgatacgattactccgactccatattcatgtgctcttatcactttttcccgtttaagaatcactatttcccgcgatcactttgtgatcttccacttcctttctccagaatctgggcatctcatttctgctattctcatgatttcaacatgcattctcttcatctcctgtattgcattggggatttttcctgctttgt

SEQ ID NO: 4024 - DNA, 453 bp, Diabrotica virgifera
  Clone ID: LIB149-014-Q1-E1-A6
tttatagccgcagtttgtctctacgacgtatctgctaaacaagatgactacgtgcaatgggtgagttatgatggtacaatacccgccaatgttgtggaaggaactacatccattgatggtagacaattatatattgcccgtgcctttgttagtttagatgagtctgatctttataatgacaatcaaggttacatagtaggcccagtggaagcaggagttttacaactcaatgctagttttcctgatttaacttaccatattaccgacaacattgagatcctaactgttgtggatggagccaaagtcgaatgggttagcacaaatcaaacatttttaccaaaatggttcgatagtgatgactaccatccagtgcactccaactggcatcaaattgttaatataaattcaaccatttatataggaagaatctacgactcggaaataggtggtaca

SEQ ID NO: 4025 - DNA, 187 bp, Diabrotica virgifera
  Clone ID: LIB149-014-Q1-E1-A7
cccattttgtctctacgtcgttgctgctctgtatgatgactacctgcactgcttgatgtatgatggtacacttactgccaatgttgtggaaggagttacatccattgatgggagatagatatctattgcccttccctttgttagatcatcatgagtctgatttttatgttcacggtcactgttaaag

SEQ ID NO: 4026 - DNA, 417 bp, Diabrotica virgifera
  Clone ID: LIB149-014-Q1-E1-A8
cacgcgtcagcacaaatatcggcgtgtttgtttatactaattactggttagtagtgaagttgatcctaggattactagacgaacgcatctgccatttggcattaattaggggtgaccacacaatactagcggtagttggtgttgttgtcaaccctagcctattttacaatgtgtaacgactttatcgatttggctgacgatttagaatgttggatgtcacggttaccacacaatgtgcgacatataccacttactaacatttctatcccaggttcgcatgacagctttacagccaacattacgaaagactctgatatatcccctgatgccgacgatatagttaatgaactctcacttttgggccccatatttaaagatgtcatagcaaggtggtcacgatctcaaagctttttagcc

SEQ ID NO: 4027 - DNA, 427 bp, Diabrotica virgifera
  Clone ID: LIB149-014-Q1-E1-A9
caaagttccagtgcttgattttagttctcgtagctactttagcattcgatagtgcgattgcaaatgatgtagcaaaaccgtgtgagtctgattcttgtacgatcggcaacaattgtagatgttctagtcaagcgtcacctctaggtggaaatctcacagagtatcctcagctgattagtttaacatttgatgaagctgttacacaacacatctacgacaacagttggattacattgctcggaaatatatataatccagatgataagccaattagtggaacattctttgtaccacatgagtatacgagctatcaaagagttaatgatttgtacaactttggatttgaaattggtgtgcactcaattacgaaggattttagacaaaattactggagatatgcaactctagacacactaacaaaagaatt

SEQ ID NO: 4028 - DNA, 398 bp, Diabrotica virgifera
  unsure (1)..(398): unsure at all n locations
  Clone ID: LIB149-014-Q1-E1-B10
atcaaaccaaaatggcaaaaatcgtcctcttcttctgcgccatcattttggcttcagcagctgctttaccaacccaatcagctgacggaggtgttgtcgacatcatcaaaaaggtcgtgcacaagcttgaagacataatggaaaaggtttttactgaaggtcccaatttcatcgacactttccctgacaagtatgacgaccgccttactaaagtgctagatgttacaagggccgtgcttactaaaatcgctcaagcacttaaagttgttatagataaagttgctgaacaaagtaatgatgctggaaagaaattggtttcctgtgtcgaacaacacgaagctgatctcgtcaatatccgcgtcgctctcgtcgaaggtgccggcanatgcgtaaaagat

SEQ ID NO: 4029 - DNA, 431 bp, Diabrotica virgifera
  Clone ID: LIB149-014-Q1-E1-B11
gtcggactcagggtcgcacacgcgtccgcccaagcgtccgcgtataggttttggcagcatgagttcgtccattgtgctccagagattgatgaattattcgagtcagtcgcaagatcttgtatggtaaaatccacagcgcaagcgcaggaaggcgacatacaagagtgataagcagttttgtgatttggatatacttctataaaaattgaacgattgattgtgacttttttaattttttgtgaataattgatagcttaattttgggagcaacgcattttatttttagaatctaaggtgattatagtgtatagagattaattagtgtaatatattagctatttttaacaagattttcaagtatttgtaacgattacacatataaatgtggatgtaacacatgggtttcaatgttttgagcattaacagcgtcg

SEQ ID NO: 4030 - DNA, 393 bp, Diabrotica virgifera
  unsure (1)..(393): unsure at all n locations
  Clone ID: LIB149-014-Q1-E1-B3
agaaaatataatggcatagaagccaaatgatgataatttgtagcccactataaccccaatgaggaatctacgatgaatgtcccccagttgctttccagtaagtactcgatatgagaatttgaggatttttcaaacggcgtcccaatttgtttaaatagtaggaaagtcctcaagtctgtggtgttactttggctgatgtagatccatctgctggtgcaaaagctttggaagagcttgaaaaggaatttggtcncaataaggcaatatttgtacagacagatgtacgggatcggcaacagtttgaagatgcttttaagaagactgtcgaaacgtttaaatatatcgatattttatttaacaatgctggtattttaaatgattctacatgggatg

SEQ ID NO: 4031 - DNA, 372 bp, Diabrotica virgifera
  Clone ID: LIB149-014-Q1-E1-B5
ccacgcgtacgggcaaaatttactctctttcttttggcagctgtctttgtagctgttttagctaccaaagaagtcagctcaagtgatgttaaagttgttgatgatccagacgatgaaccaactactacaactactgctcccgctacgtgtgactgtgaacaatgtaacactcattgcacagaggaaagcaaatttgacccacccaaaaactacgctggaggagtctgtgtagataataaatgttattgtgtcgaaattgtttaaattatattcctttatattatcaataaatgtttttaaatgaaaaaaaaaaaaaaacacaatacaaatacaaaacaacaaaacaaaaaaaaataaaaaaaatttcaacat

SEQ ID NO: 4032 - DNA, 453 bp, Diabrotica virgifera
  Clone ID: LIB149-014-Q1-E1-B6
agcaaattctcaagaaatatatgtccaacagtatggtttgaacaaacaagtagatcagcttatccaatcattggtatatcaccaaaatgtgatctctcaacaagttgagcaattcattcaacaaggacaacgtcttccccaagacttgctttcccaacaagtattagtctaccaacaagttcgccaattgattaaagttttgagcacccaacaacttaacatgatcaacttcatccaatacctcgttgaacaaggtaatcaagttgatcaacaattgtacgctgttcaaagaaatttttaccaacaagtccaaagacttgttcaacaggtagttcttcaacaatctcaaatcaaagaacaaatccaggtacttatccaacaagaacaaactgttccacaagaactagttttattccaacaattggcctaccaacaagttgaacaattcatcca

SEQ ID NO: 4033 - DNA, 459 bp, Diabrotica virgifera
  Clone ID: LIB149-014-Q1-E1-B9
gatattttctatacaaaactaacactttcgatagcgaataaatcgaaaactattaatttgatcaaaaaaatgtatttaatgcaaaaaaacattttttgcttagaattaaagtttttatcaacttttgcggtcaaaatgtaataaaaaaagtttccacccccgagatggggtggcaaccaccccatggcaaaagcgcctttcggaatcatatagattttgatccttgaactatccactacttattttcaaattttcaagcaaatcgatccattttgtaaaaactgcgaggtgaaaagcttcggttcctggcctataatattaggaaacaaaccaagtatgtatgtgtaaggtaaggaattatactgaacaacaatttgagacagtgatttatgagactctttatgagactaattacctgaagtttacaaatgatatggaaattcctcatctcataatctc

SEQ ID NO: 4034 - DNA, 433 bp, Diabrotica virgifera
  unsure (1)..(433): unsure at all n locations
  Clone ID: LIB149-014-Q1-E1-C3
gtcacgtaataataatactaagaagttgcagaataagtctcgtaagaataaacagagtgtgttacctgacaatataaaacaacgtactgactcgtttacttgaaaatctctttagcataatttttatatattttattgttgcagggcgttagcaagtataatttatagtaatcgtcatatcttgacaacccctgcattgtttttatcgacaagatgtgatagaataaacattagtaacgtaattaataattactcagctcaataacgaactattagtgattttatttagattgtttaagacttttatatagtaaaaatatacattcctcatcacatccagcgaagggcagtgcctgtgagtgtataccanaatatattattttaattaatgttaatgtaatttgttgcggatactgcccttattgatatattt

SEQ ID NO: 4035 - DNA, 431 bp, Diabrotica virgifera
  Clone ID: LIB149-014-Q1-E1-C9
acgcgtccgcggacgcgtgggcgtccacacacaatgaaaaaaattacactcttcttctgcgccattatcttggcttcggttgccgctttgccaaacaaagtagctgacgataatttcatcgacgacgtcaaaaagatcgtccacacgattgaaggcctcattgatgagcttttcactacaggtccaaatttcatcggaactttcgctgacaagtaccattggtacctcactaaagtcttaaactatacaagaacggctattacaagagctttagaagcacttgaacctattttaaatcaaatcgctgcacaaagcactgattctgtaaagaaattgatttcttgcatcgaagaacaagaaaatggcatcatggcacttcgcgtcaatttcgtagcaagcgtcggtaaatgcataaaggacgatctcgtcgc

SEQ ID NO: 4036 - DNA, 262 bp, Diabrotica virgifera
  Clone ID: LIB149-014-Q1-E1-D11
attattatttagttgacactagtacagtattttttactatcagtaaagaaatcttttagttactgatagttaatgagtattgtgagagaatagtttatttttataatcgagtgatttactttttgtgccttgtgtatcagggattattaattaatctttatatattaatgatttccgacttcaaaacaccgaattcattaacatttttattgtaacctaggtatttaaggtaattttttggtagtgaaatgtaatccgtttt

SEQ ID NO: 4037 - DNA, 449 bp, Diabrotica virgifera
  Clone ID: LIB149-014-Q1-E1-D6
tccgggtggcccacgcgtcagaaaaaatggcttccaaaactgttcttttcggactcttggtagtccttttggtcaaccactctttggctagagatctgactgtctgtcccaactcagacaaagcaaccaaagctgtatacgacaaagaagtagcaacatccgttgtaggaagcaccatccgtgttagagtaccagacagcttgttcttgaagaaaccaatcacctgcattgttattgtggacaataaccacagcgatagcgtacctgaagtagaagatggtggtgttgacagtacatgggtgaccgtaaacattgctcccgccattaccgaactgctcagctacagaatccaagtgtacaccaatgaataaatatagattgtaatatgtctgaattatgtaaagtggtgctaataaaggctaatgtgtatataaaaaaatcaaaactta

SEQ ID NO: 4038 - DNA, 392 bp, Diabrotica virgifera
  Clone ID: LIB149-014-Q1-E1-D9
atgaaattcaggaaaattttgatttagatgatgtcgtcgaaaataacgattttgaaaatctgttattgtatcatgattggggaactttctcctgcgaacatacagtacaaagtaaagggttgtcaaaactattgtcatatccgagaaattcttttgatttaatattagttgagtacacttttaccccttgtttattctatttaattcaagctttcaattatccgccgacagtagtaataacaccatttctcttgccagcatttttagctgaaacatttggaagtgatgttcagcctgcttatatagctagtcatgtattaaaccacaatggaaaatttacatttttcgaccgattgcggaattttgctttgttgaagatggacactctactg

SEQ ID NO: 4039 - DNA, 443 bp, Diabrotica virgifera
  Clone ID: LIB149-014-Q1-E1-E10
attacagataataagtattgtatcgacattaatattgctaaggtatgtattgtgtcggtatcatattgattttcgatacgatatcaatacaaaatcgatatttttatcgaatatcgtgaagctctacttaattgagattaatgctcaaaatcctggtactataactggattaagataaaaattggattatggttggatgattttaacaatgaaaaattgggacaataaataaattaatcctcatcgtttttaatctttttacgataataatttttaaaaattcttaacaaattgccagactttataataattattgtcttcaattttgcgtcatttatctaaatctataaatgatatcaagtcaattcaagttataaagtttaataaaatttccaacagaagtgtatctaatatctatcctaaaacagagtttatactacaaa

SEQ ID NO: 4040 - DNA, 284 bp, Diabrotica virgifera
  Clone ID: LIB149-014-Q1-E1-E11
cttagaccgcccagatcgttcacgttaaaggaggaaaccaggaagtggtccgcagtcaagttgtccaacccaacgaaacccaagagcttcttcttcaaggcgtaaatggatcatctttgaaaattatcaacgaaaacgagactgattacgctatcttctcagctgaaggaggtgaagtaattgatggattcagatatatggtaagaccactacgtcgccgtcccggtgcaagaaaaatgttctatggattttaagtatttaaatagaatacacatgttctgaat

SEQ ID NO: 4041 - DNA, 112 bp, Diabrotica virgifera
  Clone ID: LIB149-014-Q1-E1-E2
cccacgcgaccgaaaaaaaaaaaaaaaaaaaaaaaaaataaaaaaaaaaaaaaaaaaaaaaaaggcggacgctctacaagaataaaaaattatttactcaatcataaaacaa

SEQ ID NO: 4042 - DNA, 424 bp, Diabrotica virgifera
  unsure (1)..(424): unsure at all n locations
  Clone ID: LIB149-014-Q1-E1-E5
cggacgcgtgggttttaaggttatttccgcgtgtacagctttcgaggtagtaattggcagaatatgttggggacaacctgttccaagtcctctgcgaagttttctaggatgtctcccctcacatttctgactgtattttatctccagctcgaagcttggcacgaagatctctcataatgatgagaacttcctgtcgtggaattttctgtatgatctgttgaatttctgtttactcaattactttttattcctctttatctgtaatgggagcatatacttggatattggtataaagttagtaaagtatttggcagccttagatgatacgattactccgactccatattcatgtgctctgatcactttttcncgtttaagcatcactagttcacgcgatgactttgtgatcttccacttcctttct

SEQ ID NO: 4043 - DNA, 452 bp, Diabrotica virgifera
  unsure (1)..(452): unsure at all n locations
  Clone ID: LIB149-014-Q1-E1-F2
atcaaattattaatttgtacactatgtttacagtagttgcccttttattgtgtgttgctttatgtgaagtacatagcggtattaaagtctgcaaaagattatcgtgcaagatttacagcatgtgctgatccccttaatctagtaatattggaatccgacagtcacatttcacgacgtctcatcttgtctagcagctgaagagttccagtgctaaggttgcaagaaccgcctatttcatacagattgctcgttgataaggttaggagttcaactgaaccacttaatggtgcatgaagtgtatgttctccatatgttgaaatacgtatcattccatgattcgtcggatctcttcattataggattgaagtgtacatgaaagcatctgataccacgcctgcatcaacagcaacaactaattanntagaggagatcaaaatttttaaataactttt

SEQ ID NO: 4044 - DNA, 455 bp, Diabrotica virgifera
  Clone ID: LIB149-014-Q1-E1-F5
agcttagggctggtgtcagttatgcaaaagatgtcaaaaatgacctaagtgacggtattttatttaattctgcagatgataaaatattgtttccatcattaatagacccaaagccagcagaaataccaccaccacctcctatcaatctagcagatccaccagagcctccaagtgacgtaccggaggccctatataacaaacgtcccagacctccaccaagcaaacgacctagaccaccaggtcctccaccaagcagacgtcctaaaccaccaggtcctccaccaagcagacgtccaaaaccaccaggtcctcctccaagcagacgtcctagaccaccaggtcctccaccaagcagacgtccaagaccacctggccctccaccaagcagacgccctagaccaccaggtcctccaccaagcagacgtccaaaaccaccaggtcctcctccaagcaga

SEQ ID NO: 4045 - DNA, 372 bp, Diabrotica virgifera
  Clone ID: LIB149-014-Q1-E1-G11
tttaatttacaattataaaatattttttaggtaatcttcagaaaccttttatctaatgcaagtctatctactatgtgtgagagaatatttgatgtttataaagttataaatctattttatgtagcttgagtagcacggattgataattcaatattagatatttagcaatttcgcagttagaactagctaaacaatgtaatatttttattgttggtctaaatatacttatctagatttgatgtgataaagtgtgaatctgatttaaagatatccaaattttcaagaatgatattatatacatctatcagcattcagcttaaagttgaatatatctctattacgactatcatatatttttatggatgagccttt

SEQ ID NO: 4046 - DNA, 430 bp, Diabrotica virgifera
  Clone ID: LIB149-014-Q1-E1-G12
cccacgcgtccgcccacgcgtccgcccacgcttcagatcacacgtcaggttaataataagttataaataatattaatttaatattttatatattttttattaatttattaatttaatttatttatatttagtatatgatgaaattatgatgattatattattagtaatttattgtaaatatagtggtttaatataggatttcggcaggatttctgtcacatgtttatcacctgcatgtcattttgaagtcattatgtagtctcgcctgcgtatcgactgattacggaggacgctgtatggtgaccgtgctatggtcgtacaaacgttacattatcaatagatagctgatatgaaggggtggttgaaggttggactgtcattaattcagtcattaagtaatttaattttaagtttaaatgcctgatatttt

SEQ ID NO: 4047 - DNA, 449 bp, Diabrotica virgifera
  Clone ID: LIB149-014-Q1-E1-G5
gatattctataccttggtcattgttttcattttcccaggttcccagatatttgtagttattcactatttctacttgttgctcgatatctaaccttcctaccataagttgcttagaaataatcatgaacttggttttttaacgttcattatttgtagtccttactttatactgacttgatataatatatttactagttgcagtgcttctagatctatagtgtcatctatatgttgttctatttttttgtctagtcaattttgtataaattgttctgtactgggagcattctgttgcatatactgactttgctggtgttacaaacgtggacagcaaccaatcctggggaatatcgaggaactcactaaatccctaaacatactaatgtattgcttttcatatgatacaaaatggcgcctgtctaccattttcaatgataacttcactaaaa

SEQ ID NO: 4048 - DNA, 397 bp, Diabrotica virgifera
  Clone ID: LIB149-014-Q1-E1-G8
aaaaaaaatcaagaaaataaaaaaaataaaaaaaaaaaaaaaaaaaaaaaaaaaaaaaaaaaaaaaagaaaaaatataaaaaggataaaaaatttatataagcttaaatcaaaaaaaggggagacaattctatagacaaaaaaatatggggggcccgcccaaggttttacatctttctttctcggtaaatctctgtcgttacccttcctacgggtccccaaagttctattccgtgggctcctttttaaaatttgctaatcgggaaaccctttggttttccccatttttccccgttgtgaaaatatcccttttcccccagcggtcttcgccacacttggcccccccctttttcccttttccacattttgccccgttaaaattgaattggtaccccccc

SEQ ID NO: 4049 - DNA, 307 bp, Diabrotica virgifera
  Clone ID: LIB149-014-Q1-E1-H10
cttacacgaccattgctcttaatatacgatgattcgtatactgtgcgcgatttccgctataccttttaccggggtataatcggtatgtcgcactcattcgtgaatatctgcacatgtattacacgcgacctattgctccaatcactgttctggtcactggctctgtgaatacatcttgagttgcctcgctcccgcgcactgctaccacaatcatcacttaactggtggtggaaacacgccatccacgccagaggataataggaatggcagttatacgtagaatggccagatagacatcaaccccact

SEQ ID NO: 4050 - DNA, 407 bp, Diabrotica virgifera
  Clone ID: LIB149-014-Q1-E1-H3
cccacgcgtccgattgacacaaacaccccaaaaccccaagtatttttagccatgtggctacaacaaactggcaatttcaccattgatacaagtctggccactgaaagaggatttactaccatagttcagtccttcatgcaatttttcgaaaatgatgcaaatgtcttttggttaccaagaaatttttatgagaatgtcaaaaagtttgatgctgatttagggaaagtcgtggagaaaacttacttgatactggagaaagaagatgctgcatattacaagcatttaagtaaaactggattgttggccaatttaccattagctaaatggtttgattgcggtttcgctggaatattgtataaatctgcccttgaaagataattgaagaaactgcggatgtgataccaaat

SEQ ID NO: 4051 - DNA, 428 bp, Diabrotica virgifera
  Clone ID: LIB149-015-Q1-E1-A3
tgggcggacccttgggattaattttaaaataataaaaaatttttaagtaaaagtaaggaaaaatttaatttaaggaaagttaattagtatggtgaaagaatatttaattttaataaaagaaaaattaatttttggtacctggggtaccagggataataaattaaaaataataaattaataatttccgaatttaaaagacctaaaaatttaaaattttattgtaaaataaaaatttaaaataattttttggtaatgaaatgtaatccgtttttaaataaacctaattttttaagaaataaattaaatttatttattaacaatatatttataattaaatatttttatattattaatattaaatatttttagggatgagcttaaaaataaaattttattaaaatttaatttttacataaaaattaggatta

SEQ ID NO: 4052 - DNA, 133 bp, Diabrotica virgifera
  Clone ID: LIB149-015-Q1-E1-A4
cccacgcgaccggttaaaaaaaaaaaaaaaaaaaaaaaaaaaaaaaaaaaaaaaaaaaaaaagggaagaaaaaaaaaaatgagaaaaaaaataaataaaaaaaaaaaaaaaaaaaagggagatggggaggagg

SEQ ID NO: 4053 - DNA, 322 bp, Diabrotica virgifera
  Clone ID: LIB149-015-Q1-E1-B1
caataactaatatacaacctgagcgatctcaatgtaagaaatcttgtgccttcagttaccacttgggaacccggtgtaagtgccttaaattaagctcatcagttggtagcttcagttacaaggaagatcagaaatgataccaaatggggtgaataaagctgtatctttcaactattatcagctagtcgactacctggcaggttactgcttaagataatatgaccatggacatagagacctctccggataagtatcggatttacactggatagttgcaatccacggtgcacatggcgaccggcatgttggcataaagcttcaa

SEQ ID NO: 4054 - DNA, 304 bp, Diabrotica virgifera
  Clone ID: LIB149-015-Q1-E1-B10
ggtcgacattccgggtcaaccacgcgtccgcaagactcgtgagcgagaagcgtgttgtgagaacacaatcaatagtcattattgaggctacaacgtagaagatcgattttgcgcacctgctgaggtggagacgacatctcaaattactaggctgggtatgacgtatcaccaacacgactcaatatgctcttcgattggcagtcgtgtaagcaacgaccaggtagtgttagcatctagtcacatcaaacatctttcagttattactcacatcgattctattacgaagaatattgcggacacagag

SEQ ID NO: 4055 - DNA, 105 bp, Diabrotica virgifera
  Clone ID: LIB149-015-Q1-E1-B11
tgcagcaagctcatctattgaagcatgccactataatacagttattttcattcactgatcaagtcacatcaggaatacagacaagtgagtatgtacacaagggta

SEQ ID NO: 4056 - DNA, 397 bp, Diabrotica virgifera
  unsure (1)..(397): unsure at all n locations
  Clone ID: LIB149-015-Q1-E1-B2
cattttgctagttagaatatcaaattgataaacatgaagttcgtattggtcgctctagttttggccgtagtggtgtgccaagtgatatgtgatggtgatgatactggttcctccagcaccaccatcgcggtcaccaccagcgaagctccacctaccaccaccagttcgaatgcggaacaatcatcaacaacctcagcacctgagagcagcaccaagggtggtgcatctacggccattcccgcaataggacttgtattgggaaccgctttactgtgtctccactaaaagcagaaaggacgcttttgtctagtcactgttcactttaatacactcacttanattattattttcganaaanatatcaatttgctcanaanatanacatcagacatacaac

SEQ ID NO: 4057 - DNA, 400 bp, Diabrotica virgifera
  Clone ID: LIB149-015-Q1-E1-B6
gacgaagccataatacgacaaacgtactataagaaactgactacgccactgacgttgctattttgtaataaaacaccacattcaacatttatctcccatactttggacgagtctgattaacgtcatgtcatgagtgtagctgtatgttgataacaaaataattattgttttaaatcttttttagagaaagaaagtataatttctttccaatatgaacagtatattaattaaatatgtgaacacattacgtgtctaatttgtaaataagatggatacactcagtgcttatataccagatattgtgtctctcgagaatatacaaggtgcattccgttagttgtttttagcgtctatgcttcgtctgttcagtttacaaagtaatttgggacacgatacacat

SEQ ID NO: 4058 - DNA, 331 bp, Diabrotica virgifera
  Clone ID: LIB149-015-Q1-E1-B7
tctagactgagtcatattacgataaacggactagaagaaattgactacacgacagacgttgcgaatttgtaatgaaacagtatattcaacatttatctcccattctttggtggagcctgagtaaccgtcgagtcatgattgtaactgtaggttgtaatcaatacaaatatcgttttacatcttttttagagatttaaaggaaaatttcttaccattaagaacattatatgaattacatgtgtgaccatattacatgtctacctagtttttaagatggatactctcattgcttatataccatatattgagtctcacgagaatatacatggtg

SEQ ID NO: 4059 - DNA, 447 bp, Diabrotica virgifera
  Clone ID: LIB149-015-Q1-E1-B8
gaaaaatccagaccctttgaaaagaggattcccttccagttagtctaaatacgaggactggccaagtacctaagaggtggaggccatgaaactacaagaagaagaagaaggtaaatttaattaattgtattttgcttgcagtactgcattttaataactaattttatttactacatacaattagcataggccgttccaacatgctgtcaaaattaaatcaatatggctgctggaagtaaaatataaatgttattctataggttcttaatgtgttttagatggttttagttcatttttgttgtatttctttgtaattttgtgttgtacaaagattaatttaacattttgtctggaagtattaatttagaaagataatatgcttcattggtgttgtgttttgaagtgtgaaatgcaaagtaatcctgatcaagtcaagataaagttcac

SEQ ID NO: 4060 - DNA, 81 bp, Diabrotica virgifera
  Clone ID: LIB149-015-Q1-E1-B9
ttccgggcattttgcgctaacgaccccttaacaagcccgtccgatacgggttttcttttaccaaatgaacactttcatttt

SEQ ID NO: 4061 - DNA, 364 bp, Diabrotica virgifera
  Clone ID: LIB149-015-Q1-E1-C11
tccgggtctaccacgcgtccgaatacaagtcttttagtaatgaatctaacatgtctccgtcccacagacgaagctttatgcgcgctgaactcagtacctgcccctgcagcttcggcagaatcatcatttaaatgaacactcaaatgaacggctggttcaacatcagattctccatactgacacttatactgaattatcatctactgtacctacacattcattttttacccaacaacaggactcatcaacaattgtacctacttattactcacttatttcagcatcagattcatctacaacagcaccttaattatctgcagtgaatccaacatctgattcaccatctacagcatctacagattct

SEQ ID NO: 4062 - DNA, 415 bp, Diabrotica virgifera
  unsure (1)..(415): unsure at all n locations
  Clone ID: LIB149-015-Q1-E1-C4
cacgtatctccatcgataaccattatctggtgttttacatagataataacaaataacaatcatgatttttaaagtatttttgtttgcgttgttcgtagcagtaataatggcggaacaaactgcagaagaggcatggccacaatataagaaagatttcaacaggtcgtacgacgccgctgaagatgccgaaaggttcgccatattcaaggaaaagtacaaccaaatacaagaacaaaacaggcaatacgcagctggtaaatcaacatggacagcaggagtgaacgactttactgacagaaaacccgaagaacttaaacacctccatggtctcaaggttcctganggaaacgccgctggactccattaacctattactacctgaatgttttatacctgaaatanagtgatcattttc

SEQ ID NO: 4063 - DNA, 438 bp, Diabrotica virgifera
  Clone ID: LIB149-015-Q1-E1-C5
cacacgcgtccgcagcattgacggcaccgatgttggtctttacagatccaccacacaggaaatgaacaagaaaatcggatacgatgtaacttacttaggagaactaagcgacacggatagctatgaagatcccaaattcttactgaaaggagattcgcaatctaagccaagaatcatagatttcgttccgctggattacgcaaccaagagcatgtttccgaacaatagtaatattcccgaatatcagactttggaacgagagaaggtttatcacgtgttaaattctgctcctaaatccacagttaacaaagcagacattaaacaggtagatgatgtagatggtaaacccagaagtacgaaccccttcgtagaacctgaaccaaataaatctcctgagggcgcgactaaattggaaggtactattggtcaagaaagaag

SEQ ID NO: 4064 - DNA, 122 bp, Diabrotica virgifera
  Clone ID: LIB149-015-Q1-E1-C6
gacggcatcgatgttggtctttacagatccagcacagatgaaatgaacgtgacgatcagatacgatgtaacttaattaggagaagtaagcgacagggatagctatgaagatcccaagttctt

SEQ ID NO: 4065 - DNA, 410 bp, Diabrotica virgifera
  Clone ID: LIB149-015-Q1-E1-C8
acgcatccgcacacacgtccgatttctgattaatatattaaaatttattaaacgtaattaattaaaacgtaaaataaatctgcaaaaatatacagggtgtcccatttaaattaaataagttgagggtatttctggtgaaactggtgtagtaacaaaaaatatggcgtcagatgctttcagtgtcattgtacttgcatgcaatggcgtcttctttatttcaaagatatttagtatgtttcattcttcaacgcaaccctgtataaacaaaatcaaagcttgactatcctatacgaagactgttattttatgatagagcacatcgatttaccattatttattggtttgtattttgcctgccattctattttatcatagttacttccttataaattcctatgagatttattaat

SEQ ID NO: 4066 - DNA, 118 bp, Diabrotica virgifera
  Clone ID: LIB149-015-Q1-E1-C9
caacctactcatcaaatgggtaatgggtataatactactggtatttttggcatgtagatgatttcgtccaacagattgtcaatggcgcatctctgaagttttacctgatgcgaattta

SEQ ID NO: 4067 - DNA, 350 bp, Diabrotica virgifera
  Clone ID: LIB149-015-Q1-E1-D1
caaaaccaacagcatactcgtcgtcgaacgtcgttgatgtacagagcctaattacgatggcaaatattgctagcggggattcagagattaactcgaaatacaaaccggtgatagctaaaagtgttccagtatcgatctcagatgacctgcttgaggaacccatttacgtgttaactacgaaagctcccgtatcaatcttctagattctatgcagtggatcataagtaagacattgtggcagttcattaggtttaccatatatatttgtcaaaatgagtgtcccatggtgattgactacatggatgatgtatctgcacgatgaaaagatgctgatttagatgactactttt

SEQ ID NO: 4068 - DNA, 358 bp, Diabrotica virgifera
  unsure (1)..(358): unsure at all n locations
  Clone ID: LIB149-015-Q1-E1-D10
ttttgcaattgcaggacaggattcaactgttgaatggttaccttatagtggcttaccagacgagcatgcattattaattcatgttcatacagaatataccccagctgtttatattggcctatcacacgtgaatggtaatgcagcgcagtctgatgcttatcttcctgtgaatagagttgcatgcttcaactatgcaaacgtaactattaaatgatataaactatatggctgacaatcctcagattctatgtttcaataaccctgatgcattgggatggcattataggatggcaccacactttgatgacttattgaatgaatctaanattgctcccataggatctggttgggacgcaca

SEQ ID NO: 4069 - DNA, 451 bp, Diabrotica virgifera
  Clone ID: LIB149-015-Q1-E1-D3
cagactctaagtggtgtttccgctaaagatgtatctaaagtagacatcgtgaagcaaacggagtggttgctggaggatttgtccaaagagctcaagaagaaagacgacgacttggtgcaattggaatcagatccagaaataaccataatcacggagatgacggaaaccgacaaggacgctctggtcaacgaaaacgaaaacaagaggcggaaagaaatcagttcgtttctggaggaagaaatgaacaagatagacgaagtgtttaacaaacttaaaatcaaagtaaacgatgatatcatagttggtgatttagctaaaagtgttaaccaaatcaaacaagaaaaaattaggaacaataaagttaaaagtaagcattcgatcgatgagttatgatgaatgtaagattgtgtttagttgcgatatcgattgattgaagcggtatattaatttg

SEQ ID NO: 4070 - DNA, 333 bp, Diabrotica virgifera
  Clone ID: LIB149-015-Q1-E1-E12
caagtaatgaattaaaatatacactcagatttaaatatattgtcaattatgctaaaacgatgttaaccggtgtattaaaacaatgtctagtttgaattggaaagaactctttccaacgaaattaagtttgattatctttatcggctacatacttttacttgttaatcaaggaattttggtaacagcttcaaaacgctcagacaacaactacaactataatatcgtaacagtagtactattgacaaaagttttaaagttaatcatctcgtcagtcccatattgtaaagataagtctactggtcaactgatttctgaagtagtcaagcacaaaca

SEQ ID NO: 4071 - DNA, 300 bp, Diabrotica virgifera
  Clone ID: LIB149-015-Q1-E1-E4
cgtttactttggatgaaccacagctacagacatcaataatctacagaatgatcaaacttggtttgggcattgatgaagaagaatctatgcttactgaataaaccccatctggcgaagctcctgctgccgaggctggtgatggagaagatgcttcccgtatggaagaagtagattaaatgcattcatttaacgagcatgtgttgtaatatgttcaaatgacaatttctctcattccttatttttgtaaataacttatttcttttttatacagagtattactagcatttgaaacgctactgg

SEQ ID NO: 4072 - DNA, 439 bp, Diabrotica virgifera
  unsure (1)..(439): unsure at all n locations
  Clone ID: LIB149-015-Q1-E1-E6
gatggataggcatatttgccatgtatgcttatgtgctatgtgtgcacataaagcgaattttgatgaatgaaccctccacacttagtcctatgtggctgaataaggtgcataacaaataacacacagtgaagtgtgttgcggcaacattagataaaccacattcaaaagtgacctcatgctgttgaatacttctgtaccttggcattttgttagcccagagttatactgttgtatgttctagttttgagaaaagggaaaaacaaaaaagattttagttttattaatcattttttgttttttcccttggcattttgttgatattcattaanatgaaataaatttttgtttttcgcttttttcaaaacatacaacaatataactgagctgacgaaatgccaaaggaaagaagtttttaacagcatgaggtcacctttcaatg

SEQ ID NO: 4073 - DNA, 443 bp, Diabrotica virgifera
  Clone ID: LIB149-015-Q1-E1-E7
tatacattatgtaggtatataccatttctggggtgtcaagaaatttaaacatttaaaatgcattcagtgattgatttgacatcatgtccgtccaacaagtaaaatctccaaaatctctcaacttatcgccctttacacaaatatcggaaaactataactaactgaaattcaccagcgacgcgacgtctgtcgtttcatcggcaatcactgcaacacaaagataattttcaatttctttccttatttcctcgtgataaacatctaagatgcactgaaggagttcattttgtgtagttttgaggtacatgcttttaaagatttggaactttgaatatgaaccgaagtcgttgtctaattcggctaacattgaacagttccatatagatgcctctattttctgaattttccttttcgtcgtgatttctcaaagctaactcgaaact

SEQ ID NO: 4074 - DNA, 452 bp, Diabrotica virgifera
  Clone ID: LIB149-015-Q1-E1-F12
cgcgggtcgatgcaagcgtctgcactgacgtcctggtaattattgattaacctgtagaaacactaaaaactgagtgaatctttttttccttattattttttaagatctactttttactttagtatcaactacttattatcttattatcaactttacttattatcaacaatttaattactgttcgatattttagccactttaaggttaagtgaatcaatgaaatgtgtaataaattaaatagctaaattgtatgtgctattattaatttcagttttatgtaccaactaataaatgagtttctcaaatgaaggtattaagtgaggaaaatttctgaatgaaattgaaaaaatgggttttaagagtatctccaggttttcaaacgaaaacatcttgtatagtctgtttaaattattagagaattgtaaagtctatccacactgttatatagcata

SEQ ID NO: 4075 - DNA, 446 bp, Diabrotica virgifera
  Clone ID: LIB149-015-Q1-E1-F4
gaattctcagacgatcgacgatagtgcatgtagaaataaaccaaaatgaaaactattttgagtttgtttttgtgcgtcattttggttagtgtaaacgcgtgggtggctattataccagctgatccggcaaccgctcatcttggagactgttatacaacgagtcataatcttggagctttcacagcaggcgaggagaaaagaattgaaggaagatgtgctgtggcagtatgtagtgctagtggggatattagcctaagaggttgtggagttagaagagcagcctatcctataagagtactacctggagatttatccaaaccgtatccaagatgttgtcacaggatagtgggacctaacaatgacaccgacagtgacaacgaacgaactccggaatacggaaatgtagtcctggcggggtgctttttgaatcctatgctctcaagata

SEQ ID NO: 4076 - DNA, 330 bp, Diabrotica virgifera
  Clone ID: LIB149-015-Q1-E1-F5
aaaattttcaacattagagtgttcaatatatctatcaaatatgtctctggaacggcaaggctgttcgattccaccgacatcaagcgtatttcagaaagacattgaagctcatgcatggctcgagactaaccatggcgccattttacctcaaggagatgcctatagattatatggaccatcatagaactgtcctctgacaactcatcaacttataggcaccaggatcgatcgccaatttccacacatcaggaggagtaatcatttagatggatatcatcaacaacttcaatgccgaaaacattgccaacagtgtagctgataatgatgttt

SEQ ID NO: 4077 - DNA, 98 bp, Diabrotica virgifera
  Clone ID: LIB149-015-Q1-E1-G6
cgcgtgacccgggaactttcggaccagcttggcatcagatcaatttgcaggctggtccattgctgctgtcaaagcttaggtcaattctcagagggtca

SEQ ID NO: 4078 - DNA, 450 bp, Diabrotica virgifera
  Clone ID: LIB149-015-Q1-E1-H1
atgcggtaaaacaaggaactgactttacaactcatgaagttgagaacgctattaagcgctggttaaaacatgctcctaaccgtaacaagaaaaattactaatttggaattgttttaattttagttttttatttgattaaacatgcaaaggttttataaagaaactgtaggtgaacgccaaatgtgtaggagggtggctaaggaacttaaaaatacgattgaaggtcttaatagtaatttaaatcaggcttcttcccttgttagtaaaacagtagtacatagtgataccatttagtaagtttttaaggataagtataaaatttgcaagatgttgatgtgtaaaatgtaacatctttatttaaaaatagtcaaaaaatttaaaaataaaaatattctcgattatgttcaaaaaaatttaaattttttgactatttaaaaaaatatgttttac

SEQ ID NO: 4079 - DNA, 426 bp, Diabrotica virgifera
  unsure (1)..(426): unsure at all n locations
  Clone ID: LIB149-015-Q1-E1-H11
gatgcgatggttctatggtgttagaattatttgtactggtacttggagtattttctaatggcctgctgttatttttaaaatttggaaaatctctcgggttataaataaatttattatttgagatgtatgattttggaatagcttcacttgcctcaaaaaatgtcaaattttcatacgccatcagttctttaatattcttttgtcttgtatattctgggcagctcttgtcaatagatttgtgagagtccttgcagtaaaaacattttgtcatgcatacgtcttcatgtttgtttttcccgcaattaaaacatctttctttcnctttacagtttgtttttgtgtggccaaatctaagacagttatagcactgtgtcactggggcaatatatgtgtccactagtcttggtatgccataaaaaaacacag

SEQ ID NO: 4080 - DNA, 388 bp, Diabrotica virgifera
  Clone ID: LIB149-015-Q1-E1-H3
accaagcctccggtaaagccttaggaaaaaattttgatttaatggaaagcaacggtttaattaaagaacagtggttggtaaaagaaactttacaattaaactgcgcccaaaaaagcccaaatccccgaacctagagtttcacggataatgtacacctcagcagataggtaggaggccctgacataatggcacaagctttgtacatgcttttagaggttgacaagtataatttaaaacatgatctgttgcaacacgatgtgctgtgatacctcgtacagtgttgcgacggcccagtttgcatcttttcactagtaatccacgatccctatcatacatatatcctggtctaccaaaaaatttgtcaagatgagcattgccactttcacga

SEQ ID NO: 4081 - DNA, 293 bp, Diabrotica virgifera
  Clone ID: LIB149-015-Q1-E1-H5
cacacacgtccgatttaatttattttaatataatattttatattataagtaaaagtaaaatatttaatttatatgataagtgaatagtatatatttgctgaattagtagatgaagtaataatttttttattatattagtacaaaatattatattctatgttacctgtgacgctatgcagtggacataggtattatatatattatataatatattatatattattcagatttcgaaatattagctagaagctatataaaattatttatttgttatatagtaaatatattataat

SEQ ID NO: 4082 - DNA, 416 bp, Diabrotica virgifera
  Clone ID: LIB149-015-Q1-E1-H9
ggaaagttgcttttgttaattggtgtaattgcgtgaaagatggaggtagagcaattgtgtcttaaggagccccagtggatactggacaggaaggattccggtcctctcttttggagaagagactcgtcggaaactgccagagtaaaattccgctacgaagttgatatcaaagagttccaaagaggtgaacacgaattcgaggaacagttttggccagaaccagactctccagtaatatccaccagcatgagtgttatgttctgcattacggtaacagtcatcctaccatggctgttgtttgcacagaaaggtttctaaccaaggttagattgagagatgagttaaatcgacgatattagaagaagagatgaatttcacgtcagccaatgacagggagtgcgggaattaccaataac

SEQ ID NO: 4083 - DNA, 411 bp, Diabrotica virgifera
  unsure (1)..(411): unsure at all n locations
  Clone ID: LIB149-016-Q1-E1-A1
gatagaggccagtctgtatacgatgaatccgaatttacggatagagcagaaggcggcagtcaaaatgaagatgaacatcatacgtcttttgtgtctaaagcagatattacaatagatgacgataacgtagaagatgcatcactgatgtcagtatacagcaacacagaacaggaagcagaatacacagagagatatgcatcactaccaagaaaaatagaaaaaataccagatcctgacccaaggtcttcagaaaaaattagaaacgattacacgaactacgaaacagtaaataaagtggaagatgacgataaggaagctgaagaagtgagactggtacaaaagcatttttcaggtagttacagtaaacgggagaaagaaaaatggaaaaatgccgtanaaatgaaaaaatat

SEQ ID NO: 4084 - DNA, 399 bp, Diabrotica virgifera
  unsure (1)..(399): unsure at all n locations
  Clone ID: LIB149-016-Q1-E1-A6
tacaaattttatttaaaaaatttatttcgcggtcgtatcaaaatcggcggttgcttcaaacgttgtttctgatagaacggttaattcttctagacaaaaagtgctaataaacatttttgttgaaaatcatctctgctagatttcttgtttgaaacattttttctaaggcgtacagattcttggtaaatcgatttaccctcaccccttatgagagaggttttagtataaagcccgggagtaagagtggcaataaattgacatccctagcataattcagcttgctcatgtgatttttataggtccagtggtatttttgtctctagcgactggaacatgtgantattttatttaacaaatacggtttatgtttgttttttatgtaaatttaagattataaag

SEQ ID NO: 4085 - DNA, 114 bp, Diabrotica virgifera
  Clone ID: LIB149-016-Q1-E1-A7
ttgcaactccctaaagtgagtcgtattatatttgttagcactctgtctacacataatcgtctgtagcttcctaatattattcagtttgaagggttacctcatcactacgcgttt

SEQ ID NO: 4086 - DNA, 66 bp, Diabrotica virgifera
  Clone ID: LIB149-016-Q1-E1-A8
atcctgctattactcggtcgacgcggaatcgtccgtagcttaacaacctgaagcagtttcaaggat

SEQ ID NO: 4087 - DNA, 376 bp, Diabrotica virgifera
  Clone ID: LIB149-016-Q1-E1-B11
cattaagttcactaaccttgtttcaacccttgttgctcatgcattttctttcccgttagttcattatccatgtgttagattcattgatatttgcattagtggagatggatttttgacccgtgagtgggatggatgcataccttcctgctcatggttgggaaatttcgatacttctagcagcgtaccagttgcctcatgagagagatctggagtgttcagggttgattgtttgtcatgatctggtatgtcatggtggcgtgtgtgcttatatgtgcgacattcattaaccataggtagtaactatcactttggcataaggtattggtaccgcatcattcagtaacagttttaaggatcatctagttgcgcttgtttc

SEQ ID NO: 4088 - DNA, 429 bp, Diabrotica virgifera
  Clone ID: LIB149-016-Q1-E1-B2
tgcccacgcgtccgaataatactaagaagttgcagaataagtctcgtaagaataaacagagtgtgttacctgacaatataaaacaacgtactgactcgtttacttgaaaatctctttagcataatttttatatattttattgttgcagggcgttagcaagtataatttatagtaatcgtcatatcttgacaacccctgcattgtttttatcgacaagatgtgatagaataaacattagtaacgtaattaataattactcagctcaataacgaactattagtgaatttatttagattgtttaagacttttatatagtaaaaatatacattcctcatcacatccagcgaagggcagtgcctgtgagtgtataccaaaatatattattttaattattgtaattgtaatttgttgcggatactgcccttaatg

SEQ ID NO: 4089 - DNA, 301 bp, Diabrotica virgifera
  Clone ID: LIB149-016-Q1-E1-B4
cccactcgtcagccacgcatcagctgacacctgggttcttgtcacagttagtacagtttttcgcatccatggcatgagtgtcaaccaacgtgcatgatgctggtctgactcttagcgtgtcatatgaaaggcaatgacatgacagtcaacgatttattctatgacagcaatatcgttcagaatcggggatcggaattcatcataaaatcggacttgatgcacattaaatccagtgaatcttcacgtagcgcagttggaatagtcacactgacctgccaacatggtgatcagggatgttata

SEQ ID NO: 4090 - DNA, 417 bp, Diabrotica virgifera
  Clone ID: LIB149-016-Q1-E1-B5
cccacgcgtccggttcaattattcttctactattagttggacaaagttcagcacttataccaggtctattgaagggaattttggacctaatccttggttcagtttcttcgaaaataattttaattccgtccgctaatatttccattccaaagaatttacaagacattataattggtgacttaaatttaacccaatttcatgtatatggattagacactttcaaatacaaggatgatgtttacaaattggacacagatagaaagtcatttacaaggaacagaatttctgttaatacaactctggataaactaggattggaaactgagtatgttttggatatgagtttactagatgccgttccattgtatgggaatggaagatttacgttagaagtcacaaaagtacgaatggatatta

SEQ ID NO: 4091 - DNA, 412 bp, Diabrotica virgifera
  Clone ID: LIB149-016-Q1-E1-B6
cccacgcgtccggtgacgcgtggcctgacgcatgggcagaaccatgttctacgtattcttaatgtacatcgattcgaagtggactttgtcactactcataactaacattatcttttgccttatggataatgactatatttacttaatcgttccagcgattcaaacagacaaatattttattgtacagtgtcttatattggtaatgacgtagatgaggaggtttcttacatgctaattttggaaaatggaaataggtcttgctcgcaccaactacaaattaaaattcatgtaacgacaccacttgaaaactctgatttaaagaatattttatatgatcctacatcagtagtagccagaattgaaattttcaacaatgaggatgaggtattagagtttagtgatcctgatgatg

SEQ ID NO: 4092 - DNA, 56 bp, Diabrotica virgifera
  Clone ID: LIB149-016-Q1-E1-C1
tgaaatgagtcgtattaaaaaaaaaaaaaaaagggcggacgcacaagaaggataaa

SEQ ID NO: 4093 - DNA, 417 bp, Diabrotica virgifera
  Clone ID: LIB149-016-Q1-E1-C5
aagaaggttgataacaagccgcagtaatttgtggatttgttttgaataattttatcatatttgagttttaatttggtcagggttatagtggatttgaaacgtgcaattaatacttattttgtatgtaatttaaataaaataagaagtctgtacatattttattagccattcaattattatttcttcgtagtagtttcttctagatgacatttggaattggttcaatagtgactctttcattttctgatgctatatagatataaaagtggaaccaaccctgaaaacagggtacgtctccatacttgttccatttcgtgaatttttagtcacactattcgattattgacttgtttaattaaaagcgaatctattttttttttacacaaaattactgtccaaatagaataccattaattc

SEQ ID NO: 4094 - DNA, 97 bp, Diabrotica virgifera
  Clone ID: LIB149-016-Q1-E1-C7
gacgcgttgttcaatgcaaccccctaaagtgagtcgtattacaccgctatcttttattgatttgataggaaaattttatgcatcgatagttacttag

SEQ ID NO: 4095 - DNA, 322 bp, Diabrotica virgifera
  Clone ID: LIB149-016-Q1-E1-C9
tatagagagtcgtattaatcgcagccaacaatctgaacgtcactgctttgtcactcaacaatcattgggaagactttaaggtcaaacactggttagcttacaacaacccactcgaggatagggtccgcatttcagttttccaaaccaatctgataggcatcatcgaacattggtgcaaagacactatcaacgtcttgtccgttcactacggaagtcatgcagttcgctgacatgacctcggaacagttcatagccactctcagtgagcatgcatagattatccctatcatcattacaactcttcatgttcaagatgtaaacg

SEQ ID NO: 4096 - DNA, 454 bp, Diabrotica virgifera
  unsure (1)..(454): unsure at all n locations
  Clone ID: LIB149-016-Q1-E1-D10
ctgggagtaccggatgacactgtgaggaagtgtgctgccggttgcttaggtgccctctgcaagtatctaccaccggatcagttggagtccactctattcgaacatattttatgtgatgatagttcagctaacaataccctgaaagaaggcagaggttcagcactaacggtggctttaaaagaagctgctgtaagtttatgggacgagcaatacagagcaaagttgattcaaacgttactaagtcaattatcttctcaatcagtcgttatcaatcaaatcgccatacgatcctgtggttatctcttacagtttttgttgatgagcgaagaacccattcccagcaacctactggtaccattcgttagggctatgaacaacaatagcaacgacgtanaacaacttctagcgagggtatcattccacttggccaaaataattcccccagaaaagatgt

SEQ ID NO: 4097 - DNA, 280 bp, Diabrotica virgifera
  Clone ID: LIB149-016-Q1-E1-D11
ctctacagtgagtcgtattaatacgtgtgagatcattagcttaccatagcgttctgatgctgcatcaggatgcatctccggatcattaggagtccgatctataggatctcaccttatgtgacgcccattgagcacgtaacattcatgacctccgtacaagatgacgtttattggaggttgctcacatttgcagtgatgttggatatggctcattacgcagagcatgacatgctcatggatcaccaattcttgttatctcttaatctgtcaatattagtca

SEQ ID NO: 4098 - DNA, 420 bp, Diabrotica virgifera
  unsure (1)..(420): unsure at all n locations
  Clone ID: LIB149-016-Q1-E1-D2
atactataacggctgaaccgtctccattcacagtaacaactgaaccgtccccattcacagtaacagctgaaccgtccccgttgacaataacaaaagaacccacaccatttactataacagctgaaccgtccccatttacaataacaactgaaccgtcaccattcacgatgacaaccgaaacgtcccctttcacaataacaactgaacagactccattcacaatgactactgaaccgtccccattttcaatatcaactgaagagtcgccattcacaataaccactgaaacgtccccattcacagtaacaactgaacaaacaccattcgcagtaacaactgaaccgtcaccgttcacaataactactgaaacgtcnccattcacaataacaactgaaaagactccattcacaataacaactg

SEQ ID NO: 4099 - DNA, 190 bp, Diabrotica virgifera
  Clone ID: LIB149-016-Q1-E1-D4
acaacaccctctagtgagtcgtattaactcgtctcagctcattgtagcatatgtagatttaccaagcacagtaccatcagtccgggccacctggcgaccaaaggaaaagcgtctacgtctatgagacgaattcgggaacactgttgtgacactggttagcagaggcatgtccttctgcgttcattatcga

SEQ ID NO: 4100 - DNA, 427 bp, Diabrotica virgifera
  Clone ID: LIB149-016-Q1-E1-D8
atatcaaaacataaatcagattgaagctgttcaccgctgctgctgcactcactgttcccataactgctaatctaagttccttcgagcaatggactatctttaaggccatacatatcatatcgtacaacgttaatgtagacatcattcgtgtcactgtattccaatttatcctcaacgttgtctacgagcatattgctaatcactagagtgtttaacaaacctactatattggctgtaaatacattcgcacgattggtctatcgcttaattccagtccagtttggctcttcaaatggttatcaagccacttgaaaccttcaatggaaaacacgtataatatccattgtcaacgctgcaaatgaagttgataggagatcaagcgctgacctgggagtcaaggatctcggaatctgtggatcatgctggg

SEQ ID NO: 4101 - DNA, 325 bp, Diabrotica virgifera
  Clone ID: LIB149-016-Q1-E1-D9
gagtcgtattataaaaaaaaaaaaaaaaaaaaaaaaaaaaaaaaaaaaaaaaaaaaaaaaaaaaatagcaaacggaacgaatataaaagatacaaacatacgtaagcaatgcaaagataagatcctcacccaatcattaacaaccagaaatcatttcaaggtcatccgtcttttcattttactgggtggctcacaccggcccactgtccattacgcaccttacccggcttcatgcccctcctcctgttgccggcctgcctactaggcgggcggcttttttcactctcccttcggggaaaccccgcggttgtacaggtaatccccc

SEQ ID NO: 4102 - DNA, 257 bp, Diabrotica virgifera
  Clone ID: LIB149-016-Q1-E1-E1
atcatttgcgaccaattggaattgcctataagccagcattaccagaaaatcttgacacgataaatagagatactgccgattgataaaatttaacagaatattaggcattattaaggcaggttactgttaataagatacccagataattctgcaactgtacaagtgtcaaaagaagaaatataaaaaataaattaaaaaaacaaaaaaagcacaaggaagaaaatacttaccccgcaccaacaaacgtaaaaataaaa

SEQ ID NO: 4103 - DNA, 397 bp, Diabrotica virgifera
  Clone ID: LIB149-016-Q1-E1-F1
tggttctgctacataaatgcaagaaattcgataatttttgtgtggtgttaattttaaagttgttataactttcttccaaagttatttagtgatgattttgacaagtataactactatatcatatttagttttttctgattcgtctactatgttattaaagcagcttctgtttatctgtattcgttacaaaaaactctggatttagtactaaagaacactaaaccacgtttggtttatttttgaattagtattgtttggtactaaattccgatggttcacataatactgctactaaaattgtaaattatattttataagtacattacagtcattgatcacattaacattcacttttttattgtagatttctggacaaatatattttattagtatcagt

SEQ ID NO: 4104 - DNA, 145 bp, Diabrotica virgifera
  Clone ID: LIB149-016-Q1-E1-F3
aacaccgtaaagtgagtcgtatataaactcgtgtgatactctctgtgggatgttacgaagtcattagtgagtttacgtgcccccacaaatgcttcttcagtaggaagtttgggatcaagagtacgacgatgggtcagggttcaca

SEQ ID NO: 4105 - DNA, 453 bp, Diabrotica virgifera
  unsure (1)..(453): unsure at all n locations
  Clone ID: LIB149-016-Q1-E1-G11
gtacataacattgtattatggaagaacgagatttagtttctaatagacgcagatcattgcataactatggcgaagagaaacctgtttgtcgaaaatttccggataatgatgaacaaaatttccaatatcctccagattatatccacaaagtaaatacagaaacggaaaaatggaatgctcacctcagtaacatcttagtcgaccaacagaggtacaaagaaaaaatacgtgaacttaaaactgtagtgtacaatgaaaacgttttgtcacatgatcagcaggaatttttaaaatctatagactttaatacatacttgagacaaactgaaatattttgtaaaaaggtgcatttagccgcagaactatacagtttcaataaaagtgaaaaatatcaagagttacagaaaaccattgaacatgttcaaganatcattgatagtanactgaagacat

SEQ ID NO: 4106 - DNA, 164 bp, Diabrotica virgifera
  Clone ID: LIB149-016-Q1-E1-G3
cacgggtcgacacaagcgtctaaacagacgtctgaaaaaaaaaaaaaaaaaaagaaaaaaaaaaaaaaagaaaaaaaaaaaaaaaagaaagaagcacaaaaaagaaaaaaaaaaaacatacaaatgcaagaaaaaaaaataaatctgggaaagagtcaacaaag

SEQ ID NO: 4107 - DNA, 52 bp, Diabrotica virgifera
  Clone ID: LIB149-016-Q1-E1-G5
atttcttagtattcacttgtggttaggtcggagcttcagctccgctcgcagt

SEQ ID NO: 4108 - DNA, 428 bp, Diabrotica virgifera
  Clone ID: LIB149-016-Q1-E1-G6
ctgactcgtctagtttttatcatgttattggggattttccccattttatagaaaagagatcagatcaaagtatttcataggttatatataattcgatgtaactaagccctttagaacaaacaaaaatgggaggaacacattcaaaccccccaaaatggctttggagtttttagggggtttgaacgtgtttttccaatttttgatacagttgaagtcctacagttacttcaaattatatataacctataaaaaccttgatctgatatattttgaagttgataaaatggggaaaattcttaaaaaccccataaaaaacagtttttcgaacttatgaagatggcgcaccttacggaaaaatctgaaaaaaatttgaaatacagtttttgataaaaacacaagacaaaaaaattaaatctgctgcaatctcc

SEQ ID NO: 4109 - DNA, 254 bp, Diabrotica virgifera
  Clone ID: LIB149-016-Q1-E1-G7
acggacgcgtccgcccacgcgtccgaaaaaaaaaaaaaaaaaaaaaaaataaaataaaaaaaaaaaaaaaagaaaaaagggggggaagatggaagggtatagtgaatacattagggtggatggaagattagattcaccgttcaaaggggggggcgagggtaattcaatggggtttgattttggagttcctgtccgggaaaaacctggggtttgccaaccttatccccttggatggtagcgggcttttccttgat

SEQ ID NO: 4110 - DNA, 280 bp, Diabrotica virgifera
  Clone ID: LIB149-016-Q1-E1-G9
cccacgcgtccgaaaaaaaaaaaaaaaaacaaaaaaaaaaaaaataaaaaaaaaacagggtggacgcactatgaggttaatcgccttcattaagtcttgcacgtgatttcatgtcgcttctatgaggattcggaacttcttatcggtggccatcgcttttacttagtcgtgactgggaatgccctgagtcttactatcattaatcgacttgaagcatatcctcattactctacatggtgtaatatttaataggcgtctagtgatttccattctgacaatt

SEQ ID NO: 4111 - DNA, 411 bp, Diabrotica virgifera
  Clone ID: LIB149-016-Q1-E1-H3
acgacgatgaaggtattagttcttctttctttagtcgcattcagcgctgctctaccaacacttcttggtagaaccgctctggtcaaagaagatggaactgttactctcaccgactctagaggataccaactggtaatcctcaagagtgttaccgatcccagacaagtcgaagttattctcaggagtccaaacacaagaacccagatgttccaagttggggaaccacttagaactagagaaactatcgaccgtactctcgttggagtttcagcttaccaaaactacaaccaagctgatattcttactgatattttccgtcagtatgaaggtactcttgacgacaccaaatactacagccttcttaacagaatccaaatgttagttgaagctggactcattaatgaaaccatc

SEQ ID NO: 4112 - DNA, 416 bp, Diabrotica virgifera
  Clone ID: LIB149-016-Q1-E1-H6
cggacgcgtgggcggacgcgtggggtcagaaaatgcacaataactgcctcttaaaatttaccaagtttcatttgcatatctctattggttttggagcaataaatgggtcgtcggtttgtaagaaagatttcaacatcccgtatctcggaaactaagcacttcaggacatatgtttataaagcaaactgtcgttattttttcatgcggaattgccccttaacgtgtgtcgcacttaattggaaacaccctgtattgatgaagaacatggccagttgttaacgtgattaacttttttattgtccaacgtaaacgaatggatcaacaaataaggtgttaagaaggcctaaggctgcagttgagttttggttccaatattttatcgatgctaaaacattccacggagtgttgcgaacttt

SEQ ID NO: 4113 - DNA, 357 bp, Diabrotica virgifera
  Clone ID: LIB149-016-Q1-E1-H7
cccacgcgtccgggaatacgacggtacaagcgtaaggtcactgctcaggcaactcatcattcccgaagtttgaatgagtgcgaattcgacaatagggctgatctaacattaccttgccgtcttgtcacaagtcatcgacatgttcgttgttggacaattattgttggatttttgcattaatatcaacctttcactgtacgacagtacatatttaccatttaatcacattcagccatattgttgcaaaatcaagattatcacatctttctaccgattcaaatttaactccagctaaaccttcagaaaattgtaatacttttgaaaccacatttggtgtcacatatcatataatcacca

SEQ ID NO: 4114 - DNA, 344 bp, Diabrotica virgifera
  unsure (1)..(344): unsure at all n locations
  Clone ID: LIB149-019-Q1-E1-A2
cngacgcgtgggtgagcttgattaaatcattttggnaaaaaactacagtatacacgttcccaaaatattctttcagctgaattatacataaaagaacatcttgacaagttagcatacccagaaatcacattattgttcaaaacaatcattgggcaaacatgaatagttaattttttgcaaaatggagtttgttaggccttattaggttttccttaattttaaaaacttttatacaaaaatagaactttgtgttacaaaattaaaagttatgtgatggcacaagaacgtgtttctttatattctgtagaaaacaagaatctacagacccggtctgtttaatacct

SEQ ID NO: 4115 - DNA, 336 bp, Diabrotica virgifera
  Clone ID: LIB149-019-Q1-E1-A3
acaatttggctagagatctgactgtctgccccaactcagacaaagcaaccaaagctgtatacgacaaagaagtagcaacatccgttgtaggaagcaccatccgtgttagagtaccagacagcttgttcttgaagaaaccaatcacctgcattgttattgtggacaataaccacagcgatagcgtacctgaagtagaagatggtggtgttgacagtacatgggtgaccgtaaacattgctcccgccattaccgaactgctcagctacagaatccaagtgtacaccaatgaataaatatagattattgtaatatgtctgaattatgtaaagtggtgct

SEQ ID NO: 4116 - DNA, 355 bp, Diabrotica virgifera
  Clone ID: LIB149-019-Q1-E1-A6
aatcaactagacggtgatgtgttcagtaattgaatgtaaaatttaaaataatgttgaaattaatcaccttcatattcataatagtgaccgtcaatgcagcagaaagaatcaacaataatttaatttataaaaatgtggatagaaccatagatttaacgtcacagttagtaaaaatcaccagcaccataactcttgaaaatgccggcgcagaccctatcaagaattttctactggcggagcaaccaaatttagttgggcagatagcatttaaaggtgccaaagactctgccaagcaagatttaaacgtcttaacagcccaagtagaaaaccagagtgataagagattccacaaagt

SEQ ID NO: 4117 - DNA, 384 bp, Diabrotica virgifera
  Clone ID: LIB149-019-Q1-E1-A7
aggccgccctttttttttttttttttttttttttttttttttttttttttttttttttttttatccatagcccgcgataaggaagatttgcttccaaaaaattgcattataaatttagtagctatgcttcttttcatgagcatttttcagtgcgtcacaaatgatagaaaaaaaggtaagtccgtgataatatacattctagtgacatgacattttagttaaatctgacagttatcacattttatttgcaattttgcataaaatcaaatcaattgtgtttattgaatttataaaatggtattttctttgatttgtatagtcttataaattgtacggatcatattcgtagatatattatataattcggaaataaagtatttttcg

SEQ ID NO: 4118 - DNA, 369 bp, Diabrotica virgifera
  Clone ID: LIB149-019-Q1-E1-A9
acccacacgtctgcacaagcgtccgcccactcatcggcgcacacgtcaggcatagttgacggcttcggttcccgatcattgcgcaacacatggatgtattagcataggcgacattttggtagagaacgttgtcccaatagtacatatctgtcatataatatactactaatctattccactgtcactgacatctgctacatgcattctaatcgatcgtgttgtttcacagtagcttacagcacgtttagagagagcataggaagtgtgttcactgagataccagcgacggatgttgtggaagcgtatatcaaaattacgacagctgagttaagcacagattcaacagtaaatttgctgaaatcatgtggg

SEQ ID NO: 4119 - DNA, 364 bp, Diabrotica virgifera
  Clone ID: LIB149-019-Q1-E1-B3
acggatacttttatctatatcttaagtttattgatctgaggtgccaagcaattgtccaacattgatcaaaacagttccgtaaattaattaataataaaaacctcttaacctaccaccagcatttactgctgatagtgcttgaaaattgttattacgatttagtctctatttaccaatttataaaaataatactatttcattattcacacacatgcacaaatttttgtaatgtcacttttaaagtttacgatatatgaagttcattcttctattttttggttgcaaagttttcaatgactttataattaaaattatcaatacaatttacaaaatgcttttctgcagatagcatacctaaagcact

SEQ ID NO: 4120 - DNA, 372 bp, Diabrotica virgifera
  Clone ID: LIB149-019-Q1-E1-B5
acccacgcgtccgcccacgcgtccggataaattaaagattggagttgttggtacagggatgataggcgccgaaatagtaaaagttttggttgaagctggttatacagtaaatatgtggaataggacattagcaaaatgtaaacagttagagaaagaattagggaaaggagagcatctttccgtcttactgactgctagaaacgtactcgttaaatctgatgtcgtatttatgtgtatatcagatagacaagctacaaaacaaatggtagaaaatgagttcgaagcttctatagatacagaaaatttgttaaaaagtaaaggtattttaatgatgacgagtattgacacaaatgaatcaaaggaaataaacga

SEQ ID NO: 4121 - DNA, 358 bp, Diabrotica virgifera
  Clone ID: LIB149-019-Q1-E1-B6
actaaaatctaaaactcaaccatcagatatcgaattttatcaattttataggaggtatgtcaaaaatatgaatttcgctaaagagtaaagtacctttatatttcagaatataaaaaattgttattatgaaaagttgtttcgaattaaaaactatgttttaatatgcaactaaatcctcccgaagcacccaattctggagtagaactttttgatatgttgtttattaaacatttcttaatcaaattacagaaagttctatcttgtgtgattttttccgaagtctatttccgagtgactcccctatcgctgggttatgttggttcgtaaatttagttgcgaaattagacagcgaatcttg

SEQ ID NO: 4122 - DNA, 344 bp, Diabrotica virgifera
  Clone ID: LIB149-019-Q1-E1-C6
attgtttaatgctaaggagtggctaaagaagaaacttcaaattttgacttctatataagtgcaataatatgcaagttagtgcgttcccaaatgacgagatctttatcataattatgagagtaggttggtttaggacaactatctccaactaactaggtacatagtaaatttagtaattatttttttgtaatgttggtaaaattgtgatatcgactagatatgttggaagtttggtacaaccaggggcgggtattcatagccaatactaattgtaacttagaagtaaaaaattatccataagcagttttttaacattaactgaatcgattaaaacactaaaacaa

SEQ ID NO: 4123 - DNA, 367 bp, Diabrotica virgifera
  Clone ID: LIB149-019-Q1-E1-C7
aagatttttaataattctcaaatatttaaatcatccctgactaaaaagtaattttgaagaaggaaaaacgtatctggcagttcgtataattagttttaagtgatatatttgttgttaatagtgttgttattgagagaattatggttgagaaaaaggctgtacagaagcccgctggggatgcaccaaaaaaggtgcacaaaccaggaaaacctagaaactatgatttgggaaatggagtactcagattctctaggtctaaaatgttccacaaaaaagcattatacaaattcgttggcaagaaagtagaagctaccaagaaacctcaaaagccccaggttattgaaaaaccaattggtggagagaaaaa

SEQ ID NO: 4124 - DNA, 400 bp, Diabrotica virgifera
  unsure (1)..(400): unsure at all n locations
  Clone ID: LIB149-019-Q1-E1-C9
acatgtgcggcattacgtaccgcagtgtgtccactcatgtaatggtagccaagcggggatttttgcagtaactcgagcgcatcagattctcatatggggagaaacatggtaccctgtagatgtacctctaccatatattggctctaaacacagcggagttcgttaagggggtccgaaaaaaatctatccttagaaaaactcgaaattgccagattaagataagaagcgggagttgatctgagaaggtgttacgtctcaggaagaaagtgcatcagtcaattgaaaaatataatcaatacgacggaaaatgcagtgaatgcattgcaatctacggccaaaagggtactggaacangctaataaaatggttgtggaaattaataatggcagagggaacaaag

SEQ ID NO: 4125 - DNA, 348 bp, Diabrotica virgifera
  Clone ID: LIB149-019-Q1-E1-D1
tccacattgtcttctgtatggccagacatccaggctgatagttctgatgacgagagcattgattctgaaaatgaagatcttttaaagcatgccaatgtatatacagccgaagaaattactttactagctagagataaactaataaagttgcagtcattgtatattgaacagtatagatatctacaatatttattaacaaagaaaagaagaaagtatttgcatttgttgaaacgagagaaagaaacatgttgtaatatttataatcaagtgcgtgataacccaaaggaacagagattatataaaaaattaaaagcgttatataactatcaaaagtgccatggtactgat

SEQ ID NO: 4126 - DNA, 412 bp, Diabrotica virgifera
  Clone ID: LIB149-019-Q1-E1-D11
aaacaaacaaaaacgaattgtccaaaatgctgcttaaaattgtcgtcgtttgctgttgcatttcaattgcactcagtcaagctgttggaaaatgtcccagtgtagatggtagatatccagtataccttcctgatgcaacatcctgctcaacattttatgaatgttctaatggaacaccataccaattcaaatgtgcgtatggaacatatttcgacagccagagcagaatatgcagacataaacgagacgtcaattgtggcagtagaaggagagattagtactctagttcaaaaaatgtaaatttgttttaattctcgtagtacctgtgatacacacagtttttgtattatgttaaaaattaaaaaataataaaaaagtgattacatctaaaaaaaaaaaaaaagggcggccg

SEQ ID NO: 4127 - DNA, 153 bp, Diabrotica virgifera
  Clone ID: LIB149-019-Q1-E1-D4
acaatgcttgccgctaaagttgtcttacttttgggccttgcccttttcgtctcagctggtcaagatcttgacaagggcatggaaattgtgaaatgcgcccagcgagcaataagcgtaggagtacctgaattaggagtcccatcacataatccc

SEQ ID NO: 4128 - DNA, 332 bp, Diabrotica virgifera
  Clone ID: LIB149-019-Q1-E1-D8
tatgactgtgccaaagtatataaacaatgcgctagaaatcgccaaagaagacgggcttctacaaaaaataaaaatcctcaaaaaaaaaaaaaaaatgaattatatacaaagaaaactcaaaacaaaaaataaaaccaacaatgattcaacaataaaataaaaaaggatactgcaacacctagataaatacctatcataagtcaaagtggggggccgccttaggggttccatgttaacttgcccttgtaagctagttcaaactccttccaggggttccctaaaattcatttcatgggccttctttttaaaacctcttgtcgggaaaacccctg

SEQ ID NO: 4129 - DNA, 362 bp, Diabrotica virgifera
  Clone ID: LIB149-019-Q1-E1-E6
acggacgcgtgggaggatgtgttcgaacagagaatggaaacactaattacataaacatagaacgaggagtgcatcaaaacacttttgcattttgttccacctattatgtaatgtatatgccgaatatgtaatcagagcttctcttaaagatcgccctgaaggtgccataattaatggaatcatcattaacaatgtaatatattaactatttagatgggaaataagccacaattaaattgaaaaaaaataattttattaacgtttcgactcccaaatcgggtgtcgttgtcaaaatacaaaatactactaaattaaacaaaaatgttgttccttagtaaaaaattcttctaataaattattta

SEQ ID NO: 4130 - DNA, 354 bp, Diabrotica virgifera
  Clone ID: LIB149-019-Q1-E1-E7
acccacgcgtccgcaaccaggctgatgttcttgctgatcttttcagtcaatatgagggtattgtagatgaccagaccttctatagtttgttgaacaaacttcaacatttggtacaagctggagtcatcaacagagtagtcttggatgttgtaagaaactgggatcagcaaggtgtacaaggtgttagtgacattgtctctctgcaaggactctctggttatggcaacttccaaggacaatcaagaggatattccccactcagagagatcttaaagaatggagtacaaggaaggagcttcaatcaacaatggttgaacaattccccagtccaatctttgcagaccatcttgcaac

SEQ ID NO: 4131 - DNA, 388 bp, Diabrotica virgifera
  unsure (1)..(388): unsure at all n locations
  Clone ID: LIB149-019-Q1-E1-F1
aactatggaaacttaagttaagttgtttccccttgtatggaattacatgcgtgtcttgtggtgtgataagaaaccgttgataaacttcccttgtcaatgtgatctttcataaacgcaatctgagaatttttaaataaacttacagttatatgaaattatcgtccaacgatcttgatttttgtaaaataatctttggtgtatttactgtcactttgaataaggcgagcgtttgtatacagagatatacagtgggaatgatgttttttttatcgatcaggtatttaagtttttttatcaaaatagaagttttataaccaagtttttttgtctctaagatcggctagtgtgttttttaatatcaaatgttaaatttanataaaatatttta

SEQ ID NO: 4132 - DNA, 411 bp, Diabrotica virgifera
  unsure (1)..(411): unsure at all n locations
  Clone ID: LIB149-019-Q1-E1-F12
acacaatagtgagtcagactcattggattgccatcatcaatagctcctcttttaatcgtaacaaatgagaaatttgcgactcgagttacgaaacttgacttgtatccggtagaagctttctctttggattgagattccagaagttccgggaaaagagattcaagcacagaatccaccaggaaaaagatattcctgcagagcagctgtgggccaagagtcaaagaatgaatttggcctagacctagcgtcaaagtaaagaattgaagcggaagccgacttggacttaaacttagttgagagtggtctcttttttaatctcgtatgtatctcctgcanggatcgggctagttgcattactcgaaaaggaagcataatcggaagaacctgtcgtgtagtgcctgcgtctattgt

SEQ ID NO: 4133 - DNA, 431 bp, Diabrotica virgifera
  Clone ID: LIB149-019-Q1-E1-F3
acccacgcgtccgatcgttaacttcaatcaaaacgcagttacgatttcaaagagaaggtgaaacattgtattaaaattaaagtgaagtaaaataaagtagaacaatagcattgtgaatcgttgagaaacagttgaaattcgaacaagtgatctatcattttcattatggcgacagaatacgtgcgtttcagcccaaacgcatttctaaattcgtttaatgcaaaactagaacaaccagtccgacaacatctcaaaaatgtatacgcctgtttggccatgtccacaatgtctgctgcccttggcgcagcagtccatctcttcaccaacatcatgcaagcaggatttctatcagcaataagagctttgggaaacctctttccctcatattacacacacccgatgacaatggcaaatcaatgacgacaagagta

SEQ ID NO: 4134 - DNA, 156 bp, Diabrotica virgifera
  Clone ID: LIB149-019-Q1-E1-F5
tacacgcaactacactgagtcgaattaaacacaatggaatggtttcaacaacaactcatcattcattcgacgtagtgatagttcttgcgactcgtgagaggatatttgacttttatcaggtaaaaatttactctttggatcgtgagtggcagggat

SEQ ID NO: 4135 - DNA, 265 bp, Diabrotica virgifera
  Clone ID: LIB149-019-Q1-E1-F7
acgtaatcagcgatggtaaaaatccttaaatacgaaagtaatcccaaagtatatgaacaatatataccgttaaaggttcatgaccaccttttcggcatttggaaccagagtacatcgctatgataaatccttgtaatgtataccgagcgttagtatttccgactgttgtccaaaagcagttattggcgatgtaaacactgatcggctgggtgccatatggtataaaaatgataatttgcactggctcttgttaactggcgggtat

SEQ ID NO: 4136 - DNA, 445 bp, Diabrotica virgifera
  Clone ID: LIB149-019-Q1-E1-G5
aagtggataaagatcataacgttggtggtatttgccacttaggtgattgtttatgtgtttatcattaataatgttttattagttaataaataaagttttaggttttaaaaaaaaaaaaaaaaaaaaaaaaaaaaaaaaaaaaaaaaaaaaaaaaaaaaaagacaaccacacaaaaaaataaaaacggtacatccccctacatactacaacacacctcacccgtacagtcaccaaaatacccctcacaggccgtcactaaacaccatctcaccggccaaaaccctacaaccacccacctgaaacaccctgcaccacaccccccttacgccagttggaaaaaacccccacttggcccaaccccgcgtttccccccccaaaaccccccccccatctaacaccccaaaatgggaccccccccctcttaacggccaaattagcccccccc

SEQ ID NO: 4137 - DNA, 406 bp, Diabrotica virgifera
  Clone ID: LIB149-019-Q1-E1-G9
acagtttacatgtaccagtttagcattatcaagttataaaagttatttttacaacataaatactaacagaaaaaatgaaagaagatgacaaatttgacgtaaagtataacgcacaatcctacaatatatatgaatttttaaataaccatccgggaggattaaattatgtgcaaccgtacaaagaaaaagatgttacgaagccgatgagcttatatgaacactccaaagctgcctattaccttttagaagaatatacaaaaggaaaacgaagagcagaggaagacttagagtctttggtaaattgggacaagcccatgttgggtcaggtcggtaagttgggtaccaaatattacgaatgggtgacatcaccagtcgacagaaaccttagattattcggaaatcccat

SEQ ID NO: 4138 - DNA, 346 bp, Diabrotica virgifera
  Clone ID: LIB149-019-Q1-E1-H1
gaatacctgaattgggagttccacaacatgatcccttcgtcgcctttagtaagaacatatcatggcatggagacatcggtgttgctagcacctcaatcgacatcgacacattgagatggtatggtcttgccgactggaacgttactgctaagcaaatcaatgatgacgctgataatgtagcggtctttgactgggtcaatagatggcccgttttcacaatctccggcaactaccgagcaaccgttaaagaactgttccttacacagcattacaaaggaagcttcaaaatggtcatggagaaaccagtatggactggaaaaataagcgcagataaagtccaacccaa

SEQ ID NO: 4139 - DNA, 415 bp, Diabrotica virgifera
  Clone ID: LIB149-019-Q1-E1-H12
gcgtcaattttaattaaacaattaataaaaataaaaaaattttattgaccattcgtctattgttcccccgaatgcatatgtctgcaaattttcattcatttgcattgaagaaaagtcagtcaaattaacgtctaaagatttgatgcaaactattgaagtaaagaaaagcgtttaaaaaacgagcctgtaccgccattaacaagaacaaaaaaataaacttttttatcccattcctagattttgtgtaatcttcgaactactaaaattttttatttctaacaagaaatcgaacatattataactaataactaattaggcaacataaagaaattatcactgtcatagcctgcgtcagattttctctaatatgttctgtcatctttatcgatatctgttcagtgcagtagtgtgttaa

SEQ ID NO: 4140 - DNA, 355 bp, Diabrotica virgifera
  Clone ID: LIB149-019-Q1-E1-H5
ctccaagatgaaggtactcattcttctttccgttgttgccttgagcagctgcttaccagcatccagaaatcaacaatacgttgatgtagactacaacagctacaacgctcatcccgtctacaacttctggaggacttggaatcagcaacactatggacaagaaccatggaaccaatgggtacaatatggtgtccagaaccaacccggtaactactggaggcagtacgtgcaacgcagcaaccaagctgaaaatgtcgatttaccttggatgtatcactcttgggatgtccaggatgtgcaaaacttaactcgcgttcaacgtgttcagttgctactcaactacgtcagactttac

SEQ ID NO: 4141 - DNA, 321 bp, Diabrotica virgifera
  Clone ID: LIB149-020-Q1-E1-A1
gaccaacgcgtcggcccacgcgtccgccaacgcttccgcggacccttgggcaaaaatgattgcttttgcagtaactttttgtttgctggtaatatctgcacagggacaaattcctgttgaaagatgtccagatgtaaaaggagtggcaaatttcgacggatatgcatatttgggtaactggtacgaacaaggtagatatccaactttactggaagatcacggaagatgtgttgttaccaatattgcagtaggccctataagtagaactataaggagtcgtacgcaatatatcaattcagaaacaaatgagacacacgttct

SEQ ID NO: 4142 - DNA, 402 bp, Diabrotica virgifera
  Clone ID: LIB149-020-Q1-E1-A11
acggacgcgtgggcggacgcgtgggcaagaatttaggtttatatctttaattattatggcttctcacggaaaagcggaaactgaaaaactaaagcaaaatttggagaatcagttggacagattagtggagcagctgcaggatttggagaattgcaagctgaaattttaactgcattgagacaattaaacgaacaattgaccacagaggaactaagatttttggaacaacataaccacattgcgaaagcatttttagattttaactttatagaagtgccagatgacgaataaacggatttgatgtttaaatatgtacttttatacgtaaccaaatatataagccattgggtagaataggaagtaaatacgaaaagtgaatttttaatcataaataagaaacta

SEQ ID NO: 4143 - DNA, 353 bp, Diabrotica virgifera
  Clone ID: LIB149-020-Q1-E1-A2
aagcggctcaagaatttcacgtttttttggactttgccgacttctttgaacaagattttactcggacacgattatactagtttcattttctctgaaggggcctctaatttacttataatcataaaatgctaacttatctaaatcttgatacttttactaaatatctatataataatctctaaagcaactgactttacattttagttttgggtttaggttagtgattgacctctctcgtttcattactgaatactaaaataaactaaaagttaagttatgtgtgatattagtgcaacatttttcaacatttgtaaaacagtcactttatcggatttattatcaactttaagttt

SEQ ID NO: 4144 - DNA, 371 bp, Diabrotica virgifera
  Clone ID: LIB149-020-Q1-E1-A3
acgccacgcttacatagcgcacaagcatagattacgagacatcatcgtttaaccattatgtcgttggacctctggataaaaatgttaaaataaatcgactagggcatttagtttttaattaaaaactgtaataatgtactagcataaaaaaaaatttaaataaaataataaaatgactcatattgtctcttatttactaacccaatgcattacaaagagtgtcaatatatttttaaaaataaaaataagttgggtcgtacataaaatagaaaatgcaacacgattattatcacactgttaaaaataaataccagctacgcttggtcgtatataaaatataaatgacagctacgcttcaatggataatggtt

SEQ ID NO: 4145 - DNA, 363 bp, Diabrotica virgifera
  Clone ID: LIB149-020-Q1-E1-A4
agttaaaagtgtacaccacacattgaaacatgatgggtgtctatggtattctttgtaccctactagtggtattatgttcagctcattattgtacagcatattacaatgcctcccacgaatcatataaacttccatgtaaccaggaggaattagattaccgtgcatatccatatgactgtcacaaatatatagcatgtgaagataattctctggtagtcctggactgtcccaacattttcatttggaatgaagatcgcaaagcttgcgactttgctgcaaacaccgaatgccaccaaattccatttccagaacccgactgctcggatggcaaaaattcttactggagatatccctttgattgtg

SEQ ID NO: 4146 - DNA, 332 bp, Diabrotica virgifera
  Clone ID: LIB149-020-Q1-E1-A5
acccacgcgtccgtaaatgccgaagagtctccaagtctagcagctcttgcaccaaaatgtgaatgcggggacatccttgacaagattctgtgccaattgacagaaaactctaaagaaattctcacactcaatgtaaaactagtgtcaattagaaaagaatcaacagaacttcaaaacaacgtagctgagaacacgtgtctggttaactcgatcgaaacagacgtcacagtcattgaacaacaacagaaccaaactgtgaccgttatcaataaccatacagctatcatcgtcgacattgagacaaaactagaagtcatcatccaggaacaaaa

SEQ ID NO: 4147 - DNA, 350 bp, Diabrotica virgifera
  Clone ID: LIB149-020-Q1-E1-A7
aacatgaacggaaatgtcatcaatcttctagttttgttctcgtgcttttggttatcggcacaggcacaagtgcaagtttcaatttattatgagacactttgcccagatagcattgcttttattacggaccaattccatccgtacctataaggatctcaaagattacatcgatgtagaatttgtgccatatggtcatgcctcagaaacaaatatcactggacaatgggcatttacttgccaacatggccctgctgaatgtttcggaaacgctttccactcctgtgtacttgctctaaattccgacagaagcaaaacagaaaacgttgtccactgttccatgaacgcaaagg

SEQ ID NO: 4148 - DNA, 400 bp, Diabrotica virgifera
  Clone ID: LIB149-020-Q1-E1-B5
acgtcaggtgacgctggtcacaatctctcttcatgtcattatgtcaaagataaaatgtgcctattgttatatgttataacagattgcctaataaacatgtaaaaaaaattattatggaaaaagtcactaagtgccattaatgagttttaacgcatatctctacaaagtattcgtatgtaaaaagttactaagtcaggtatttttggctacttaatattttctgtagtaacgggttagtgatttttcaccacacagaaataatcatttagaaacacatttagcaagtagtgacttgtataatagacagatatagtgaatttcattcgatcggtgaaagtaatgagttttttcacaaagtgtcaattaatgacttttcgcccggaagacgaaatttccttgg

SEQ ID NO: 4149 - DNA, 327 bp, Diabrotica virgifera
  Clone ID: LIB149-020-Q1-E1-B9
cgcctatgaggcgaagacaactaatttgttttaacataaaatcaaacacaataaacaccataataatttttgacacagttcattactctcctaacgcaatgacttagtgggtctgttcctatgctttaacattttaacattgttttaattgtgacatatatttgtgtacttgtttcaaaactaaatttacgatggcttggtaagtcgattttcttttaaattgtattgtagctttcaataaataatgttttagtcaatccttgaaaaaagcatggatttcctgctgaagtgtcggataatatatcaataaaaatgtcataatatcat

SEQ ID NO: 4150 - DNA, 376 bp, Diabrotica virgifera
  unsure (1)..(376): unsure at all n locations
  Clone ID: LIB149-020-Q1-E1-C1
ancaagcgtccggcagatcgggctagatatttttgaaaaaactatcattgacaatggtttttaaagtatcccttttgtgtacactgatggtgttagttgcttattctagtgcatacgattacagcaattgtcctggaaataccaacagacacaaaaatctgatatacagctctttactcccatcagcgtatagcgcgaaaactcgtatcccagcaactggatattaccaaagacctatcacctgcttactgctaatcgatcaaaaaggaagcaccagctcaccaaaaattatagaaggtggatatctcgacacttttgctgtagtaaatatcacttccacaactgcgcaaccagttagttactatgcaatagtatt

SEQ ID NO: 4151 - DNA, 369 bp, Diabrotica virgifera
  Clone ID: LIB149-020-Q1-E1-C8
aacgaaaacatttcgtttataaattcgcaaaagtgtgtgtgttattgcgttgccgctcctgcaatactcagatcagatttatcgatgaattgttatgtagtctttccttcagaatccaaatctgaaaacggaatttcgatatttccaaccgtattcgagataatcgacctcaaagtctaaaatgtgacgttacaatcgttttaatttcttccgacacactacacgtccagctgaaatcgttgctattaagtaggctagttttttaatctcgatttgttaagcatagcataggttatgtacatttgagtttgacagttcgtgaatgtcaaactaaattttaaattaagtattaataaaacatcaatgaca

SEQ ID NO: 4152 - DNA, 379 bp, Diabrotica virgifera
  Clone ID: LIB149-020-Q1-E1-C9
cccacgcgtccgtaaagtttataattggtgtagcacgatgtataaaatgtattatagagaataaatcatctcaacgatgacttggagacgaatcgttggcacattattaggaaaactgacatccccgagaaggggatacaggttattgcatctgtggaattacaagtgcaggaacagttgataaagataaattacaaacctttcttaaacttcggtactgtcgacatcaagtatctaggaatcatgaggagtaaacctctgtaaaaaatccctaatactaaggtgtaagtaatcgtgccaatggtatggatagtactgatgctacagtactgctaacggtaccttcatggatattggcgaattcttggagtattaaaaa

SEQ ID NO: 4153 - DNA, 337 bp, Diabrotica virgifera
  unsure (1)..(337): unsure at all n locations
  Clone ID: LIB149-020-Q1-E1-D1
acccaagcgtccgcggacgcgtgggtccgcagcagccctattctagtgctcctggtgctcctcccggtggacatggccatcaaggatctcanggaccttacggagggttttcgtatacacagcacagtgctcctcaaagttatgcagctcctcgcaggacccaggcatacagttccgttttggtaagagaggcagacaaggctctagatgacgccacacgaatattcaaaaactgcaaggattacactgtggttaaaacagatcagtgtgtgcgcagtggaaatcgccagattgataaaattgtaaagagcgttcgacacaaataatacatctacat

SEQ ID NO: 4154 - DNA, 408 bp, Diabrotica virgifera
  Clone ID: LIB149-020-Q1-E1-D11
gtgaacttcaacaaggtttattgagccaacagcaatatttacctcaacaatatttatctggagaatatcttcttgaagatcaaatgaacactaatcaaatcttgaaccaaatctacagacagcaacttggacaatctccattgaaccgttatttggtaaacatgagacttgtaaacggacaacaagtatacgaagttcctgaagaattcgttaacgttcaacttctcgaacaactcaccgctaaacaagaaattatcaaccaaaaatggactcaaatgatggaaagaagacaaccaatcactgaagacgttcaacatcagcaacaactgattaaccaacagatcgaaagacttattgaacaattagcttaccatcaaaacctcattacacgtgaagttgaacaataca

SEQ ID NO: 4155 - DNA, 412 bp, Diabrotica virgifera
  Clone ID: LIB149-020-Q1-E1-D2
acggaagcgtggggaaagatttaagaaagaggttcgaaaaaaatcagcccaaaaataatatagtatccagcttaacggctagaagtttatcaaagcaaatgaaagaggaattacgaaattgaacatagaaatattcaacaattcgactgtgccactcacccgtttatcaatataccaaaaattgaaaaagacttcagcgatattacttaaatgtttgttttattcaattttatttatgtacatattgttttatattaatatattgtgttacttatcttcatttacattgtacttacataaagaattaaaagttaccattaagagaagtgtactccttctgcgttgaacgcatgtaacaacctgtaaagatataaaaattggtaattaatgggaataaaattaattacacttt

SEQ ID NO: 4156 - DNA, 364 bp, Diabrotica virgifera
  Clone ID: LIB149-020-Q1-E1-D5
acccacgcgtccgcccacgcgtccgaaatatttgaaaaacttggtgggaaccattacagaatcttcgtgaaaacaatatgcaaatattagtgttcaaatatcggtcagtggtctgcgacttgaaattaaactatatttatttcagaattcaatatttcgttgaatgtttattttttcaacttcttcagaaattaagttacaattaaatgcaaacataacttacatgcaatcatttataagacaagcaagttaagagacatcttttgcaatattttaaaattctgagaaactaaaaacatccggttcgataataaaattagttaaaattgcaaaaaataaatttgacaaagataagatgaatttt

SEQ ID NO: 4157 - DNA, 411 bp, Diabrotica virgifera
  Clone ID: LIB149-020-Q1-E1-E10
agcgtcgataaatatttgccggctcaggatgatcaagcttcagaagaagtttctgttcctgttactgaggatggtcctaaaggaaaagcgattagcacaattcatcacgctgacaggttttcaagaaagcttagaagacgcttgactcaaagaacaatcgccgaagtcaaagccctaaaacaccaaagtgccgaagcagtacacgttctcacatatgttctagaactgattgctactgatcctgtcctggcttaccaaaaaggaaaagatttgtgggctagtttgagccaagacgaaccggagaaccaggcaaggccagaaaatctcgagcagttgattgtactcttgaccagggaatctgccagaagagttgttcatctgattaatttctcaagcaccttgattagcaca

SEQ ID NO: 4158 - DNA, 405 bp, Diabrotica virgifera
  Clone ID: LIB149-020-Q1-E1-E11
cgcagattgaaacatgatgggtgtctatggtatcctttctaccctactagtcgtattaggttcagctcattattgtacagcatattacaatgcctcccacgaattatataaacttccatgtaaccaggacgaattagattaccgtgcatacccatatgactgtcacaaatatatagcgtgtgaagataattctctggtagtcctggactgtcccaacattttcatttggaatgaagatcgcaaagcttgtgactttgctgcaaacaccgaatgccaccaaattccatttccagaacccgactgctcggatggcaaaaattcttactggagatatccctttgattgtgccctattctgggagtgtatgaataaccaattgtatcttttgccatgccctgatgatta

SEQ ID NO: 4159 - DNA, 409 bp, Diabrotica virgifera
  Clone ID: LIB149-020-Q1-E1-E12
ctctttcctgaccttcaccggtagatactgaatattgacctatttcaaattttctgtttataacttaactgttatttactaaataaaaaaaatatggtgcagaaaaaagtctgggcagcgagcaacgacggtgcaatcgagtacatttcgttgacatcagaatatctcgaggacgccttggatgtcctgcggaaaagcttttatcgatatgaagcaggatgttttgctacaggtttgtcggaagacctcgaagctatggctgaaatggatagctacatgattgaagtggccaaaggaggggtgtccatagtggcagtggagaaagcaactaatattgtttgtggcgttgctttcaacaaaattcagttggaccacggaccaagcggcaaaaattattacaagaactact

SEQ ID NO: 4160 - DNA, 349 bp, Diabrotica virgifera
  Clone ID: LIB149-020-Q1-E1-F4
gggtcggccacgcgtccactaagtcataccttattcatgaacacccatatacggtttttgattcacctataaggtatttaatttgggcattacatcacctgataaaaagggacacctctatgattgtaagtttgtatgtatttagcgctgaatttcccacctctactacgttcaattctgtttgtctaacaacataagaagttttccatcttttgcgtaattttgccgctaactagagtgctcaacaatgtattactcgtataagtataggcgaatttcaaaagtttaaaattaatatatgtatgtattaatatattattcataaaattagaatctgatttaaaaagaa

SEQ ID NO: 4161 - DNA, 378 bp, Diabrotica virgifera
  Clone ID: LIB149-020-Q1-E1-F6
acccacgcgtccgatttcgaatcaagttttaagtttgggtaatcgattttttgaggtttgtggggtaagtgaccagaatttttaatgcaatttgttttcctaaggtatttgacaataacaaggtgctccatacaataatttaatcttgtaaagcagttttcggtatacatagaaacgtatctttatcaacataatatatcaacgtgtaataaaaaaacaataagtaattataaaaatagattttattgatatattaggatttattgctagttcaagtgagacttaatgtttattttgaatatatttcaactttattaatataaaaacatatactgacatgagtacctgatgtgattaattaaaatctccgaattgccc

SEQ ID NO: 4162 - DNA, 412 bp, Diabrotica virgifera
  Clone ID: LIB149-020-Q1-E1-G10
aggaaaaataatttggatgaccatctgtaatcatccgaaccatgcgaattcaacgtatcatgtgtagaagctaatgttgtggactgattgtgctttgtggtgtgtgcctgtcttaccaaacaacccaaatatcaaaaataacaaatataaaatataatctaaagtttgtaagacaaagatacatatggagaaaatattagcgacacaccaacaaatcaaaatgccagcaaaatatataaataatcaaatcaataaagtaaataaaatacctaaatactgaaaataatttctagttaggtgtaaaatataaccacactagaaaaaaaaatatatgcatacagtcaataattaattgtacatgcaaacatactaccattggtagaaggactaaaaatccataataatagaacat

SEQ ID NO: 4163 - DNA, 289 bp, Diabrotica virgifera
  Clone ID: LIB149-020-Q1-E1-G11
aatccctttaaagtttattctgctgttataaaaattatgtgtaatattgttttaaataattatacaaaaaacaagacagccatcaaagtgataaattttcaagaaagtataaaaagaaaaataatgctaaggaaaataacaaaaaaaaaacacaagttatctactctgaaccctaagactgcacatcaaactatgtgagcaattgttgttatagttatttctagcgatattttgtatataatttaaaataatataatatttatttaaaataaagtattttacacataac

SEQ ID NO: 4164 - DNA, 412 bp, Diabrotica virgifera
  Clone ID: LIB149-020-Q1-E1-G12
aggttgtttgattaggaaagtaagatccgttttactaattaacaatgaaaaattttctagttctggcagcagtttttgcagttgcttatgcaaaccaagatgattatctccgttgggtaagctacgatggaacaataccagacaacgctgtaccagctggagaggatgctaacaataacactatatatattggacgtgtctacttaaacaccaatacaaaccagtccagttggaactataccacagatgcaaaaggatacgttcccgggaatcttagagaaggagttgtgtctttagatactgtgctattccaaaaggttcatacagctacagaaggaattgagattttaacagtagtaaacggtgcaagaatagaatggaaattcgttaaaaactatcagttcccacaact

SEQ ID NO: 4165 - DNA, 66 bp, Diabrotica virgifera
  Clone ID: LIB149-020-Q1-E1-G7
aaaaaaaaaaaaaaaaaaaaaaaaaaaaaaaaaaaaaaaaaggaagaagcacaaaaggaataaagg

SEQ ID NO: 4166 - DNA, 407 bp, Diabrotica virgifera
  Clone ID: LIB149-020-Q1-E1-H2
acccaagcgtccgtatatatttattattttcgaatttaaaagagctaaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattaattaaatttagtaatgaagaaaataataataataaaaa

SEQ ID NO: 4167 - DNA, 355 bp, Diabrotica virgifera
  Clone ID: LIB149-020-Q1-E1-H4
gtgggtttttgaaatcaagactcagccgaactagtatctacacacaatggttctttctggaaaatacagtgtaattggggaagaaaacttcgttcaatatcttaaagactatggtataccagaagaacaaattaaaaatagcggtcaattttctatcgaattcaaacaagacggtaacaaagttatagttactgaatctgctgccggcaaatctaaagttacctcttttactcttggagaggaatttgaagaagaacgttttggtcacaaaattaagagcaacgcaaaacttgagggtgatatccttgtaatcactaacggagaccattctaggaccttcaacttcactagcact

SEQ ID NO: 4168 - DNA, 377 bp, Diabrotica virgifera
  Clone ID: LIB149-020-Q1-E1-H7
acccacgcgtccgaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataatattagtattaaaaaattgtatatttagtaaaaatatataggtttaataaaggaattcgggaacatttttttcaactggttaataaaaacaagtcctttt

SEQ ID NO: 4169 - DNA, 395 bp, Diabrotica virgifera
  Clone ID: LIB149-020-Q1-E1-H8
ccgggccgacccacaagtcaagggggttgttaccttagtagtgagcactccagtgtaccaggaagatttacagagatattatcctcaaggatcaattccatgcccattcttcaagaaagacgccagttttaatgcatcttccgatgatattaaagtttattttagaaacaaagatcatcctgagagttcagtaccaatagacattaaccatagttcggaagtcgatgcgttgggattttcaccaaataaagatacaatgtttgttgtccacggctggcacaacggtcacgactcgccagtctgcgatgagatatccaaagctgtcctccagaacaacgatataaacgttttcctaatcgattggaacaaaatcgccagcaacctctacttagtag

SEQ ID NO: 4170 - DNA, 348 bp, Diabrotica virgifera
  Clone ID: LIB149-021-Q1-E1-A1
aaaggaaccggtatcgttgaattcgctgataaaggttctgttgacaaatgtatggagaagatgcagcgatatgaagttaatggtagaaagttagttgttaaggatgactcaggcgttactaaggacagaactggagctatactatctggaacttccagaagacctccagcagagaggaacttcggtggtggcggaggcggaaatagcttcaacaacagcatctccttcagcagtaataatgatggaaactggggcaacacctatggtttgagtccccaattcctgggatccttgaaaatttaccctccaatcgttaacagagttttcaatgctaaccctgaatacaat

SEQ ID NO: 4171 - DNA, 99 bp, Diabrotica virgifera
  Clone ID: LIB149-021-Q1-E1-A12
atttcagtatgatgccgtgcatccttgctgctgccctcattgtaaccataagtgccgctctatgtgccttcgacacgtggactacttttaaggccaatc

SEQ ID NO: 4172 - DNA, 395 bp, Diabrotica virgifera
  Clone ID: LIB149-021-Q1-E1-A2
gtaggtaccaactataacaatgaaacaagttattgtctccttgtgttgtttgattatagcaactgcagctataccaattgaaagttttgtagatgaagatggccaacaatatgttttagttcctttgcagaggcagagaagggatctaacatggggagcaaaccaaaatggttactctcttggccaaaaaggtactatctacagcagtggtaatcaccaatttgacggctcgtacggtgcatcaaaagcttggggatcacatggtattaaacccgattcatttggcggccgtgtagattatactcacagtactagtggttcaaacgcctttgttggagcaaacagaactccaggttggggtactgatgtggctgccggtggaaggtacaatatag

SEQ ID NO: 4173 - DNA, 381 bp, Diabrotica virgifera
  Clone ID: LIB149-021-Q1-E1-A5
ttttatttattttaaaataataaaatattttttagtaaaagtaaagaaaaattttatttaatgatagttaattagtattgtgagagaatattttatttttataaaagaaaaatttattttttgtaccttgtgtaccagggataataaataataataaaaaattaataatttccaattttaaagaaccaaaaaatttaaaattttaattgtaaaataaatattttaaataatttttttgtaatgaaatgtaattcgtttttaaatatacctaattttttaagaattaatttaaatttatttattaccattatattataaattaaatatttttatataattaatattaaatatttttagggatgcccttaaaaataatatttt

SEQ ID NO: 4174 - DNA, 407 bp, Diabrotica virgifera
  Clone ID: LIB149-021-Q1-E1-A7
gtgaacagcgcttggctccgcgttctacgaatacgaggtctttcctaagtactaacgtacctaacctaccccaaattgtttttgtctggccactccacccaaacgattttataaaaatactggaatattacgtagtgatggtaaatttgagatcacccttgatcaaaggaagttaaaaacacccaagggaaatatttttgcagttgagagtgaagctttagcattagcagtggcaacagaatggaattctcagaaagataaaattattagaagtaaaatgcatttgacaactctgtgtaataccaccatggacaatcctaataacttgacaaaatatgatattgccaattatattgtaaattacttggatactgatactgtcctatttcaagctaatgaagatgaag

SEQ ID NO: 4175 - DNA, 432 bp, Diabrotica virgifera
  Clone ID: LIB149-021-Q1-E1-B1
ggccgagccacgcgtccaggggtaacataagaaaaccctttatagtttaactgttagcaggacaatgttacagttccatactttgaagtttcaaggtggtaagaaaaaaaacggccaatttggccccaattgggaatcaacacacaaaactgtgacctgtggcgatatcaaatcgctgagatacacatatgtggcgagatcactaccaaattcggaactcctttgccgattttggggagaggggttataatacttacagaaatggggggtaatgggaaaaacggtgaaaaattaatagggggaaacaaaatcgggagaatcgcaactacagatcatcccaaaacactttttcagtgcggcataaattatcgaaatctctcaaacgcattacaattggggaagacagaaaaaaaaggtgcccccccggggaat

SEQ ID NO: 4176 - DNA, 376 bp, Diabrotica virgifera
  Clone ID: LIB149-021-Q1-E1-B5
cacgcgtccgaattattttaccattcaatagcgttaactccaatgcagtttaaaatttaaccattaaaaaattgggtgtacttacgcagagtttttaaccctccgttagtcgctatcggtgtcacacaccgacgacagaattattcattcgggatttacaaaataacgggttttttctatcgccactttctgtacctcttcctatcaactaacctcgtgttagtatacattcttacctacttgggtacagttgtgcgagttttatagctactttcggtgcaagactccgtagcgactaacggtgtggttattactttattggcataacttgcagttcaggttaagatttagcatcttagtagtgcattttatcgac

SEQ ID NO: 4177 - DNA, 132 bp, Diabrotica virgifera
  Clone ID: LIB149-021-Q1-E1-C1
acccacaacgtccgggcaagggttcttcatggttgaaaaaacatgttaacatgaccttgcccgcagaaagttgaaattggtatgaccgcatgctgattatatttggacggattgttaacaccaaacgccatt

SEQ ID NO: 4178 - DNA, 368 bp, Diabrotica virgifera
  Clone ID: LIB149-021-Q1-E1-C10
aaaaaaaaacaaaaaaaaaaaaaaaaaaaaaaaaaaaagaaaaaaaaacaaaaaagaaaaaaaaaataaataaacataaaaaaaaaaaaaaaaacacttcaaaaaaaaaaaaaaaaattcgggtgaccgcccatcaggttcaaaccttacttacccttaaaaccaagttctaacccctcctaaacgcccaccaaaataaattccatgggccatcttttaataatttcgaaaagggaaaacccatggcttattccaactaaaccccattccagaatacccccttttacccaccgggtttaataccaaaaagccccgcacgtttggccgttccaaacattttcccagcttaaatggcaaatggaataccc

SEQ ID NO: 4179 - DNA, 391 bp, Diabrotica virgifera
  Clone ID: LIB149-021-Q1-E1-C11
aactaatcgattggatggcgattgtgtctgctgaatgcaccctttatcttttatctttatgtcagtaaatatgtttatctgattgttagcaataatattaaaatcctgatttagataaaatggattcaaagacagtttttgaaacataacgaatgtgatttgatgatccctatgaagatcaaattcctagcttacatttgcatggtgagttcaacatgtatatgttattagagaacaagtaacacaagtggtgtacggaagcaaacgaatgtaacaccaattgaaagtccttcaacatgatttagatgcacacatgtttcaatcatttgagatacacatttgtagaagtatttggttggaagataactattaataatttcaattgtaaaaa

SEQ ID NO: 4180 - DNA, 398 bp, Diabrotica virgifera
  Clone ID: LIB149-021-Q1-E1-C3
gcgtccagaatgatgaaaatattaattgtgacgctggtcctttgggctggtgtcagttatgcaaaagatgtcaaaaatgacctaagtgacggtattttatctaattctgcagatgataaaatattgtttccatcattaatagacccaaagccaacagaaataccaccaccacctcctatcaatctaccaggtccaccagagcctccaagtgacgcaccggaggccctatataacaaacgtcccagacctccaccaagcaaacgacctagaccaccaggtcctccaccaagcagaagtcctaaaccgccaggtcctccaccaagcagacgacctagaccaccaggtcctccaccaagcagacgtccaagaccaccaggccctccaccacgcagacgccc

SEQ ID NO: 4181 - DNA, 407 bp, Diabrotica virgifera
  Clone ID: LIB149-021-Q1-E1-C6
caaacagtaaacaggtcagtagagtccgtttttatagataaaggtaatttatagtctgctgtgtaatctgatgagtagatcgctgctccagtttggtctgtgtcttcatttttgaagacgtcggtataaactctttacagagagacatctgaataatatccagtgggaaatgctgagattgctcttaatttagttttataaagttcgaagactatctttgtgtagtaagcataaagttgtaagaaaatttttatttttctttgctctggaataacttttcagtaagttgcaccaagttaattttcccattttttttcacatctttcactttttggatttatattatatcgtaaaattattttagtcttacaaaaggctacatacctacttctttagcaggactatca

SEQ ID NO: 4182 - DNA, 394 bp, Diabrotica virgifera
  Clone ID: LIB149-021-Q1-E1-C8
accacgcgtccgcccacgcgtccgattttagtatatgtttaattaaatttttaaaaattaacttcacatattagtcaaaattgtaattattaactttatttaacttgaacttattaactttacttaactttaacttattaactttatttaactttaactttaatttattaaattcatatgaacttctggattctaatccctcagattagtttttggtttcacttgttattattactattataaaccacgagttaggaaaaggatctgtgtatccactcgtaggtttatttattcaataaggcttgtgcctgtcccactcacagtgaggtatttatatgttatatatagtatcaggtagtatttaattaaggtgtacgtattataaacgtacaat

SEQ ID NO: 4183 - DNA, 284 bp, Diabrotica virgifera
  Clone ID: LIB149-021-Q1-E1-C9
ctcgtagcatcttggggaagatgggggctagcggagccactcgtagatacgtatatttggtggcaattgcctgcgaatatttcagtctttgtctgcggtagcgcactccgatggtcaaccccagtactcccgcgtttggagaacttggccgcttgcccgttagatcatgttacatctacatccgaagacggattgatcgcttcgtgcctacagctagcagtcgtcttcagacccgtcgtatgtggaatactgggcgagttaaattggcacggagctgatacgac

SEQ ID NO: 4184 - DNA, 415 bp, Diabrotica virgifera
  Clone ID: LIB149-021-Q1-E1-D10
attccactaagtcttatttaacatcggctaatgatcgaaccttccgcgaacaacgataatgacctattatcgatttcacttgagtcttatttaatcacttcttaaaattaaatataacaatttgttgtatacaggttgttctaaatttatatgcccgtggttgagaaaattgaaaatattttatattaaattgaattttgtttataattattaaaatttaattttcatatcaaatagaaatataacaatatagttatattaatatattattatacctatatattttattgtaaatatagattataactttatgaaatacatacgtccaccgaaaatagctatttcctatttattagattcattgacaatagatacaaattcagggttataattttctggaaacgaatggaacttg

SEQ ID NO: 4185 - DNA, 415 bp, Diabrotica virgifera
  unsure (1)..(415): unsure at all n locations
  Clone ID: LIB149-021-Q1-E1-D3
accacacgtccgcccacgcgtccgcccacgcgtccgatttctggttttttgtttatggccatctgttttttattttttgttactaaacaaaagtatttaccatatttaatatgaactaattttctaaataaaatttctaacatgggtatatgaattaaattacatatttttttgccaatatatactccagtaatatatgaggggtgtaaaatcaaaggcggcaatctccactttttcatgttttgagttagggacgccatttgttgcgtttttttattatctgttagataaaactatttgtaaaaaaccaaaagcggtcttaactgtataaaaatcgcagttaaaaattcatgttangatcaaaagcggcaatatttatagctgagtgcgtaccaaacacggcaatctccgctgc

SEQ ID NO: 4186 - DNA, 409 bp, Diabrotica virgifera
  Clone ID: LIB149-021-Q1-E1-E1
accacgacgtccggttttatcgagcaataaaaagaatttacacgattattaaatttaatatacatgacagtacatagtacatgtagataatactagactgtaaagacagagtttagactagactaacaaaaaaatgggacaagcaaaaagccaattcactgatgatgaactgcagaattaccaagatctaacatattttaccaaaaaggaagtcttgcatgctcatcagaagtttaaagctctggccccagagaaagtaggccataaataaaaatgccaaactacccatggaaaaaattttattatatcccgaactgagtgtgaatccatttggagagcgcatatgtaaagttttcagctcaaatcatgatggccattgcacttttgaagattttttggatatgatgtc

SEQ ID NO: 4187 - DNA, 397 bp, Diabrotica virgifera
  Clone ID: LIB149-021-Q1-E1-E12
atcagttatcgctattttatatttgccgagacggaagaaaactattggatcaaaaatatttttttgtttatttataaaattaatcttataaaaactatggaaactagagtaattttgatagtggatttagcatctacgaaaaaaattcgtctctaaatggtatgtaatatttttcttcataaaatttaaatttttaaaactcaagtagctctatattttacgagttacttattccgactcaaaaacctttgtaaaaattaatatattattaatttattatttttccctgtattaacaagtagtgatgaagaggaacaaattattacttaaattaaattatagcgtacagttcaaaaaacttataaaaatgaatctcactgtaatgaaacacttaaag

SEQ ID NO: 4188 - DNA, 412 bp, Diabrotica virgifera
  Clone ID: LIB149-021-Q1-E1-E4
atttaaatatctgcagaaaaccaaatttactaaaaatgactaaaccaaaatcgaataagagaaacttcggtgataaaggtaagttttcccaaaaacgtaaacaagggattggaaagagaaaccagaaatttaaaaacaacaagaaaaataaaggggggccgaatgttcataagaattttccaaaaaagcaggttcaggatgtcaaaccggatgtagagaaaaatgaaattaaaaatgatgtggtacaagctggctcatttataggaaatcctgacaagaatccaaagaaagatccattttttatcatcaaacaaaaagtaaattcttcagacaaccacgagaaggaaaaaattatcaaagaattggaaaataaaatcaatgctatcgaaagcaagggtcaattgactaacac

SEQ ID NO: 4189 - DNA, 387 bp, Diabrotica virgifera
  Clone ID: LIB149-021-Q1-E1-E8
actcaaaagaaatacgtagaaaataagaatagtattaggagagtatcgagtagcgaagattttcagagccaaagagctagttctgtagaaagagtggctagttctacggcgaaaaaaggttctgataagcttttgacttacgacgactgtgaacatgaaaaaagaagatcccacgagagattcgcaagaccgctagcaaccaaaggaaagaaacaccccaccaaaagacttaaagtaaaatgtattccacgccctaagtacaagcctgaactatctttcgatacaagagaccagcacaaaaagctccagctcacccacggtggctttctagccgaacacgacagctctagaaccggatttttgaaactacacattgaagaaggaaac

SEQ ID NO: 4190 - DNA, 415 bp, Diabrotica virgifera
  Clone ID: LIB149-021-Q1-E1-E9
atattgttccggtttagtattatattggatatttcttgatgatgtattgaaaaaatgaaaagtgcgtgtagagatgttttatatttctgcataggaactatgcaccatatgaaaaaggacaggaagggttttttatcataaattagacgtggaatttaaaaatggttttagttcgaagtatctcagtggcgtgctatttttttctttaaaaaaattcagaccattgcccgtaggcgcgccgatgatgaatacaagattcttgattgtatgtcggaggatgcgtagtggctgcatcctggaactcgccaagtttcattttcgtggctcaactggtcttggagcaatgaataaattggcagtttgaaataaaaatttaaacaccccgtatctcggaaacaaagcatttgtggacata

SEQ ID NO: 4191 - DNA, 404 bp, Diabrotica virgifera
  Clone ID: LIB149-021-Q1-E1-F12
cccacgcgtccgccacgcgtccgcccacgcgtccggcaaaccgttgcagtaggagtcatcaagagcgttgccttcaaagatcccagcgccggaaaagtcacaaaagctgcagaaaaagcccaaaagaagaaatagtctatttggactccactacttaaataattttgatatgttttgtttcttttatatattaatattggagtatcaatgtatttttaataactaatggacttattacttgcattgcattatttgtgatctgtaaattaaacttggacaaataaagaaaaaaattaaaaaaaaaaaaaaaaaaaaaaaaaaaaaaaaaaaaaaaacaaagaaaaaaaaaaaaaaaaaaaaaaaaaagaaaaaaaaaaaaaaaaaaagggggggccgcccaaaag

SEQ ID NO: 4192 - DNA, 393 bp, Diabrotica virgifera
  Clone ID: LIB149-021-Q1-E1-F2
aagattatatatacgttcagacaaagtttctatttcaaataataccaacagagatttcctatttcacatgaaatagggactgtccaacttatgcacatttttttgatacaattgttcatagtaatttcaagtgctaaatatggttcaatcatctttccgtacaataagtatttcatgttttttttcaactggagattacccttgtttcaatccttttttttctttcattcatactcgttcattttaatgttttttatggttatcggcacagcttttacaattcatccccttactagtcatactctctgtaaacagtagttcaattaatttcattaacatcattttccaataccgctgactacaactgacatatattacatttttttaaattat

SEQ ID NO: 4193 - DNA, 411 bp, Diabrotica virgifera
  Clone ID: LIB149-021-Q1-E1-F3
accaagcaacaagctttcgaaatctgttataaaattttttcgaacaattatcaatgtccttgggttattactactgataattacatttttgttagtttttgacgtttcgacttccatttcggaaattgttctcaaaaaaggaaaattttataaaatcaactaatattggatttccaacattatcattacaaccaatggtggcttaatcccatcaaaaatataattgtcaaacatgccaaaaaaaaaccgcttcagaatatttttatgtcgattacttcttactattcgggccatgtcccagatttttctagctagttggtcacactatgtatgatagagacgaaatacttatcagaacgagaaaattatttctggagttcctaagttcatggacctaacaaccagtgaatc

SEQ ID NO: 4194 - DNA, 403 bp, Diabrotica virgifera
  Clone ID: LIB149-021-Q1-E1-F4
accacgcgtccgggacaatgtgaaagcactggtcgtttcaagggatgggaatcaatgtttgtcaggtagcagtgatggatctattaaattatggaatctaggatcgcaaaggtgataatgacagatttaaaaaatatatccaacagtattacagtgtgtgtagaagatgctccaattttaaaaatgtgttttactgctgatcaccaagccgtgtgggtatcaacatccgattcgagtattagatgttggaaattaccaaccgaaaagcattttaaagaagaagttcggatgcccaccaatccgttatctttaatacaaggaggtgcggcgattaagcaggcagtagttttaaacgacaaaaggcacatcctgactaaagatgctcaagataacgtagcgatat

SEQ ID NO: 4195 - DNA, 397 bp, Diabrotica virgifera
  Clone ID: LIB149-021-Q1-E1-F9
acccacgcgtccgaaaatgtgcccatcaagtatgaaacaaaagaagcaaaaagcgctttagagcaggctcctgcgaggccacggccctggttccacggaaccatgttcagtacgccattgatctagagaactcttaaaataagctacaggtggatgctattgatcaattttctggaatgagctttcaagaaagagaaggctcttagtctaatagttccgaagctaccggctattttggtttcagtcgaataaggcaatacaataatggagagtacttaattttcccggagtggatcaggctaccaaatactgtgaccatttcatatagcaagtatttcagtatcttatgaacaaatgttaaatcagacttctaagcttcgatgacagaagacgttta

SEQ ID NO: 4196 - DNA, 349 bp, Diabrotica virgifera
  Clone ID: LIB149-021-Q1-E1-G12
aaatttactctctttcttttggcagctgtctttgtagctgttttagctaccaaagaagtcagctcaattgatgctaaagtggttgatgttgcagcagctttcaaagacgatgaacctactgaagcgccaattactgatgcacctgctgcgtgtgactgtgaaacatgtaccactcattgcacagatgaaagcatattagacccaaccaaaaactacgatggaggagtctgtgtagataataaatgtcattgtgtcgaaattgtttaaattatattcctttatattatcaataaatatttttaaatgaaagaaatttaaaattaaatagttttacagtaataataataaa

SEQ ID NO: 4197 - DNA, 387 bp, Diabrotica virgifera
  Clone ID: LIB149-021-Q1-E1-G3
aggacacgtgggcggacgcgtgggttctgcgcaccattattacacaactagatgccgaacaccaagcagagcatgtcagtaggctgggtataatcggtgctttgattggagtgggagcagctttactttcagggcatcttatggaattatccaatggattctcttacttagacagtattagtatactaaacagtattttaggcttaggatttgtgaaacttttaaccgttattcatccgagcaataaggaagaatcagagctttcacaaccagtacttgaagaaattactacagcactcataaacctcaaaacctactctacgtctacaacatactctcatatcttccttcctaaagctttaacagcgatcagttatggtatacccg

SEQ ID NO: 4198 - DNA, 193 bp, Diabrotica virgifera
  Clone ID: LIB149-021-Q1-E1-H2
gcgtccgaccacgaagtccgcggacgcgtgggtctctattaaaatattgtacaaaaaatgaaatcaattttcattattacattctttgcttgcattggtcttgcagtaacagttgcaattccaatgaacataaaaggtccagctccagatttagatgatccaaactgtgtaatctgcttttccgctggaaatt

SEQ ID NO: 4199 - DNA, 393 bp, Diabrotica virgifera
  Clone ID: LIB149-021-Q1-E1-H3
accacacgtccgcccacgcgtccgctctgatgtcatagaagagttcctttatatagtcttcccacatgtttatttgttcttcagggcttgaaatcagtttgccttctgctttgattagattatttggcccttgtgagtatgtcgtgcctgtgaattccttgagtttcttatacagatggaaggcataatgtttttttatataagttttcgatttcttcacattgttctgttatccatttttattttgcaattttttttttggtgaatggttctatttaatgctttgtacattgctttgtgctgtttgaattttcttccttcatccattaaatccaatatctcctctgtcatccatccttgcttccatggtcgctgttttgtgagcatttcaat

SEQ ID NO: 4200 - DNA, 294 bp, Diabrotica virgifera
  Clone ID: LIB149-021-Q1-E1-H5
ggacgcctctcaacacgattcaggctaatgtagtcgtgaatgccaagtcagaacactgctacagggtcaccaagtttcaattcaatggccgtcggatgacaatgtcgagactggaaaaaccctgacataaaccatcttaagcaccatgcagcacatcgcccgtttcgccaccaggcatgttacagaagacgcaggcaatgatagcccttcacaacatctgcccagcatgaatatcgaatggcacgatccatgtagcggcagcattaagtactgcagatctggaggagacaggtc

SEQ ID NO: 4201 - DNA, 222 bp, Diabrotica virgifera
  Clone ID: LIB149-021-Q1-E1-H6
cccttgaatgcaactcaaagcccctccaaaagggcccccaaattcaattcaacgggccgccttttaaaaactccttaatgggaaaaacccggggtttaccccaagtaactccctttaaaaaaaatccccctttcaaaacctggcttaataccaaaaagccccccacaaatccccctcccaaacatttgcccacccaaaatggcaaatggaacgcccctttta

SEQ ID NO: 4202 - DNA, 410 bp, Diabrotica virgifera
  Clone ID: LIB149-022-Q1-E1-A4
aaacatttcctctgtgaccataattgtatttaaataaaccaaacttgtattgagagacaataacgtaaaagtgacatctttgagaactaagcgttcgaaaacatagcaactctgaaagatttcacagaggaaaagtttgtcggacatgtcgcaaggaatgcaaacacaaagtttaaaacttatatgtatcactgaaattttaggtccttgtactggggactatatagtgtaaagttaaacaatttttaatggcaaacattttgatttctcttataaacatttatttaaattgcaggtttgttcgatttgtttatcacctaaaagtattttacttatttattgtaagttgatattttaaaggtttgtattttagctttagtaaagttctcagtgtattatataatattttc

SEQ ID NO: 4203 - DNA, 80 bp, Diabrotica virgifera
  Clone ID: LIB149-022-Q1-E1-A5
aaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 4204 - DNA, 372 bp, Diabrotica virgifera
  Clone ID: LIB149-022-Q1-E1-A9
agttgagacttctttttcaaataacggtacgacagatggctaagaagatgaattaaccgaacaatttataattatataatcagatgaacattatctatatttacacaatatacattactagagttactgtatttggcaagttttcttttctaaatgtttaatatggtgtttttaaacgcaaattcattttttatgttataaatacctgtggtaatcattttatagatatcttttgtgggctaactgataatgtcaatatacttatacccaagtgtttataaaatggtatggtttaaagaagaagttgccatatggagccatattagatttaattaaagttttgtttaattaatattacagataatacttttt

SEQ ID NO: 4205 - DNA, 106 bp, Diabrotica virgifera
  Clone ID: LIB149-022-Q1-E1-B12
aaccacgcgtccgttatttttttttttttttttttttttttttttttttttttttttttttgttctatatttctatcggtcgttctatatgatttaagctatgttg

SEQ ID NO: 4206 - DNA, 107 bp, Diabrotica virgifera
  Clone ID: LIB149-022-Q1-E1-B6
cgcacgaatctaaatcgagtcgtattaggtcaatctctttgttggagaactcgcgtggcatggccggtaggaccttagcacagtgacacgtgccttccgtcgtttga

SEQ ID NO: 4207 - DNA, 402 bp, Diabrotica virgifera
  Clone ID: LIB149-022-Q1-E1-B9
aggcggacgcatccaaggcacagaagctgaagttggcaaattcaaggaaaaggtttaaagaattacaagaacttaagaaaaagaaaaatgccactgcttcagttgataattctgaaaaagatctacgtgaaccaacaccagttgatagcccagtaagttcaacacacagttcaattaatgcagaaagtgaacttgcaaatgtaacaaacactcaattgccaaactatttcatgactactgcacaatcggatcctgcaacattttttgaaaatttgtctacaactaatactaatgttggtgacgttgggaacatttctgatgtagtagaaactccaatgtatgaacaacatgtaccctttgataataattatgctttgtttaatcaaacgaatcaacaaagtt

SEQ ID NO: 4208 - DNA, 419 bp, Diabrotica virgifera
  Clone ID: LIB149-022-Q1-E1-C10
aagaaatttgggtgaaacgcttaacgaaacaaatcaaaacttgtaataaagtaataaaaaaacgcactttgcctataggtacaattagaaaactgcaaacgcatgtaggacattttaaacattttaaacagattattttcaatagacatgtcggtatggggctagacaacaaactaaaacatagagttaaatgggaaaatgtagtttccgcgtttaaaagtcgaattaaaactggagttatagttaatttatggcataaggacttagcacatttcctaaatgattgttatattatttttaaaaataaaatcagaaaaattttaaaagcagataaagttgttaaagttaatgtttgtttttgtggagaatttattaaaaaatcgggggaagaggaaattgtaaattttaaatattttaat

SEQ ID NO: 4209 - DNA, 390 bp, Diabrotica virgifera
  Clone ID: LIB149-022-Q1-E1-C11
caactatttaaaatatcctccgttgaagactgtctttttatatagggtttttaaggttacaagactgacaaaatcatttttttttcatgtaacaaatcactatatagagagttttcaaatgcgtttaaacatatactattgtatgaccaagagataaacttttctaatcaccaatgatcttcttacacgagaatagcttgaaaacgttgtgttgcaaaatatattgtggctgtaaacaagcaattttatttaacccagcctgtgagatatattcaccccttaaaaatgacattcgggtgtaacaattcattggagcgaggtgtattaactcgtgtatatctcgatttatataattttagtaaattgtatttgttattgtttttatttatg

SEQ ID NO: 4210 - DNA, 428 bp, Diabrotica virgifera
  unsure (1)..(428): unsure at all n locations
  Clone ID: LIB149-022-Q1-E1-C2
gagcaacataaagacatcgaacaacacgcatttaacattaaaagggaagtagattcggtggatgatttcgaacatttaggacacgactcaagtcctttacaggatttgttgggtttgcaacaagacaaagaggtgacagcacctgaaacagtccatgaaatcaataacacgcccaagactgcggtgagtcatcaggccggtgcttccaaattattacattctttgcaaaatccactgattcccgaaaaaatgaatagaaatctactggaagacgatttcctggatagaggcgaaggtaaagaaaaattagatcaatttttacaggatgcagcaataccccctgctacttctgtcttcgatcacggaaataataaattattctctgcaaatctaatanaagctgaaaaattcaatgagcctgagaaaaa

SEQ ID NO: 4211 - DNA, 403 bp, Diabrotica virgifera
  Clone ID: LIB149-022-Q1-E1-C3
aggacacgtgggtagaaactttgacagcttatgtttaacatccagtgttttaatgattgttgtaatatcatgatagagatcccgtcatttgggtaggcactaatttgcatattatggcgcatctaaaaatggtccaagaaccgtcttaaaaattggtgattggttataacattgaagtattgaaattgtttaatgctaaggagtggctaaagaagaaacttcaaattttgacttctatataagtgcaataatatgcaaattggtgcgttcccaaatgacgagatctttatcataattatgagagtaggttggtttaggacaactatctccaactaactaggtacatagtaaatttagtaattatttttttgtaatgttggtaaaattgtgatatcgactagat

SEQ ID NO: 4212 - DNA, 79 bp, Diabrotica virgifera
  Clone ID: LIB149-022-Q1-E1-C7
aatttctaaaatatatttccttatttttgcatattattcaacatgtctgtaacataattttcaaaataaatccactctt

SEQ ID NO: 4213 - DNA, 427 bp, Diabrotica virgifera
  Clone ID: LIB149-022-Q1-E1-C8
atacttacagtattgcttgtagtttctagttctttagcatttcctgcaaaggaagaaatttcaacaaaaaatagcaatgtaagattttatgaggcagccaacaagactcccttttcgacagacaacattacgatcgattatagtacaaatgaagaatttggcctgaatattacagctatttctcgagttaacaatcttgaagattttctattgcttgttagcaatctaacacacaacgtttcaatactgaacattggtcaattgtcattcggacaatcttcaaagcataaattaaatccgtttgaaaagaatgcttacgttgttgcggaaactgtctcgacattcagcgtttctaaagaaggtgatttggttcttaacgcaagtgcaggcactgtgcagtctctgaaacttgtaacagattttacag

SEQ ID NO: 4214 - DNA, 400 bp, Diabrotica virgifera
  Clone ID: LIB149-022-Q1-E1-C9
cgtccgaaaaatgttgaaaatattaattgtgacgctggtcctttgggctggtgtcagttatgcaaaagatgtcaaaaatgacctaagtgacggtattttatttaattctgcagatgataaaatattgtttccatcattaatagacccaaagccaacagaaataccaccaccacctcctatcaatctagcagatccaccagagcctccaagtgacgtaccggaggccctatataacaaacgtcccagacctccaccaagcaaacgacctagaccaccaggtcctccaccaagcagacgtcctaaaccaccaggtcctccaccaagcagacgtccaaaaccaccaggtcctcctccaagcagacgtcctagaccaccaggtcctccaccaagcagacgtcca

SEQ ID NO: 4215 - DNA, 245 bp, Diabrotica virgifera
  Clone ID: LIB149-022-Q1-E1-D10
tctgtgttgacatcttttattgattgactctttcactaatattgtgagagactaatttacttttacacttgagtcttttattttctgttccttgtgtttcatggattatttgttgtacattagatgtttgatattttcgagtttatgggtgctaaagatttaaaatttttattgtaaagtgaatattttacataatttttatgttttgagttgttattcatttggaagtatacccagttttttaa

SEQ ID NO: 4216 - DNA, 339 bp, Diabrotica virgifera
  Clone ID: LIB149-022-Q1-E1-D11
atcgcatcactgtttgaatgggacggggccattcgggacgttgtattgacagttcgttgatattgatagatatttttaaaatgtcttaattttttttatatattcatcaagtaatgacttatgcattattccattcaaatactttaaattttcacttttttaaagatcatattcagtgagtgtttaaaagttgttatattttttattgcttttgtaatacttaacatagctattttgtttttcaatttaaatttgaagtttaacggtttgggtttttaatttaagtctaaaatggaaagaaaaaaaatttatttgatgtcagaataaatagtttttatt

SEQ ID NO: 4217 - DNA, 405 bp, Diabrotica virgifera
  Clone ID: LIB149-022-Q1-E1-E1
aaaatattgtacaaaaaatgaaatcaattttcattattacattctttgcttgcattggtcttgcagtaacagttgcaattccaatgaacataaaaggtccagctccagatttagatgatccaaactgtgtagtctgcttttccgctggaaattttattcaaggatttaagaactcaggtgattccaaggaagaagcaaaacaacaaagaaattttatctgtaacctgtttaacactgacgagctaatgcaaatctgtatgagcacttatgaagaggacgtcgaatatatttatggagtaactgacctcagaacagtaactgaaatgtgcatagacatgaacaaatgtaaagctaaaccaaatatctaattgtgttttttaaataaaaacatgtttttagtgtttt

SEQ ID NO: 4218 - DNA, 413 bp, Diabrotica virgifera
  Clone ID: LIB149-022-Q1-E1-E5
aagaatctttcgttgattagtaagcagttacatcatatgataaaacctagttgttctcaatataccaaacggtattcatcaacattaacattcaaccctttcgtcaaaaatgttcatcaaaataaataaacgagcgtggatcaacttgtttatatttgtgatattaagtgtaactattatatttatgttctcagacgatcacgtaacagaaataagtattaagacaaatagtgaaataaaagagaaacatgccattatatcatataccataaataatacgactaagacgactgctactagtacttctacaactactaatactgctactgctacttccattagtactactcctagtgccgatatacactgctacagagaaacaagtttagcttcccttcccgatatttccgaaa

SEQ ID NO: 4219 - DNA, 437 bp, Diabrotica virgifera
  unsure (1)..(437): unsure at all n locations
  Clone ID: LIB149-022-Q1-E1-E8
actcaagtggtaagaagcatagattattactatatatttttcgctaaatatacgaatatttaatactgagaatcataaaaaactattgtttcacttaaaaaaattccaggcccattgatttctacgccgatgacgttccagtaccttccagaaaaatcgagaatgttctttctttaaatatataaggagggaagacattgcgcatgggagtgagctttttgctttgaaatcgagtagacgtgaaaccagtgaattcacatataaggtacataaagtgatttgaagcaaaacttaacatctgtgtagaaattaaaactattttaagtattgtgtgcattttacaatgggtaaagatttttataaaatattaaacatccaaaggggtgcaagtgatgatgacatcaanaaagcatatcgaaaaactgctctaaaatacc

SEQ ID NO: 4220 - DNA, 372 bp, Diabrotica virgifera
  Clone ID: LIB149-022-Q1-E1-F11
attagttgtaaacaactcctgggatttaacatcagcgagttccgtcaaatcaaatgcccaatgcgctacattgatcaagatctactctggtttcgtacagtactagacccgtcgcgtcaatcatttaggagttcaacaattggatgacatcctgcttatacgatgaatgaatctcgcaatccatctattgaggatactgctttggtataactagatctcgatgtggaactaaacgacagtgataaaatcgtcatacctcaagaagcacgatgcagacattactaacactttcaccatctgctggttggacttatgcggctactacgatggaacatcccgacatcctacaattacgaagtgtaacatttatac

SEQ ID NO: 4221 - DNA, 64 bp, Diabrotica virgifera
  Clone ID: LIB149-022-Q1-E1-F3
aaaaaaaaaaaaaaaaaataaaaaaaaaaaaaaaaaaaaaaaaaaaaaaaaaaaaaaaaaaaaa

SEQ ID NO: 4222 - DNA, 350 bp, Diabrotica virgifera
  Clone ID: LIB149-022-Q1-E1-F7
aaaagcggtttgatctgcaataacaaaagccgaaaaagttataaagaatgccagagatgactgaagtagacaaaaccgtgatccaagagacaaaacctgaacaaagtgaatcgtcaacagacagtgactccgatgaagacatccctgagttggaagatgcaggaactgcaagcgccgcctcagctacattccccggaaccgcaactgcaaggttggccaagggtaagggccccaagggcaaacaattcaaaaggaaaaaggaagccagggaagataaggtcaaaattgggccttaaaccggtacaaggattaaccagggtaacatttaggaattcgaagaaaatcctttt

SEQ ID NO: 4223 - DNA, 416 bp, Diabrotica virgifera
  Clone ID: LIB149-022-Q1-E1-G1
gttcccgtgtgatacattaggataaaacaatagggcttttcattcacagtcgcatttgtttcaagcttctgtcatgtgtcacgtaatatggatatatctacgtcatacgttatttgtatacgctctgagcttcgctggtgtcgctcctagcggttactaattcaacttttaccggtaatttttaaatttattatttaattgttatcgcttattatttacaacgcaaaaaagtaattaaattgtaatcgatttttttaagatttttctaatcattttgacgttctattgataaaatatcaatttcttacttcggatactttgacaataatcgtgtagatggcgctaagattataatagattatttataattagatattaaggaacattaaaaaaacttaaattcagtatttaaaacg

SEQ ID NO: 4224 - DNA, 349 bp, Diabrotica virgifera
  Clone ID: LIB149-022-Q1-E1-G2
ataaattttgaaagtgataaagacagtttgtgataaactgtagtgcagttcttttcgtttattttctcacctctcacataacaattaaactgaaacaatggcccccccgggtatcgggaattcggtggagatccgccccgaggcgacagcatcgtcggcagagaggagcagtagcaacggagtcgctacattccaaaaggacatcgtcgttttggatgggggcttcgctactcaattaggctgccacgtccaacaaccgattgatggagacgtcctatggagttccaggttcttggccaccaatccagaggctgttattgatactcacttagattttctcagagcaaga

SEQ ID NO: 4225 - DNA, 420 bp, Diabrotica virgifera
  unsure (1)..(420): unsure at all n locations
  Clone ID: LIB149-022-Q1-E1-G3
acaaaatagttgtagactattcgttgacaagatgaattcaagtattttggtagttttaatgtgtttgtgcgctgcacaatttgctttcggctcacagcatgagattaaagatggaaaatgttccaacgcatctcaggatgatctagtatttcgtgatcatataaacaaagcttcaattcctttcattaaaagagatgagaaggttgaatggcatggagacacaaccatttactgcctacaggtcaccaccgatcaagatgaatcaaaaggtgctacagctactgtaaaggaaggaggtgttggtcattcttttgtgaccgtcaaagtagagtctggtagaggacatagtttggattattacgtaaaagtttacgctaagtaataaatgtantattttttatattataaaattaaattcat

SEQ ID NO: 4226 - DNA, 422 bp, Diabrotica virgifera
  Clone ID: LIB149-022-Q1-E1-G6
acagtaactaaatatactgaatacgttaagaacataagtgtacattgaaacaatcaaaatccacataatagggaaatatagtaaaaggaaatggaggaaattaaatcaattaaaattagacaaaaacgtacaaacatggtgaacagagtatgcacaaataagtacacaagaaagtactccaaatacgtttaacacgtttggtgcccatcttgaacaagtgccacttagcggtaccacgtacttaatccttcatttagtagcacagtactactgacgccacttaccgatgcgtcatcggtacctttgataaaaccttcgtgacgctatttgtgcgtcatgggcaccgaacgtcataattaaaattgtgaacgggagaaggatttttcgtcgattgtcatttgcaacagtttggacaatgacat

SEQ ID NO: 4227 - DNA, 395 bp, Diabrotica virgifera
  Clone ID: LIB149-022-Q1-E1-G8
aaagcagtacagtacgagtacggcgatcctcagtaactacgcaggtagattatgctgtaccggtacgcattgaatatcagctgaagaacataatgttttgatatttctttttaattttcgtccaagaacaatatttgtttatttatttgtgttaaaaaagtgcaagttttgcttcaaataaaaattaagtatagatatgggactgctactttacaccttgggatctttaacgctgctggctatattatggacggtcagctccgtagccagatatgtcctgaaatttgcctgtttcggagtgttatgcatgatatttgcttgtgcgccgatacctttgatgttgttgaatccaagaaatagcaaaaacgccttaattccatcagctctgctaagat

SEQ ID NO: 4228 - DNA, 363 bp, Diabrotica virgifera
  Clone ID: LIB149-022-Q1-E1-H1
atttatatttattttaaaataataaaatattttttagtaaaagtaaagaaaaattttatttaatgatagttaattagtattgggagagaataatttaattttaaaaaagaaaaatttaatttttggaccctggggaaccagggataataaattataaattaataattaataatttccgaatttaagaacctaaaaaattaaaatttttagtgtaaaataaatattttaaaaaatttttttgaaatgaaatgttactcgtttttaaatatctcaaattttttaagaaataaattaaatttatttattaacaatatatttataattaaatatttttatattactaatattaaatatttttaggga

SEQ ID NO: 4229 - DNA, 405 bp, Diabrotica virgifera
  Clone ID: LIB149-022-Q1-E1-H11
accacgcgtccgcgttttcttaaaacaagtagatatataccatagaagacttatgatgtttgttaaagaagtgttagtgttgtttttatttgcgacattggacattgtttccggtgaaatatgtaccaattctagtgaaagtggatgcgactgtagacagtttaccaatcccaagacacaccttcctacctactacgcggattgtagaagtagaagcctacaagatgttccaggaaacatagaacatattatacatatattagatctgtcaatcaacaacatccaaacgctcgatccaaaaaaatacagcttaagtagtgaaaacctggaagaactaagtcttagttacaataatatcaccttcatagacgtcagcttctttcagaacctacgtaaactaaaaag

SEQ ID NO: 4230 - DNA, 379 bp, Diabrotica virgifera
  Clone ID: LIB149-022-Q1-E1-H2
gggtcgaggcacgcgtccgagcaactgtccagcattcacctaaaatgaaatattttgttttgttggtaagcattgtcgccattacagcatccgacttacaaggtacagccgtagaccaatgtttatgcagagacgaactcactcaaatctacaatcaactcgtcgaagctaatgccgaattgaaggaggccaacgatgaaatgattcagctggactccgatatggaatacatggacaataggttcgaagcccagaacgaaaatttggaagaactcgaaagtgcacttaccatgcttcgttacatccaactccaaactctacaagagctttccagtcaaggacagattctcaattgcattgtcgtcactgttcaaaacat

SEQ ID NO: 4231 - DNA, 353 bp, Diabrotica virgifera
  Clone ID: LIB149-022-Q1-E1-H5
acaagaagatcagtagatctacaggctctaaaggacgtaaaaagggctttattggatatttttgcttttatgacaacggcagagttagcagcttggaacaaaatgcttgattacttcgcaaaaaccgcaattaaaggcattcatgaagaaaatgaataatcatttccatttaagcttgagatgtgtggagagtgtgagatgaaatgaaattaaacaatttgtatgattcaaagacattaaatttttgatttattaaaaaaaaaaaaaaacaaaaataaaaaaaaaaaaaaaaaaaataaaaaaaaaagaaaaaaaataaaaaaaaaaaaaaaaggggcggccccccaaaaggg

SEQ ID NO: 4232 - DNA, 108 bp, Diabrotica virgifera
  Clone ID: LIB149-022-Q1-E1-H8
tttcgcatgcatgcgacttcatatcccttccatggtgtcacgtggattcacttcaatggccgtcgcattaaatcgtcgtgacatgggaaatccctggacttacccaac

SEQ ID NO: 4233 - DNA, 325 bp, Diabrotica virgifera
  Clone ID: LIB149-023-Q1-E1-A1
cccacgcgtccgcccacgcgtccggagctttgatcgttacaagtggaatcgatcccaatcaaaatataaacaaaatgagttccaaagacaatagcgatgttgcagtcgacaaattagacaacgaaaaaagtacagatggcaaagcagagataaaaggaacgaagcgagcggcagaggacaaaacagaagaccccaaaaaagcgaaaaaagaagaaaatggtgcaaattcagacggtgaggatttagatgaggaagaagaagaggccattgaagaagaggaagacacgggcgaagaagacgtagttgaaggggatgatgaagaaat

SEQ ID NO: 4234 - DNA, 396 bp, Diabrotica virgifera
  Clone ID: LIB149-023-Q1-E1-A11
cccaaatatttataataaaattttattattaaaattacttgattaatataagggatttgcttatttcggatcttccgacttttagtgacaattataacacagctcaaaaagttttcgtacattcggctcatcgtgttcataaaggatccatgaattatcaatttattgatttaatttaggtatagtattgtttaatttatgtagttatatagaattttcgcaaatctacaatggttttggtgtcagtactttatctggttcctttattcacaagcgaagttcatccgattttttcaattaatataaattaaattatgaattctagcctaaagcctgtttatattctaatattactatgtattttatttagttatataaaaaaattttaattcaaaa

SEQ ID NO: 4235 - DNA, 406 bp, Diabrotica virgifera
  Clone ID: LIB149-023-Q1-E1-A2
ccgcccacgcgtccggagctttgatcagtacaagtggaatcgatctcaatcaaaatatacgcaacttaggttcgagagacaatagcgatgttgcagtcgacaaattattacgttatgtaccttgagttggcaggacaaagatatagagaactatacgagcagcatatgccaattcagaagaccccaaaaaagcgaattttgaaagtatggtgcatattcagactgtgatgattgagatgaggtgtaagacgatgccattgaagatcaggattacacggacgaacaagacgtagatgtaggggatgatgaataaatatatgctgatcatgatgatgatgtaaagggcgacggtgtagagaaagactaggatgttgactcataataaaatgggagccgtcaaaccctg

SEQ ID NO: 4236 - DNA, 396 bp, Diabrotica virgifera
  Clone ID: LIB149-023-Q1-E1-A5
aaatgtcctttttgtattaacgtcatggcaaccactgttagtatttaaccctttcagctccgctgtaatatgtccagcatcatgacgcacttacgcgtcaaatacactggccaatagtcatctttggacgcgcgtatgcgtcaccgtagctgaaagagttaaatctctgtaatttctccaattttcgtttacccaaaaactgatctataatgaatttgggtacttgactggaaagtgtgatctaaattattcttctctcaaagaaattgtttgctgtcattttgagataggttaatgaaattaataacggaaaggattagcatttaaacacgttgatgcaatatacttataataacttgtaggagtatgtttatttttatgaaaatagtagttttc

SEQ ID NO: 4237 - DNA, 373 bp, Diabrotica virgifera
  Clone ID: LIB149-023-Q1-E1-A7
acccacgcgtccgcggactcatgagcggacgcttgcacagtctcgtgtacgttgttctacagtttaacacccaattatgttttattgccataaatgtatataatatcttgactattaattctgatttaatgtaatatggattataatattaatatctgaaaattgaatacatacaaaagatatataggaataactataggaattcagcgacctgatattcacatgtcaatgtataacatgtctgtttgtcataaatatcttgacacatatcgacgaactgttaaattgaatcggcgtagaagttgaattgtacctatggatcatttgcagtactattgatatagaagactggtattgtagctgcgtctaagac

SEQ ID NO: 4238 - DNA, 388 bp, Diabrotica virgifera
  Clone ID: LIB149-023-Q1-E1-B12
tcgtattaccaccaactcctccaccaagcagacgtccaattctacaaggtcctctatctaccaaacgtcctagacgaccaggccctctaccatgccgactgccctataccaccatgatgtctagcatgcagacgtgcaagaccgccaggctttcgaccaagcagaggtctaaaaacagcaggtcctccactatgcagccgtctaagactaccaggcgctccaccaagcagacgtccaagacgaccaggccctctaccaagcatacgtcctagaccatcatgtcctccatcaagcagatgtccaagaccgcctggtcctccatcaagcagacgtctaagaccactaggccctccaccagtcagacgtctaagaccaccaggtcctccac

SEQ ID NO: 4239 - DNA, 309 bp, Diabrotica virgifera
  Clone ID: LIB149-023-Q1-E1-B2
actatagttttagcaccgaactgtttattttttgtacctagtgtaacgtggattactacttgtcactacctagtattattttcgagtttagtatagctactaagtacagtttttattgaaaaatacatattttatgcaaatttcttgtaatgcactgttactcgattttaaatatatctaactttttacgcactaagttacatttatttattaccaatatatttaccattaagcatatttatattcctattatcaagtatgtttagggatgagcttaacaataagcctttattaaagtttacgttttag

SEQ ID NO: 4240 - DNA, 413 bp, Diabrotica virgifera
  Clone ID: LIB149-023-Q1-E1-B8
aacggagcacaaacttggcggataaccgaaaacaacagaagaaaactggaggcagtagaaatggacgcttttagaagataagtaggagtgtcacgccagagagagaatacgtaatgatgagataagacagcgaatgggggttgacggctctctaacaacagacatagaaagaaaacagctgatatggtacggacacgtccagaggatggataactcaagactccctaaaataattatgcaatgggtaccaccaaaccgcagaaagagaggaagacccaagaaatcttggagagagggagtaacgaacgcgatgagcgcaagagatcttagagagggccaatggaatgatagagtgtcatggaaattaggcatcggacaacgtcgcaagacgttttaaaaccgattgatatata

SEQ ID NO: 4241 - DNA, 406 bp, Diabrotica virgifera
  Clone ID: LIB149-023-Q1-E1-B9
agcggtcaaaatgcggcatgctatagaattattctggtctgatctggcgcgatctagtctaattcttgtttcgaattactaggattttaatgttcctcttgcttgttcctaaattacgcccttgcctctaggttatactcatctcacagaattacctaggacgacccagcatgaatagcccttccactatgacaagatcgtttggctttcttatggagaggaaagtattttataatacaaatagtttttatgcaattgaggagatagttaaataatacatcaataaaaaccgattttgcagttgaagataatatgttctgccatttcctctctattttcgcagaatcttcatgttgcattgtctactttgcccatttgtcaaatatatctgagtcagcagtgtata

SEQ ID NO: 4242 - DNA, 296 bp, Diabrotica virgifera
  Clone ID: LIB149-023-Q1-E1-C1
aaaccgtgcaaaggtttcatttacagaaatttttttaataatggctagaaaacaagggtagtttaaaaagaactgttcatatttagtaccttgtgtatcatggattaatatttaaaagctatatatttattaatttccaatttgaccctacatagttttataaaattattactgatttatatcatatagttaaatgaaattttttgtaaagatctgttaaacggcgtgaatatatcaaattttttaccatatttataacattaacttaataacaatatatttaatacaaattattt

SEQ ID NO: 4243 - DNA, 402 bp, Diabrotica virgifera
  Clone ID: LIB149-023-Q1-E1-C10
tcataacgcacgtgcaggcactgtgtcatctctgaaacttgtaacagattttacagatcttcaaaagcgaccaagaattgaatataacctcactgttgtaacagaagtcaatatgacatggattaccaaatctggcccattaaagaataaagtaactaatctaccctcatatataagtgatccacagccatataccactccaaatttcactgctttggttccgttggtcaatggaacattcaatgatgaatcttcctgtcgaaacgaaatatgcaaatctacttcgaaatcaagctacaacacaggctcatactacgtatttgatgatattactgtaacatttgaaagatacatcagtaaaccatatataaccagtactagatttgaaaatggaagtaacac

SEQ ID NO: 4244 - DNA, 414 bp, Diabrotica virgifera
  Clone ID: LIB149-023-Q1-E1-C5
atcataaacagatttatcaatagcgaaaatgtttaaagttacgtcacttgtactgatcatctcaattcttgctccttttgcaattgcaggacaggattcagctgttgaatggagaccttataatggagtaccagatgaccatgcaataataattcaagttcaaactgaatatagcccagctgtttatattggcctagcacacgtgattgataatgcagagcagtctgaagcttatcttcctgtaaatatagttgaaggcttcaactatgcaaacgtaactttaaatgataaaaactatatggctgacaatcttcagattctatgtttcaaaaaccctgatgcattgggatggcaatatacaaaagcagcaaactttgatgacttattgaatgattctaaaattgctcccatagt

SEQ ID NO: 4245 - DNA, 389 bp, Diabrotica virgifera
  unsure (1)..(389): unsure at all n locations
  Clone ID: LIB149-023-Q1-E1-C8
tacccacacgtctgcccacgcgtccgatcgctagtatcaccatatcatccgcgtagctatgcagtgttccttgctattgaaaatagtcctgtttgtgctcatatttgatcttctttcgatgtgttctaatactaggttgaataaattcgttgttagcgcatccccttgttttaaacctctattcactgtgaactatcttaacctccggatgaccaaggggggtaaatttggactccaatgtatgttttatttaataaagtcagaaatattttcaattttaaactcattatttttctatttgactttaatatcattctagataccctcatattttgtaataaaaaaaattccctaattttacaaaanaaaaatattttctgaatttgggg

SEQ ID NO: 4246 - DNA, 410 bp, Diabrotica virgifera
  Clone ID: LIB149-023-Q1-E1-C9
aggttcataacgcaagtgcaggcactgtgcagtctctgaaacttgtaacagattttacagatcttcaaaagcgaccaagaattgaatataacctcactgttgtaacagaagtcaatatgacatggattaccaaatctggcccattaaagaataaagtaactaatctaccctcatatataagtgatccacagccatataccactccaaatttcactgctttggttccgttggtcaatggaacattcaatgatgaatcttcctgtcgaaacgaaatatgcaaatctacttcgaaatcaagctacaacacaggctcatactacgtatttgatgatattactgtaacatttgaaagatacatcagtaaaccaaatataaccagtactagatttgaaaatggaagtaacacgaca

SEQ ID NO: 4247 - DNA, 397 bp, Diabrotica virgifera
  Clone ID: LIB149-023-Q1-E1-D11
aaccacacgtccgcccacgcgtccgtgattgttctcaactattagtttcactgaaaaaacagatgctccaactgcagcacccaccgaaagtacaactagaagcgtttgccaagaaggtgatcgaaatgagtatatacctgattgccacagattttttgaatgccaaaacaatagatgggtaggtcctttccaatgtccagctgatctttactggagccaagcaaataaacgatgtgtagtactagcgcagtcagattgtaataaacattaacgagagaagatattaacacataaaatgaatttgacattacaaccgaaggctttacttgttatattgtaatataattttgtctgttgttataatgagcttaaaaaaataattactaatttttcatta

SEQ ID NO: 4248 - DNA, 391 bp, Diabrotica virgifera
  Clone ID: LIB149-023-Q1-E1-D2
gggtcgagcccgcgtctacatttaatcgaaatatcaatttatagatgcaatatccacaattgatttgtttttatgcatataagatgtgacaactgtcacatttgactaaaatgtcatgttagaataaatgttataaatgtatagctactatcacggactgtaccttttttctatcatttgtgacgcactgaaaaatgctcatgaaaagacgcatataatattaatctaatagtagtatagcaccacttgattcatattccctaataattagttttaccataattttaatttataatacacacctatgtatgtaaccgattttaataaagtgactttacataattaaacacttttataggattaaaagttacatatttttagggatgaacat

SEQ ID NO: 4249 - DNA, 88 bp, Diabrotica virgifera
  Clone ID: LIB149-023-Q1-E1-D8
gcaaaacccaatagtgagtcgtattagtcgtcgtgaccgtctctagctagtttccgcactcctttagttcagcggtcggatgcgtagg

SEQ ID NO: 4250 - DNA, 253 bp, Diabrotica virgifera
  Clone ID: LIB149-023-Q1-E1-E1
tttaagcctggtaataattaattgtaaaaaataataattttaatttttaagaaagttttaataacatgagaaattaaattaatttaaatttagtcaggatgatcatatgagtagtcactgacactgtatgttcagtttgagtatggacgttcaacataggaattcggcgacattactacagttaaatagtttgaatttatattttacgatcggatttgtcagtccacaagtagcatatcgactgaaactcgtg

SEQ ID NO: 4251 - DNA, 391 bp, Diabrotica virgifera
  Clone ID: LIB149-023-Q1-E1-E10
ccatcggttaccaatatctggtgttttacatagattataacaaattacaatcaagatttttaaagtaattttggttgcgttggtcgtagcagtggtaatggcggaacaaactgcagaagaagcatggccacaatataagaaagatttcaacaggtcgtacgacgccgctgaagatgccgaaaggttcgccatattcaaggaaaagtacaaccaaatacaagaacaaaacaggcaatacgcagctggtaaatcaacatggacagcaggagtgaacgactttactgacagaaaacccgaagaacttaaacacctccatggtctcagggttcctgagggaaacgccgctggactccattaacctattactacctgaatgttttatacctgaaat

SEQ ID NO: 4252 - DNA, 399 bp, Diabrotica virgifera
  unsure (1)..(399): unsure at all n locations
  Clone ID: LIB149-023-Q1-E1-E12
tgaccaaccagttaattaacctaaccaaaccatgggaaaaccaccaaatggtgttcccccacaagtttgaccaattcattcaacaaggacaacgtcttcccaaagacttgctttcccaacaagtattagtctaccaacaagttcgccaattgattaaagttttgagcacccaacaacttaacatgatcaacttcatccaatacctcgttgaacaaggtaatcaagttgatcaacaattgtacgctgttcaaagaaatttttaccaacaagtccaaagacttgttcaacaggtagttcttcaacaatctcaaatcaaagaacaaatccaggtacttatccaacaagaacaaactgttccacaagaactagttttattccaacaattggcctaccancaag

SEQ ID NO: 4253 - DNA, 403 bp, Diabrotica virgifera
  unsure (1)..(403): unsure at all n locations
  Clone ID: LIB149-023-Q1-E1-E9
agtacacgtatctccatcgataaccattatctggtgttttacatagataataacaaataacaatcatgatttttaaagtatttttgtttgcgttgttcgtagcagtggtaatggcggaacaaactgcagaagaggcatggccacaatataagaaagatttcaacaggtcgtacgacgccgctgaagatgccgaaaggttcgccatattcaaggaaaagtacaaccaaatacaagaacanaacaggcaatacgcagctggtaaatcaacatggacagcaggagtgaacgactttactgacagaaaacccgaagaacttaaacacctccatggtctcagggttcctgagggaaacgccgctggactccattaacctattactacctgaatgttttatacctgaaa

SEQ ID NO: 4254 - DNA, 400 bp, Diabrotica virgifera
  Clone ID: LIB149-023-Q1-E1-F2
agaaacatgaagactacctttgttttggccattttagtttgcgtcggtcttaccgtcagcgcccaaaagaatgactttttgtgcgatacctgcgtacgaatagtagaagtagtccaggactacgtacgaaaagaaattccattggaagaagttgaaaaagaagtgaaagaattgtgcaaagttttaccaggagatttggcaaaattgtgcgaggacaagttaattccagcaatcgaccaaatgtacaaccagatggaagacactcctcctagagatttatgcgtagagttggaattctgtaattaatttgtttgttagaatattataatacaaactcaaaattaaatttggaaaaaaataaacatcatgaggggtactgtctatggccatcaaaatactc

SEQ ID NO: 4255 - DNA, 302 bp, Diabrotica virgifera
  Clone ID: LIB149-023-Q1-E1-G10
aaatttggtaatttggtaaaggaaaggattaaaaaggagtataaatccaaggaattaataataaaaaaaaaaaaaaaaaaaaaaaaaaaaaaaaaaggaaaaaaaaacaaaaagaaacaaaaaaaaggaaggccaaacgggggggccgccccaagggatccaacctaacgaacccgggcaggcaacgccaaagccctccaaaagggccaccaaaatccaacccacgggccgccgtttaaaaacgccgtaacggggaaaccccgggggttacccacctaaaccgcctggcagcagacccccct

SEQ ID NO: 4256 - DNA, 383 bp, Diabrotica virgifera
  unsure (1)..(383): unsure at all n locations
  Clone ID: LIB149-023-Q1-E1-G12
cggcccggtgttgtattggtttcccgtcccaaaatctctctctcaaaaaattatcctccaattgtcgacccaccacctattttgcgctaacgccacgagaatgacggtgttggggctcacctaagtgtcctaagtgattgtttgctgcatatcgcggaagatatgcacactgtgttctgcgtgcctgcctccatctaccttttgctcattatcaccccctacacgacttcctggtgggctgttggcagtcatttggtaatggatccaaaccaaacctgtaagagggcaagatgggcacgcggaaaaatggcagacatatgccacaataaaccaggattattaaatcaaatagccaaaggtatagccctgngtcaaaccgaatg

SEQ ID NO: 4257 - DNA, 321 bp, Diabrotica virgifera
  Clone ID: LIB149-023-Q1-E1-G3
aaaatgaagagaagaatcggtctttgggtgggggcagcatgtggaaaattgagagaaactttaaaagtgagttgctcacatgtctaaagagaaaggtatttgatccgtgcgtccttccagtcttgttagcctcagctaccaaactaagagtgacacagagaagaatggaatggtccatttgcgaataactctgcgagacataatcaaaaacgaagaggtcaggagaagaacaaaggtgactgacgtcatcaaaggatagccagactaaaatggagatgggcaggacacatagccagaatgacagatgggcgatgaacaaag

SEQ ID NO: 4258 - DNA, 371 bp, Diabrotica virgifera
  Clone ID: LIB149-023-Q1-E1-G8
acgctggccccttgggcaggtgtcagttatgcaatattatgtcaataatgatctaagtgacgctaatttaacgaaatctgcatatgattgtgtgttaccatcataattatacccaaggccaatatatttattatcaccagcgcctaacggactaccaagtaaccattgcctctatatgactttccggttgccctaaactacaaacttcccatttctccagcaagctaacgatctaaactaccattgtcttgtactaagctgttattcgatttcaccaacacctcatttattcagacgtcctataccatttatttctccaccatacatttatccttaactatctgtacctcaaccaatacatactactttta

SEQ ID NO: 4259 - DNA, 332 bp, Diabrotica virgifera
  Clone ID: LIB149-023-Q1-E1-G9
aataaaataaaaatttaaattaattaaaattaagaaaggtggaaaaaataatattaaaaaattgtgaaattaagaaaaattaaaaaggttaaaaaagggaatccggaaaaattttttccaccggtttttaaaaacaatgccttttggagtaaaaaaaaaatcccccctggccaacggataaattggacggccccgggaatttggcccttccaagggacccaaaaccataacttttttaagggaacccgggaataagggtttggatgaaaaaaaaccggccttgattaatttaaaaaaaaatttacttttaaagttaaaagcctaaatttttt

SEQ ID NO: 4260 - DNA, 393 bp, Diabrotica virgifera
  unsure (1)..(393): unsure at all n locations
  Clone ID: LIB149-023-Q1-E1-H10
tactttaccacttggaatataagggtacccaaatttggtggtacttaaaagtaccgtcgggagactaagggttaaacttaagtatttctattgttaggaccgtttctgaagctagcaacaataagacttaatatcacctaaagcattcccgtctgtatgtttactaatagcaggtattgaacgagactattaataaatttaaaacaaaatcaacagacactaattacaatacctactaatcaactataccttcgatggcctattgttgagagaaaatggtagttctccacaagcgcaatataatacacacaaatttacattggttgctcaacaattcataanaacaatagacggataataatatataaaaggtaattcaatttacgtaaaaac

SEQ ID NO: 4261 - DNA, 400 bp, Diabrotica virgifera
  Clone ID: LIB149-023-Q1-E1-H12
gggttatccttgattgaagtcatgcataaatcaatagtttatttttatcttgttttaaaactgagtttctttattagtttgtatgttaaatctgtgcattgcatcattaacatatgttgtcgaataagcatagctaatgatacaaacgagaaatttgtaccagtgttgctgaagactggtccagcgggatttgatttggcgatttcacaaaataacacaattaaattaaaaagaggtgaacatattgcgttttattgtccaaagaagaactatcttagaataactaatacaagtgtagaacatggaagatgccttactggcaatagtttaagtattaaaggaaatcgctttgatttttcttatatcttgtgtaagaatcatgttgtgggcgaactgcaaa

SEQ ID NO: 4262 - DNA, 247 bp, Diabrotica virgifera
  Clone ID: LIB149-023-Q1-E1-H3
tacagtgggtttcctctacacttctttgcgccagtgattgctatatcaaacacgttgtttagcaaaacaatcggcagttctaagaggtgaaaaagattgaaatgctcaacaatgattcattgtaaatatatgattaagaatttatacataagtgacgattttattttaattctttttgacaacttggaatttatgttttatgtttttctttttaattttttgttattaaactttatttttttatatt

SEQ ID NO: 4263 - DNA, 411 bp, Diabrotica virgifera
  Clone ID: LIB149-023-Q1-E1-H6
agcaaaatgtttggatggcctggggttacagttgggttttagtttcaatgttttatatgcgctggaatattcgacagggtgttccaaactttgaggagggaacacactgtcattgttgcacccggtatgcaatgacacttgtctgttcgtcagcaatattattacatcgatattcttgaggaataaagctatgacatattaaaaaaaaagcactagaatcgaacaataggtttaggatatatgagacattggaaatgtcccatttttgaggtgatgcgataattttgacgcttagtgtattaactccgggtattcttggtttattgattatttattgactattttgcagattatcttgagcctaaaaattgtataaatattgtatattaatttatcttatatttgcgattt

SEQ ID NO: 4264 - DNA, 402 bp, Diabrotica virgifera
  Clone ID: LIB149-023-Q1-E1-H9
cccacacgtccgcatcacgctcagatggatggcgtcactggtatgaaatacatatatgctaagaaattgtggtttaaaagtaaaaagtcgacctgtttcgggatgttcctccaaagtcgtccatttgagagaaaatgaatttgttccgtgatttggcccttctctgtataataaacctgtctattttggaatcaatgtatctttcccgaaacattagctaatgtaaaatacaagagtatgataccacaaaaaggtttgttcccgtttccaattgcattaccaatcaatttgttctttctcaattttctattcagtataagctatacgtttcaaatgagcatcttttttttttggtgattactgtcataattgtttgagaattgaaattttttatctctaagc

SEQ ID NO: 4265 - DNA, 359 bp, Diabrotica virgifera
  Clone ID: LIB149-024-Q1-E1-A8
attttaatccgttatgtaattttattgtaaattatcaaatacatttggatttggaataaaaagatacacttgataaatatttttaaggatgagcttaaaaaataaaattttattaaaatttaattttaaaaataaaaattaagattaaaaatttgcatatttgacaatatgttattagttacttttatatattagtatttttattttttataaattttttattaggatacaaatttaaattatttaaatttagtaatgatgatagtattagtattaaagtattgtatatttagtaaaaatatataggtttaatataggaattcggcaacattttttttacctgtttagtaaaaacatgt

SEQ ID NO: 4266 - DNA, 405 bp, Diabrotica virgifera
  Clone ID: LIB149-024-Q1-E1-A9
ccagttctagtgtaattacaaagtgtagtagtgaaaaatagtattcaggatcaatcaaaattttaataggtaaatctaccagtacctttgcctttttgtggttttgtattgttttagcgttatggagaccgatactctacaaactgcaactcccgctgaagcagagatacctgcagagattttggctgtaattaaagcagcagttgaacaaactctcgtcagtttaatggaaaaacatcttggtaaacgtaaacattgcaggtccaggtctagatctaagagcagaaaccgttccagttctcgaagccgtggcggacgttctagatcaaaaagcaaaggtagatatgacagatcaaaaagtagaggcagacgtgacagatcaagaagcagaggtaggcatgacag

SEQ ID NO: 4267 - DNA, 393 bp, Diabrotica virgifera
  Clone ID: LIB149-024-Q1-E1-B12
aatgaacttcatctgagtataattttcataaactaagcagttaaaacagaatgttgaaaaacagattgtaaccgtcttctttgtaaaaatgtacttaaatatctcgtttaaatatttaaaatagaatgtagattatacattgtgtgagcataaaactgtaaaccctgaaattcttgaaaaccctaaacttttggaattattttactgcttcagttgtgcaaactataacgaaacagtttagttaagtcgatatctaattattttagatgttgaaagtattccaaaactgtaaaattaaagattttatatatgcccgacataacgtcacattgttaaatagatgaagaacctataagaacctcaattcagcacaaaatgagatataaagacata

SEQ ID NO: 4268 - DNA, 318 bp, Diabrotica virgifera
  Clone ID: LIB149-024-Q1-E1-B5
cgagagtcatacaaaatggcaaaaatcgtcctcttcttcagcgccatcagtttggcttcagcagctgctttaccaacccattcacctgacggacgtgttgtcgacatcatcaagaaggtcgtgcacaagcttgaagacataatggatcacgtttttactgaaggtcccaatttcatcgacactttccctgacaagtatgacgaccgccttactaaagtgccagatgttacaatgaccgtgcttactaaaatcgctcaagcacttaaagttgttacagataaacttgctgaacaaagtaacgatgctggaaagaaattg

SEQ ID NO: 4269 - DNA, 365 bp, Diabrotica virgifera
  Clone ID: LIB149-024-Q1-E1-C12
aactgttacgtgggttagtttatctgtttataaattgatatttaattcagtagtcagacaaaaatattgaccaaggtgatattttctattcaacatagtgtttcaggttcgccggattatttatgctttagtatacattaattatacacgcgcaagtgaatactgtatgacacatgctgataatcggaagatattatctttaccctgctaactgtgtcacaattcattagtctcaatgtgctatcgctgttttcatagtatgtccggtaggtttaattatcaattgcattatcacaaagtgtgactggtaaaccaatagttctctctcatttgaatgatgagcttccacgaacgaggttatcaag

SEQ ID NO: 4270 - DNA, 377 bp, Diabrotica virgifera
  Clone ID: LIB149-024-Q1-E1-C5
acgaagatgaaggtactagttctgttttctttagtcgtactcagcgttgctctaccaacactccttggtagaaccgtaagagtcaaagaagatggaactgtatctctcttcgactctagaggataccaactcgtaatcctcaagagtgttgccgatcccagtcaagtcgaagttgttctcagaagtccaaacacaagaacccagatgttccaagttggggaaccacttagaactggagaagctatcgaccgtcgtaccctcgctggtgtttccgtttaccaaaactacaaccaagctgatattcttactgatattttccgtcagtatgaaggtattcttgacgacaccaaatactacaaccttcttaacagaattca

SEQ ID NO: 4271 - DNA, 345 bp, Diabrotica virgifera
  Clone ID: LIB149-024-Q1-E1-C7
agcgaaactacagggtagtattccatggtgcctaatgtatgctgatgatatagtgttaatatgaaatagagtgagagacttaaaacaaattctggaacagtggagacaagctctggaggaatgaggtttaaggcttagtaagacaaaaacagagtatttggaatgttcatttatagatggacttactacatataatatggaatctttggatggtgaaatgattgtgaaaagcataagtacctatgatccgtattacagagtaatggagaaatatatggagatgcatgcagtagaattatggctggatggatgaagtgagaagaagcgagtggtgtgttgtgtgac

SEQ ID NO: 4272 - DNA, 229 bp, Diabrotica virgifera
  Clone ID: LIB149-024-Q1-E1-C8
agtttattttacctttctaataaaataaataaaacaaaaaaaaaaaaaaaaaaaaaaaaaaaaaaaaaaaaaaaaaaaaaaaaaaaaaaaaaaatgaaaaaaaaaaaaaaaaaatgttggagaatggggaggatcccttctggtttcagccttacttgtacgtgcaaggttcattaaaactgcttccttactgcaactaaaatgcaatccactgacggtcttttgaatg

SEQ ID NO: 4273 - DNA, 329 bp, Diabrotica virgifera
  unsure (1)..(329): unsure at all n locations
  Clone ID: LIB149-024-Q1-E1-D5
aaacttccaagggcaatcaagagtaaaatccccaatccaaggagatcttaaggaatagagtacaaggaaggagcttcaatcaacaatggttgaacaattccccagtccaatctttgcagaccatcttgcaacagatccagcaacaacgtggacttcaacaagaattattgggacaataccaaaacttgccccaacaatatttgaacgctgaatatctccaaaaccaagacattggtaccaaccaaatcttaaacctcatctacagacaacaacaacaacttggacaaggcagaccagtaccactaaaccantaccaagacattgatacc

SEQ ID NO: 4274 - DNA, 309 bp, Diabrotica virgifera
  Clone ID: LIB149-024-Q1-E1-D9
cacgactctaccctcacgtcctgttacatcatatattacttctgagtacaagtcacgtgtcattttagttaatgatagttaactcgtattgtgagagaatattttattttgatgcggtataaagttagttgctgtgccttgtgtaccatggattattaattgatagctagatagttaggatttgcgaatttaaaagaggtcattaattaatttttttattgttttatatatattttaaatagcttttttgtattgaaatgtcattcgtttccaaatatgtctaattttttaagaaataaattattttta

SEQ ID NO: 4275 - DNA, 384 bp, Diabrotica virgifera
  Clone ID: LIB149-024-Q1-E1-E1
actactaggtgtaaaagataaatcttattctatctgttcttaatgagttttagataattttagttgtatttctttgtaattttgtgttgtacaaagattaatttaacattttctctggaagtattaatttagaaagataatatgcttcaatggtgttgtgttttgaagtgtgaaatgcaaagtaattgtgataaagtcaagataaatttcacttttaaactgaactaaataaggtttctgagagacaacaatggttaaatgcaatacaatgtacaggttttactagcgaaatgaaaattttcctgtcctgtctgctgtaatcattttatatctggtaagttacaattacaacagtaacgattttttgaaaatgttaacatttta

SEQ ID NO: 4276 - DNA, 402 bp, Diabrotica virgifera
  Clone ID: LIB149-024-Q1-E1-E10
cgcacgaatctacattgacttgtaagatagcaattcaaagacatacataaataaagatagcagatagttgaaaaacgcagatagatcaagttgaaattgaaatccttgtcgaatctttgtgaaatacaagacacatacaataacattcaagatgattgtgggaagtttatttttaatcttattagctacagttcatttcggaaactcctacgtttgtcgaccttgcgaggaaaaaacagtatgtgaaccactttcatgtcgagaaggacaaaaacctgttccaaaatggtcatgtaattgttgtgatacctgtctcacagtgttgaaagaaggagataattgcagtggtaatcctttcttaggagttccaagtcaggttgtatgtgacacaggcctcatttg

SEQ ID NO: 4277 - DNA, 399 bp, Diabrotica virgifera
  unsure (1)..(399): unsure at all n locations
  Clone ID: LIB149-024-Q1-E1-E12
aatcgcggcacacatttcaaacagctgttgtaaaataaagagaagagacagtgacttcgcgctagcacggctggacagttactgaactgaacggaggaacgccacgatgctaagatgagcgcgcaacccccttcctagcggctacagatcaaaacgtaacgaaaattctggatagccctcgtatatacggtaactcgcactattcaatgaaatatgttcattcacgatttttaaagtaaaaaaatttgtttttttttagatcgatagtcgttgacatttcatctggtactttttccagtttttaataataaacatttttaggtgattttttttctttataatgaatgtgtattaaatctctgacttatcgttccaaacttgtcnctcaattcttcttaa

SEQ ID NO: 4278 - DNA, 228 bp, Diabrotica virgifera
  Clone ID: LIB149-024-Q1-E1-E2
tgctgttaaaccaggactagccttcgagttccactttttcaggtggctaaagagtctaatactcatatgcatgggaatggcgtgtcgaggcttacgaacaaatcagcgtcactccagttcatcccggcttgggcgtgacctcttcgcagttaaatgaggacagtgagcacttttcaaattagaagacgatatcattaatcagccacagtgcacggtcatttggtgaat

SEQ ID NO: 4279 - DNA, 350 bp, Diabrotica virgifera
  Clone ID: LIB149-024-Q1-E1-E5
aaattgagtcaaattaaaaaaaaaaaaaaatttttaagtaaaagtaaaaaaaattttaattaatggaaagtaaataagaatggtaaaaaaaaatttaattttaaaaaaagaaaatttaatttttggaccctggggaacaaggaataataaataaaaaataaaaaattaataatttccaaattaaaagaaccaaaaaattaaaaattttaatggtaaataaataatttaaataaattttttggaaagaaatggtaatccgttttaaataaaaccaaatttttaaaaaataaattaaatttaattaataacaatataattaacaataaataattttaaactaataaaaataa

SEQ ID NO: 4280 - DNA, 364 bp, Diabrotica virgifera
  Clone ID: LIB149-024-Q1-E1-E7
gctcatatgagagacatacacccatgcaaaaatgaacctattgatgagttcagtgaaccagaagatctcatggaaggtataacaatggtggtcgatacaaatgaacctgaaccatatgaagatgactccaaagcatggtacagggaagaggaaatccatcagactgaagaagacttaaaggagctggaatctggaaatgatcatatttgccacctctgcaatcagccattcccattaagggccatattattgcagcatttagttacctgtagagcaacaacaggcaatacagaatctgctcctttggctgtagttaataaaatcatcatatagaataaatagaaagccactcataattgtaacg

SEQ ID NO: 4281 - DNA, 409 bp, Diabrotica virgifera
  Clone ID: LIB149-024-Q1-E1-F10
tacacacgcgttctggtcggaccaaaggataacaatggaaaagaaagaatcacaaaattgccgaagaagcataatcaagataaaacggaaagcagaaaatctttcactgcaccattagatgatgacgatgagaatgatggagataatgaagaaagcgatgtcaaaccaacggataacgatagaaaagaaataatcacaaaattaccgaatagccacaatcgagataaaatggaaaacagaaagtcattcactgaaccattagacgaagatgctgaaaatgatgaagataatgaagctaacgatatgcaaaataaaaacaacgaagcagaaactgtaacagaaccatcccataaaagtaataaacagaagaataacgaagaaaccgatgaagatgagattgtagttcctg

SEQ ID NO: 4282 - DNA, 201 bp, Diabrotica virgifera
  Clone ID: LIB149-024-Q1-E1-F3
tatttttaaggtcataggtaaagatatttaatattattaatataaaaatatttagttataagtgtattgtgaatagatacatttatgagttaaatatttttataatattaatattaaatatttttagggattagcttagaattaaaattttactaaaagttaatttttaaataaaaattaggagtaaattttttcatagtt

SEQ ID NO: 4283 - DNA, 327 bp, Diabrotica virgifera
  Clone ID: LIB149-024-Q1-E1-F4
tttttaacaacaagtcccaacccaaaaaagaatttaaaccaagaactccggaattccaaccttagaaaacctcctttgaacggaaaaaatttaaaggggtcccttaaacctgagaatggaaccaattaccagaatgaaatgtacaaaatgctgaaaattaacccggtgcacaataaggaaaacctcactagcctacctaaagatgaacagcgcaaactaccatttttaggatcatgtgatcaagcccaaaacgatattctgaaatgggcttacttgctgcaaaacttacgaagaccttcatcccttgctagggtgttaacatcaacg

SEQ ID NO: 4284 - DNA, 89 bp, Diabrotica virgifera
  Clone ID: LIB149-024-Q1-E1-F6
aatttaaatattttgattttgttataatataaaaaacttcttttttgaagagttgttataaaataaattttttatcattatatgtacat

SEQ ID NO: 4285 - DNA, 407 bp, Diabrotica virgifera
  Clone ID: LIB149-024-Q1-E1-F7
agttaataaataaatttataattaaatatttttatattactaatattaaatatttttaagctcatccctaaaaatatttaatattaataatataaaaatatttaattataaatatattgttaataaataaatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaagatataaatttaaattatttaaatttagtaatgatgataatattagtattaaaaaattgtatatttagtaaaaatatataggtttaataaagga

SEQ ID NO: 4286 - DNA, 357 bp, Diabrotica virgifera
  Clone ID: LIB149-024-Q1-E1-F8
aatttaatgatagttgcttatattataacactagtactacctattgtaatatagttgcaagggaaatactaatccgcgttaatattacatttttatctacatcaaatttatttattgtacattgggtgccagggattactttgtagaaaatctttcattcaaagtatcaaatttttgagagcgacaaaattaggttttttatgggtggctaaataatttacacacattgattgtaatcaagtgctcatctctttctaaagtataactaatattgttaagaatgttcatatgtttacataatcgtagtatatcaatccgaatgtagatctagctgagccgtatcagcaacttctacgg

SEQ ID NO: 4287 - DNA, 401 bp, Diabrotica virgifera
  unsure (1)..(401): unsure at all n locations
  Clone ID: LIB149-024-Q1-E1-G11
acgaacaaccggcccttagatagtttgtgagactatacatcttaggaactttttaacaaatacatgtattatgtgactactgacaaactgctaatttttaatgtattttcgactaaaaagtattaattgacatgtagctatcgccagatctgctaacacagagtgaaagtaaaaatcacatgtaactcaaattgagaataggtagaacgatttttatttaaaccaaattgtggatttgtgctagtttagcttatttattgacgtttgataatcaatgtctctctgtaatgtccggcagcacttggattgaattttgattctaatcctctcttttaagttaaccgaagaattattttgttttattttagaatgatacgtanatacttaactcgagttcacct

SEQ ID NO: 4288 - DNA, 345 bp, Diabrotica virgifera
  Clone ID: LIB149-024-Q1-E1-G7
atgtcagcgtgtcaagctactgtctccttgagttgtctgattatgcccatgggtccagttctatgtgacaatgttgtgtcataaagatggccaacatttagtgtaacatctcttgcacttgcaaagatagtatctaccatgcgtgattacgcagatttcgagtgagctcctgatcaaaatcgacgaatctacagcatgtggacgcaagcattttgacggctcataaggtgcatgataaacttgtcgatcatatggttatagatgcttgtccattcggcggacgtgcatcctacactcacattgcccatggatcactcgattgagctgacgtactcaatcctcaag

SEQ ID NO: 4289 - DNA, 358 bp, Diabrotica virgifera
  unsure (1)..(358): unsure at all n locations
  Clone ID: LIB149-024-Q1-E1-H12
aaatgggtacaatatggtgtccagaaccaacccggtaactactggaggcagtacgtgcaacgcagcagccaagctgaaaatgtcgatttaccttggatgtatcactcttgggatgtccaggatatgcaaaacttaactcccgttcaacgtgttcagttgctactcaactacgtcagacttcaccaacaatggaaccaatggacacatgatgtaactgccaatgaacgtcttcagaatatgttgtatcaacaccttcctgaacacttatggagctccaacgagcaaattgtaccatacatgatgaactacttcaaccaatacccaatganatacaacgacattatgcatgaagttatgc

SEQ ID NO: 4290 - DNA, 366 bp, Diabrotica virgifera
  Clone ID: LIB149-024-Q1-E1-H3
accacacgtccgactgctccaagatgaaggtactcattctcctttccgttgttgccttgagcagctgcttaccagcatccagaaatcaccactacgttgatgtagactacaacagctacaacgctcatcccgtctacaacttctggaggacttggaatcagcatcactatggacaagaaccatggaaccaatgggtacaatatggtgtccagaaccaacccggtaactactggaggcagtacgtgcaacgcagcaaccaagctgaaaatgtcgatttaccttggatgtatcactcttgggatgtccaggatgtgcaaaacttaactcccgttcaacgtgttcagttgctactcaactacgtcagac

SEQ ID NO: 4291 - DNA, 294 bp, Diabrotica virgifera
  Clone ID: LIB149-024-Q1-E1-H4
aattgttctagatctgataaacaatctttaagaaaagttaacgcataatttaattaatggtcagttaataataatggggaaagaaaatttaattttaataaaagaaaaattaatttttggtacctggggtgccagggattataaattatcaattatatatttattgttttcgaatttaaaagacctaaaaaattaacatttttattgtaaaatagatattttaaataatttttttgtaatgaaatgtcactcgtttttaaatatagctaattttttaagaaataaattaaattt

SEQ ID NO: 4292 - DNA, 376 bp, Diabrotica virgifera
  Clone ID: LIB149-024-Q1-E1-H5
cccacgcgtccgaggagttacaactgagatgtgagacatcagctgctgacttggttagttgttcccaattcgcatccaaagtgttaaaacgctacaacaaccatgaaccctgcggaaacaatgcgtacctgaaatggaacttttttccatcattccgtagacgtgaccgctcctcccgatcgaccctgagtgtaatcaatgagaaacctaatgggcaaatcaaaaatggaagaatcaataggaagaagaatcgtactaactaattgccaaatttctatgcagtactattgtaagcacagtttgttttaaattcttataaaaaaatggtcttagcttttaatgtatagtgtgtgttaactgcaagtttgttcatgtg

SEQ ID NO: 4293 - DNA, 172 bp, Diabrotica virgifera
  Clone ID: LIB149-024-Q1-E1-H7
acccacgcgtccgtgttgctagtcaaaaaaatcattcgatttattttttttactgtgaaatatatagccaattttacacgtactcaactagagttaaggtaaaatcacttattgtttacagctaatgaattagtgtctttatatttgtatttaataaattgatacataatgc

SEQ ID NO: 4294 - DNA, 67 bp, Diabrotica virgifera
  Clone ID: LIB149-024-Q1-E1-H8
actaattctagatctgataaacaaacttgtgtaccttaaaacaatgtaacttagcaattatttttat

SEQ ID NO: 4295 - DNA, 345 bp, Diabrotica virgifera
  Clone ID: LIB149-025-Q1-E1-A1
aatggaaatggcttaaaaaatccaatttttttttaattaagaaatattaaataagaaaaatttttttccaaaaattttttaaccaataaaattttgtaaaggtccttaaggttaaccaatttaaattataaaagttcgtgttaatggtaatgattatattttaactttttcttctttatgataagatttttatttagattaatttttttgattcctttatgttttaaaaaaaatttttgattaattcaatgattaatatttttttttacatttttatttttttttaattatggtagaagtttaaattatttctctatttcaaatattttaagtattgatttttga

SEQ ID NO: 4296 - DNA, 380 bp, Diabrotica virgifera
  Clone ID: LIB149-025-Q1-E1-A10
acgcgtctactatgagtcgtgatattaccagagatgacgcgtatgatgtagtgtgttaagaggactttgtactgcctaaaggaagtcatggccttcatggcatctacgttccctttgattagatactttaattctttcagcgtcgggaataactgtaacttgagacgattacatccgggacttattttacttttctcatggacttcaacgaccgatttttagactcacagtacgtaatcaggtcattaatttaacagataggattatgaatcgatcacctcttaggcattgtctgtttcaatttatggagtattcattttttgtacaattttggtttcatgagatacatgtctacattggaagaagcttccaattctttt

SEQ ID NO: 4297 - DNA, 457 bp, Diabrotica virgifera
  Clone ID: LIB149-025-Q1-E1-A12
gggtcgacacaagactctataatgacgtctactaacgcgtccggaaaaataggaagtatggtttagtgtcaacaataaaaatataatttgtgtactttctttaaatatgaaaattttaacggattttacccaaaatttacttgattttctagtcgagcaacaatatgaacatagtcagaatattattagaactcacaccaaaaaattgaatgaattgggtgatttaagttttcctacaaatactaaaaactggtaccaattcattgatgtaattaaagaagaatcagttaaaagtgtgaatatagttaaatttgaaatttcagaaacgactagagaattagttacagagcaattgctgcaaaaaagctccagttggccaattgaaataaataaaattgtttttaaaaaggctgatgctcacatacatttgaaaagaagtccagtactttataaaaca

SEQ ID NO: 4298 - DNA, 418 bp, Diabrotica virgifera
  Clone ID: LIB149-025-Q1-E1-A2
aaagggtgccttgtgcaaccggctaacaagcatcaaaaaacaaaccccattacggccagcagcagaactatggcgacgtagagaacaatcaatacagcagccaccccgtctacaacttctggaagacttggaaccagcaacacaatggacaagaaccatggaaccaatgggtagagaatggtgcccaaaaccaacctggtaactactggaggcagtacgctcaagctcaatctcaagttcaagctcaagctcaagctcaagctcaagctcaagctcaagctcaagctcaagctggaaacgtagctttgccatggatgtatcacatttggaacgtccaagatcttaacgaactatctccagttcaacgtgtacagttgctcctcaactatgctagacttcaccagcaatggaaccaata

SEQ ID NO: 4299 - DNA, 409 bp, Diabrotica virgifera
  Clone ID: LIB149-025-Q1-E1-A6
cccacgcgtccgcccacgcgtccggagatatttgtaattttatttaacatatttacaagatgaaacctattattttgtgtttgatgataatagcagcatctaaagctattccaacaaacagattaaccaatgatgatgccaacttgggagattttccatggatcgtcgcgttgaatatttacgtccgtatgccatggtacgagataacttatcacgaatgtggaggcgtacttgtaagcaaatcttgggttttaacttcagctagttgcgtcaaatctaatgccgtatggaatacagtgacagagatctacgctggtttcgtacgacaaaacgacccgtcgcgtcaatcatttacgatttcaagaattgagcgacatcgtggttttaatatgaatgaatctcgcaatcc

SEQ ID NO: 4300 - DNA, 398 bp, Diabrotica virgifera
  Clone ID: LIB149-025-Q1-E1-A9
gaagtttctaaaagtgtatcattgtaaaagtgttttatataaagtgaagaatgggcgaggtattgaacaaagatgcactgcattcttggattcagcgtgcgataggtacagaaaacttcaattttactgtggaaaacaccacccaaaaaggagagggttacgtaggggacttatttttcgttaaaattgatttacaacaaccgattaacggactcaacgttctttatctggtcgtaaaaaccaacaagagggatcctggatcgattcgtctcatgcaggatttttgcaagatagaagtattcttttacggcacagtttttaaagaatagcaggaatttctaaataacaagaagcttccagttcttttagacatggtacccaaatgttataaaactttt

SEQ ID NO: 4301 - DNA, 378 bp, Diabrotica virgifera
  Clone ID: LIB149-025-Q1-E1-B12
acaacatcctataatgagtcgtattacgctattcaagaaggtattgaaacggccctcaaccatggtcttatcggaaataccgtcggagacttccttaaaatgagattcaacactgtctggtatcccactggcaaagtctggcaaatgatggactggtgcaacggcggctccaccgacgccccaacaacagctgcagcatacacaattgcaccctcaacagctgcaccatagacagatgcaccctcaacagctgcaccatacacttatgcagcaccaacccttttataagcataaaattaatttaaaatataaccaagaatatattttccaccagctttgtaactataaattactaatatttcgtatccattatttact

SEQ ID NO: 4302 - DNA, 361 bp, Diabrotica virgifera
  Clone ID: LIB149-025-Q1-E1-B6
ccagtacagcccagtgaagtgctaggaactataaatcagaaatagagatgttcaaattaaacttcatttgtaaataaacttaattgattgtgttaattgtttctaaacctttttattgtccatatgatataattatattattatgaagaccttagactccttaaagtttagagcaacaacgctagatgccgcaagaactattgtactattaatgggtcgtactcaacttatccagtcacaactcccagatgcccaaaacgcatacgcaccaaatcgtatacgaccttattcaaatacacacccactcacatatattaattaacgtagtaattatgttgtattataataaacatttataact

SEQ ID NO: 4303 - DNA, 411 bp, Diabrotica virgifera
  Clone ID: LIB149-025-Q1-E1-B7
cttgacttcatatttttaaacatataacataagcataaaatggcttctaaagcttcttttgtctccgtattgatgttgttggttgctgtagccaatgcttatgatgtaacaaattgtccttcaaataccggtcgccagagaaatcttgtttacgacaatcttttatcgggagtgtctatcaatgttcgtatgccaccggcaggatattttaatagacccataacgtgccttcaactaattgatcgacagggaacctctgtttctccaaagatagtggaaggcggatatctcgatacatacatggtagtcaatattacatcattaaatggtcaagtactttattaccaggcacaaatatatattgattaattaaatttccttaattgaattatatcgttattatatatgtat

SEQ ID NO: 4304 - DNA, 270 bp, Diabrotica virgifera
  Clone ID: LIB149-025-Q1-E1-C12
ccctatcatgagtcgtattattcaatctactatactatctcttaggaccactcatgaactattttacttactgatagttaactattcttgtgagacaatatcttaattttataaaagaaaaacttattttatgtaccttgtgtaccagggactatcaattaataattagaaacttattattttcgaatttaagagagctaaacattctatctttttattgtagaatacataatttaaccaatttttttgtcctgcaatgtcaatcgtttt

SEQ ID NO: 4305 - DNA, 420 bp, Diabrotica virgifera
  Clone ID: LIB149-025-Q1-E1-C6
tattagggaacttaaaaaattatggcattggacgaattatagtcagaagtaaattagaaagatatccagagaaatcttatatgaaggttctaaaagttgagacgttaccaaatcctgaaaacccatcaatggataacactagaaaaattaaagtttgggtagaagacacatttagaggcaaaactttcccggaacctgttcttattgaaggtatcagttacaaaacggattatagattattaccaaaggatgaagaggaagcatattgtaaaacgtcagaatataaatatcaaaagattcttcctaaaactatggatttccctccgctccttaaagaaataataaaaaggatagcaaaatctaaaggagaaaatgttacagaagatccaaaattaaatatattttacaatcaaacgagtt

SEQ ID NO: 4306 - DNA, 295 bp, Diabrotica virgifera
  Clone ID: LIB149-025-Q1-E1-C8
cccacgcgtccgcccacgcgtctgccaataacaagaccagtagcggagcgtgcggaggaagcgcatcacgatcgactatataggtgaccgtatcgcgagggatgaattcagttgacttcaagcagcagcgagaggcggaactacctgacctaacaatggctactctacttggcgctgagaagttttattagatcatcatagcttaatttgtgtagcagtagccctaaataattgttttgagcggcaaccaaaccattcccgcaagttcggcagacatgaagttcctcctcctccg

SEQ ID NO: 4307 - DNA, 369 bp, Diabrotica virgifera
  Clone ID: LIB149-025-Q1-E1-D1
aaaaaataaaaaccttcttaaaactttattttcttaagcaactggtttttaaggtgcttttaaaaccatgttaaaagacactttaagtgcaggcagttttatagcaaacttaaaaaggttatggagacttttaaagacaatttaccttattaaattattttttaaacccgtatacttctatacaggccaacaaatttttacatgtgttatgataggtagatacgtatttgtaaccataaaatattaaaaagtacttggttatttcagatcaagatagagacacacttgcgtacctaactttattgataatgttaacaaaaataggtctaaataactcacgcgtcctataatttctaaatttttactaca

SEQ ID NO: 4308 - DNA, 372 bp, Diabrotica virgifera
  unsure (1)..(372): unsure at all n locations
  Clone ID: LIB149-025-Q1-E1-D10
acgaacgcgtgggcgggcacgatgggcggtcacttgaggttcaattctcaggttttacgctgtatagtacacatgattctaggtttatgtcgatgaaagtgttcattttattcacattccgttcgttcggatatgacgtacgttcggcataccggtgttcaaaattgcggcgttcgacggtaaatgaaaacttttgctcactaaagctcaaaacttatctagacagaccataatattgatcaacaaccatacttatcaacgtttatgacattaaggtattactaccggtgataatttcgactgtatgtgcctacagatgctcacaatacatttttcttatattacacgtcanacatgagaaatcaaccacaa

SEQ ID NO: 4309 - DNA, 423 bp, Diabrotica virgifera
  unsure (1)..(423): unsure at all n locations
  Clone ID: LIB149-025-Q1-E1-D4
cccacgcgtccgctcggcctatgaaatttctgtcttgactcaatcgtttccaatcgcatctgaaaaacgctttttaaaacagttgtttaccagcaatctgccgtatacgtacaatcgttgtccatatttcgccggtcgccggaacaaaaaaattcagtgaacgtgaacataaagaagcaaaaattcgttcttcggtatcggcaaatgtggacaacgtaagaacaaaccatggcgaaaggcattttgagtctccattattccagaaagcaaatcaacaacgttacctacctactaacaaattggcagaaagttcaaaaggctaaatcatacacagaacatgctggtaaacggtatttttctactgggaaaccgtcaaataaggaagcgtcngaggttaagggaaattcatacaacaagttaagc

SEQ ID NO: 4310 - DNA, 408 bp, Diabrotica virgifera
  Clone ID: LIB149-025-Q1-E1-E12
tccatgaggtaaaaagtgaaaagtgtgtaagtggaagcaggaagagaaaacggaacttcgggattttcgcaattagaaaaaaattaatttgatggaaaagaaaactctaagaagcattccgggtacagcgtacagtgcccaaaatggtcatttactggtttcttctggaataccgtccctggatactctgttaggaggtggaataccggtcggaactgtggtattaatagaggaagattttcacggatcttactctaagatagtattaaaatactttcttgccgagggtattgtctctaatcattctactttagttgctagtcaagatgtaaatccttccaatattatcaaagaattacctgctgtgattgatagtgatctagagccagaaagggtactacaatcccc

SEQ ID NO: 4311 - DNA, 414 bp, Diabrotica virgifera
  Clone ID: LIB149-025-Q1-E1-E2
aacacgcgtccggtttgttaggtttgttacaaatatgtccacttattgtatcgattattttcaattgagagatattttaccaaaacaatttgagccgatgagattctacggtgtaatttttgtaaatacttaaagagcgtgtttcaaaaatgcgcttaatataatatattatcaatacagagcaacctttttttctttattattttttcttgttgaacaatatataaagttcttgaactccctaagtggaacatagagcttcagtgaaaatgcaccatcacctcattccaagactttccttgacttcttaccaattgttggacaattataactcagattaattttactaagtgacagttccataagtaaaaatatgcaatggctatatattgcgtactaaacttaagaagaaaa

SEQ ID NO: 4312 - DNA, 285 bp, Diabrotica virgifera
  Clone ID: LIB149-025-Q1-E1-E3
tacaagactctatagtgagtcgtagtatgtcatgtttgttacaaatatgtccacttattgtatcgattagtttcaattgagagatattttaccaaaacaatttgagccgatgagattctacggtgtgacttttgtaaatacttaaagagcgtgtttcaaaaatgcgcttaatataagtatattatcaggacagagcacactttttttcgtaattaatttttcgtgtagaacaatagatatagttcttgaactcgctaagtggtacatccagcttcagtgacgatg

SEQ ID NO: 4313 - DNA, 294 bp, Diabrotica virgifera
  unsure (1)..(294): unsure at all n locations
  Clone ID: LIB149-025-Q1-E1-E4
cacacgcgtccgaaaaaatttttgattaattcaatgattaatatttttttttacatttttatttttttttaattatggtagaggtttaaattatttctctatttcaaatattttaggtattgatttttgatcttatagtttaattttactaagattttgagtttgtactttaataattttagctagaggaaaattatataaatatggaatttattcaaatttatttttattagtattaatttttttaatattaagtttatatttagtattttcttcattanatatttcattttt

SEQ ID NO: 4314 - DNA, 401 bp, Diabrotica virgifera
  Clone ID: LIB149-025-Q1-E1-E5
gtcggatgaatccagacaagtgaaaaaagatggaaaagtggttaataattttgctgtacatcatacacttcgcaacagccggagaaactaaccaaaattcgtccaacatttgcacgcgatgcaaatgcaacagtaaggacgagttccttctggactgcaccaatcaaaactttgagcacatcttggcggaatggcctccccataaccagtcgctggtcgccacttttagttataacaacatcacaaatttaggacaacttccggccacgaatcaaacagccaaatttgttttcgatcattgccgtatcaagcatttggaagatagaatgttctttttgattcaaaacgtcgaatatatagatctgagtcacaatttgttaaccaccgaagcaatctccgga

SEQ ID NO: 4315 - DNA, 379 bp, Diabrotica virgifera
  Clone ID: LIB149-025-Q1-E1-E6
cccacgcgtccgcaaaaaccaaaaatgaagctagaagttgttttaaacatttgattaatatttattggtaccgtttatgcatctgaaaccaattctaccaatgtggataaatgtccaaatggagcattattgcctatagtgcaagtagtatcgaaagagcaactgtgtatagagcctccttgtgatgtacatgctggatcacctgcttacataactgtcaattttacttcacctgagtatctaccatccatgacacctacctacttagtccaggcactacgcttaccaatacgttacccagttggaaaggatgcctgtacctcgctcaacaatacgatatgtcccttagttaaagatgaatttgtatcctaaagttacg

SEQ ID NO: 4316 - DNA, 431 bp, Diabrotica virgifera
  Clone ID: LIB149-025-Q1-E1-F11
cccacgcgtccgatccactagagcacttcagcagtgaagcgacataaggttgaccgcctggcctgcttggctatcaaacccagtgttattagaaattgttgatcaatctaatgtgacgtcactcacaactaattcgtactttgaattaagtcattaacgctaaatactcatatactcaaaagaagcttatgatattattcatataattaaaatgtattctttttcccatgaggatttttcagtggcgtcacagtttttcgatttctttctaacgcattaaattgtatgtgacagaaaaaaacgtacgtcggtgattacatttcgtcggtgacatttataacatttattctagttgtcaatagatggcgccataatcgaaaataaaataatttgcgaattatataatatatctacgaatataatctgtacaa

SEQ ID NO: 4317 - DNA, 375 bp, Diabrotica virgifera
  Clone ID: LIB149-025-Q1-E1-F12
taatatcttaatatttaattatttaaatattttttatataaagcaattatttatatattgaaattctagtaaaatattaaagttagtttttattttaaattttttagccttaggtggattacccgcgttctgaggatatcggtcctaattgattagtagttaacaatttatattgtcaataatttttatgctgtaagattaattttaattatgtgaactttaaatacaatatggttttattgacgagttacgttatccactatcactattataagatatgttatttattcaatttctattaattataataataattgataaagttatttaaatgcatatacttaagtctaattagttttatgtatagactttttc

SEQ ID NO: 4318 - DNA, 273 bp, Diabrotica virgifera
  Clone ID: LIB149-025-Q1-E1-F3
gagtcgtaatagcaccatatgggtcagttcatacatccatatgcatccaagcagttcactttgtgcctataattccagccgcagacagattcaaagctacgaacacaggtggctcaaattcatgctaatatcatatgggccgcccaaacatctgtcagacacgatgctcaaagacaaattactgtataccgcggtatgcttttcacatagatcacgacagcccgcctaccagttcattcactagacatgcgtaatagcatgagtgtatctatg

SEQ ID NO: 4319 - DNA, 171 bp, Diabrotica virgifera
  Clone ID: LIB149-025-Q1-E1-F6
tacacgcctaaatattgagtcgtactaaaacttgtctcatattttttaccaagcatgtctcattagaaactatagtaacgagaatcacgacaggcaagattctctagttaagtacaattagatacgtcttagatctacttgcatatgtgtggtacttctaagtgctaatac

SEQ ID NO: 4320 - DNA, 370 bp, Diabrotica virgifera
  Clone ID: LIB149-025-Q1-E1-F8
ctcgcgggtcgacacacgcctctacagtgactcgtgataaaatggcacaaatcacacttcgtgcttttggcagtagtatcagttgtggatcgtggcatgcagctgaggccagccccaatgcagctcatggagtaagtgtctttaaggcaatggctcttggaaaagttggagcatcatgtgattgcgagacctgctcacaaggttgtgaaagcattggcacagattatcttggatgcagttgtgaccaagacgactgttattgtgcatacataaattaaatatgttgaaattgcaccagcatgattactaatatatagttttttaacatgtagaataattcaatgattaatatttttttttacacttttag

SEQ ID NO: 4321 - DNA, 439 bp, Diabrotica virgifera
  unsure (1)..(439): unsure at all n locations
  Clone ID: LIB149-025-Q1-E1-F9
acaaaaaagtgtctgacaatatcaaaattagtaacgaacttgcagattttctagcgaataaaagtggatctattgaaatgactacacaaactccttgtgaagacattcgtttccttctactaaactgtgaattgactgtggctaaatgtgaaattaaagctaacaaacgagtgatggcagaaatggaaaaatcgtcaaaacatcaagaccatatcgcaaagttacttacaggtaatatacaaacgttaaaagaagaagcattaaaggctcgtaatgaagctgcatcacggaagacctacagtacaacanacaacattacagatgcaatgcagtacaacaacatcagcagtggagctagcgaagatgtcaggaaagtagcattattaagagatggtaccgatcaatccggtgctactagtgctcaaacagaagctgcagc

SEQ ID NO: 4322 - DNA, 356 bp, Diabrotica virgifera
  unsure (1)..(356): unsure at all n locations
  Clone ID: LIB149-025-Q1-E1-G1
atttaatgttgtcagaacctagtgcttttgcgaccgctgttcaaggattacttagtgcacagagacaggctttactacataagtcacatgctggaggtgaacacttgtgtttcctgngttctggcagaaacgaagaagaccaatacactcatatggtagttgcgtcgtttcttcaaaagcatacacaatacgtctcattactgatgggtggctatatagctgtgcacaactatttctcagacaacgtcgatgatttccttcaagatcacaaccccaagagctgcatcgtgtgtgctcctacatacgcttcaanaatgctgcagtctagtcaaaaaccatcacagtccaacgaactg

SEQ ID NO: 4323 - DNA, 411 bp, Diabrotica virgifera
  Clone ID: LIB149-025-Q1-E1-G4
aattcgggcccgaacacgtccaaatttttaaagataagttgaaagtattaccgaagtaaaagtaagtttttagggaactctaacaaaaatatttttttataaaacagttaaaataccacaatttgttttgtatatattatatatacataaacagtaagcgccacgctactcgacacatgggtaggtacctaattgctatgcttatgggctaacccggtctgttcttagatgtgactttcatctctatcatgttactactgtcaaagaactattcaaaataataattgtttttccatacaaaaaaatacattagttaatattattgttactctgctttaaaataactttttaaacaccatgaatattacaatgcttcaaaacttttaccacttcaaatacacgtcaaacttt

SEQ ID NO: 4324 - DNA, 400 bp, Diabrotica virgifera
  Clone ID: LIB149-025-Q1-E1-H10
aactccctataatgagtcgtattagtatagatttaagatatacaagatgtgactcatatttctaacgataccgaaaatatatccagttgcaatacccattagacaactgtcgactttaagcacaggaaaagcaagtactgctgcaaaatttatccctgtattaaagacatcaacaaatactattcaaaatccttggatatatcaacaaagcgataacttcaatcttccgcaatgtccaaatttaacgatagatctcacatatactatcaaaacagtcatagctgaaatagaacgaggtacacaggctgtaattcatgcaccaacatttgatgatatgcaacaagaaagaggcggtgaacatgttgctgtgcaagttgaacaagatgcacatacataaact

SEQ ID NO: 4325 - DNA, 429 bp, Diabrotica virgifera
  Clone ID: LIB149-025-Q1-E1-H12
gaatccgaaaaatgttattgtttgatagaatcaaagaaatggtttcaagttctgatataataacataactcaagtgagaaattgacgtttaataatttagcttaggtaaaatgttttgtactattgtcgttgtgttttctttcaattacgcagaactaaaaaatgctctgaaaaaactgtgttaaaaataacaattttgttaaaaagggtgaaggacagcgatatgattcagatacctctcaaaaagggtttaatactataatatattcgatattaatgacatctagtatcgatttaaaacatctaatactcctgaaatacttgaaccaataaaaaatattctttgtggcatgttttgtcctaccacaatgaaaaagaaagagaagaaaaataaaaatatattaaattttacaaacatacgaatactgt

SEQ ID NO: 4326 - DNA, 389 bp, Diabrotica virgifera
  Clone ID: LIB149-025-Q1-E1-H2
agacaaattggactccaaaaaaaatttttgggtcccttttggaaaaaccgaaaaagaaccccgtttaaaacttcaagcctcttcaaatcaaatcccctggtaatggaaatatcaatctctggagtgtacaaattggtcacccggtacaaattttactcaaattcaagtgcctcgtgaaaaagttcttctctcgattgaaccccagtatactttttttattgtactcgttgaaaaaggctacaaatatatagacaaaagcaaaactatgttacaaaatttcttaagaatatttttatataacctgttgtgcttagatattttataatagtgtctttttacacaagtagcatgatgcttagactgatagtaactgtcctgttccacttttg

SEQ ID NO: 4327 - DNA, 309 bp, Diabrotica virgifera
  Clone ID: LIB149-025-Q1-E1-H3
aacatcctatagtgagtcgtattaaattatgtgttttggttcaatttggtcctttttactaagagtcccgagttagttttcttaatgccacataactagtcttctgggaaagtatattacttttactggagtatacgttatttttcagggggttgtgtctctaggcgtattcaatttgtctcgagataattatcatcttccagtttaaagccactaaacggttaataattgtatcgtaggaaataggttttaaacagtttttttgggctgagctgtggcttcgtctttacgtaagtcgaattttttagg

SEQ ID NO: 4328 - DNA, 439 bp, Diabrotica virgifera
  Clone ID: LIB149-025-Q1-E1-H9
acgcgtccacatgatttaactttattatagatttaagataaaaaagatgttactcagatttctaaggataccgaaaataaaaacagttgcaatacccattagagaactgtctaatttaagcataggaaaagcaactactgctgcaaaatttatccctgtattagaaacatccacaaatactattcaaaatccttggatatatcgacaaaacgataacttcaatcttccgcgatgtccaaatttaaagatagatctcccaaatactatcaaaacaatcatacctgcaatagaaccaaataaacaggatgtaattgaagcaccagcatttgatgatagtatcaagaaagatgcggtgacaatgatcgtaatcacgaggaaaaagatgaagaaacataaactggaaaaatttgagaaagcgaaatgaggtttgaatgggcat

SEQ ID NO: 4329 - DNA, 404 bp, Diabrotica virgifera
  unsure (1)..(404): unsure at all n locations
  Clone ID: LIB149-026-Q1-E1-A1
acaaggcgtcggacaaattacgcaaggtgttgtcttggccctcattgcgttaatgcgggggttcatcgtatttcctttcgttttaatgaactcgattcaactgcaaacaagccttatatttacacgctttaacttacccagaaatcccgaatactttgaaaatcagcatttcccagcctacaggaacagatatgtcagttttaattatacaaaggatgaaggcagtaagcttcttggagtctggcacattcttcncgtaaatctagcatatgaagatctatatgacaatgcgactgacattaactatgatgaaatcttactcaacagtaattacagtgttctgctttattttcacggaactggggaagtgagatcgtacagcgaaagaaaatatgagttgctga

SEQ ID NO: 4330 - DNA, 426 bp, Diabrotica virgifera
  Clone ID: LIB149-026-Q1-E1-A10
agcaatactcagcattcaacccatttaaacctaactaaactagtattatgtatttagtaaggtttaaatgggttgaatgctgagtattgctgagggctttaactgaattacatagtactagtttagttaaaagatgtgtttttatgttaaaagatgtgtaattcgtttaaaattatgcaataggtatttcaatacatttcaaaagaaaataattttagtaaacaaatagtagatacataagtattacctactattaggttggattattttaaatactgttaatcacaatcacaaacgagttcttattatgttattattccgtagtgcgtacgatgttgccagtttattaaaatttccaaacattaaaatacaggtatatggaaaacaatgttaacttttttttggaaacggttgactttagaaaaa

SEQ ID NO: 4331 - DNA, 358 bp, Diabrotica virgifera
  Clone ID: LIB149-026-Q1-E1-A11
atcctctagagtgagtcgtattacagtacaatttttactaacaaaactaatttaatgtattggggtgagttaaaatagggtttaatgcttattaatgctaatagcttaatcagaaatatattgatccaatttatttgattatatgaatattatatcatacggatagtagtctaatattattggacagttcgtatctcaattcattactgcgaactctatgttggattaacgtttagtagtggtgtaactgctacctacaagtatgtttgcgaattttaaatactgacaatctctgtctttaacgagttcttatcaagttaggattctatcttgagtacaatattgccagtttattacg

SEQ ID NO: 4332 - DNA, 97 bp, Diabrotica virgifera
  Clone ID: LIB149-026-Q1-E1-A12
aatacaacactctaaagtgagtcgtatagccgactgtattggtcagttaatgtgatatgtgtaataatgttaattgtatgttgtgttaacatataat

SEQ ID NO: 4333 - DNA, 428 bp, Diabrotica virgifera
  unsure (1)..(428): unsure at all n locations
  Clone ID: LIB149-026-Q1-E1-A5
gctaaacttccagaaatactatgattagaacacaatgaacataaaataatagtctagctaattggttcctatcaaagattgaattttaatttagttcaagttttgtggtggtttgcgcttaggtttgtgtaaaggtttagacatatttattgatgaagatttagatattgaaatttagaaatttaaaagtggaaaatattctactgaaaattaatatttgcaaattgtcagttgcagtaacatgttacgtttcatttttaaaatcatttaagtcatcaaataggtacctaattaatcttttagtgctaattttgtgtttttacgtatgtattataatatccgagttcagatcgggatangtaattttcttttcatcacttggttcatatattgccaaaataatacttcaatcacacttttcatatacg

SEQ ID NO: 4334 - DNA, 307 bp, Diabrotica virgifera
  unsure (1)..(307): unsure at all n locations
  Clone ID: LIB149-026-Q1-E1-B2
gcgttttggtagtgcatatacggaatatgtgaaaatatgtttagttgtttaggttaattacatcncaacaatcgattgagactatataaaatttaaccactaagagagtagcttccgatgattagggcataaacagacgaaccattctgcagcgctacgctgtattctaaatttttatgtaaattaaaagtgccattccacaagagcgacagtggctggccacggtcgccgatactcgctactgtggcgttcattacaaaatcattggtgctaaaaaatcgcctggttcagccagtttgtgggtcac

SEQ ID NO: 4335 - DNA, 421 bp, Diabrotica virgifera
  Clone ID: LIB149-026-Q1-E1-B4
aatccttcaaatattatttctacgcgtatataataaaatatgtctagtggctgtaattccagtgtattcggcatcgtgattctaaaaaagaacacagctaccgcctaaatatttcgtgttggtatcattcgacgtcccaggctatgacgcggatgacgtgcaacggttagtaaattagatgaagtatatttatttaaagttgaaatacgtcacgtcttctgcacggtacttaaaaatattttgtccattgtaaactttggatgaaataatatttcgaatttaaatataaccatcattactaatcaaaagacttaaccgttgttattggaagactgtgatcaacattattatattattacacttatccacatgtatatgacattgtatatctagttagagtaattttttacttcaaatattt

SEQ ID NO: 4336 - DNA, 426 bp, Diabrotica virgifera
  Clone ID: LIB149-026-Q1-E1-B7
attcggggcgcgacccacgcgtacacccacgcgtccgcgttctttaacggtaaaatattgcaaaacatctaaattttaaagaaccgcttggattgacatgacatttggcatacacatagctaataagtcaaagaaaaatagtgatattgtgccaatatgtgcttttgccctgggggtggttttcaccccattttgggggtaaaaaaatattcgtccaaagaaagtcaggaaatggataaactggctaattttaagtaacttttgttctatagagttttttcactaagtcaatacttttcgagttatttggcagtgaatatgttcattttttcaacaaaataaccacgcttttggacggttttttgcaaataactcaaatagtaagaattttgtcgaaaaaatattcttaacaaaaacatagcctgt

SEQ ID NO: 4337 - DNA, 385 bp, Diabrotica virgifera
  Clone ID: LIB149-026-Q1-E1-C1
cacgcgtccgaaatttaactatgaaaattaatttaatagttttggggaatggaactggaactaaaggaaaaaatggacaacaaaaatggggaacattttaggattacccacaccagagtatatgaaattattgaggagaacaatcatcgatccggaatcttaaggaaaaacctgatccgtattaaggaacaaaacaaaagtacgaaaaagtgaatcaacttttaacttcggaatactaaattgcagaccttaccgaagaagaattcctagtcgatttaaatccgctggtagttctaaattaactaaagtcaatagcattatttcgtcttctaaaagcagaagtaaaatctccggtgtatcagatgatttgggcagacaatatgac

SEQ ID NO: 4338 - DNA, 388 bp, Diabrotica virgifera
  Clone ID: LIB149-026-Q1-E1-C4
acatttacgggcttattttgaacacgcgtttttcgcccccgaggaggggtgactgtcaccccccaagtgggagcggccgacgacacggattcaactttgaagtggagtgtgagtggagccggaatccgggttttcatgcggttcggagttgcccctgaaaattacactccaaaacggtcatttattgggctattacagagacgctaattgtatccgaacatctgcgtttcctccggactttattttaaattgaaaattcatttaaacttcttgacatttcctgacatccttggtacttagagagcaacaagcgaagtgaaacttggacaaataacgccaccttcgcgactattaaaaatactgaccgttttctctgctttggaccaag

SEQ ID NO: 4339 - DNA, 420 bp, Diabrotica virgifera
  Clone ID: LIB149-026-Q1-E1-C7
agaacagaatgccattatcttctccgattcactttaagttcttaaaattttaaaatgcaactcagatacaacaaatggtattatcttggtatcacccaaacaattattattaagaaattacaagatcaaaatagatttataatattcttctgggttaaaacacacgtaagaataccaaataatgaaattggagataaaattgccacagaatgcatataaatgggggaacaggaacagatacattgcgaattaactacggatgaacaaataaacacatcagaacatataatgatgagaaaatggtcctacttgtggcaagaatttacctttacaaatccaacacgttacaccagactagaaaccacattgaggaaaaaaacttggtacaataagtacgattacaatcgcaaaaaaatcgac

SEQ ID NO: 4340 - DNA, 437 bp, Diabrotica virgifera
  Clone ID: LIB149-026-Q1-E1-D1
aatatttggaaaaactcccaattaaaaatggtttttaaagtatcccttttgtgtacactgctggtgttagttgcttattctagtgcatacgattacagcaattgtcctggaaataccaacagacaaaaaaatctgatatacagctctttactgccaccaggatatagcgtgaaaactcgtatcccagcaactggatattaccaaagacctatcacctgcttactgctaatcgatcaaaaaggaagcgccagctcaccaaaaattatagaaggtggatatctcgacacttttgctgtagtaaatatcacttccacaactgcgcaaccagttagttactatgcaatagtatttattgattagcctattgattagcctttagtagtatttagatatatttatgcactactattatttatttaaatgatatattttcgttg

SEQ ID NO: 4341 - DNA, 297 bp, Diabrotica virgifera
  Clone ID: LIB149-026-Q1-E1-D11
cataatactagaatattttttaaaagtggtgacgaaattttttatatgatgattgtttattaatgttatgacatattatatttttattataaaagaatgtattttttgttgcttgtggtgcatggaggattaattaataattatcaaattattattatcgtctttattagagctggtaaattatgatttttattgttgtataaaaattttatgtaatttttttgtagtgatgagatgttcgtctttaattaaatctacttttttacgaagtaacttaagtttaatttattagcaata

SEQ ID NO: 4342 - DNA, 372 bp, Diabrotica virgifera
  Clone ID: LIB149-026-Q1-E1-D12
acaatcctctatagtgagtcgtattatttttttttttttttttttttttttttttttttttagtccgtttttgtacaaaaaattattgtcatattctgcaattccttggatatatttaaaaaccatttgttgaacatacaatgtcagtgatataatttctatcagcaattttttaagcttaaactttattttttatattgaaaagttctttttttcctttaacttaatagctttgttatccaaattataatgttctttgtgttgacactgtttatggttttgcttttgtctttgtaacatgtttttttgtaataatattttctgaattggtcttgtctgtaaataagaaacactatgaacagtttttttatt

SEQ ID NO: 4343 - DNA, 414 bp, Diabrotica virgifera
  unsure (1)..(414): unsure at all n locations
  Clone ID: LIB149-026-Q1-E1-D2
aaaacttttccaaaaatggcttttttctataatttgttcaaactatcttctatttttatattttaaaagtgcttgtacaacctgtacttgtacattctaccccagtatatataacanatataacatttgtttttaataatgtgattataccaatgattganattatacanagaaataaacaaaaaaaagtatagcaacactgtgactcttcagatgccaaataacctcaatattgtttgaatttgcagtgttgccggtgcaaattcttctagtatacgtataacatttcaaaggacgttcaaaaatacacattcagattcgtatacgaaatttttcattcgagttaactcgtatacgaaaaattcgatttaattcgaaaatacgaccccagatcgacgtttgaccgagtttgtc

SEQ ID NO: 4344 - DNA, 438 bp, Diabrotica virgifera
  Clone ID: LIB149-026-Q1-E1-D6
acacccacgcgtccggatttttgaaatataaataattgttttgcatgtttttctaaggatagattttttttcgcccccccccttaacgaacttccctgcattaagagccaatatatggtagaggtacatttacagggtacaaaaatccccgtttgggctcccctaccatcatgggataccagatttattacggcagtttatgcatctgtcaaaacctaccatgatatgaaattttaaaaggcaatgagggtatgatattacgtacagtcggagggatggaggagtacccatgaacgatcatataaggcacgctgtgttttcctgtcaccgtgtcacaacgaaagttgcccggcgcaagtacatgtaattataattattgcatgtgcttgcgctggccaattttttgtgtgacgcggtgacatgagggtgcaccgtgtt

SEQ ID NO: 4345 - DNA, 171 bp, Diabrotica virgifera
  Clone ID: LIB149-026-Q1-E1-E3
ataagtaacacaggaataatataataataaataaaagaattaatatatttccagaattaaagagaacctaaaaaaatataaaattttatatgtgtaaaataaataatttataaaaaaatttttttggataatgaaaaggtatatccggttttataaataaaccaaaatttt

SEQ ID NO: 4346 - DNA, 165 bp, Diabrotica virgifera
  Clone ID: LIB149-026-Q1-E1-E8
gtgagtcgtattacttttctgtggtcgtaaatagtccctctgtgtactgattgttaattaatggggtgtgagcaaatttggtttctagggggtagagctccagttggtgtgccgtgtgtatctaggattatttcttggggtttagttagttggtgatttcgacgt

SEQ ID NO: 4347 - DNA, 377 bp, Diabrotica virgifera
  Clone ID: LIB149-026-Q1-E1-E9
agtatttttaaaaaactcacaaatgttttagatcgtatagcagaagacagcacagctgcaggtaagaaactggctaaatgtttcgaagactccaacattaattcagtgcctgttttatttgtaaacctaaccttaagttgcattgaagacgatgtgattaaagtagccgagtctttaggaccgctggtaaagcaacttgcagaagttcaaaagaaggctaaagcagcaaccgagaacattgatgagtgtggagataatatcactgatattggatgtgttcttaagcattttgtaacttgttacctttgacctgaagatgctctacaaagtttaaagagcgaaaccggtcgtcggaagttataataaagattgagagt

SEQ ID NO: 4348 - DNA, 427 bp, Diabrotica virgifera
  Clone ID: LIB149-026-Q1-E1-F1
acaacgcgtccgttaaaagattcgtttggaggataatttaaaggtaaaccattttttccattacaacagtccaagaagttttccaataaaaagtttaacaatttttacttttgtttaatgttaactatgtcgaaattagacaagttagcacaagcagactgatacaaacgctgttttaacgtgcattttaagtagttcatatttattttcaaaatgttttacccttttgggacttctcttttacataaaacctaagagtaaggcgtggatgctattttgtggatgctgagattaacacaacctcttaggcaacatcatttttaggtaatttttcattgtttatgtccatctttcatttatatcggtcataatttatttttaatgtaattttagtaagtaaatcatttactttgaacagtgaaataaa

SEQ ID NO: 4349 - DNA, 276 bp, Diabrotica virgifera
  Clone ID: LIB149-026-Q1-E1-F10
cggacgcgtgggcggacgcgtgggcggacgcgtgggcggacgcgtgggcggacgcgtgggtttatttattttaaaataatagaatattttttagtaaaagtaaagaaaaagtttatttaatgatagttaattagtattgtgagagaatattttagttttataaaagaagagtttattttttgtaccttgtgtagcagggattattaattaggacttatatatctattattttcgaatttagacgagctttgtccgcaatacttgtaacgtcgcaat

SEQ ID NO: 4350 - DNA, 132 bp, Diabrotica virgifera
  Clone ID: LIB149-026-Q1-E1-F3
agtcttcgcatccgcgacaaactaatccaaacaccttgtccaatcctaaaaccaaaccgaaaattaagccaaaggattccggataacggaccagttttaaaaaaaccaaaaaatggcaaggataagtaattt

SEQ ID NO: 4351 - DNA, 227 bp, Diabrotica virgifera
  Clone ID: LIB149-026-Q1-E1-F4
acttttaattctgttctgtggttagacaactttattttgacaatttttactgaccaggcactaaaagtatctatcaaatccgctacagatcttgcatcatacgtcaatctaaaaattgacgatgggtaagacgcatcttaatttatatactgcccactcatgtgcaaataatcatattgctttcaatatcattaacatcaaattttgtaccaatgatgctacataaa

SEQ ID NO: 4352 - DNA, 436 bp, Diabrotica virgifera
  Clone ID: LIB149-026-Q1-E1-F6
acccacgcgtccgcaagatgaaggtactcattcttctttccgttgttgccttgagcagctgcttaccagcatccagaaatcaacaatacgttgatgtagactacaacagctacaacgctcatcccgtctacaacttctggaggacttggaatcagcaacactatggacaagaaccatggaaccaatgggtacaatatggtgtccagaaccaacccggtaactactggaggcagtacgtgcaacgcagcaaccaagctgaaaatgtcgatttaccttggatgtatcactcttgggatgtccaggatgtgcaaaacttaactcccgttcaacgtgttcagttgctactcaactacgtcagacttcaccaacaatggaaccaatggactcatgatgtaactgccaatgaacgtcttcagaatatgttgtatcaacacct

SEQ ID NO: 4353 - DNA, 420 bp, Diabrotica virgifera
  Clone ID: LIB149-026-Q1-E1-G11
acaagcctctagattgagtcgatttatcgtagctactttagcattcgatagtgcgattgcaaatgatgtagcaaaaccgtgtgagtctgattcttgtacgatcggcaacaattgtagatgttctagtcaagcgtcacctctaggtggaaatctcacagagtatcctcagctgattagtttaacatttgatgaagctgttacacaacacatctacgacaacagttggattacattgctcggaaatatatataatccagatgataagccaattagtggaacattctttgtaccacatgagtatacgagctatcaaagagttaatgatttgtacaactttggatttgaaattggtgtgcactcaattacgaaggattttagacaaaattactggagatatgcaactctagacacactaacaaa

SEQ ID NO: 4354 - DNA, 427 bp, Diabrotica virgifera
  unsure (1)..(427): unsure at all n locations
  Clone ID: LIB149-026-Q1-E1-G2
agattaaggcccctaaatgctaacaaccatattgtcatcgagagagctcagttgccacaattatctcaatataatacaatgtatgtatttatgaatctaaatatgtacaatgtatgttccctatgtccagctgaacgatttacgtactgtacatatgacatcggtaacaaaatcttaaaaagtacaattattgtattaaccaggatacacatttagagtaacgaggatgtgatagttgtatttaagaaattaccgttaagttttaaagacttcttgtcttctttttttaaagttcacctctacatacatttagtaacttacaaaaaatcagatacttttaggaaagacctgcgatatgtgttaagtttaaatattttacgattagattaggttaagttctgtngtacttaaattcatcgagtgcaat

SEQ ID NO: 4355 - DNA, 325 bp, Diabrotica virgifera
  Clone ID: LIB149-026-Q1-E1-G3
tattaatgctattaaccatagtgtcatcgatagagctcagttgcctgtattatcacaatataatacaatgtatgtatttagaaatcgacataagtacagtgtacggtccatatgtcaaactgaacgatgtacgtactgataattcgagatctgtaactgactcttttaaagtgacgctgttgtattaaccatgatacgtatttaaagtaacgatgatgtctatagttgtactgtaagagattggcggtgaagttttaaaaacttcatgtattcatttttttaaagttcatcatctatatacttttaatgcacttactattttttc

SEQ ID NO: 4356 - DNA, 350 bp, Diabrotica virgifera
  Clone ID: LIB149-026-Q1-E1-G4
cacgcctctaaactgagtcgtcttaaagatgttccgtgtttaaattggacaagtaaagaaaaaattggtttccggtaaaaaaattggtactggaaagaaaccatttggctataatgtagaaatgattcaatctatgacccttactggcacggggtaggacctatgcaataaattctccatcaatggtaattccatttctacattgactggaaaattattattactctcgaaagctttgagttaatcaaggtgctgggcaaaggtacttttggtaaggtaattctgtgcatataagagacaactggtatattgtaagccattatgattctcaagatggaagtgatcattca

SEQ ID NO: 4357 - DNA, 440 bp, Diabrotica virgifera
  unsure (1)..(440): unsure at all n locations
  Clone ID: LIB149-026-Q1-E1-H1
cagacgcgtgggtttcaactctttcctgaacttcaacgggtagaaaacggaaaatgaaccaattccaaatttccggttaaaaactaaacggtaatttacaaattaaaaaaaaatatggtgcaaaaaaaatcctgggcagcgagcaacgacggtgcaatcgagtaaattccgttgacatcagaatatctcgaggacgccttggatgtcctgcggaaaaccttttatcgatatgaagcaagatgttttgctacaggtttgtcggaagacctcgaagctatggctgaaatggatagctacatgattgaagtggccaaaggaggggtgtccatagtggcagtggagaaagcaactaatattgtttgtggcgttgctttcaacaaaattcagttggaccaacggacaagcggcaaaaaatattancagaactacttgaacatgtt

SEQ ID NO: 4358 - DNA, 446 bp, Diabrotica virgifera
  unsure (1)..(446): unsure at all n locations
  Clone ID: LIB149-026-Q1-E1-H2
gcgtccaaaaattttcaaattcccaaagaaaaggtaataatgggaaaataacaaccggcttcgccgatgcattaaatacccataattataaaaggacggataccaaaaacccaaaaaaggtgtgttcataacggtaattgtccggccaaccaattggcgtctcaatctttaaacgaaatggattccaaaaggggtatttggtatgcagctcagtatggtgacctanagagagtcaggaaactagccaacgagaggagatgtgcagatgagaaagattcagcgggttatactgctcttcactacgcagcacgaaatggccatctgacagtttgtttgtttttgttggacaatggtgcagatgttaatgctgttaccaaaggaggagctacagcattatgtcgagcagcaactgcaggcaaagaagatgtggtagattccttaatgtc

SEQ ID NO: 4359 - DNA, 449 bp, Diabrotica virgifera
  unsure (1)..(449): unsure at all n locations
  Clone ID: LIB149-026-Q1-E1-H3
gcgtccaatattaatttaattaggatggggtcaaccattttacaagggccctccttccgaaacccccaaaaaagttaaggtcaagttaccaaatactccttacggcaaaaaattaatgcccggtaaccaaataacccagccccaataaggtacttacgcctaaggtaaaaatcccggtcagcaagatcctggaggtcctggtattttgcaaagattctgttaagtagaagactgtatgcagttggagttaattcctatggattangatgcgctacaaatcgtccagctgtaaatactagagttacgagctacttggattggattgtaaatattatacaagattatggcttttgtatgaaataattttgtttgtatgatataaacaagaacttaatagatagtaattaaaatatatttgttgttaaatggttgtatatacaaaatgttac

SEQ ID NO: 4360 - DNA, 429 bp, Diabrotica virgifera
  Clone ID: LIB149-026-Q1-E1-H7
acccacgcgtccgcccacgcgtccgcccacgcgtccgcccacgcgtccgcccacgcgtccgcaagaaatggctgtttgtttgtttattttattatttgtctgtcataacaaatataatataatgtcagatcaaatatatacttctcaaaatgatcaaatcttactaagagtcgtatcagtttttttaggaaccagctgtacattgtacttttttctatggatgcagttttgtaagagtttaaacttcatgcttgtaggtatattatatgcataaattgaaatagcatacataatagataaaatttattataaatagaataaattatatatatgtaatccattaaaaattctaattaacccgggagcagtcgcgctcacttttgttacgtaagcagtcgcgcgtagagaaaaaatcttacagtacgaatt

SEQ ID NO: 4361 - DNA, 421 bp, Diabrotica virgifera
  Clone ID: LIB149-026-Q1-E1-H8
ttccatagggctggaactagctcatctcctccagaggatttgtactgcttaaaacattttagtaacatgatcatagatattttgccaatagatacaatttgtttattcctaaatttacaactcaaactttgtggtttaagatactcttaataaatattatgttttacaatattaatatgttttatttcatttattacaaaccacgaattgcacaaatttacttaataactatcatatttttatcattgagagcctaaaattaaacagattctacatatagatttaaagtttgtgatatggatgacatatacagtgaagtagttagaagttgtatcgctttatagtgatcactctagtgacatactgtcacacaaaagtggaagaacgaataacaatccactgcaatagcttcattaaatgc

SEQ ID NO: 4362 - DNA, 305 bp, Diabrotica virgifera
  Clone ID: LIB149-027-Q1-E1-A1
acttgactccaaagtttcatgttttagtacatgtgttagtagatgtatcatcaccgtttaatatatagttatgtgattgacaatgtgatacattagttcatttagataatattaatgttcatgtgtagccacgagtgattcattggtctttaaataaatatttatatcgatatcatcttcgctgtcaaattagcgattttattggaacttttatagtctaattaatatttttgttaagtgctgtgaaacgatttgaaatacgtctaaatctatatcgaagtttttaacgtttcttttaaacttaa

SEQ ID NO: 4363 - DNA, 60 bp, Diabrotica virgifera
  Clone ID: LIB149-027-Q1-E1-A12
tgagtcgaattaaaaaaaaaaaaaaaaaaaaaaaaaaaaaaaaagggaggaagcacaaaa

SEQ ID NO: 4364 - DNA, 426 bp, Diabrotica virgifera
  unsure (1)..(426): unsure at all n locations
  Clone ID: LIB149-027-Q1-E1-A9
aacgaacattatgattaacagaagtgtttttacgatattcttgctgggggttatttctttggcccagggattcaatacaaaatattttgacacagaatttcttacgtccaatgggaagttgaaattggctaagctagtaaaatatgaacctgaaaagtttgataattatggagtttctggaattacagcaaatatgaatgaatatgcagaaaaaattttcttcaatatcggaaggtatgctttaacccatggtcttgaccctgtcaatattgcaaatgtaactgaagattttatgctggcatcaattaagtttaaaaatggtaaacttcacggaatatccacactaaaaagatatcaggacgtgctagctaattacgtacattccagtangactttaattgtcactttacctatagaatttgttga

SEQ ID NO: 4365 - DNA, 452 bp, Diabrotica virgifera
  Clone ID: LIB149-027-Q1-E1-B11
tcgcggatcgacccacgcctccaaaaaatttagagattttgcaatattttaccggtaataaaaagtcataaaactgtcaaactgaaaagcagaaattaaaaagttctcttaaaaaatactaaatttaaacgattttggaaagaaattatgtaaaaatggtaaatgaatttgataaactaatcgaggaaatattcaaaattaaaagtgaactgaaaaacgcaatacaggcaagtgaattaaggatactactaaacatagaaaacttgaacgaaaagataaaaaatttagaaaaggaaaattcacaattaaaagagaaagttgagtatttagaaagaggccaaattaaaaataatttattaatttttggtattgaaaactccgaaaacttggaagtaagcgaattttgcaataaattaagtcaacttttaaaaattacattgagtgttaatgat

SEQ ID NO: 4366 - DNA, 359 bp, Diabrotica virgifera
  Clone ID: LIB149-027-Q1-E1-B12
acccacgcctccaacacacacgtcagcccacgcgtccgcccacgcgtccgcggacgcctgggcggtcgcgtgggaagtcgcatgactgaacgcgtgcactccattgggagaacagtaagtgcagtttggaaagtgattgttgcaacgtggcacgagtctgtccaatactgagctaggtttgcagctccctcgtatctcaagagaaaacttgcattaatgcacgaaactcagggtcacttatgactgtatatagtaagatccataggcagactgaatgtcacttgccatttcacatcagatctatgttttaggggtattactatcttgacatattacatctagctctatattctccagat

SEQ ID NO: 4367 - DNA, 374 bp, Diabrotica virgifera
  Clone ID: LIB149-027-Q1-E1-B3
aggacgcgtggatgtaaaataaatattttaaataatttttttgtaatgaaatgttattcgtttttaaatatatctaattttttaagaaataaattaaatttatttattaccattagatttataattaaatatttttaaataattaatattaaatatttttagggatgagcttaaaattaaaatttaattagattttaatttttaaataaaaattaggattaaaaatttacagattttaaaataggttaatattaatttttatatattataatttttattttttataaattttttattaaaatataaatttaaattatttaaatttagtaatgatgataatattagtattaaaaaattgtaaatttagtaaaaat

SEQ ID NO: 4368 - DNA, 382 bp, Diabrotica virgifera
  Clone ID: LIB149-027-Q1-E1-B6
tattctaattctattcattcagtccagtcgatacaagcaagcaagatgagaaagtaaaagtaaaaagttaagatgtgtttcacgccaaatatggtttttttgtactttttcaagtggcctgataaataattattgttccatatatatatgccagtataaggatataatcgaatataaatattaatttcttcaatcggacgtaaatacctacccgtattggaattcaagttttaaattgtaattataaaacttcaaacacaactggtgctgcaaattacttcaaaatgagtgaaattacactatatctttggaaaccgaagctgccatgttccgttggccatattgcaatgcagtttccagatggcgaatacattagcttttg

SEQ ID NO: 4369 - DNA, 254 bp, Diabrotica virgifera
  Clone ID: LIB149-027-Q1-E1-C10
gacccacgcctccaaagcatggtaacttattgatgccaattatcgacgatgccatcaaaactctcattaactctctttttgcttaggcactgccaagatgcagtcagaaacaatgccgaaccattttagaaggttgtggggatttttgtttccttagtgaatctgtttttgtaatttatagaacatattacacactgtaatgaaattataatggataatggtgtaaataattaataattatgaaaaaatataaa

SEQ ID NO: 4370 - DNA, 340 bp, Diabrotica virgifera
  Clone ID: LIB149-027-Q1-E1-C5
tctctgaattgagtcgtattattgtcattttcttggttccccttggggcccgggtttgcctcgctgctggtgtcttgcttttgtggccgtgccttcggcttttttgctcttcgtggttgttttttgtttcctgttgtctcggggatcggttttcttggtcttgtccggttatatagttgcccgttttaaaacagccctcggcttgcacgtttttaccgttacgctagcaggttgtatagcttttttgtcctcacatgttactcgtttttacatttgtccagtttgtttggaaataggtctgctttatttatctgcactatgattatagcttggtgtgttg

SEQ ID NO: 4371 - DNA, 361 bp, Diabrotica virgifera
  Clone ID: LIB149-027-Q1-E1-D1
aaccgagctaaaatacggttaggtacgtactgtaagcctattttgggcaacagcctgtggacataccaaacaaaagattgctcatgtactatatctctatcactgatatgtatttaattcgaatttatcgtgagtaatctctaaagaacaatactacgacaataaacgatggagtgattctattaaacaaaacaatactttcaggatgatccacgggctggcctacatatcgggacatacactttagatggcaaaaattagaataaatgggcggggggtaagaaattctgtgatattaaaaaatgatttcatgtctacattgaaagtgatacgaaggaaacgttagtaaagacgacgaaat

SEQ ID NO: 4372 - DNA, 323 bp, Diabrotica virgifera
  Clone ID: LIB149-027-Q1-E1-D4
atttgaatgtgagatttgctcaaagcagtttttcataaaagctacattaacatcacatctaacacaacatattgagaagaaacaaaatgcgcacattatagagaagtttcactcttaaacacggcagataaactcctctcaaacatcattcttagtggactaaacccttatactaaaaatcgcctaggagaatatcaagctggttttcacgctcagatccacagtatattaatcattcacgctgagacagtttctagacaagggatgggagtataacggacccatacacaatctcttcatatactttctatatgcatatgata

SEQ ID NO: 4373 - DNA, 384 bp, Diabrotica virgifera
  Clone ID: LIB149-027-Q1-E1-D5
accacgcgtccgaaagattcaccgttcctgaacaattcgttaaccaagaagtgttaaatcaagtatacaacgaacaatccttaattaaccagagagcacaacaacttgtagaacagaaccaaccaatttctcaagaaatttatgtccaacagtatggtttgaacaaacaagtagatcaacttatccaatcattggtatatcaccaaaatgtgatctcgcaacaagttgaacaattcattcaacaaggacaacgtcttccccaagacttgctttcccaacaagtattagtctaccaacaagttcgccaattgattaaagttttgagcacccaacaacttaacatgatcaacttcatccaatacctagttgaacaaggtaatcaag

SEQ ID NO: 4374 - DNA, 321 bp, Diabrotica virgifera
  Clone ID: LIB149-027-Q1-E1-D7
atattgactgctgataatgtccaagtctaaatgttagcgccggtgagtcacggatcaaattgcccgcaagtatataagcgtggtgtcattcaacttatccataaaacttgtgtactcattattagtttgtagatatgagtccacacggacaggttagtggtgcagttcaataggatgtacccccgatagtgtcacaacgttggacaggacgtgtttccagtatacagcgcatgcactaagtgtatttgtaatctgaaagcttcgatgaagaatcatgaccgtatcactcaatatccgtattgaatgtgtttagcacgacaa

SEQ ID NO: 4375 - DNA, 407 bp, Diabrotica virgifera
  Clone ID: LIB149-027-Q1-E1-E1
cccacgcgcccgatcgtgctgtagacagtttgaagaggtcgtgactgtgctcgatctgtcatgtgtatatcaacgaatatacgattatagttcaccgtgcggtcactggttcaagctgtccgtgtactgccgacctaagatgtgtcttcagagaatatcggatattaagaagatgaatagatgtacagtgtcaagcgaaagatagaatatcatcacttactttaaacatatcagacacaagaaggtcaatatctaattaataggacttaatacttcaattggatagaaatcaagttagatcagacagtcctttaattttgtggagtgcattcgtctagctacccgtccgaagaattggtggaactgaaactctaacgtatagacaaaaactgacgactattcacata

SEQ ID NO: 4376 - DNA, 412 bp, Diabrotica virgifera
  Clone ID: LIB149-027-Q1-E1-E11
aagaagatacaagcactgtttggatataaaatctttgaaaaagaatccggggagccgactgattatcatcttaatttatatacttcgggtgattgtaaacttttttgtgcgaatggaggatgttgacgatgttgtagctgcatatggtgttattgacgcacccagagaaatctacgatttgtggaggccccttaactggatgcgccagtgcatttgacgtacctgttatgttgcaatttgtttattagattttattttattgttttgtacataaaaaagagaataggcgggtttacaacaatttaaaagcagctttttaataagtaatcatattttttttatataatgttcgctagtttaacagtcacagattcatttttcatttgtttcatccccaagagcgtcgcagaga

SEQ ID NO: 4377 - DNA, 397 bp, Diabrotica virgifera
  Clone ID: LIB149-027-Q1-E1-E7
agcttttagagatcacctttcgagttctattttgaagtaaagaaaatatagagtttatttacaaaaataggagtcttacgaacgtgacttaagtttttggaaaaaatgtgaaagatgtaaattgtcctataatagctgtatttttattcttaaacatatctaaacaaaacagaacaacccactcacacaaaaatgttgacataactgtgtcgcaaaacgtcctacatatttatgtatgtatattgtatatgccgcttgcctatcttgtttatggcattagttattaattaacatgtactttcaagtctttttataataatcttctttgtacaatactttgttttttccttaaactctaataagttctgtggccaaaattaaggccaacagttttcct

SEQ ID NO: 4378 - DNA, 400 bp, Diabrotica virgifera
  Clone ID: LIB149-027-Q1-E1-F1
cccacgggtccgatttattggtaacttcagtcttctgcgccatcttcgccatcggcctgaccgtacctgttctgacaggtccaggtccagctttccaagttaccgatggagaatgtgagaatgtctcaagagacgaattggtccgccaagagcaagtaaataagggtggttttccatttgttaccaaacaggctgatgttgaatacttaggagatccttcaaaagttatttactgcgttcaagctctcagctctgatgacccaagcgttgaatctgttgctgaaattacagttggtggagttggtcacgatttcgtaaatgtacatttgacatctaagaaaggaggacccctacattacgatgttgaaatttacgccaagggcccaaattataatattta

SEQ ID NO: 4379 - DNA, 390 bp, Diabrotica virgifera
  Clone ID: LIB149-027-Q1-E1-F12
gacacacgcccctaaagatgatcaaataactaatgatttagaaaattcaaaattaaataagacaaataaagtaaattcaaatcataccaataaactaaaaacaaaattaggtccatcagacaatttaaaaataataaataattcacaaacaaataaaaagaaaatagatattgcaaacattgaatttctaaatgaagctaattctacatattctgtaggtagcatagtaacagtagttactgattccatgtctagtaatagtaatatatccacaagtatttcccataataattctagcgagggtgaaataagtgaaagggaagatgaaatcagtgaaaatagtacaaatataagcaacgtacaaaaagaaaaaagaaaaagactcaattc

SEQ ID NO: 4380 - DNA, 404 bp, Diabrotica virgifera
  Clone ID: LIB149-027-Q1-E1-F5
aaagagctcagagaacagttgatgcttttagaagccagggaggaaaagctggaaaagaaagagaagaagcgaaccaagagtgctgtgcataataatgaattggaggatatagagtctgagaagagtactttacaaaatagaataaatataattcaaaagaaaattctagtaggtggggaaaatttggtagaaaaggcgcagcaacaaatggaactcttagaacatgttgataaagagttgcagcatttggatacatcacattccatattgaaagagattcttctacacaaagaaaaagaaaaaacaattgttaagaaagaatatgctgatcttaaagaagaagacaaagctctcgattctaaactagaagaagttgataaattgatctctaaagcggtttaaat

SEQ ID NO: 4381 - DNA, 371 bp, Diabrotica virgifera
  Clone ID: LIB149-027-Q1-E1-F6
caattctctaaagtgagtcgtattaagttgatgcttttagaagccagggaggaatagctggagtagaaagataagaagcgatccaatagtgctgtgcataataatgaattggtggatctatagtctgagaggagtactttactacatagggtatatataattcattcgaaaattctagtacgtggggaatatttggtatagtgtgcgcatcaacatttggaactcttagattatgttgatatgtagttccagcatttggatacctcactttccatattgaaagagattcttctacacaaagaagatgatcactcaattgttacgattaaatatgcggatcttaatgatttaaaggatgctctcgattctaa

SEQ ID NO: 4382 - DNA, 261 bp, Diabrotica virgifera
  Clone ID: LIB149-027-Q1-E1-G1
aatttatttattttaaaataataaaatattttttagtaaaagtaaagaaaaattttatttaatgatagttaattagtattgtgagagaatattttatttttataaaagaaaaatttattttttgtaccttgtgtatcagggattattaattaataattatatatttattattttcgaatttaaaagagctaaaaaattaaaatttttattgtaaaataaatattttaaataatttttttgtaatgaattgttattcgattt

SEQ ID NO: 4383 - DNA, 370 bp, Diabrotica virgifera
  Clone ID: LIB149-027-Q1-E1-G3
taaaaaaaaaaaaaaaaaaaaaaaaatttaaataaaaaattaagaaagattttctttaaaaagacttatgtaactcagctccaagcatacagttcagctttgtggcactagcttctgttgtattggctgtaattgttccaaagttattgtaacttaatgtaagtgcatgaagtacacaatgaaaatacttgcgggttacaatcgaataagacacacatttatctaaagaactcgcacattttgtaataataaacagagatttacaacttaaaatttttgtaaaatagcaatatttgaaatatcattacatttgtctatagccacaaataataataatagttaatgtattcctggtaatggaatgaatttt

SEQ ID NO: 4384 - DNA, 303 bp, Diabrotica virgifera
  Clone ID: LIB149-027-Q1-E1-G6
aaaaaaaaaagaaaaaaaaaaaaaaaaaaaaaaaaaaaaaaaaaaaaaaaaaaaaaaaaaaaaaaaaaaggggaacacgggcggggctcccaactggtttatgggtgccttcgccttcagatctctgctaaattcctcctacgggttccctcacttgccttccacggtccaccttttttccagtgtaaacccggtagtttcccgacttttctcacgtttaaccccttgtccttttcgcccctttgcgccttggggcttatcccccttccgggtctcccgcttttgtcctttccaagcctttgc

SEQ ID NO: 4385 - DNA, 358 bp, Diabrotica virgifera
  Clone ID: LIB149-027-Q1-E1-G7
ttttttactttaatagaatgtcaaaaacagttgttgttttagctttagtgtgctgtattgtagtacatgtccaatgtgaatcaattatctattgtccagatcctgcaaatccatactccacgataatcataccacaccggccgtaattaaaggaggacttcgatttaagtatgtagtaattgaatttgattttgatttgttactagaatcaagctatgtgattttcatttatactttagagaacgaagattcatctgtttaaattacaatctaaaatagttttataagaaattgttagtttgaaattaataaactgtgaaataaattcaaaaaaaaaaaattaaagaaattcattaag

SEQ ID NO: 4386 - DNA, 419 bp, Diabrotica virgifera
  Clone ID: LIB149-027-Q1-E1-G8
actcgcgggtcgacaaacgcgtctgacacacacgtctgcgaacgcgtgggaaaaattgtttaaataatttttcgaccacggcaccgcccggcaccctgcggatgtgttataaggacctctttttgagtaactttgtgcaaagcaaaaaaacgaatcggaataataatttacctgacgggggcgacgatacagcttggactatagcgctgattgttaatgattaaaaataacagctttgtaataaaatactgacaaaatttcttcaggatcttgaaggagtgattttaaactttgatctgatcacttcctgacttttattatataatttttaatcgagttaagccttaaaaatggccatttttgcatttttcaaattttaattcgcgtataactcgacaacaatcaattttagagaaaaa

SEQ ID NO: 4387 - DNA, 353 bp, Diabrotica virgifera
  Clone ID: LIB149-027-Q1-E1-H1
attattacaaagccaaaaatgaagctaacaggtgtatgttttttaatcgtggctttttgcgctatcaacgcattagcaagcccttccgatccggatgatccatcaccagatgaacaaactaatgcaccatctgtttcaacatcagattctccacctgacacagtaactgattcatcatctactgcacctacagattctacacctgacccagcaactgattcatcatctactgcacctacagattctccacctaacccagcaactgattcatcatctactgcacctacagattcttcacctgacccagcaactgattcatcatctactgcacctacagattctacacctgaccc

SEQ ID NO: 4388 - DNA, 304 bp, Diabrotica virgifera
  Clone ID: LIB149-027-Q1-E1-H2
aatgtctctttcagcgactatcgtcttgccgactcactggtaggcgacttctcaagacactactaccacgcgaaatgacacctctccggcaatgtagccgagttacaaaagatgacggcagaacacggagcacatgtagagtggctttttgacaataaacttcagaattaagccatcgtatcaatgttatagttctacacataagtacataaactagttttgcggttaccagcataggacacagtaccagatcataagactatctattcgtcaatcagaatgtcaccagtatgtctcatcttaa

SEQ ID NO: 4389 - DNA, 411 bp, Diabrotica virgifera
  Clone ID: LIB149-027-Q1-E1-H7
cacccacgcctccgaaaaaatttcatcttcagatgtcattttaatgggaaactgctaacattcgtttatatattaaatatattgtatataataattattattataaatataataataattgttgcaaatttagcaattaatattttgtgaattttcaatgcaacttagcagaacttccatgtgtattttagttttttcatattattatttattttatattttcatgttataaattacccgttgtctgaaaagacgagggattgagatcattgttattgattattgattgtgcttgattattgattgattattaatattacccttccttacatcgcctatgaacaggatactatcaaataaattaaataaatataaaaattgccaatagtcccaagacaaaaaaatttaaaa

SEQ ID NO: 4390 - DNA, 393 bp, Diabrotica virgifera
  Clone ID: LIB149-028-Q1-E1-A11
accacgcgtccgcggacgcgtgggttcgattcagctacacattttgggttttttttgaaagaatcggttactgttataattttgactatatactggcaaaataattgctatcactgactccgaatatttgacattaggatcaagtgtattatttgatatgttagattggctaaataaataatataaatttatggcttctctaaaaatgagtcaataagtcaaacaccactttattaaaatttcgtcgatgtgtaactacctaaacttgattttgagtacaagaagtatagtaggaagttcaataacatcaacatctgactaaagtatttacggaaataaacttcggtgggaaagaatacttcatggagaaaggtgaaaagcagatgtccagga

SEQ ID NO: 4391 - DNA, 57 bp, Diabrotica virgifera
  Clone ID: LIB149-028-Q1-E1-A3
acacacgctgctcagaaattattttaaaataatagaatattttttaaataagaagaa

SEQ ID NO: 4392 - DNA, 434 bp, Diabrotica virgifera
  Clone ID: LIB149-028-Q1-E1-A6
agaaaaggtattagaagtagaagatcagcagaattagaagacacagaacaagaaaacaatgaaagaagcaaaagaaatattgccttcctacctggattttcaagaaaaggtatacgaagcagacgatcagctgaattagatgacgcagaagaagaaaacaatgaaagaagtaaaagaaatattggtttcctacctggttttgcaagaaaaggtataagaagcagaagatcagcagagttagaagacacagaggaagaaaataatgaaagaagcaaaagaaatattggcttcttacctggttttgctagaaaagggatacgaagcagacgatcagctgagctagatgacgcagaagaagaaaacaatgaaagaagcaaaagaaatattggctttttacctggtttcgcaagaaagggtatcagaagtagacgttc

SEQ ID NO: 4393 - DNA, 428 bp, Diabrotica virgifera
  Clone ID: LIB149-028-Q1-E1-A9
cgcgtccgaccacgcgtccgcggacgcgtgggcaaaaaagcaatgctgactttttttgttttacgagatttttggtatctctaacaatttttaagttattttgaaaaaacatttttcaaaattaaaatttttaaagattttactttaaaaccaatttttttccaagataagcactttgaatcgatgaaacttacagatcatataaacacaacataagtaaaataatttgtggaacggtggcgattaatttcgtttaagttgctggttgggggctggtcttcctgattttttttgccaaaacaaaagcgaccaactttattttgagcgtaacttacttaaatttaatgttagaaacttgttataaaaacagaggtagagatttttttaaacactttaaaaaagttatatgtaatgggttttccccaaaa

SEQ ID NO: 4394 - DNA, 410 bp, Diabrotica virgifera
  unsure (1)..(410): unsure at all n locations
  Clone ID: LIB149-028-Q1-E1-B1
cacacgtctggaagacattttggcaattattgctataaatttattatataaaatgaagtatttatctgttctatctattttttgctttgtgggaatagcgtttgctgctattactttctccaaggaaaatggtctaggaagcatatcggattgcctgttttgtacaggtgttggaaatcaagttagattgctgcaaaaacacaatctttcaatcgaagaaataagagacgttatattccaagaatgtactttgcccacggattggattttcttcgttagctgcgaagcctatataggcgagatcataaacggagtatttaattcaaccaatttggaagtacatgaagcatgccagaatatttaatactgttggtaaacantatattgtaatgttttaaagaatttaatat

SEQ ID NO: 4395 - DNA, 432 bp, Diabrotica virgifera
  unsure (1)..(432): unsure at all n locations
  Clone ID: LIB149-028-Q1-E1-B2
acccacgcgtccgcaaattgttattgatttgcacttttctcgcctgcgctggtttgagtacccaaacatcacctgaagtaaatttaacaatttattatgaaacttactgtggcccaagtcgacaaatgatagaagatatcctgatacctgcatatgccaagctgggagatattcttaaattaaacttagtctcttatggaggagcaatgtacatgatacattcgaatgggtcaatcgaattcaaatgcagccatggccactatgaatgctttgtaaaccgaattcatgcttgtgctatcaatttatctccaccacaagcacagctattaaaattcattgagtgtgacctcagaaaatcaatgttcaatacaaatgatgaacttttagaattcgncaaagaatgtgccgatgacagcaatttaccttacgatg

SEQ ID NO: 4396 - DNA, 419 bp, Diabrotica virgifera
  Clone ID: LIB149-028-Q1-E1-B3
cacgcgtccaaacaaaagctggtaatacttttgtagttgaaatttttgtaacaattttttatattttaaatcatacatcttgagaatataaaaattattataaagtatgctttgaaacagctgaatgttaaatgtatcagccaaattatttattaatataaatagtatttactggtgtcacaaaagctggtaatacttttgtagttgaaatttttgtaacaattttttatattttaaattttaattttttaaccgaaaaatttttggatatgacatttgttttgggcgaaaccattagaaattattaccagcttttgtgacactagtaggtacatagatactatttacttcttaatatacttccataacgttcatttgtttcaaagcatactttatatgttctcaagatgtacgtaaat

SEQ ID NO: 4397 - DNA, 418 bp, Diabrotica virgifera
  Clone ID: LIB149-028-Q1-E1-B7
actatattttgttgtattttattattttaaattcacaaaaatcaaactaatttgattaaattcataaggtaataagcaattgtcaaaaagtttatggtgtaataaacgttcagttggtgtattttcccaaatgaatgatacgtctagatggctaaatggtagagtgctctgatttacaatctaacagccctataatacgcaggctcgaaccccaatgcaagtttttatttttttatatattttatgattgtaagtatattattatataattttttccagaaaatacgtatttagttaaaatttttggcaacaattattgttcagaaatcatttctttgtggcatttttcaatgtgtttgtgtgtgtgttttattcttttagttttttaatttttggtattgttttaataaaaattttt

SEQ ID NO: 4398 - DNA, 393 bp, Diabrotica virgifera
  Clone ID: LIB149-028-Q1-E1-B9
atcctgattattgatttagagatgtgtacaaatcaacaatgcattagtgaatccttcactctctcttagtgtacataatttgaaacaattaattttacatccaattataggtccatgacatgtgacacattcatgtcatatatcattaagtagcaattgctcaattctatgctttcgaaattataaagtaaatcctttctgcaccagtaaaacagaattgaacaattgtgtcagcagaaacatatatttttggatagtaatgggagtcgaatgagtgtccttagataggattttgttatgattaaagtaaactttattgtaacttactgagcatggggatacgtgagcgtggggatatactcggacatttactcaaataatccttatttttga

SEQ ID NO: 4399 - DNA, 55 bp, Diabrotica virgifera
  Clone ID: LIB149-028-Q1-E1-C12
aaaatgagtcgtattaataaaataatttttaataaaagtaaggaaaaggtgttga

SEQ ID NO: 4400 - DNA, 433 bp, Diabrotica virgifera
  Clone ID: LIB149-028-Q1-E1-C9
ccggtctacattccgggcgacacagcgtccagggatacctacgaagttccagaaaacggaaacgaagtcaaaatatgctaccacaccatcgagcaaaacattctggagcatatgagcaacgcttatggaagaataagtcttttagatgaaattagttctaaaagagtagattccaagaacatagtaggtgtgttttttggagcatcccacatagagttaaacatagcctttctttgggcagcgtttgtgaaaagatatgacattttggaaaatttgttataccttggagctgaaattaattattttgagcctgctcaaggtcttagcgctcttcacttagcagctttcagcaactgtattagcggtatgcagtttttaatatccaaaggctgcgatatcaatgctctatataagttttatacacccttacatt

SEQ ID NO: 4401 - DNA, 428 bp, Diabrotica virgifera
  Clone ID: LIB149-028-Q1-E1-D1
acgcggccagtcaaaaataaggaacgtaggttatgcactggttatcttcgtagcacacctatattggtcatggaatgtgagcttaatgaacctccattttcattacgcagggaatacctaagtgagaaatttatagttaaaatagcggttaacgataaactgctattaaataaaattgttcatttaaccacctcatacctaactcattattactgggaaaaaaagaaactgtttttagttgtggaaagcttcctcaacgtttctaattccattggcgacatacaccaaatagaacaaagctcgtctcgaaagctaaattatgaagattatttatctccagttatttaactgtcatttaagtaatattcgtgcgacagacttccttactaaaatagaccaccttcagtgtgtacaaaaaaactggggga

SEQ ID NO: 4402 - DNA, 409 bp, Diabrotica virgifera
  Clone ID: LIB149-028-Q1-E1-D11
aggtcaaggcatcaaagatataatccagtggcccagaccaggccctccagtagttaggcttcaaaataagtgggctttggagtatggcatgccttctacacatgccatggttggagtgtccataccattctcagttttgttgtacacaatgggccggtaccagtacaacattcctttggggatgtgcattgcagttctttggtgcactttgataagcatcagcaggctctatttagggatgcatacagttttggatgtcatagttggtttagcgttagccgtactcattatgtttcccattgttcctttggtagacttattcgataattatttacttacaagtcccacatctccgatattattactagtttcgtcgattttgctgatattctactatccaaacagtggc

SEQ ID NO: 4403 - DNA, 409 bp, Diabrotica virgifera
  Clone ID: LIB149-028-Q1-E1-D6
agcgacatcgaaccaaaatggcaaaaatcgtcctcttcttctgcgccatcattttggcttcagcagctgctttaccaacccaatcagctgacggaggtgttgtcgacatcatcaaaaaggtcgtgcacaagcttgaagacataatggaaaaggtttttactgaaggtcccaatttcatcgacactttccctgacaagtatgacgaccgccttactaaagtgctagatgttacaagggccgtgcttactaaaatcgctcaagcacttaaagttgttatagataaagttgctgaacaaagtaatgatgctggaaagaaattggtttcctgtgtcgaacaacacgaagctgatctcgtcaatatccgcgtcgctctcgtcgaaggtgccggcaaatgcgtaaaagatagcgt

SEQ ID NO: 4404 - DNA, 394 bp, Diabrotica virgifera
  Clone ID: LIB149-028-Q1-E1-D7
aagaaaaggtataagaagcagacgatcagcagagttagaagacacagaggaagaaaataatgaaagaagcaaaagaaatattggcttcctacctggttttgctagaaaagggatacgaagcagacgatcagctgagctagatgacgcagaagaagaaaacaatgaaagaagcaaaagaaatattggctttttacctggtttcgcaagaaaaggtatcagaaatagacgttcagttgagatagaagacgatgaagaagaaaacaatgaaagaagtaaaagaaatattggcttcctacctggatttgcaagaaaaggtataaggagtagacgatcagctgaattagaaccagaaggagaaaataacgaaagagcaaagagaaacaatgggttcctg

SEQ ID NO: 4405 - DNA, 369 bp, Diabrotica virgifera
  Clone ID: LIB149-028-Q1-E1-D9
cgcgtctaaaatgatgtcgtatcactatccttgtttcagcccttgtggctcttgcagtaacttcgcctttagaatatcatccataaattaaattcattgagaaaggcattagtggtagagggaacaactacccgttattgggattgttgcataccttcctgctcaaggaggggaaacgtctatacaccataacggagtaccagttgcctcatgcgatagatctggtgtgaacatggttgatgagaatgcagaatcatgttgtgaaggtggcggcagtgcttacatgtgcaagagtcaacaaccatgggcagtatgcagcactttggaatatggttttggtgccgcgtctttcagtaacggagttgatgt

SEQ ID NO: 4406 - DNA, 202 bp, Diabrotica virgifera
  unsure (1)..(202): unsure at all n locations
  Clone ID: LIB149-028-Q1-E1-E1
aggacgcatgcgaaaatattatggtactttatactataagtatggaaaattttcattgaatggtangtacttagtaatgtgagagaatactatcatttgtatgaaggcccggttatttaatggaccatgtgcaatcatggaatagtaatgaataagtacatgcatataatattcgaatttataagagctaacctattaaaat

SEQ ID NO: 4407 - DNA, 324 bp, Diabrotica virgifera
  Clone ID: LIB149-028-Q1-E1-E6
actttttttttttttttttttttttgaaaatatgttaaaattgttaggtaatttcaaggacgatgtagaaatgttattgatcgcatgcaacagacataaaaggaaggtatatcaaaattttctattgtataaattttccagttagcttgtatattgtacattatttatatatattatattatattaatttttgtagaaaatatatacaaaatgataatgcacacttatttactttttaattcaaatttagtattaaaccattttacaattattataacaaatttatttttgcaaaaagaaagattacttatttaatctgtaact

SEQ ID NO: 4408 - DNA, 300 bp, Diabrotica virgifera
  Clone ID: LIB149-028-Q1-E1-E9
agccaggatcaacgtctacgtccagggcctctcctgccctcaatcttgccttgtagaatcaactgcagcagttggtatttttcgttacgcataatgtggccgaagtaagacggagatgtacttataccaagtaaagtcgcttgaaaatcaacagtgaagtcatgatttcctttgactgcaacccgccctttataacataatttacttttagaatctactatcattatcactagtcaccacagattgatcagcaacaggatgagaggacgaacttcctttttgcgctctgttgtggagtgt

SEQ ID NO: 4409 - DNA, 431 bp, Diabrotica virgifera
  unsure (1)..(431): unsure at all n locations
  Clone ID: LIB149-028-Q1-E1-F2
aataaaataatatatgtaggtatatgtacctaccaaataatattgttaattattataaaatttcatcaagatgaagctattagcagtgtatcttatttgtttaaaattggtgttcagcttggaattggattcccaatgtgacaaccgggggacgcttgtttatgaagatatgcactgcaagcctataacgaaggaaggccacaaatgccctgtagaatttaagtgtgatttggaagccaaaggcaatacttgcagatttagaaacagagatattccttttggttcttatctatctgacaacgatacgtacagcgcttgtagtgtanggtgtagttgtcaagaagataactctttcgaatgtgctgaattggattgccctgaatacgaaanaccgagccccaccagcaatgactgctatttaaagtataaac

SEQ ID NO: 4410 - DNA, 324 bp, Diabrotica virgifera
  Clone ID: LIB149-028-Q1-E1-F4
acgcgtccaattttttttctcaacagaataatttaattaactaagttaaaacttataaataaaacaaaaaatagggcaggtactggaataagtcgaacacacggtaaagtacacatagtaaaagatatcatcggatcagattctaatgctatatagaagggcctttaaatcctttccccgtcaaagtgaatcctccgaaggaactcatcgccatcgccttaatgaaatgtccttgaaggttcaattcctccgtgaaatccactaagttaaccaccgaagattatataaccaacaaaacgcccaacaccaaacaggccattgttc

SEQ ID NO: 4411 - DNA, 433 bp, Diabrotica virgifera
  Clone ID: LIB149-028-Q1-E1-G11
tcgcgggtcgacacaagcgtctaagttcactcaaagtactgtgatttggattttgtttctaaacttctaaaacggaagaaggtatagttttgtaaccaaatagttttcttaggtttcgctcagttgtaataatttttttaactccagtgaattaaacttttcaaaattatgaagcttcttggaaaaattatcttaatcttattgataggtttcgcttacacccagtattttgaattattccttggtaagcagatcctagaaaaacttgaacgtaaatgtgaacaagctgggttatctgaagtatttcagtctcttcaggaaatgtctcgtcaagttacaacatgcctggatgtcaaacaacttaatttaaatccagatacaatcgttgaagaattttctcgtgctgaacgaacttacgagcttcttaactttt

SEQ ID NO: 4412 - DNA, 434 bp, Diabrotica virgifera
  Clone ID: LIB149-028-Q1-E1-G6
aaggggaaatgtgatcataaaatatgtagtatgtcagaacggcatgttagagataatggaaaatattccctttattgtgaataacctagagaagcatagttttattaaatttattaggatataaaatcacgatgaagaaaagataaccaaaattacgtaggaggtcaaacaatgtgtttactgtgggattcctttttgtcttaaacgtaatacattgatgtcctgccgttagcgcagaatcatcatccttatttttatcataaagttaaagggtgtcgacgttgtcaagttttctgtaccattgtattaggtgtaagttatagcatttagtggtgacaagaaataatatttcatttaggggtgactatatttattgcattttgtgatatatatagtaaggtctcgttttatgcggtggatacgttctacagaaa

SEQ ID NO: 4413 - DNA, 213 bp, Diabrotica virgifera
  Clone ID: LIB149-028-Q1-E1-G7
ttagagataacgggaaaatattccactttattgtgaataaactagacgaagcataggttttaataaggtgttattagcgatatcagaatcacgggtgaagacatagagaaccagatgttacgtaggcaggtcaggtcaatgatgtttacttgtgggattccgtttttgtcttaatgcgtgctagcattagaagtccatgctcgtatagcgcag

SEQ ID NO: 4414 - DNA, 81 bp, Diabrotica virgifera
  Clone ID: LIB149-028-Q1-E1-H11
aaaattatattaaaaaatagtaaaaaaaaataataaactgaatttaaaatgggcggtcgtctcttactggttaccatgctt

SEQ ID NO: 4415 - DNA, 450 bp, Diabrotica virgifera
  unsure (1)..(450): unsure at all n locations
  Clone ID: LIB149-028-Q1-E1-H3
acggacgcgtgggttaataatcaacaactatacactgacgccgatatttattcgcccacagcgtcagaaaatggtacatacattgttaaacagtccccggacaactcatccatgttcgacatggacataaacagtagtgttagtgttagaagtagtagtagtagacattcttcttatccatcgtcgccggtgggctccgtcgtccgccctgcggcgacggagacccccgacgatagtgaaatgtcgttccagtccagttcttcgtcgaagcctaggctgtccttggatctcggtctggtacaccagaccaactttttagatgtcaatacgcctagcatcatcgccgaagtggttagcttggaatcgactggttttaacatcttggatctcgttanagaggacgatatacaattcgtaaatgacgtttttcccgatgcgtcaacctcaacc

SEQ ID NO: 4416 - DNA, 353 bp, Diabrotica virgifera
  Clone ID: LIB149-028-Q1-E1-H4
gcggccacacacgcgtccgataagagagccaaaaacctcattctaggggaaaacgatcgattgtggatgttcccaataggaacaatattggaccagatggaggagaggaagtagatttttaaaatcgattagatgcacaagtattttttattaaacatatgtctttttttattatttatgttaatatattagttattaggttcttttgactgcaataaaaattattccttattagattaaaaaaaaatgaaatacaaaaaaaattctacaaaaaaaccaatagaataaaaaaaattaaaattaagttaaacaaaacataatataaaaaaaaaaggggggccgcccaaaaggtt

SEQ ID NO: 4417 - DNA, 58 bp, Diabrotica virgifera
  Clone ID: LIB149-028-Q1-E1-H6
aaaaaaaaaaaaaaaaaaaaaaaaaaaaaaaaaaaaaaaaaaaaaaaaaaaaaaaaaa

SEQ ID NO: 4418 - DNA, 126 bp, Diabrotica virgifera
  Clone ID: LIB149-029-Q1-E1-A1
acggacgcgtgggcggacgcgtgggtttttttgaataaaaacatttttatgaataaggaagaaaagaggaagcagaaaaaaaaagaaatggaagaaaaagagaaaaaaaaagaagaaaaaagggga

SEQ ID NO: 4419 - DNA, 429 bp, Diabrotica virgifera
  unsure (1)..(429): unsure at all n locations
  Clone ID: LIB149-029-Q1-E1-A2
acccaagcgtccgcccacgcgtccgcncacgcgtccgcccacgcgtccgatttttattattttaaaataataaaatatttttttaagtaaaagtaanagaaaaattttatttaatgatagttaattagtattgtgagagaatattttatttttataaaagaaaaatttattttttgtaccttgtgtatcagggattattaattaataattatatatttattattttcgaattaaagagctaaaattaaatttattgtaaataatatttaataatttttgtatgaaatgttatcgtttttaatatacaatttttaagaatanttaaatttaattattaacaatatatttataattaaatatttttatattattaatattaaatatttttaaggatgnagctaaaaataaaattttattaaaatttaattt

SEQ ID NO: 4420 - DNA, 436 bp, Diabrotica virgifera
  unsure (1)..(436): unsure at all n locations
  Clone ID: LIB149-029-Q1-E1-A3
gtccacggcaacagaccgaaaaaacgtcgcattaaagaagagaaatctagtgatggtgatgtaacgagttctccgaacaaganagaaaatgctgaggacgataatgcagataataatatggaatacactgaacagcanattgtatgggctaaaatggtaggccatccgcactggcctgcagttataatcagtgaagtagaagtcgatgccgccatgccatcatcaaaatcaaacaagcaatattatccagtggtgtttctaggtgattttacgcacgcttgggtagaaaaaagccacatacacccatacgagaaaaacatcgagaaatattcaaaaagttcaaaaacccagttctttgcgcangcgttangacaagctaatgagcatttaagaaagcagaaagaggacagtgaatataaaatagcgttcgaacgtt

SEQ ID NO: 4421 - DNA, 122 bp, Diabrotica virgifera
  Clone ID: LIB149-029-Q1-E1-A5
acccacacgtccgcggacgcgtgggaaaaaaaaaaaaaaaaaaaaaaaaaaaaaaaaaaaaaaaaaaaaaaaaaaaaaataaaaatgaaaaaaaagttaaaaaaactgctaaaaaatcaata

SEQ ID NO: 4422 - DNA, 403 bp, Diabrotica virgifera
  Clone ID: LIB149-029-Q1-E1-A6
accaagccttcggttttaattaatttaaaataataaaataatttttaataaaagttaagaaaaattttaattaatggaaattaagtaataatgggaaaaaataatttaattttaaaaaagaaaaaattaatttttggaacctggggaacagggaataataaataataaatacataattaagaatttccaaattaaaagaaccaaaaaattaaaaattttaatggtaaatgaataatttaaatgaattttttggaatgaaatggtaatccgttttaaatagtaccaaatttttaagaaattaagttaaattaattaataaccaaaaaattaaaatttaaatattttaaaataattacaattaaaaattttaagggacaaccttaaaaataaaattttaataaaa

SEQ ID NO: 4423 - DNA, 405 bp, Diabrotica virgifera
  Clone ID: LIB149-029-Q1-E1-B11
gcgtcaagaatgattcatttcacaatgaaaggtctagttatctttgtcttttgcattgccgtggctgtatcccttccattggatgtcattgaagatgagagtggacaggaatatcttgtagttccagtacacagagaaaggagagacttaacctggggtgccaaccaaaatggatacactcttggtcaaaaaggaaatctctgggaaaatggtgcccacaaatttgacggtgcttacactggctcgaaagcttgggattcacatggactgaaaccagattcttttggaggtcgtttagaatacactaataagccaacaaaaactactgcctttgtaggcgcagacaggacgcctgggtacggtactgatgtcaatgctggagttaaatacaactttgttcaagat

SEQ ID NO: 4424 - DNA, 459 bp, Diabrotica virgifera
  unsure (1)..(459): unsure at all n locations
  Clone ID: LIB149-029-Q1-E1-B2
acgcgtccattcgattttaaaatattcagccttgctattttttattaaatttgtcagaaaatttttgtattcttgtttaagaatttgttcatgtggtttttgaataatttttttttgtgtattgattttattatgccagatgttatccattttttctgtttaacttcagtctgtcttatttttttacataagtagattcttttattttattttgaagtgttgttacaattttagtttcttaatagttctcttaatttgttgtaattaatgtaactagtcttaaatgtattcatatttgttttaccaatgttcatattaaagttaagttcaactantgtacagaaacgatcggtagtaatatgtgaataataaatataatatgtatatattataatttagttactattgggacatttgttatatttgtaagttacaatatgtatttacatattgtaatgt

SEQ ID NO: 4425 - DNA, 262 bp, Diabrotica virgifera
  Clone ID: LIB149-029-Q1-E1-B6
gacccacaagtccacggacgcgtgggcggacgcgtgggcgaacccaaacaaattaggagacgatacaatgctgatgacagacgaagaaagttacgacgaatttggacctctcgaacaattgttgatccagaacaatgataaaagaactgatgaatgtgaaagggatttagattgcagttacatggcaaattctatatgtgatggtacaacaaaaaactgccttcaaaagtagagtaattcccatatttgcaacggaagtttt

SEQ ID NO: 4426 - DNA, 235 bp, Diabrotica virgifera
  Clone ID: LIB149-029-Q1-E1-B8
acccacgagtccacggacgcgcgggttatttttttttttttttttttttttttttttttatttttttttttttttttattttttttttatattattttttttttattttattattatttaatttttgtaacttgtgtatcaaggattaggaacgaatacctaaaggaatagtaagtacgaagtcaaaagagctaaaacacgaaaagttgcaacgtaaaagacacagagcagaaaa

SEQ ID NO: 4427 - DNA, 441 bp, Diabrotica virgifera
  unsure (1)..(441): unsure at all n locations
  Clone ID: LIB149-029-Q1-E1-C1
atgtaaacacatttttccgaacaaaatgaacttaaagggtccacctgaaaccaaacttgtcgtagaaacatcgatagaatcgccggaatatgacgggatcttgttagtggctgcaccggatcaaaaagtgaagaattcgaagttgaattctcttgttcaagatgctctaagtttcgaccaatccctcaagacagaaatcggcgttttacagacagatttaccggcgagacgagtggtttattctcctactggtccaatcgatacggactacgatgatgtgagaattttcaaaaacagtgctgcggcgggtgttaagagggcgctaaaggctggtgttaaaaagttgttggtggtccttgangaatatcncgcatttgaaagtaccgagttggttacgcttttgggagtattggatgccttatatacgcctattcaagtcag

SEQ ID NO: 4428 - DNA, 404 bp, Diabrotica virgifera
  Clone ID: LIB149-029-Q1-E1-C10
cccacacgtccgacctcagaggcttatattttaaacccatgattttttggaactaggggcccattgcgtcttgttctacacatcaaggactaccaaaacacaaagtttcagagcatttgacagagagccatttcccataaggtttctgtggggtccattgtccattggtaaagtatttaccaaaggttgtaaagaagtttaatcatgaagaaggtcttcaaagtcaggaagtagataatcgagaaagtgataatgacttagttataaaagaacacgtttttattgtagacaaccctgtagtaaaagacttaaatagactaaggtgtgtaaattattcagatgtatcaagtaatttagcagccactggcagccagtttagtgtacctaatccacagcagtttagt

SEQ ID NO: 4429 - DNA, 411 bp, Diabrotica virgifera
  unsure (1)..(411): unsure at all n locations
  Clone ID: LIB149-029-Q1-E1-C3
acggaagcgtgggccagcgtcagcaatganatacttttacttgacatacgtcttgatctcttacttctactatataaatgccgaagagtctccaagtctagcagctcttgcaccanaatgtgaatgcggggacatccttgacaagattctgtgccaattgacagaaaactctaaagaaattctcacactccaggtaaaactagtgtcaattagaaaagaatcaacagaacttcaaaacaacgtagccgagaacacgtgtctggttaactcgatcgaaacagacgtcacagtcattgaacaacaacagaaccaaactgtgaccgttatcaataaccatacagctatcatcgtcgacattgagacaaaactagaagtcatcatccaggaacaaaatgtactcgagaccaatat

SEQ ID NO: 4430 - DNA, 253 bp, Diabrotica virgifera
  unsure (1)..(253): unsure at all n locations
  Clone ID: LIB149-029-Q1-E1-C4
acgcgtccatattaattcagaataatcatatatctgttactaaaagtaacgaaataatttagttaatgatagttaattacttcttgtgagagaatattttatttttactaaaagaaaaatttattttttgtaccttgtgtagcaaggattantaattaataagtatgtatttattatatgcgaatttaacagatcatactattttaatttgtactgtataataaatattttaaagtatgtctttgtatgaaat

SEQ ID NO: 4431 - DNA, 426 bp, Diabrotica virgifera
  unsure (1)..(426): unsure at all n locations
  Clone ID: LIB149-029-Q1-E1-C5
aacccacgcgtccgcttattttaatttatatcgacaaatggaattttataggttatttttatatttacaaaaatatttcatgtcatttgtcaaaataaaagattctttaactgcgtttgcaataccatttttttagacccgtcctgtatttgtcctttattaaagtatcctgtaataaaggatcctttatttgccggtggcaataactctctattatcagctttgtaattgccttttattagtttaccaccactattttgagaattgaaatgacagcgtgaactgtaggaagttaggcatgttccgtattaaaacagatactcacagagtaagaatatacggggtacgttcagtatgatgatttagattttagataanaagagatatattanatagaagataataaaagagtgggccaacgagttt

SEQ ID NO: 4432 - DNA, 368 bp, Diabrotica virgifera
  Clone ID: LIB149-029-Q1-E1-C9
gcgtcaacagtaaatcataatattaaagtaaaaaaaaaaaaaaaattttatttaaagaagggttaaataataatgtaatgataataaattaagttgtatttgagaaaaatttagtttttgtaccttgtgtagcagtggattgtaagataagtatttttaataataaatatggggggggtctcctctagcttttttgttaaaatttggcattgtaagatagttattttccttaaatttgtttgtaaagtagttgtaaattcgtgcttttttttatccacttttttatgagaaaaattcggtttatttattaataatacctttataatgtaagtacttttatgccaataaggttaaatatttatagggat

SEQ ID NO: 4433 - DNA, 458 bp, Diabrotica virgifera
  unsure (1)..(458): unsure at all n locations
  Clone ID: LIB149-029-Q1-E1-D2
cgcgtccacgaaaaagaatgctgcttttattattacactactactacctattgtattaagttacaaaggtaacccaaatcctctttcaaatgactttataaactacatcaatagcagacaaagtacatgggttgctggaaaaaaactttgatgagaacctttcaatccaagagatcaaaaatttgttacgagcanagaaaggtaaattacgcgtggctaaagaatttacacacagtgaagatattcaagttcgcaattctttcgatgcaagagaaaactggaaagaatgttcagatgttatcagcaccgttgtagatcaatccgattgtggatcatgctgggcgtccctgcagcttctgcatgaatgacagacgatgcataacaacccagggaaagcttaaagtacctgtttcggctgaaaatctaatgtcctgctgcgaatcctgtggatatggatg

SEQ ID NO: 4434 - DNA, 309 bp, Diabrotica virgifera
  unsure (1)..(309): unsure at all n locations
  Clone ID: LIB149-029-Q1-E1-D4
aattttaccaaaccccattttaatcaatttttcaaaacatcttttttattttttaaaattaagtacttatctctaatagtttaggagattatcatcagatattcatttaaacgattaaattattagtaacaaattatctgactggttttcagcctggtaccctcgaaaaatcgaatttacgcaccaaaaaagatgaaggtactgagggaacataagagtgcatattcaaccatccccttgttcctaaactatatacttattatatttaattagatcatattttantatttaagtaatactgagataaaa

SEQ ID NO: 4435 - DNA, 452 bp, Diabrotica virgifera
  Clone ID: LIB149-029-Q1-E1-E3
aagcgtctagcttaactctcaatagagattggtttaccaacaagttcatgaagtaattgaacgtttgacctcccaacaaatattcttgaatcatctagccgaaagcactgaagcaactgaagtcgatactatttccattcaaagatgggttgtacaacaaaatattattaacgagcagatccagcaattgatccaacaagttttgtaccaacaaactcacgtaaggcaacaaatccaagtactaattcaacaaggacatgttatcccacaggaactcgtcctttaccaaaaaattacctaccaatatgttgaaagatttcttcaagttttgattaaacaattcgtaaatcaacaaaccaactacaaacagttgattcaaattttgggacaacaaagacacaccatacctcaagaattggttttccaatatttcgctatgttacaccaattac

SEQ ID NO: 4436 - DNA, 271 bp, Diabrotica virgifera
  Clone ID: LIB149-029-Q1-E1-E4
aatttaaaaataataaaatattttttagtaaaagtaaagaaaaattttatttaatgatagttaaataatattgtgagaaaataatttaattttaaaaaagaaaaatttaatttttggaccttgtgttacaaggaataataattaataattataaaattattattttcgaatttaaaagagctaaaaaattaaaatttttaatgtaaaataaatattttaaataatttttttgtaatgaaaatgtattcgtttttaaatatatctaattttt

SEQ ID NO: 4437 - DNA, 124 bp, Diabrotica virgifera
  Clone ID: LIB149-029-Q1-E1-E7
attaggggaggcctatgttcaactttggatgcagaagtctgcatgatgatgatgtcaaatgtaacgatcaaataatacacaacatcaaattctatgtggctgttaggcctggatcccacgtacc

SEQ ID NO: 4438 - DNA, 86 bp, Diabrotica virgifera
  Clone ID: LIB149-029-Q1-E1-E8
cccacgagtctgaaataaatcaaaaataaaaaaaaaaaaaaaaaaaaaaaaaaaaaaaaaaaaaaaaaaaaaaaaaaaaaaaagga

SEQ ID NO: 4439 - DNA, 407 bp, Diabrotica virgifera
  Clone ID: LIB149-029-Q1-E1-E9
cggacgcgtgggaaacgatgaagctggttctaggaacgctgttcctaagtgtcctgattttcaataaagcttctccccggcaaatcagttatggaaaactagaaagactacaagacgccttgaaaagattttcgataaacgatattaacttgttgcccaatgaaaacgataggcttaaacaaaccactcctgaaaaacgaggttgtatgtatcttataggcgaaagttgcagtaatggacgtgtgccaggtgcaggagctgacagcgactggataagaaatggaggaaatgttcctggaaaacgaacttggaaattgttcgattttcacaatctcccaattttatcaggaaaacgttgtgtaaatcttttaggcgagagctgtagtaacggaggagcttctggtgcg

SEQ ID NO: 4440 - DNA, 416 bp, Diabrotica virgifera
  unsure (1)..(416): unsure at all n locations
  Clone ID: LIB149-029-Q1-E1-F1
attatagctcaaccgacttacaaggtattttatcgattacctcgtatctcgataaccgaattaaagggtgttttatcgattttgcccatttatttcagggcccataacttaagaaccccttgtatattttttttgatattaatttggtacacataatatgtcacatttagaactcgaaccatccaactactaatcacaagaaaaatccaggtccggattaaacanaattataaatccattgtgaccttganacagcatcctgtatgttgaaattttcaaaacccgtttgcacatttganaagagctttaatggagcttttaatttttgcgcagacaactcaatgactttgattttgaaattatgtcgaaatttttaagaactcaaacattcgaaacaaaaatttcgatataatttt

SEQ ID NO: 4441 - DNA, 375 bp, Diabrotica virgifera
  Clone ID: LIB149-029-Q1-E1-F12
aacccaaacgtccgccaacgcgtccggtgaactttcgtaattgtgtttattatttaacactgataaaccccagcagaattattaaacatcagaatggaacaccagcagctgatcaaggaaatgccttatagtggaacagattcccatacaggagagactgacattggcaaggaacagaacaacctttcagttgaggttatggttgcagaaggagaaagaacatggtacaaggagctccaaatatcacaaatcgaacattagagggatctgctttaatgacagcgtcgtagtattggaagctgcagctagaaatgacattgatgaaattcgaatgttgctaatgaaaggcgtcagtccggattcgtgcaacgaaga

SEQ ID NO: 4442 - DNA, 225 bp, Diabrotica virgifera
  Clone ID: LIB149-029-Q1-E1-F2
tttatcgattttgcccatttatttcatggcccataacttaaggaccccttgtagattttttttgatagtaatttggtacacataatatgtcacatttagaactcgaaccatccaactactaatcacaagaaaaatccatgtccggattaaacaaaattataaatccattgtgaccttgaaacagcatcctgtatgttgaaattttcaaaaccggtttgcacattt

SEQ ID NO: 4443 - DNA, 395 bp, Diabrotica virgifera
  unsure (1)..(395): unsure at all n locations
  Clone ID: LIB149-029-Q1-E1-F3
agtttagttganaataattaattactaatcatttaggaaganatcctaagaacgggggtaatccacctaaggatttcttcctaaatgattagtaattaataatttagttganaataatttttatgctgtaagattaattttaattattttaactttaattacattatttttttatttacgaattactttttctactataactattataataaatgaaatttatagaaaatctattaaaattaataataattgactaattttttttaatgcatttactttaataagattaattttatgtacagaaattttcagaatactttaaaanaaaaaaaaagaaggaaaaagaagaaggaaatagacaaaagaggggaggaaaaaaaaaaaaagggcggccg

SEQ ID NO: 4444 - DNA, 446 bp, Diabrotica virgifera
  Clone ID: LIB149-029-Q1-E1-F5
agcagtagatagatcaagtatatagaaatataaatggtttgtctaacaccgctgttttagatttgaagtagtggaaaccaaagttgtgtcacatgattagaatttccgtaaaagtatttataacgattgttccttaagactgttctaacgaaagtagtagcgcaaaatatctaaacgcttctaataaactcaagaatgctattcattgccgccatttttctcgtacatttgacgtgcaatatgtatacgtcatacgtcattggtatgtaccaaagacgaatgacgtatattgtacgtcatacgtcatacagtcactcactctgtcataaaaagtaaatttatataaaaataaattattccatatgttctcgcatcgacatgaatcttatttttcgctttttaattattctggactctttaatgtgttcgctgaaataattttatcc

SEQ ID NO: 4445 - DNA, 444 bp, Diabrotica virgifera
  unsure (1)..(444): unsure at all n locations
  Clone ID: LIB149-029-Q1-E1-F7
acccacgcgtccggtttttaaatatatctaattttttaagaaataaataacatttcattacaaaaaaattatttaaaatatttattttacaataaaaattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaattaaaattaggattaaaaattttcatattttaaaatatgttaatatttaattttataaattattatttttaatttttataaattttttaataanatataaatttaaattatttaaatttagtaatgatgataatattagtattaaaaaattgtatatttagtaaa

SEQ ID NO: 4446 - DNA, 415 bp, Diabrotica virgifera
  Clone ID: LIB149-029-Q1-E1-F9
cgggtcgagcacgcgtcaagtaaaaggtgtaaatgatataagtaaaatttaataaaaaaaggatgtatgtatgtgtactttgtaaacaagagcatcatcagtgttacaggaacatggtgagccgcccaagggtgcgggggtgaaaaccttttacaaatagactaaaagtcttatatgtatagaaatataataaaatccaaaggatggatataaaatcttgtggatatggccttgagacaacatatatgttgtcctagagccatatccatgggattttatatccatctttaaaaggttttcacctttgtgtttttgggtggctcaccatgttcttgtaacacttcttgttacagagcgaaaacgttttgtttctatgtttgtagccttataggggctttttaaactaatatacctt

SEQ ID NO: 4447 - DNA, 405 bp, Diabrotica virgifera
  Clone ID: LIB149-029-Q1-E1-G11
agcaagcgtcaacccacacgttctgcgaacgcgtgggcttttctactttgggattatttgtcccatctcttctagatattatcgtcaattggaaaaattggggtagatataattggattttggtcagagatttatttataataaccatgttcgtgtttggttttgtgtttggagcttattatgctgttctccattttatccaataagcagcagactatggttagatgattatgtacattccatgtcaagtaactcagacaaaaacttttggatctccgatttgtctgaaatttggtgtacagctactgtttaacataaaaataagacatactaggtaagtcttcttgtgtttttttttcttctgtaaatgtcattttaagcgtttgtatagtgatttggtgttta

SEQ ID NO: 4448 - DNA, 400 bp, Diabrotica virgifera
  unsure (1)..(400): unsure at all n locations
  Clone ID: LIB149-029-Q1-E1-G4
aaaagagtaagaattacgtcaattacccgcttcattactttcttccaaattcccaatttcggtgctaattaggaaaataaatttgggtcctcaaatttaaaaaaattaaaagtataaaccttaaaggctttaaggggccctgcnggtctgtcagctacgccactgtatacaagttttcggttgatatgcacacgccatgagcaagggtccttcatggttgaagaaacatgttaacataactttgcccgcaaaaggttgaaattcgtatgaccgcacgctgagtatatttggacggattgttaagaacaaaccccattttgaatcacaaaccttaaaaaagtggaatacaaattataaggactcaccaatgtaacgtgtacaaacacaaaaacattttaaa

SEQ ID NO: 4449 - DNA, 307 bp, Diabrotica virgifera
  Clone ID: LIB149-029-Q1-E1-G5
gttcattcagaagaaaaatcagaatgaagctgttcatccttgctgctgcccacattgtaaccacaagtgccaatcgaggtgccttcgataaatggactagttttaaggccaaccatatgaaatcttacatcgttagtaaagacaaacttcgtttcgctgtttatccaagagaacctcaaaaagatcgaggaacacaatgctaaatacgaaagtggagaagattcctactatttggctgttaacaaattcaccgattggtccatcgctgaattccaagctatgttgagccgtcatatggctaacaagc

SEQ ID NO: 4450 - DNA, 278 bp, Diabrotica virgifera
  unsure (1)..(278): unsure at all n locations
  Clone ID: LIB149-029-Q1-E1-G6
aatcagaacaaatcgtccaaggatttttctttggtccagttattgaacaaccgagtgaaactgcctttattactgaaccaatgtattcaactatcgaaggtggaaggatgagcaaagttcctttgtttatcggtatcaactcagaagaagctctggacagaatcacatattcgtatttcccagggtctgtccaagcgtacgatgctgatgtcaagcagttagtaaatagaaacatgcatatacaagacgatgcttacanagaaaccatcgggaatgaa

SEQ ID NO: 4451 - DNA, 244 bp, Diabrotica virgifera
  Clone ID: LIB149-029-Q1-E1-G8
aaaaaaaaaaaaaaaaaaaaaaaaaaataaaaaaaaaaaaaaaaaaaaaaaaaaaaaaatgaattagattcaaaaacttgggaggtcacctcataggttcaaatgtataactaaatctctatggggcgtcatcgagcttcaatttatttaccttcttttaatatgttgaacgtcgtttaatccctttgttacccaaaattctttgccttgaccctattttaccaccctctttcagatccatttt

SEQ ID NO: 4452 - DNA, 406 bp, Diabrotica virgifera
  Clone ID: LIB149-029-Q1-E1-G9
acacacgcgtctgcattaagtcagtatcatcaacatggcgaacttattgggaacaataattttatttggattttttgcactggggtttgcaactcaagaactaatatcctgttacgattgcaagccaagtgcagacaaacctgatgaatgtgtttatccagaaaagaatcttgctcccgttagtaactgccaaccaccgtcaaatggaacggcggtgtgcgtttcgtcttacgttcaaaatataaatgctgctagaactggagtctaccgaggctgctttaacataacagcagaaataggcaacgcgtgtgatttgtttgtagaagaactctcgtctaatacatcaacaattaaattttgtcgatcatgtactacagatagatgcaacacagattatttgaatgaa

SEQ ID NO: 4453 - DNA, 393 bp, Diabrotica virgifera
  Clone ID: LIB149-029-Q1-E1-H11
gcgtcaattataaatcagcataggcacaccttaatctgtttgttttttgtgcacttgtaaattttgctaataatggggtaacgtcagctgttactggattgactgatgatgacttaataataacattatctatatgaactggagtccgaggacacgtccttcagagttttgaaggtcgtaatttccatgccttcgaaagtattccatatgcagaaccaccgattggttagaacagatttcagtcgcctgttgtaaatccaccatgggaaggaatattaaatgcagctgctaatgaaaaaatgtgcccacacttgctttcacataatgatcctgttcatataagagatgatgattgtctgaatcgaaatgtatatacaccattggttagtgatc

SEQ ID NO: 4454 - DNA, 318 bp, Diabrotica virgifera
  Clone ID: LIB149-029-Q1-E1-H2
ttatatacctgttatatatatatgtatatgtgtatatatatatatatatatatatatgtatatatatatcaatcggttttaaaacgtcttgcgacgttgtccgatgcctaatttccatgacactctatcatcccattggccctctctaagatctcttgcgctcatcgccttcgttactccctctctccaagatttcttgggtcttcctctctttctgcggtttggtggtacccattgcataattattttagggagtcttgagttatccatcctctggacgtgtccgtaccatatcagctgttttctttctaggtcggt

SEQ ID NO: 4455 - DNA, 193 bp, Diabrotica virgifera
  Clone ID: LIB149-029-Q1-E1-H4
ggcgaccacgacgtcagtatataggatcatctagaccaaagtataaatggatggcagatcacacagaaaatttaagtggaactccagggcagtatatgccatattccactactagacccaaaattgaagcatggacccccccaggaaaatagaaaaatgttattttgtgtagtatattgtgaattttatgtat

SEQ ID NO: 4456 - DNA, 459 bp, Diabrotica virgifera
  Clone ID: LIB149-029-Q1-E1-H5
cccacgaatctaaaatgagtcgtattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggccccccaaagggttcaaaccttccttacgcgtgcaggccccttcaaggcccttcaattgtgccccctaatttcattccatgggccttctttttaaaactccgtattgggaaaaccccgggctttacctaacttatcccctttggagaacacccccttttcccaagttggcgtatttccaaaaaggcccccttttttccctttcccaaaatttgccaaccctgaagggctttgggaaccccccctgttccggccctttaaccccggcggttttgggggttacccccaccttaaccgccaattttcccagggcctaacccccggcccttt

SEQ ID NO: 4457 - DNA, 61 bp, Diabrotica virgifera
  Clone ID: LIB149-029-Q1-E1-H8
gcgcaagatcagttaaacaatattgagatgaccaataaatgtggtaatatttgtaataatt

SEQ ID NO: 4458 - DNA, 402 bp, Diabrotica virgifera
  Clone ID: LIB149-030-Q1-E1-A3
agcgtcagattttaaaatggggtaatataccattgattatataacagaccatgatgaattgtgccaccgtttaagcacccgctataactacaacactaccagcaccatctgacgtcaaaagtccacttgaacaattagcaattggaaataaacaactaacgtcaaatctgtacaaagaaattcttaaaactaagaacggaagtattattttcagtcctttttctgctgaaaccgtattagcgctgacctctgaaggagctaaaggtgagacgagaagcgagctagtatctgcactacaccttccagaatcacaagagactatccaacaaggatttaaggaacttttaccacaacttaaaatcaacagtaaggatgcagtattaacttcagccaataaaatat

SEQ ID NO: 4459 - DNA, 375 bp, Diabrotica virgifera
  Clone ID: LIB149-030-Q1-E1-A8
agttttaattaagattaataatttatatttaagtattagttttgaataattttaattattgatagttaatttatgatgtgagagattcatttatttttatatgttataaattaattttatgtaccatgagtatcatggattattaatttattattatataattaatatatacgaattaaatttagctatgatgataatatttttattgtaaaattgttaatttagttaatttatatgtgttgaaatgttgatcgcggctacatatatctcacctgttaagaaataacttgtctttatgtattaactatatagtcacgcctgcctactgataaattagtaaggccgcggttttttaagcatgagcttgtagcttaa

SEQ ID NO: 4460 - DNA, 411 bp, Diabrotica virgifera
  unsure (1)..(411): unsure at all n locations
  Clone ID: LIB149-030-Q1-E1-B1
gtcaacagtcacttgtgcgaacgcgtgggcgaaaatgtttggttttgtagtaactatttgtttgcttgtaatatctgcacagggaaaaattcctgttgaaagatgtccagatgtaaaaggagtggaaaatttcgatggagaagcctatttgggtgattggatcgaacaagcaagatacccaactttactggaagaccacggagaatgcgttgttaccaatattgcactagaccttaatggagttgtaaaaagtcgtaccacatatactaatagcgaaacacgcgaagtacatgttctcgaangagaaggagtatcaaattcaaccacaggaagaagccaaatttttagtacatttccttaatcaagatgtaactgtacctttttgggttcttggtacagactatacaacat

SEQ ID NO: 4461 - DNA, 389 bp, Diabrotica virgifera
  Clone ID: LIB149-030-Q1-E1-B10
aggacgtgtgcgctttgttgccatttatagaccgtatatctaatatgaaactaaacatgctgtatgtacaccacttccgagttccgaggcagaatgaattaaaactatgatgttaacaacattagattgttttaaatttaaacttaccattaattacgttacaaatacaactagttcataaaagttgtccagagaggaaccagtgttaaaagtactattatctagctatttatactatttattgttgtaacatatcctgtgtgtatatacaatcgacatttttaacttatcgcctatcatgaaattgatttttaaaacttggagttttttcactgatataatatattcaaaatggtttaagctgaaattagatgtgtgcctgaccattt

SEQ ID NO: 4462 - DNA, 423 bp, Diabrotica virgifera
  Clone ID: LIB149-030-Q1-E1-B11
ccgggccgacccaagcgtcagggcgtactttattttttttaaggggagcgagtttttcataggaggggggtgcgattgtcaaaggcgaaaaaatttcatttggttttaaagctaagggttaggaataagtgtcacttttgacccgggaatactagctcaaacaggggcgtcacaaaaaaatcactaacttgcgggttgaaggaaaaaattgaaaaaaagggcaaaaaagttgaaaaaaaatttcagatggacgtaaatcgggtgctttttagagaagaatgttgtgcttttggacttaaccgttcttaattttttgcgattttttatttgaatgtttttccctaccaggagcgtactttccttttttttaaggggagcgagttcttcataggggttgggggtgggttggtcaaacgcgataaa

SEQ ID NO: 4463 - DNA, 369 bp, Diabrotica virgifera
  Clone ID: LIB149-030-Q1-E1-B12
aggttttggtttggttgggattgttagatgttgttctggatgttcgggagctgatggatgtgggattggttgtgcaatttttctagaccagagttggtcggttgtgtactggttgtggtgtgattgtggaaatgttttgatttgttttgttggagatgttgaggttaagttgagcaatggtggttgtgtaagagtttgctagggtctttttagtgttgggggtgtcaagcgatagaatcattaatgagtagttcagagttggagtcgggtgtaagggtgactggctgtacatgaaattggatttatagtggtgtgaagttatgattgtttgtacatagatgagattttgtgtgatgttacttactgaaa

SEQ ID NO: 4464 - DNA, 235 bp, Diabrotica virgifera
  Clone ID: LIB149-030-Q1-E1-B5
aggagacgcctgggataaactgttgaggaatgctgtcggacacagagtatccatacgagcgagtctatgagacctgtagatttggactatctatagtgccagccatgatcagtcacattacgtacatgaagacaaacgacgaatcgcatcttaccaacacaattgctgcaaaatgtcggatcacagtgcctaatgatacatcggctacaatccagtcaaatgggccgtgcataca

SEQ ID NO: 4465 - DNA, 401 bp, Diabrotica virgifera
  Clone ID: LIB149-030-Q1-E1-B7
aggactaagcttacaagaaatacaaattttgctcactagtggtaagattacatataaagagagggttaatctatagttgcttactttcttctataatggttgttccaagactccattttctgcttttatatattttctgtattatgattatcaacatcatcttgacaatactatctttgtatatttatatctctttcttcaaaatttaaatcaaatgttttaaatttgtgtaactgttatttacgattattcatagtaacattgaaaatgaaaataaacgatggagaaatatcgtcttttggcgtgatgtgatagcttgaaatttttggaaatttgaagtgacgtgacaaagccagatgacaggtttcgtgcaggaatgaccaatgatataaaaaacatga

SEQ ID NO: 4466 - DNA, 293 bp, Diabrotica virgifera
  Clone ID: LIB149-030-Q1-E1-B9
caaatctcagtagtgagtcgtattaagttgccaattttgcttaaatattgttctaattattgatagataggttgtattgtgagatactaatttacttttataatggataaatttattttttgtaccttgtgtctcagggattactgaataatgattataaatttatgagtttcgatattagcagagctgataaattacgctttctagtgtatgatagagagatgagataaattttttgtactgagatgtgatacgtttttaaatatacctagctttttaactttcgcattgag

SEQ ID NO: 4467 - DNA, 403 bp, Diabrotica virgifera
  Clone ID: LIB149-030-Q1-E1-C12
agattcagacaagaatgtagtacaatgatcaaaatgtttaagacaaggcactaagtcaattcataaaatctatacacatagagcattcagtccacacatgcacatacaaggtgaatattaaattactcatgaaagcagtgacacagactaaaatttgtgttgccattctgcttattgctctttcaaaacgtgtaacaacgccgataaaagaaaaatatattttttacctaaattataagcgctttttaatcagtagcgtcaattttacatatttatctgactttaattttgcagctcaattacaagccttttttaatcaatagcgtcaattttaccattcgtttcgttgaatttaataactcaatatatttaagagggtgatcaaaaagttcctggacaaata

SEQ ID NO: 4468 - DNA, 319 bp, Diabrotica virgifera
  Clone ID: LIB149-030-Q1-E1-D3
ttggcttcaagggcaaggcttaaaaataaacctgaatcaattaataacctattaaaaaaattcccatcttggacaataacgttatagctaaattaattagtacaacaaattacacagttgagcaggtaagagatggatctcatcataacatgcaaaatataaaaccccaagatcctgtactacttggcttatgtagccaagaaaatttagaagcagaagtggaaaaagcaaaagtagaaaaagagaagcaagaaaggttaaaaagtataaagaatagctattaaggatcctcaaatttttgtgctttgttaacattaag

SEQ ID NO: 4469 - DNA, 352 bp, Diabrotica virgifera
  Clone ID: LIB149-030-Q1-E1-D4
acgcgtcaggtgaagagtttgacgacgcgtaggtgatatgtgaaagtagttcgggcgatatgggtcccccagctgtagctggcacctcatcagaaggcgccaagcagcacgaactagccgaagaaatgctcgaaagtgacgatggtgtaagttctgaaggagagaagccatccatagccgaagaaggcgaagaagaaggacgtgatgcggaggcatctcccatttctaactcacggggcgtagctcatataggctcgaattctgctctaagatctgccacgtcgtcactactgagaggtgctaatcaacgatctggtcgatctccgatttgtttggagccacagatcgcccc

SEQ ID NO: 4470 - DNA, 388 bp, Diabrotica virgifera
  Clone ID: LIB149-030-Q1-E1-E4
gcgtcaaccacacgtccgctcgtaaatttgtccacaaagtataatatacacaaaaaaagaaatcaaaatgatatggtagctgttacccttaaaggttcaggaatggaatactaacaacaagaattatgctttcttattcaagaaagaaggagaagaacatgatgtgctgaggacagaagattttgccattggatttatgaacaagataatgggaggataagttacgagaattccctaacaaaatatgtgtggacggaacccatggaactaatagaagactgatggacttaacaataatgcttattaaagatgacggaaaccaatgatttccagttgccttcttactgtccaacagactgggaccaccaagttcaagaaatttttttaa

SEQ ID NO: 4471 - DNA, 160 bp, Diabrotica virgifera
  Clone ID: LIB149-030-Q1-E1-E8
acccaagcgtcagaaaactgtctaacaatatcgataaacagacggttgagtatcatacagacgaagatgatcttgcacaggaaacagagtggattcgtgcgaaaaacaggaaagagaggaaaatggacacttccctaacaccaccaaagggaactcagaa

SEQ ID NO: 4472 - DNA, 369 bp, Diabrotica virgifera
  Clone ID: LIB149-030-Q1-E1-F11
gactcaagcgtcaggttttatcaaccacgatggtgatcgttttgtggaataataatttcatttggtgtttttgcactggggtttgcaactcatgatctaatatcctgttacgattgcagacttactgcatacatcgagatgaatgtgtgtatccaggttcgaatcttgctcacgttaataattgccagacaatgtcagatgaaatggcggtgtgcgtttcgtcgtacgttcaaaatgatcatgctgcaataattggagtctaccgaggctgcattaacatgacagcaaagttatgcaacgcgtgtgatttgtttgtacaagaactcgacgtctaatacatcaacaattaaattttgtcgatcatgtact

SEQ ID NO: 4473 - DNA, 413 bp, Diabrotica virgifera
  unsure (1)..(413): unsure at all n locations
  Clone ID: LIB149-030-Q1-E1-F2
acgcgtcaacggaaacgtgggtgctttttgacacatctgcaaagaacataaatatgtagactaatagcanaaatatttcattcttttatttttacatttattatccaaaataatatttgttaaaatattagttaattactgtgaaataatttctcccaaatatgattaaatataaaactttttaagaaatcgtaataaactaatgtgacattttaaaaactccaacgatttctgcacttagttatatagaactctacactgaaatgaagcatattttgttatcattaaatactagtgacctatttatangacagttaaataaactttatactgacgattcaacaattcatattttctagatttatttatgaatattagttatactacattcgctctcgcgagattttttttga

SEQ ID NO: 4474 - DNA, 403 bp, Diabrotica virgifera
  Clone ID: LIB149-030-Q1-E1-F6
agcggacgcgtggggttgacaggtgtcttacaaagcttgtttaatttataaatactcatcacccaatgaagaactcatattttggcccgatctagcgtcatttcattatgccaggagtacgacagattggttaactgctcaaaatataattttgttcttaagtgcgacaaccctccacatgtgcctcaggcgaggcctatagaagagttttcagtcgaattgtgtataataatagttgggaagtccaaaatgaagatccgctatggcgaagaattttgcaaaaattacgtgagatcgatttagaaacagtccaaaggcttattgcacatacaaaaccaaatttacgtgccatcgaagatcacggacctctttctattctttaaaaatatattataaaccttag

SEQ ID NO: 4475 - DNA, 381 bp, Diabrotica virgifera
  Clone ID: LIB149-030-Q1-E1-G1
cgtcagctgaaaagctagtccattgacaaaggtttcttcacctccgccgtatgtctgtacttctagctctgtccaaccgtatcttaccatcgatttttctaagggttttcatctctggtgtttctagcactctttttattctctctgtatcaggtcgtctttctgtagggtcttcttccactttcaaagaaatacttcttgttttaattctaatttttcaatttaacgtatcttcggaaaacaacatgcctttgaatattttgatatctaataaattattcaatttaattttaacaacttacaacgtaagaatgctaacaattggtttgtttttagctagcgtatgtccagtttccatcgctgttgatgctgatacatggc

SEQ ID NO: 4476 - DNA, 370 bp, Diabrotica virgifera
  Clone ID: LIB149-030-Q1-E1-G11
gggagaacttattgggaacaataattttatttggattttttgcactggggtttgcaactcaagaactaatatcctgttacgattgcaagccaagtgcagacaaacctgatgaatgtgtttatccagaaaagaatcttgctcccgttagtaactgccaaccaccgtcaaatggaacggcggtgtgcgtttcgtcttacgttcaaaatataaatgctgctagaactggagtctaccgaggctgctttaacataacagcagaaataggcaacgcgtgtgatttgtttgtagaagaactctcgtctaatacatcaacaattaaattttgtcgatcatgtactacagatagatgcaacacagattatttgaatga

SEQ ID NO: 4477 - DNA, 82 bp, Diabrotica virgifera
  Clone ID: LIB149-030-Q1-E1-G7
cagctcgcgcctggtgtaacatcacaagtcctgttccatgtattcgaagttaagtttcgaacagttacatcgtacttgattt

SEQ ID NO: 4478 - DNA, 338 bp, Diabrotica virgifera
  Clone ID: LIB149-030-Q1-E1-G9
acccaagcgtcaggagaatctgaagctgcattctcaatagacgaatagatgattccgtttcatggtcgatgtgtttttcggcaatatgtaaaaaataaacctatacctgtaggtttaaaaaatttcgttttatcataaagtgatagtactgtcctagattttgaaagatctcaaggaacaagtaccaattttaacaaataaagaactgggactcggaccgtcagtcatccataggctagtggaaacgttaccggtttagcattgtagtcgccgacagatatttttcgacgatagctttgtggctcatatgatcggagctacactctcatggcacagga

SEQ ID NO: 4479 - DNA, 383 bp, Diabrotica virgifera
  Clone ID: LIB149-030-Q1-E1-H11
caacacccagtagtgagtcgtattaatcttgggttttaacttcagctagttgcgtcaaatctaatgccgtatggaatacagtgacagagatctacgctggtttcgtacgacaaaacgacccgtcgcgtcaatcatttacgatttcaagaattgagcgacatcctggttttaatatgaatgaatctcgcaatccatcttttgacgatattgctttggtaaaactggatcgtgatgtggaactaaacgaaaatgtaaaaatcgtcaaacttccagaagcagatgcagacattactaaaaattttacctctgctggttggccttatgcggctattactagggaaaaccaagacatccgacaattacgaagtgtaccatttttagaa

SEQ ID NO: 4480 - DNA, 80 bp, Diabrotica virgifera
  Clone ID: LIB149-030-Q1-E1-H2
agtaagtcgtattatgcgtctgcccacgcgtccgtgtcctgtctgtttgttgctgttcatccttgctgctgccctcattg

SEQ ID NO: 4481 - DNA, 265 bp, Diabrotica virgifera
  Clone ID: LIB149-030-Q1-E1-H4
gagtcgtaggattgtccgtttctatctgcacctttactattttcgttttcataatagctagagcatgcatatttttattgtagaagatattactgggcatagttggtttgtaatgaaatgttatacgtttttatatatatctaattttttagcacctaggtggcctttatttatgaacaatatatttctaattacctatttttagattattaatattaagcattcttagggatgagcttaatttaaagacttgatgaaggtttaa

SEQ ID NO: 4482 - DNA, 393 bp, Diabrotica virgifera
  Clone ID: LIB149-030-Q1-E1-H5
tacaacacccagtagtgagtcgtattataataaaaatgatatattagacggtttccgttagtacacaatttataatttcgcttacattacacccacaaaccacttccactaacagttttttctataaaattgttaactacgtttgacactttactcctgtcaaaactggtgtaccatatttacaacaaatatattaactacttattagttgtacttcattgtatttttaatgttaatatttaaatttgtgtgttcattaaatggacttgaggtttcatccttcatcagattgctctgtgttattttagggagaatgaaatagacagcaatgtatgttttttatagctgataggaataataagggtctaagtagaattttcaaaagaaattata

SEQ ID NO: 4483 - DNA, 395 bp, Diabrotica virgifera
  Clone ID: LIB149-030-Q1-E1-H6
tattgagtcgtaggattattaattaataattatatatttattattttcgaatttaaaagagctaaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaattt

SEQ ID NO: 4484 - DNA, 418 bp, Diabrotica virgifera
  Clone ID: LIB149-030-Q1-E1-H7
gacccaaacgtcagacatttcgaagaaacgctggaggaccacgtgattttgagaaactatcaagatattgatagtttgtgccaattccttcaagtaagggaagcaaaacgaagagaaatgcgaaacagaagacaacatgaacaatataatggaccggcaagaaggtatcaatcaaattatgaccagagaaaccgacatgcccaatcaacaaacgaagataggccgagagaataccaaaattacaatagacaacaaaattatgataacaggaatcacgcaaaaaatagaacatatgaaaatcacaacagaaacagagatgcacaaaatcctccgactaggaatacgaacgaacaaagggacggtagaaacaatcagaatttccaacgacaaaatagaagggagatgaatcatgtaacaa

SEQ ID NO: 4485 - DNA, 253 bp, Diabrotica virgifera
  Clone ID: LIB149-030-Q1-E1-H8
tctggcagcagtttttgcagttgcttatgcaaaccaagatgattatctccgttgggtaagccacgatgggaacatacagacaacgctgtaccacctggagagggatctaacaataacactatatatattggacgtgtctacttaaacaccaatacaaaccagtccaattggaactataccacagatgcacaaggatacgttcccgggaatcttagagaaagaattgtgtctttagatactgtgccattccaaa

SEQ ID NO: 4486 - DNA, 55 bp, Diabrotica virgifera
  Clone ID: LIB149-031-Q1-E1-A12
aaaaaaaaaaaaaaaaaaaaaaaaaaaaaaaaaaaaaaaaaaaaaaaaaaaaaag

SEQ ID NO: 4487 - DNA, 278 bp, Diabrotica virgifera
  Clone ID: LIB149-031-Q1-E1-A3
aatcccagctcctcttgaaggccaagacttggactggaatactactgaaactactgattggaatgctgaagttgcaccagttgctcctgttgctgcacctgcatacaatgttagtgctactcaagattgggcttctgaagttgctcaagaggaatggtctacaagtcaaccagctgctcctgctgctccagctgctgctgctccaaattggggaggtgccagtgaatggcgttaaaaatactgttttggaccaataaataaaaccctttattacccgt

SEQ ID NO: 4488 - DNA, 421 bp, Diabrotica virgifera
  unsure (1)..(421): unsure at all n locations
  Clone ID: LIB149-031-Q1-E1-A4
aattatgatcggatttatgttgggtatttattgcgattacttttacatttaacattacatttctacatttaacattactctatgagctattaaagtatatcataacccaactttttgtaaatgatgctattcccgctctttcactgcggcatttttttggaaggcatgcccaggtgctcactttctactggcaatgaaagtttgaatgcgcatgtgtgacacgcacactgaacactttgcctgacactgatccgtgacatgcgcagtaaaaggtttaactagtttcttaatgatctcagttacaaagatattcacctgtgtaatgtatgatggaaaacgtgccgttctatgctgtgttaanaccgttgccatattctatgaatctctaatgatatgtaattaaaaaatggtatataatatt

SEQ ID NO: 4489 - DNA, 266 bp, Diabrotica virgifera
  Clone ID: LIB149-031-Q1-E1-A9
acttgttcctcaagaattaatcgctcaacaacaactgatccatcagcaagttgtactattactccaaagaggagttttgccccaacaatcagcacttaaccaattggtctctcaagaacaacagttgagcttgagacagccacaaatctaccaaagagtaccacgtgtgtactaaattttgttttctttttattattgatttttgagttttcatgttaattttgattgttgttttcgaataaatgattatctgttaaaaagaaaaa

SEQ ID NO: 4490 - DNA, 428 bp, Diabrotica virgifera
  Clone ID: LIB149-031-Q1-E1-B6
actttttcagataatccaattatgggtttgcataattaacttgttttagatattgtagccataatatgttaaaaaaggtatttggaagtatgtactgaaaagtcaaaagagattgcagagttgactgttaatctcagtctttagtcattactctggaatatctctaaaaatcatatgcatgatgagcttgcactatcttgtcaattaaattgtcaaattatttattaaaatcctttataaggtatatttatattaaaaaggccctttcgggcagaccctacagattgttttcgacataaaaatttcatcatcagcgctgctaacctgaaaataagtacatataatcacttataaatgcaaacatgaatattaaattttgactaaggttaaaaatacataggggttatgcttacaggtgtacctacatg

SEQ ID NO: 4491 - DNA, 429 bp, Diabrotica virgifera
  Clone ID: LIB149-031-Q1-E1-B9
aaaaagttcttgaaaagttagaggttgacaacaacaagataacgaccaaaaattggcacttaattcaccgtgaggtcaaagaggattcgcaacggatctttttttccattgaccaagagagcgtaaaagtgttagaaaccattgattacaaacctctttttaacaatgaaagagtcaaattacatattatggctaagaaaaagcatgagaattaggaactttttctggattgatggaaatctaaatttttgggaggggtttcaatttttttcacacgtgtctgtgtttagaataattaaaaagctgattaggttaagcactcaattcaagtgtagaggtacgtatgttcaagttagcgtgtttaaatgttagcataacgaaacttctgtaatttttaggtaaagtttataattatcacaattttgccgt

SEQ ID NO: 4492 - DNA, 420 bp, Diabrotica virgifera
  Clone ID: LIB149-031-Q1-E1-C12
cccacgcgtccgcccacgcgtccgaacgaaactatcagaattggcgtttgctatacttgttacttcttcttcttctcatagcactacaaccctgactgtacaactcgcttccatagcattcgtggacgtcaaaagggtcttgggacgtccacggacgtctttaggaagtcggtaaacatggccagcccatattagacgttgggatttactctcttggactacgtcgctagtcttatacatctgtttgacctcagcctttgctctcattcggtgttggttactattaggattgtgattaggtccaaagaatcttctaaggatttttctctctctacctgttaggattttaaaaattagtaaacctgagtattagtaaactctttaaatttttgcatttttgaaaccggagagtccatatac

SEQ ID NO: 4493 - DNA, 407 bp, Diabrotica virgifera
  Clone ID: LIB149-031-Q1-E1-C5
aaagagtttgatttgagttattgtcattatgttaaaatacacggactgaatccttaaactaagggatttaaattaaatttgatgaaatattcttagggatattacaccgaacacaactttagtgcagtaaaattctcgtgttagtgattccatagtaaatcacgaagaaaaaccagggaaaaaaacgttatgataatatccctacatggaaagcatttggtcttagattgtgtttactctcaaaattaacaccaaactgtatgagtttatatgtatgttattttaaagtataaattatgtatctacgataagtcaataacatttcgaggatacatcatttatattttaatattaatatttatatatttatgtatgtattattaatattaaaaaattggaaaggggtc

SEQ ID NO: 4494 - DNA, 54 bp, Diabrotica virgifera
  Clone ID: LIB149-031-Q1-E1-C6
atttatatttataaaactgttttatattgaatgtgtaggagaaacatttggtgt

SEQ ID NO: 4495 - DNA, 269 bp, Diabrotica virgifera
  Clone ID: LIB149-031-Q1-E1-D10
cccacgcctccgcccacgcctccgcggacgcgtgggttcttacccattttaacatagtccactattttttagcaatagtaaaggcaaattttatttaaggacagctacccagtattgtgagagaagctttccttcctacacaagaaggggttacttcttgtcccctgtctatcaaggattagccactagcaattattcaggtatgaacttcgaatttactagagctaaatcatgaagacttggagtgctcaatacatacttgacctaca

SEQ ID NO: 4496 - DNA, 413 bp, Diabrotica virgifera
  Clone ID: LIB149-031-Q1-E1-D2
aatcaacaatggcatccaaaactgttcttttcggactcttggtagtccttttggtcaaccactctttggctagagatctgactgtctgccccaactcagacaaagcaaccaaagctgtatacgacaaagaagtagcaacatccgttgtaggaagcaccatccgtgttagagtaccagacagcttgttcttgaagaaaccaatcacctgcattgttatcgtggacaataaccacagcgatagcgtacctgaaatcgaagatggtggtgtagacagtacatgggtaaccattaacattgctcccgccatcaccgaacttctcagctacagaatccaagtgtacaccaaccaataaataatataaatattgtaatatgtttgagtagaattgtgatataaagtttaatgtgtgttt

SEQ ID NO: 4497 - DNA, 269 bp, Diabrotica virgifera
  Clone ID: LIB149-031-Q1-E1-D4
ccacgcgtccagtgacgcttggggtttttcgattatcttatcgtactttgactgctcatattgattctatatacttcagttctcgctttccagtgattggcaaaaattcttccgtggtacactgtcgtaagcttgtcgttgttcgacatgatagccttgtacttttattcatcccctgtgtatctatcatttgacgtcttccctaaagcattaatcctatgtcatttatagttgtttaaatatcttaaataatttttttgcttagatat

SEQ ID NO: 4498 - DNA, 431 bp, Diabrotica virgifera
  Clone ID: LIB149-031-Q1-E1-E5
acccacgagtccagattcaccaaaatgaatactttattggtagcttcagtcttctgcgccatcttcgccatcggcctgaccgtacctgttctgacaggtccaggtccagctttccaagttaccgatggagaatgtgagaatgtctcaagagacgaattggtccgccaagagcaagtaaataagggtggttttccatttgttaccaaacaggctgatgttgaatacttaggagatccttcaaaagttatttactgcgttcaagctctcagctctgatgacccaagcgttggttctattgctgaaattacagttggtggagttggtcacgatttcgtaaatgtacatttgacatctaagaaaggaggacccctacattacgatgttgaaatttacgccagggcaccaaataataatattaaataataaataca

SEQ ID NO: 4499 - DNA, 370 bp, Diabrotica virgifera
  Clone ID: LIB149-031-Q1-E1-E8
cgggcagacccacgagtcaacggtcgcttgggtaatgattgacctctctcgtttcagtactgaatactataatatactaatagttaagttatgtgtgataatagtgcattatttttcaacattcgtaattcagtcactgtatcgggtttattatggactttaagtttattattataaacgggatatcatggaactaaaatgggagtagttcattcaatttacattcaaaatataccatcttttggatgtgtagagcaacctgatgtcagccccatttcaacatgacaatcattagtagaagtgtcatcatcatgatccacgcaacgatgactacacagtaaatgagatcagactggcaactatcactaac

SEQ ID NO: 4500 - DNA, 212 bp, Diabrotica virgifera
  Clone ID: LIB149-031-Q1-E1-E9
atcaaaggtggcagccggcttaactttcgcttcgatctagtttttctagttacaagctttgtttaaatttaattttactgtctattattcgatctattcaaaatgcctaaaaataagccaaagagagatacttccgattcaaattccggaccaaacgatgatgttccaacaaagaagaccaaaaagcctgagtcaaagtcctcgaagtcatc

SEQ ID NO: 4501 - DNA, 398 bp, Diabrotica virgifera
  Clone ID: LIB149-031-Q1-E1-F11
accaagcgtccgcccacgcgtccgctgacacgtgggatgatgctcaatttatattagagatcatgaaagagtatgagtgttaccatcatagaatgaaattaaatgaattccgtgatgttgagattcgagtcttgggtattgccagcaataaaataactgttacaaaatgtctagatagtctaaatcagtatatgcctatgatggatgaatttccaataattgatagtcatgattggaatcacacatgtaacgagtatagcaattctcacatacagaaatgaagtcactctaatctaacagacagattagtcagatatccatgttcctccataggaaaagaagttaaaatgttacttcaggattgccagacattacggctgggctcacaaccaaatttt

SEQ ID NO: 4502 - DNA, 113 bp, Diabrotica virgifera
  Clone ID: LIB149-031-Q1-E1-F5
cccacgagtccataataagtcaaattaataaaaaaattttttaaaaaaaataaaacaaaaattttatttaataaaaaaataaaataataatgtaaaagaaataatttaatttt

SEQ ID NO: 4503 - DNA, 417 bp, Diabrotica virgifera
  Clone ID: LIB149-031-Q1-E1-F8
aatcagatcaatgccacctaagggatcagtgacaatctagcagcaattcgtcctccacagaaatcgtatattttgggtcgtgtttgtaaacagggacagaaacagaaaataatataaaaaaaattaaaaaaaatcgtcaacatcgtgtcccaagagtgaattcctttttgtgctaaaagacagaagtcttgaaacattccaacgtatatgatttctgttattttaaaatattggttaagactgtattcaaagtcgagttgatttgcaattatatttatgctttggagcgcatatttttgacatattttttgaagaaaataatttttattccattttttgaagaaaggatgtacgacgtagatggatctgttccaaatgccagcgaaagtccgatttttataatcgtttcgaccattt

SEQ ID NO: 4504 - DNA, 378 bp, Diabrotica virgifera
  Clone ID: LIB149-031-Q1-E1-G12
aaccacgcgtccgatttatcagtatttctctcaagtgcataatgtgctgcacgtttccagtttttatttttatagattgacatgtaatatttaaagcagttttactacgacacagtatattaccagtaaaatgtcttacttgtttcaagtagtgaagtgaatttcggttgtttttcttgttttattggtagaattctttgtttaggtaaagaacttgaatcataaatgtgatttgtttatctaagactttgtcctacacaaattgtaaatttttgtggttgtaacgctgtgatataaatatttatttctctaggttattttttctctgtgcataatgcaccatatataaaggattaaataaaggtttaaacccataac

SEQ ID NO: 4505 - DNA, 209 bp, Diabrotica virgifera
  Clone ID: LIB149-031-Q1-E1-G6
gtccgtgatgatgatattagtatcaaaaaattgtatatttagtataaatatatacgtttactcgaggaattcggcaacatttttttcacctgtttattactaacatggtctttttgtgttgagtataatggtcgcgcctggacattggattagtttcgatggtctgggtattttcacggtgctaatgtatcatgatcattagttttttt

SEQ ID NO: 4506 - DNA, 405 bp, Diabrotica virgifera
  Clone ID: LIB149-031-Q1-E1-G8
atgcacgactcaacactgacgtcgtagtaatgtgatgtatcatgtgttgcgttgcgaatattataaaatcgcgtttattaaagttacttgagaacgatattgatttatacataataggtgcagctgtataatgcttatcgcattcaatggataatgatgcaatggacatggacacaccatatgacttccataaccatgttagactgtccaaatgaagatgtcagacacaatatattgatgttgatggacgtactattatgtatgtcaaagtcaggaatggcccgattacagtgttgtgctttcctgtaaccttatgaccattttggaacgattttaaacctcaagtggaatatttagatagagatatgtggactatactagcatgggatccccctgattatggat

SEQ ID NO: 4507 - DNA, 395 bp, Diabrotica virgifera
  Clone ID: LIB149-031-Q1-E1-G9
agacccacgcgtccgactccctgatcatttcaatgaaattttaaaagaaatagtaactttacaaaaatatgtagcagcttcgagtatttttattaggaattatgatatgcaaaaatgtcagaatattttacaggaattaacagtaagaacgaaacaagtagaagacgaattgctacccaaaaagaaattttcctttaaaaataaagttaaacaaaaggcacagaacagcgaaataaaaagtaaaagtatagacgatgtcgattttaaaccaaaaattgagccagttaaaaacgttaccggttttttcaataagtgtaacgaacacctcgctttagataattctgaactgcttaaaaaggatgtttctatagaaaaattagattcttgtacagtgt

SEQ ID NO: 4508 - DNA, 384 bp, Diabrotica virgifera
  Clone ID: LIB149-031-Q1-E1-H12
aatcttggtagcctccattaatatattggaaggttacttaaactttgggattgttgtatgatggttactacatttgaagttttgcatctgagagtctttggttgacctcattgggatatcacccatgtagaggtttacccagcgatatccattttttgcttccttatctagtttgtgatcaattcttattccctcagtttctacggttaatgctattagtttcagtaatgttattagtggtaataatacttagagataatacaaaattgttaaactcttattattattcaggaatcaggaacagatttgaatgcatattttgtatcggcattgattggtgtaataccattcattatgggcagtactaatgtcgttttgccaaaa

SEQ ID NO: 4509 - DNA, 431 bp, Diabrotica virgifera
  Clone ID: LIB149-031-Q1-E1-H2
ccgggccggcccacgcgtccactcaatttgttttcagataatcatggatgtgctgtcgtcgaccaaaattgccttaacatttcattcagtaatatttttatgtcaacatactcttagtattataactgtatcaacccatgatgcagggataatactacatgatacatttttaattgagattacattgccaagtgctgatattattaaagatgacacgatatcattagtatcacaacacgcggatagtatcagtccgaatgtcgcggaaattaatttaaaggacgtaacggacggcgataagtttccagttagtataaatacatcacgtgctggacattcagatctatatgctaatgcttcatctaagcataccgatgtaagcgacgtttacgttcgctttactgtatacaaaaacgatgggttaaatacat

SEQ ID NO: 4510 - DNA, 70 bp, Diabrotica virgifera
  Clone ID: LIB149-031-Q1-E1-H5
ggccgacccacgcatccaaaaaaaaaaaaaaaaaaaaaaaaaaaaaaaaaaaaaaaggcaggaggcacaa

SEQ ID NO: 4511 - DNA, 431 bp, Diabrotica virgifera
  Clone ID: LIB149-031-Q1-E1-H6
agcgagtgtgagtgtgaggtttcttcgccttccgttattaacatcttcattcttcttcagtacaaagaatgcacaggttgtgaacgaaagtgtcgcatcattcgctgtaaatattacaattttaagttaccattaatagcagtaaaatgaaaacttccctgataatatttttatgttgcatgatagtgtctgtactatcagcaaaggatatgatgcggaaaagcatcgtttttgacaaaaatacaccagatgtgttctattgtcctattcacaaacccacaggttttgacaaaatgatcgttaaggcaaaaccgttgaaaaaattgtgcgaatttgaaggaaaacctctaccagaagattacaagagtgactgttaccaagatgttgatgaatcagattatgcgtgtaaagaaaaatacatgataatgaaa

SEQ ID NO: 4512 - DNA, 411 bp, Diabrotica virgifera
  Clone ID: LIB149-031-Q1-E1-H9
agaagtattgcaaaatttatatcagtttattgctgctaggagcttgccatctgttaactggtgacaatgaacactccgaagatctagagtacttcttgtacgaagacaaagacggcaatcttaaagtagagcgtctcctaaacagccgaccagaactcttgtcgtcgtctggatccgatgtaaagtactttttcttcagcaagtctaaccctggagatgaagaaggtgtggagattcacagcaacaacacagagaaattgaaaacgacatcatttacaacaaagagagaaactatttttatcgtgcatggatggaaggatagccataaggcagatgttaattctcatgtcagagaatatatactcaggggacacgatgttaatatctttgtcgtcgactggagtccaattg

SEQ ID NO: 4513 - DNA, 401 bp, Diabrotica virgifera
  unsure (1)..(401): unsure at all n locations
  Clone ID: LIB149-032-Q1-E1-A11
acggacgcgtgggcggacgcgtggggaaattttgggccagtgtgagcgcttacacgaaagcgaaaacaaagaagtagaaactacggaagacttcaataaagaagagagtccgcacactgaaacagccgaagaaatcttgacgttactctcagagataaaaagcagcaatctagtcgaacctaaagaaagtatccaccactgtccattttgttcagggcaactaatcaccgtatagtttttcggaatatccatctcattgggcttcagaagaatttgtattttgtaagcttttccaaaacatatttgacttattttatatatttcaatgagtgatagattantttatatatttatattttttatatttagtgagatctgtaagtgattcattatccccggtc

SEQ ID NO: 4514 - DNA, 300 bp, Diabrotica virgifera
  unsure (1)..(300): unsure at all n locations
  Clone ID: LIB149-032-Q1-E1-A12
acggacgcgtgggcggncgcgtggggaaattttgggccagtgtgggcgcttacacgaaggcgatgtcagagaagtaggagctacgggagacttcaatacagaagagagtccgcacactgataccagcgactggaatcttgacgttactctcagagatggggagcagcagtctagtcgaacctcacgggagtatcgaccactgtccattttgttcagggcaactaatcagcgtgtagtttttcgggatatccatcgcattgggcttcaggtggaatttgtactttgtcagcttttccaggt

SEQ ID NO: 4515 - DNA, 348 bp, Diabrotica virgifera
  Clone ID: LIB149-032-Q1-E1-A2
aacacgcgttcggccgaactcgtgtggaggactcgtgggtcagacgcggtgggatacgacctgattttttggctagattatttctcgacagtgcattatttagcactttcggcagatacatgtgatcatgggctataggtcaatattgcaaaggaaagaattgaactgtctgctaatgggcgatatcggaaaatgatcactcaagaagtcactttaacaacaactggtatttcagttgagtgatgcacatccatcataaagatacgattttcttcacagttaattacttgtgaatcgagtgtgtaaatttaaatatatcctttgaagtctcagaagtattatgaaatt

SEQ ID NO: 4516 - DNA, 393 bp, Diabrotica virgifera
  Clone ID: LIB149-032-Q1-E1-A3
agattttcattcagttcacacgtactacccatacttttctaattataagtgtaataaaaattttattctaatgattagttaaatctatattgttgagagaatattttaatttttaaaatagtaaaaatttaatttatgtaccttgagtttcagggaataataattaataattattaaggaattactttcgaatttaatttagctaaaattttaatatttttaatgtattatgattattttatatcatttttttgtaaatgataagttattcgttttataatatatcaaatttattaagaaataaattaaaattatttaataacactatatttataattaaatatttttataataataatagtaaatagttttagggattatccttaaaaataa

SEQ ID NO: 4517 - DNA, 366 bp, Diabrotica virgifera
  Clone ID: LIB149-032-Q1-E1-A4
acggacgcgtgggttccattcttttagctattttagcttgcgtcggtttaaccgtcagcgctcccccaaagaacgacgtcctgtgtgatatctgcgtagcattgacaaaagtgagccaggaccacttagaacaagacttgccattggacgaacttgaagaaatagtaagggaggggtgcagtgcattaccagatccacttgcagatttatgcaagaataaactgattccaccagtctacaacatataccaccgatttgaggacgcctcgcctgtagaaatatgcacagttttagacttatgtgagacaaattaatatgaaagtcagaataaactcaaaagtttaaaataaatttttgaacaagaga

SEQ ID NO: 4518 - DNA, 391 bp, Diabrotica virgifera
  Clone ID: LIB149-032-Q1-E1-A5
aggtccatgattgatcttctccaagtttgtactgggcgacccctgtttctttttccttggggattccattctatggcagtctttgcaatactggagttacttttgtgaagtgcccattgtataccctcttttgttcggtcagctggagtagatctttacttctgatgatgctaggacaaataatgcgaacaattattcgtaggtatttgttaacaaagagctgcaatttgtctttggtttttgtcactttccaagttttatatccatagggtagactttgtttcttgggctattccctacttactgtgaaagtatcacgtaaatcgatatagtaggatggaattcggagccacataccctcattgactgcccatagtatgttgccttctgc

SEQ ID NO: 4519 - DNA, 283 bp, Diabrotica virgifera
  Clone ID: LIB149-032-Q1-E1-B10
actgtcacttggtgtataatgcgtcttgaaattcggttcattcatccaaatgttagatttagtcgtagcggatgtaagcgggtggccgccctaaaggatggaagctttttttcgcttgctagttacgtcacatactcgttcaactgagtccaccatagattcatttcactaggcctctcgctttacaatcttcgtaacggttgaaaaccctaggtgttacataccattagtcgctttgtagcattttaccttttcgccaattggctctatagtattaaggcac

SEQ ID NO: 4520 - DNA, 365 bp, Diabrotica virgifera
  Clone ID: LIB149-032-Q1-E1-B2
acccacgcgtccgccgacgcgtcggtttaaaataataaaatattttattaaataaaagtaaaaaaaaattttatttaaataataattaattagtatatgtaagaaaatattttaatttttataaaagggggggttattttattgggatcttgtgtaacatggattagtatgtaatatctaaatactttaatattttcgactttattaaatttaatggctttcgttttatattgtcatgtagggaatttacatggtttttttgtaattaaatgttatgcgtttttacctatttcgaaatttgtaataaatacattaaggttatttattatcactatacttataatttgctaattttaaatgattaa

SEQ ID NO: 4521 - DNA, 383 bp, Diabrotica virgifera
  Clone ID: LIB149-032-Q1-E1-B5
aatacaatcctgttaaccttgcagttccttttacctctcttattttgaacataagcaatagcctattgtgcaatcaaaaatatatcgcaattttggcctattgaaataaacagacttatagttcatggaactggaactggctttgacataagactaacatggctaatagggcattcacatatcccacgtaacgaagaagctgacaccctagctaatataggaagagatttgaacataccattggtcatgctcctcgatgtccacgacatatacaaccattacgtctaaactatatgatgaattcagatggaaattaaacaccctaatcagaatcaaggacatcaataccgaaatgtacaagctaactttcctaaaaatatatg

SEQ ID NO: 4522 - DNA, 378 bp, Diabrotica virgifera
  Clone ID: LIB149-032-Q1-E1-B9
gcgggtcaatgcacgcctctatattgcgtcgaagcatatttcttcttgtattaacatattttctgagattttttcattcagtgtttgtattgtgaattttatctgtgatgaagagagccatatttttattaatttactgtatctaaaaaaatgtatactaataaactaacatttacaatgtatgttttaaaatagtgcaagatttatggtaaaaatggcaaaaaaaattatatcggttcgtccacaaattggtcatcaaattaatttttatatccaactggcaacagaattttattgttcattacccaaaatgtatgttttactcatttgtgttaaataaatcttgtacattaatgttattgaataaagaatatggcg

SEQ ID NO: 4523 - DNA, 407 bp, Diabrotica virgifera
  Clone ID: LIB149-032-Q1-E1-C10
taggaatgtgcattatattatgaatgtgataacggagatccaattaagttgacctgtgctcctggaacatactttaatatagaaaagagtctttgtgaaactcctgacctcgtggagtgtggagatagaacaactacaacagtaacccctccaacaacaacagaaccaccaacaccagctaattaaacgtcatcattttattattataggtacgacaatattttattgttcataatttcgtattaagaataagattagtatacatagttggttctctaaactcagacacaactggctagtgattttagtaggtcattttttgttttttgccagttttgccaaaattggttagtaattttggcaaaattactaactaggtatttagtgattaggttttttgccaaatt

SEQ ID NO: 4524 - DNA, 323 bp, Diabrotica virgifera
  Clone ID: LIB149-032-Q1-E1-C12
actcgcgggccgacccacgcctctaaagtgcgtccgtctaccggaatcacgtcacggcagtcagaagaagagcaagtagacgagcccagaatgactgatgcgaagatcatgtgagtgcagggactggtcaatattgatagttcagatttttgagtttagcagaattgagcggtacgacttaagatgctttaaactttatgtgtaataagctcgtattttcacccttgagatctgcctttcatgtcgtttagatcaatccgtgattttgaggcggtcactctatgtgggtactgtctcacttacgctagcgttagacttcagtc

SEQ ID NO: 4525 - DNA, 319 bp, Diabrotica virgifera
  Clone ID: LIB149-032-Q1-E1-C2
atagagattcgtaacaaagcttctgttgagtcatctgttaattcgggtgcccattcttctttccacgcatcggtgctattaaaggttactagagggtttccgatcttcatggtccatgctcaggtgtacgtaagattcagatttaactcttccactgtttcacgaatgtttaagtcaatagcgatagatttattaacgtcgttatgggtaagcctgtgtaatatccattagtaaacgccttgaaattaacactactatccttatcgttggtagatctataactgactatacgattggacaatcccacatgtttgtcaac

SEQ ID NO: 4526 - DNA, 402 bp, Diabrotica virgifera
  Clone ID: LIB149-032-Q1-E1-C4
agcgcgatccaggcctatacgtttattctttcggatctggctcatgtgtttatattcgagtatattaaacgttcgtctgtaagtagtgaatttttttctgtatctgtaaataattttaaactgtgtagtttttagttagtgaatttttattataagactttttgtaggaaatttttcaattcaatttttttgtgtaaagtgcgtcgcccaataggcattaattatttttgtattttaacgatgatctttatatttttcattgcgttggtatatggtgaagttgaattgaaaaaagtataattattcaccatatttaaagactgtatgtcagttttgtcgatggtgtatggcaatcttgacatattatgacatatatattggtgtcgtaattggttttccaac

SEQ ID NO: 4527 - DNA, 404 bp, Diabrotica virgifera
  Clone ID: LIB149-032-Q1-E1-C7
cccacgcgtcaaatttaattttaaacctcacatcaattgtgtaaagatgagtgtgaaaaatatagaaacacttctagaactacacattggtgagggtaaaaaaataaaagaaactcaaacaaccaacttagtcaatcctggagaaaactatggaggagaattatttaaaatagatgttacgttagaagattccgatacccagaaagaagaagttttacatattgtaggcaaaatcattccagcagatgataattcacaggaaatatttaacgttcaaaatacctttaaatcagaaataggattctatgaaaaaattgtaccggcacttcaaaacttccaaagaaagcataaaatcgaagaaatacttgatatttttcccaaattttatggaagccgaattaact

SEQ ID NO: 4528 - DNA, 364 bp, Diabrotica virgifera
  Clone ID: LIB149-032-Q1-E1-C8
aagtctgcatcgccttaattgatactgctatagctcaatgggacactgtatcctctaaaccctatattcaggagagcaatatctgatgatggtatttatcagttaacatatgtacatgtggacattgtgcctgatattatcagatgcctgaatgtatcagcaatgataaagccattgttgttttcgaagacgacgtattacgacgtccatttgataagtgctaatatcatatggtacagtttttgggaatattaaggcatcacacttagccttagatagtggcatgatgattaacaagcatgtcatttttgcagataattccaagagctttgatgctgatgcagttgcatctcaagttacatgc

SEQ ID NO: 4529 - DNA, 275 bp, Diabrotica virgifera
  Clone ID: LIB149-032-Q1-E1-C9
gcgtccgcggccgcgtgggatttatgttaacgtaatagaatattttttagtgacagtaaggacaaatttgatgtaatgctagttaattagtgttgtgagagaatatttgatttttataggggggccgttcagtttgtgtacctcgtgtatcagggagcatgagttgtcaattcactacttattattttcgaatttaaaagcgctggcggacgaggaatttttatcgtgacagagatatttgaggcgatttttttgtgatgcgctgtgattcgttt

SEQ ID NO: 4530 - DNA, 397 bp, Diabrotica virgifera
  Clone ID: LIB149-032-Q1-E1-D1
agacaagtttaatttttacttaatgtatatttaattttttgtaattcggtgattgaaacgtttatgacaactcttcaaccatgtaattatgtatatagcacatattatgtagttgtttataatatttagtgcagattgtgaaggaaggcaaaccaaataactcgttttaccagacgtttttataggacaatgttttatcacgctgaaataagacataccaaaaatgctgtttctcttaaaataaaaacccgcacatctttagtaaaagagcatgatcttgaaacgctcaaaaatggacagaagaaatttgaattgatgattttttcaaatctgaagaaaaatctatgaatttgtgatgatctagattaattagagctccgtatttagagaacgaaac

SEQ ID NO: 4531 - DNA, 437 bp, Diabrotica virgifera
  Clone ID: LIB149-032-Q1-E1-D10
tcgcgggccaatacacgcctctagaattagtcctgttagaagagacgtccctgatagaagcattatctaagcgtctcgaaggagagcttaggactgcgaagagaacccatctttcggtaggagaagttcttcttcccaatggactgacgcattcgatagccaaagatcttttttacttggccgattctgaaccttgtggacttcgtgggtgcactttgtatatagactttgagaacaatgatctcaagacgaatttgagccaggtcaagtgcgatgcttcgactccttctaccttcgaagtgtacttgacgcttaagcaggcgaccactggatggaattcgtttctgccacagtttcttaaaaaaatcacaagttctggagcgcttatgataagtgcagaatatggacttaccaagaagcaactgtatcgctcgagt

SEQ ID NO: 4532 - DNA, 56 bp, Diabrotica virgifera
  Clone ID: LIB149-032-Q1-E1-D3
caacaccctacagtgacgtcgtattacgcgtccgcggacgcgtgggtctacatcgc

SEQ ID NO: 4533 - DNA, 249 bp, Diabrotica virgifera
  Clone ID: LIB149-032-Q1-E1-D8
ttacaacacccaatagtgagtcgtattaatacgagtgcatagcatttatttctaaacttcgtttttggggtaaggccactgttgcgctgagcgcctcatgtagtaaaatatgcctagtggctgtaattccagtgtagttggctaaacgaatgcgaaaggaagagacctacgacttaaacagtttgtgtatggtgtctcgtgaagttacctatgcatgacacgtaacggtatttatactgtccgaatcat

SEQ ID NO: 4534 - DNA, 344 bp, Diabrotica virgifera
  Clone ID: LIB149-032-Q1-E1-D9
acaacaccctaaagtgagtcgtattaccgctaaagttgtcttacttttgggccttgcccttttcgcctcagctggtcaagatcttgacaagggcatggaaattgtgaaatgcgcccagcgagtaatgagcgtaggagtacctgaattaggagttccaccacatgctcccttcgtcgctattagaaacgtatcatggactggatcaatcggtgttgcaagcactcatatcgaacttaataccaataaatggtatggccttgccgactgggatatctcagctaagcaaatcaatgatgactctgattacgaggctgtctttgactacaccacatactggcccagtt

SEQ ID NO: 4535 - DNA, 391 bp, Diabrotica virgifera
  Clone ID: LIB149-032-Q1-E1-E11
tacaacaccctaaagtgagtcgtattaaaatgctgcttaaaattgtcgtcgtttgctgctgcatttcaattgcactcagtcaagctgttggaaaatgtcccagtgtagatggtagatatccagtataccttcctgatgcaacatcctgctcaacattttatgaatgttctaatggaacagcataccaattcaaatgtgcgtatggaacatatttcgacagccagagcagaatatgcagacataaacgagacgtcaattgtggcagtagaaggagagattagtactctagttaaaaaaatgtaaatttgttttaattctcgtagtacctgtgatacacatattttttatattgtgttagaaattacataatagtaagacagtgattacatct

SEQ ID NO: 4536 - DNA, 311 bp, Diabrotica virgifera
  Clone ID: LIB149-032-Q1-E1-E12
ctcgcgggccaatacaagcctctacagtaagtcgaactataactgttcttttcggactcttggtagtccttttggtcaaccactctttggctagagatctgactgtctgccccaactcagacaaagcaaccaaagctgtatacgacaaagaagtagcaacatccgttgtaggaagcaccatccgtgtaagagtaccaaacagcttgttcttgaaaaaaccaatcacctgcattgtaattgtggacaataaccaaaccaataccttacctgaattaaaaaatggtggtgttgacattacatggttaaccgta

SEQ ID NO: 4537 - DNA, 389 bp, Diabrotica virgifera
  Clone ID: LIB149-032-Q1-E1-E2
acggacgcgtgggcggacgcgtgggtttgactaatataattattaaacttcaagaattacaaacaaaaaaaatcaatgtatcattagtttggattaaaggacattgtggaataaaagagaatgaagaagtggacgaagatgctaagaaaggaagtagaactggagagcttttaagttataaatgtccccacagtgaaattgcctgccacgtaaaacccataatactagccgaatggagagaaatgtatagtaacagtccaaagggaaaattttataaaaacatagttaccaagcctcctggccagtcttagttctcaagactctcgggaagcaagcggtttttctctgttttgtgcaggttaaggttcaaccatgttttaactccccag

SEQ ID NO: 4538 - DNA, 406 bp, Diabrotica virgifera
  Clone ID: LIB149-032-Q1-E1-E6
tcgcgggctgacacacgcctcaaaaatgtgtcatcatactattgggttgacacaactgctcgcggtggagtaccatcttcagctctccgtggaggcactgacgtcgacggctacgaaatctatgttggcagagctcactatgaaggagactggcttccagcaaaagtaattccaggcaaagatatcgcctacgtatcttacaatggatccgagattggagttcaccgcttccaggttctctgcgaacaacaattcgactgggtaccatgtcacggcggtaacattccaccagacgcagtggaaggaggtagaacgtccgatggagaacctttatacattggcagagcttaccacgaaggttcccaaacagtatgaaaggttcacccaagtcacggttgttgctacg

SEQ ID NO: 4539 - DNA, 123 bp, Diabrotica virgifera
  Clone ID: LIB149-032-Q1-E1-E7
atagtgagtcgtattagacttaagttaccaagacttttagttgtaagttaagaagcttaaatttttgtagacgacgagacgaccctagagagttgtccaaagttggtagggatttttttgagt

SEQ ID NO: 4540 - DNA, 373 bp, Diabrotica virgifera
  Clone ID: LIB149-032-Q1-E1-E8
acaactctctgaagtgagtcgtattatcaattactctgctattaatttattaagagatatagttgaagactgcataaatggtttagagacattcgaatactatccttatgactgtcaaaaatattactcttgtattaagggagcacctcaggtaaatacttgtgacattgggctatattggaacgataaagttaaagcatgcgaggtaaaatatgacgtatactgctcaaacataataccattcccagatcctgattgtaaggatggtaaacatacatagttcccatatccatacgattgtaataaattctactaatgtcttgattccatacgttacattctatcaagtcgacgggatttcatgtggaccgaa

SEQ ID NO: 4541 - DNA, 363 bp, Diabrotica virgifera
  Clone ID: LIB149-032-Q1-E1-E9
cacacattattctttgcaaacgatcgaggctatctgcaaagtattgcaggagtttttatcattgtggtctccagaattccctcggttctatttgtgttggatggtgttgatgatgtgccgtttttggcatgtttttgtacattacgtttttcacttctcagtgcaagaactgctacgtgctttttaaattgccagatcaaatatcttcatttaacgatggaatgataatatacaaacaaattatagtaagttcctttgtaagacgtatatttgaagaatccctataaagggttacatcgcagaactttttcggaatactaattccatcatcagtgttaaattccagtaatgtacatgcctgag

SEQ ID NO: 4542 - DNA, 404 bp, Diabrotica virgifera
  Clone ID: LIB149-032-Q1-E1-F1
aatttgtattatcaatacactcaagaagtttgacctatttaaaaggtctaatgttagaaaaaatggagtttaaagaaaaaaagattttttgcaatttcgtatttttcaccttttacttcaaaatatctccaaacttactggagatacgaaaaaaatgataaattactaaattgtagcttttttaataactaaaattacattgcgcgtagattttattacagtgaacagttagcgagatatagctgtttaaaacctctatttacgatcaaacacatccgtattcgagccctttaaacccactccaattaaaaactaaaggatgtaacgaaatttaatttacacagtcttatagctcttcaaaaatcctacaaaatcatttttgaaaaaactttttgtcgcgaaaa

SEQ ID NO: 4543 - DNA, 431 bp, Diabrotica virgifera
  Clone ID: LIB149-032-Q1-E1-F11
acaacaccctatagtgagtcgtaatagtgacgctggtcctttgggctggtgtcagttatgcaaaagatgtcaaaaatgacctgagtgacggtattttatttaattctgcagatgataaaatattgtttccatcattaatagacccaaagccaacagaaataccaccaccacctcctatcaatctaccaggtccaccagagcctccaagtgacgtaccggaggccctatataacaaacgtcccagacctccaccaagcaaacgacctagaccaccaggtcctccaccaagcggacgtcctaaaccgccaggtcctccaccaagcagacgtccaaaaccaccaggtcctcctccaagcagacgtcctagaccaccaggtcctccaccaagcagacgtccaagaccacctggccctccaccaagcagacgccct

SEQ ID NO: 4544 - DNA, 246 bp, Diabrotica virgifera
  Clone ID: LIB149-032-Q1-E1-F2
accgacgcgtccgtaaaattataacatcaacatcaattttatgttagggtcagagacatatgttatgcatatcattagcaattgaaatgttagtcgtttttaatgacatcgaagttttaacgacatatatggaatttatttatcaaccttagatttataattgtataatggaaaacttttctggctgtacagtgctaaggattacccaaaggttggaatttcacatatagtcagatataatacttg

SEQ ID NO: 4545 - DNA, 363 bp, Diabrotica virgifera
  Clone ID: LIB149-032-Q1-E1-F3
acggacgcgtgggtggattttcaacataattagaatattttttttatacgaatgtgcacttaaacatttagtattgcaatgcattgtcataatataaaatatcgtttaataatgttctttgcatctgtgtcctgcaatgaatgctgttttctttttaattcgaattttaatttcgatcaaaagcaaaaattagcttcatttaaattagacatgattatataatttctatttaggtgatgtgtacctaataacgcgagatataagtcacacatttagtggaatactgagaatatataggttttaggaagaatgttttatttttataatagtaaaaatattttatatcataaaaaaaaataaaaa

SEQ ID NO: 4546 - DNA, 394 bp, Diabrotica virgifera
  Clone ID: LIB149-032-Q1-E1-F5
ataatctaaggtgacccagctgtaacccagcaattattaaaaattttattacttttaagatactcacttatatatatgctatgtgtgtatttgtagggtagttattcaagattttgttcctcccccaacgaaacaagcaaaaatcctttcttttggtcgttttatacctacacaagtaaagattccgctctaaaatataacatattttaaataatgcttgtttgtgtacttttattactatcatagctgtagaaatatttattgtatgatattgcaaaagtatcttatttatcccttttgaaatacaagacgaatagttagttcattatgacaaaatgacaatttacatttaacactgttattgcttatactcttaaactgttaatactaccag

SEQ ID NO: 4547 - DNA, 223 bp, Diabrotica virgifera
  Clone ID: LIB149-032-Q1-E1-F9
cctatagtgagtcgtattaagggtatttggctttcttctcatcctggtggagcttaatcaggtctaggagagacttgcatgtggtagtcaatcttcttggaaaggacagattgtctggtgctggtattggtgttttacatgtttgtggtggtattgtttcagctcgtgcagttagtagaattgcttgcgcacatgctttggttacttttggcgggtatgttgt

SEQ ID NO: 4548 - DNA, 293 bp, Diabrotica virgifera
  Clone ID: LIB149-032-Q1-E1-G5
acaattctctatagtgagtcgtattacgtaatactaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaagggaagagtaaaaaaaaattaaaagggggaggtggcttaaagggttagatgttaattttcgagtaatggaaactaaatacctttcattgggggcctcgtaattagatttaatgggcgtttgtttaaaaagttcgtaatgggaaaaacctgggttttgcaag

SEQ ID NO: 4549 - DNA, 381 bp, Diabrotica virgifera
  Clone ID: LIB149-032-Q1-E1-G7
tacagaatttcacatcaataaatattttcatgctggaatagttaagtacgttgcgtcctattgctttaagatcaacctgtatatactatttatttatttcgtttactattttatacttgtgaatgtactttatgataattgccagatgaaacaatctttacaacgtattgtttatcttcgctttagcgtcacgacatgaaagacaaaaagttttatataaacttgttaatggcagaaattccatttacaccatctctggcacgacgttgtacaataagttttgtaaagatttggatactttgaacgatttgtaaaaaataatatgaaatcattacgcaagtgtttttcaatttgacactacaaaattgctgttataatgtc

SEQ ID NO: 4550 - DNA, 421 bp, Diabrotica virgifera
  unsure (1)..(421): unsure at all n locations
  Clone ID: LIB149-032-Q1-E1-G9
agcttaattgaaatagttaaattcagttattgtttgattgcttgtttttcataactttgttattttttattatcttgtaaatggtagggagtggaaatttgaaattttgcagttatgtataactttgcgcaccctgtcaaaacgacggtgttgccgtttaggagaatcaacgatgacgtcatatctctaaattgggacgcattattattatatgtcaagggtgaaaatttgaaatgctgattgacgtttctgagtatttaaaaaaaaacaattagtgtttgaattattattgaatttgttccaaattgcagacatcgctttgttgttttttattatcttgtgaacggtggagagtagaagtttgatattttgcagttatgtataactttgcacaccctatcannattacagtgttgcattt

SEQ ID NO: 4551 - DNA, 426 bp, Diabrotica virgifera
  Clone ID: LIB149-032-Q1-E1-H12
acacgcgtctacaatgatcctcaagccagtaaagaagcttcaaaaacaaggatagacgaagtttacgaagaatgtaggtcttcaattgaccatattaatgccactttaggagaagacagacaattaattaacaaaatacaaagtgaagatactaggatcaacggtgttattgacaatttaaagaaagaaatcggaggccacaaggactctatttcaaaacttgaaagcctcataacagaaaagagttttgcgtgtgaagctaaaggcaagcaaaaccgtgagcttattgatgaattgaagaaaaaggtaactgaattgtacgagatcgttaaaaaacaagaggatttgattctcgaattaaagaaatcaactgaaaaagcttcctttactaaaggaggtactaagggtggtactaaaggtggtact

SEQ ID NO: 4552 - DNA, 376 bp, Diabrotica virgifera
  Clone ID: LIB149-032-Q1-E1-H2
agttttcggggacaccctgtatagaaaataacattcttgaatagtgttcacacaatatattcccaattatgaatgtttgttggtcctatccgactatttcccattgtctcactctcattttctccagatcttatttgactgtatctttccacctttttgtagatcgtcctacagaccttcttccatctggtatttcccaaaacacattgtttatgaggcgattatcgttattacgtatgacatgttctgcccatcttagtctattggcctttatatatctgactagattttcctttccaaagagagagactttaacttattgtatctgagcctccattcgtttgtcacgttatctctacaagggccatacatcatt

SEQ ID NO: 4553 - DNA, 303 bp, Diabrotica virgifera
  Clone ID: LIB149-033-Q1-E1-A3
gaccacgcgtccatgaaaattccttccagtttgagactgatttccttggtttgcattgtcccttcgttaaggggttatacactgtttctagaatggattaatacttatttcgtagtaggaaggatgattttggctgaggatgaggtggtagagtctccccatgcatggtcgtatggaaaatccacaagttcgaacaatgattactactaggcgactgctaacacataactacttgcatgggcataaaactttgtccatctgaaaatacttccattcacaatacatgaggtcctaatgcaaatt

SEQ ID NO: 4554 - DNA, 422 bp, Diabrotica virgifera
  unsure (1)..(422): unsure at all n locations
  Clone ID: LIB149-033-Q1-E1-A5
agtgagaccttcattcggtttgggatttagttcctctgcaagctctaaacctaagaaagaatcttcaaaaatgtctttcgtatcatatatttctgaaacaccagttaaaaggtcagctgaagaacacgaagaggtggtactgtctcctaaaaagaagtccaaaaagaataaacagaaaaatgaagaaagtacagtagttggcatttcaaatcctagttttaatcccatgggcacaccagttaatgttgaaagacattctttaaatcccattgaagaagtctcaactgaaattgaggatagtttanagaaaaaaagtaaaaaggaagataatttagaatgctccttagataatttagaggacagctcaggacagaagaagaaaaagaaaaagaatacctcgatagacactagtgaaggtgcta

SEQ ID NO: 4555 - DNA, 353 bp, Diabrotica virgifera
  Clone ID: LIB149-033-Q1-E1-A6
cccacgcgtccggatctgactgtctgtcccaactcagacaaagcaaccaaagctgtatacgacaaagaagtagcaacatccgttgtaggaagcaccatccgtgttagagtaccagacagcttgttcttgaagaaaccaatcacctgcattgttattgtggacaataaccacagcgatagcgtacctgaagtagaagatggtggtgttgacagtacatgggtgaccgtaaacattgctcccgccattaccgaactgctcagctacagaatccaagtgtacaccaatgaataaatatagattgtaatatgtctgaattatgtaaagtggtgctaataaaggctaatgtgtatata

SEQ ID NO: 4556 - DNA, 412 bp, Diabrotica virgifera
  unsure (1)..(412): unsure at all n locations
  Clone ID: LIB149-033-Q1-E1-A7
aacacgtatattttttagagacctgtaagttgagtgtacataacctcaaaaaaatttttattatttttttttggaaagaagtatataactttttttggggacagctgcagatctaatttttttttggtcttgtgtgttttgtcaaacactatatttctagtttttttcagatttttctgtgacgctggtcaccttcaaaaattaaaaaactgttttttaagggggttttgggggtttgaacgtgtttctctcatttttacatattctaaaggactcagttacttcaagttacatataacctataaagacgaaatttatttgatatattctgaagtctataaaatanggaaaatcgccaaaaacccccaaaaaaacagtttttcggatttttggagggggcgagccttgcgga

SEQ ID NO: 4557 - DNA, 414 bp, Diabrotica virgifera
  Clone ID: LIB149-033-Q1-E1-A8
acggacgcgtgggatttttgaaaaaactctcattaaaaatggtttttaaagtatcccttttgtgtacactgctggtgttagttgcttattctagtgcatacgattacagcaattgtcctggaaataccaacagacaaaaaaatctgatatacagctctttactgccaccaggatatagcgtgaaaactcgtatcccagcaactggatattaccaaagacctatcacctgcttactgctaatcgatcaaaaaggaagcgccagctcaccaaaaattatagaaggtggatatctcgacacttttgctgtagtaaatatcacttccacaactgcgcaaccagttagttactatgcaatagtatttattgattagcctattgattagcctttagtagtatttagatatatttatgcac

SEQ ID NO: 4558 - DNA, 374 bp, Diabrotica virgifera
  Clone ID: LIB149-033-Q1-E1-B10
aagcgtcacgttcctctatgacttactctaagatgttgtttgaatttcaatttatatctaattactacgtcatgcaagttgaacgtcaacctgtagacatgcctattttatgaccacaatttcgaaattaaaattcaattgaacctgattctaactttatttgcatgtttcgaccctacatgtaattttactcgcccactgaccggggtcagatcactactatggctactccatatgccctcgacattttgacttatcacctcgcggaaaaagtacattatgatcaaagatcattatcatcattaacgtaaagaatgtaaagttttaagtggtaattataagtcccattgaagaacattaatttttatctcact

SEQ ID NO: 4559 - DNA, 425 bp, Diabrotica virgifera
  Clone ID: LIB149-033-Q1-E1-B2
aacaccctatagtgagtcgtatcatctttcggtggttgccttgagcagctgcttaccagcatccagaaatcaacaatacgttgatgtagactacaacagctacaacgctcatcccgtctacaacttctggaggacttggaatcagcaacactatggacaagaaccatggaaccaatgggtacaatatggtgtccagaaccaacccggtaactactggaggcagtacgtgcaacgcagcaaccaagctgaaaatgtcgatttaccttggatgtatcactcttgggatgtccaggatgtgcaaaacttaactcccgttcaacgtgttcagttgctactcaactacgtcagacttcaccaacaatggaaccaatggactcatgatgtaactgccaatgaacgtcttcagaatatgttgtatcaacacc

SEQ ID NO: 4560 - DNA, 394 bp, Diabrotica virgifera
  Clone ID: LIB149-033-Q1-E1-B3
tccttcctggttggaactccccttatcctttcaacaattgcttaatccaccggtcctgaaaaacaattttgacaacatcccggaaaggccgcaagatccaaaagggccgcaagatccaaaagaggtcacatctagctcttcggtggatcccctaagtcctgaaaatggtgaaattgacattctcgaacgaaatttgacggattttaacggcaccggaaaggatttgtttgtgataaaaacggttgtttatgaaattggaattttgacggatattggaaatgatactaacttcgacaatgaaacccatgaacaaatcgatgtctcatttttcaacgcagcccacaacggctccatcatatacctatcccatatcccaataccgattcaaaccaac

SEQ ID NO: 4561 - DNA, 412 bp, Diabrotica virgifera
  Clone ID: LIB149-033-Q1-E1-B7
agtttcatttaacccttatcagaaccctattatgttaagaaatagtcttcatacatctgtgattgtatagtacgtgcccatagttttttaaaaatcgtgacagtgtttgcagtccatttattttttttaatagaaaattctttagtttaggataaccaacgcactttttacctggactgttctctctgcacttcccactacattagaagcaggagcataatattcaatgcaagcataccgaacgacgtagtcttctaaaaatactgaactaaacatgacagcacataattggtttgggtagtaaagacgatagtgttatttaccaaaattgaaatcatacacactaaacgctcaagtcacttaatttgacacaatctctaaagatcctaatggcattataagtctagtagtt

SEQ ID NO: 4562 - DNA, 411 bp, Diabrotica virgifera
  Clone ID: LIB149-033-Q1-E1-B8
agaaaaggtattgacttggtgaggggactctatagaataggagtggcttagaattagtcactttgtccatttcaggacttattttggacatatattttttcaccccctacagggagtgaaattcacccccatggcaaaggcacacatcggcacattatcaccttttttctttgacgtgttggctatccgtgtgccagatttcatgtcaatccaagcggttctttaaaatttacagcaaaaaccgtgaaataatgtactaataggtttatttgctttttttttgcgctgtaagagcataaacatttccatcaaaattcaagtttcattcaaaaatgttcgtttttttaaagtcctcattttatcttatgacaaagttccataaaaaatatagctacttttcttttctttgtt

SEQ ID NO: 4563 - DNA, 400 bp, Diabrotica virgifera
  Clone ID: LIB149-033-Q1-E1-C11
actcaagggccgatgcacgcctcaagactgaatcgactaagacgcgcaacggtatttatactgtacgaaccataagatgccacaaggaaatagcttgagaacagtatacttacatgcaatagaaaattaagataagttagttatcataagaaaatgcaagacacttgaaaaagacgaaaatcataatttgtcataattcttgaatccgtattagacagacagtttatttttatgtagctcctactaaccaggttaagctactcaaaagctctcagttccaagttcctttctcttttttcttttgctttagtatctatacggtgtattccacgaatataggactgttttgggttgtcgcgacagcgaatattttagtgtgcaacataagaagtacgaaagt

SEQ ID NO: 4564 - DNA, 337 bp, Diabrotica virgifera
  Clone ID: LIB149-033-Q1-E1-C7
ccacgcgtctacacacgcgtccggaaagggtcttaaagaaggacttccagacctggcacattatctggataaattataaacaactaagaaacttaatttatgtacagattatttaataaaattatttcaagttactcaacggtttttatagttaattgtatttatgatatttttattctgataagttttcagttctctcaaattgatggcaacactagaaatgaaatagactaaataatctgactaatattttatgtatgttatatagatttttgttaacagtccagatatttgtagatttattaatttgacatcaaaagtacatctgatgaaacat

SEQ ID NO: 4565 - DNA, 404 bp, Diabrotica virgifera
  Clone ID: LIB149-033-Q1-E1-D1
gggtcgacccagcgtcgaaaatttcacatagaaacgttgttgaagttattggaaggtgacccaactgttcctactcccgtcgtaaaggctcccgctgattacagatgtgttaagtgtcaaactatatgtgaagagcaggcgcatgtctgtcaacactgcatgcaggtatattgttctatatgttggatacatcacatggcagaattagactcaaacttatctttgttaatcaaacaagtagaggaatccagagatagattaaatcacaaagcacaaaatttttctggccgatgtgatcaacttgaagaaacaattaaaaagagtatcgagaaaaacattcaaagcattaagaaaatggaacatgatgtcttacttgatgtaacttctatcaaagaacaaaattc

SEQ ID NO: 4566 - DNA, 349 bp, Diabrotica virgifera
  Clone ID: LIB149-033-Q1-E1-D10
agaaaaaaaaaaagaaaatagaaaaaatggtaacaagagaaaaaaagtgactgaagagggaaatgtgaaataatttaaatatgatgggagcaccgtatttttcgcgtacggggcaaaacaaattaaaaattttagtaaaaaagagtgggcctcttcatcgctgctgtgtccagacagacgactaataattccttatttccatattcatggaaccggtcgagttttcttgataggtttttgtattaaaacgaattttcttcctatgcaaaataaaggtcttagttaggaataagttgttcaaatgaaaatgtacgagtacacactgtgggtataaatgaagtctttattc

SEQ ID NO: 4567 - DNA, 363 bp, Diabrotica virgifera
  Clone ID: LIB149-033-Q1-E1-D11
aacggacacgtgggcggacgcgtggggaacgatataaaagcataattcttgaaaaaaaaaatcaataacaacaatctgtattttttgttaaataaatctacaaaatacagacaaatcaaaataaagtgtggaatattgtaggaaattatttatagcgtaaacaataagataactaagtaacggtcatagagaggagtgatataccaaaaaattttagtcaaattattaaatatattatgcagacacgatatattaaataataattctacaaagatcgttttacacctaaaagtctggggatattttttaagtctgctcgtatggagaagattttaaacacacatgtctacctttgatttgaat

SEQ ID NO: 4568 - DNA, 151 bp, Diabrotica virgifera
  Clone ID: LIB149-033-Q1-E1-D12
aacggacacttgggcggacgcgtgggaaaaaaaaaaaaaaaaaaaataaaaaaaaaaaaaaataaataaaaacaaaaaatatttattagttaaaagggtggacgttctaaatgattgatcgcttccgtaggctgttatgcaatgttaaatt

SEQ ID NO: 4569 - DNA, 416 bp, Diabrotica virgifera
  unsure (1)..(416): unsure at all n locations
  Clone ID: LIB149-033-Q1-E1-D5
cccacgcgtccgcgaaatctgagtaggtaccaactataacaatgaaacaagttattgtctccttgtgttgtttgattatagcaactgcagctataccaattgaaagttttgtagatgaagatggccaacaatatgttttagttcctttgcagaggcagagaagggatctaacatggggagcaaaccaaaatggttactctcttggccaaaaaggtactatctacagcagtggtaatcaccaatttgacggctcgtacggtgcatcaaaagcttggggatcacatggtattaaacccgattcatttggcggccgtgtagattatactcacagtactagtggttcaaacgcctttgttggagcanacagaactccaggttggggtactgatgtggctgccggtggaaggtacaatata

SEQ ID NO: 4570 - DNA, 346 bp, Diabrotica virgifera
  Clone ID: LIB149-033-Q1-E1-D9
agagctaagcaaatcaatgacgacgaagatttcgaggctgtctttgactacaccacatactggcccagttttagaatcgtaggcaactacgaagcaaccgttaaagagcttttccttacacagcactacaaaggaacctacaacataaccatgattaaaccaaaatggactggaagaatcagcgcacaaaaagtccccactgtcttaacacctaagcccattgtagacagttttaccgtcgactggcaagttgcagatgtaaaatgcaaaatcactggtatgggaataattggagacacttatgctctcgctattcaagaaggtattgaaacggccctcaaccatg

SEQ ID NO: 4571 - DNA, 333 bp, Diabrotica virgifera
  Clone ID: LIB149-033-Q1-E1-E10
cgtcaagcaaataaaagttttgcttgtattttgattctacaacaagagacaaaaatggaacaaaatgctagattacctatgtatacacttgataaggaacttgcttcagcatttcaaattgattgtgaagatttgttaaatgagtttggatcatatcagtctttcagaattcaagattttcagaaagtatggcacattcaattcattttcatatgtctttgcggggcaaatatatactttatgatgaaatgatgtccatgctactagcatgttgtttcgaatcgagcacaatattattttgagctattttatagtttaaatacatcaccatta

SEQ ID NO: 4572 - DNA, 345 bp, Diabrotica virgifera
  Clone ID: LIB149-033-Q1-E1-E12
aaccacgagtccgctgacgcgtgggcggacgcgtgggttacacaacacgaaaatgattgttttagcagttactttatgtttgcttgtaatatctatacagggacaaattcctgtcgaaagatgtcccgatgtaaaaggagttgcaaatttcgatggacaagcatatttgggtgattggatcgaacaagcaagatacccaactttactggaagatcatggagaatgtgttattaccaatattgcagtaggcgctgatggagttataagaagtcgtaccaaatatactaatacaaaaacaaacgaagaccatgttctagaaggagaaggagtatcaaattcaaccac

SEQ ID NO: 4573 - DNA, 327 bp, Diabrotica virgifera
  Clone ID: LIB149-033-Q1-E1-E6
agcccacgcgtccggatggtgcataaggagagtgcaaactctggtgatgagaggaaaagttcattgccatttgtccctgaaattcaagcaaagggtatccctactggaaaatacaagcttgtaggatggggtatatactacagggcgcacacacaatttggaaatcactcacatatctgcgtttaaaacctgattcacagttttcacagtatgtcatgccatttggagatttgaatcctacctacagcagaagacatggtatcagagtagtaaacacaatccgctacagaatgttgaaagatgtcaacacccaggaattcttgaaga

SEQ ID NO: 4574 - DNA, 133 bp, Diabrotica virgifera
  Clone ID: LIB149-033-Q1-E1-E8
acccacgagtcagcagtgacttgtggaaattgctcatcttgtatatcacatttattaatcatcttgtcttggaagttggggaagttcatacaagtgactctcagggcgattctaatgaacattagcaggctgg

SEQ ID NO: 4575 - DNA, 423 bp, Diabrotica virgifera
  unsure (1)..(423): unsure at all n locations
  Clone ID: LIB149-033-Q1-E1-F2
ngtcacaaacattcacacaattcttctgaaataaaacaacaattcctgtctaccatctatagatatccttatttcaaaataatttttactgatgcctccaaaagcagcaatggtgcagctattttcgaagatagtacctctgtcacccgcctagccaaggagtgtagcatatactggagaactgcaagtaatcaccaacgcactaaaccaaatgtatcaacaatatatctgatataaatgttcttattatatcagattctctgattgtcttaaatggggtcaaacataatatgtatcttactcatgggaattgaacacaaataaaagacaggtattatacaatgcacaaacacgtggcaaaaacaaaatattcttatgggtaccaacccataggtataccanaaacatgggataatggagaag

SEQ ID NO: 4576 - DNA, 436 bp, Diabrotica virgifera
  Clone ID: LIB149-033-Q1-E1-F3
gggccgaccaagccttcgaccaaggcttcggccaagcctccgcctttggcttgccaaaccattcccccaaaacggtaattaataaaatttggcacaattgaaaaacatttacaataaccaaaattgtctaaagaccgggaattgcaaatggggatgcgatgtgtgaagtacatgatttttgtggcgaattttatgttcatgttagttggattgttgctgatatcaattggatataccattaaggctatctacaccgatttcgatgctttccttagcagccatagctacaaagcatccgacttagctatagctgttgggttcatcattctagtggttgctttgtttggttgtgcatgagcaattaaagaaagtgttctactggttaatctatacgctttactacttcttgtaatagttatcctggaattgaccgtaa

SEQ ID NO: 4577 - DNA, 295 bp, Diabrotica virgifera
  Clone ID: LIB149-033-Q1-E1-F4
aagttggcgtcggtcttacggtcagcgcccaaaagaatgactttttgtgcgatacctgcgtaggaatagtaaaagtagtccaggactacgtacgaaaagaaattccattggaagaagttgaaaaagaagtgaaagaattgtgccaagttttaccaggagatttgaaaaaattgtgcgaggacaagttaattccagcaatcgaccaaatgtacaaccaggtggaagacactcctcctagagatttatgcgtagagttggaattctgtaattaatttgtttgttagaatattataat

SEQ ID NO: 4578 - DNA, 108 bp, Diabrotica virgifera
  Clone ID: LIB149-033-Q1-E1-F5
agcgcatataaagaaatcgcattaaaaaagactttacttgcattgaaaaagtatggatacgtaccgtaattttctaaaatcacataaaatcaagacgtttgtccaccg

SEQ ID NO: 4579 - DNA, 357 bp, Diabrotica virgifera
  Clone ID: LIB149-033-Q1-E1-G6
tacaagactctatagtgagtcgtattaacgtctctagtgtgtatgctcattacagacaccagtggtgatgtgatgtgagtatcacatgttatagctaaggtcggttatcatcccttcacatcaaccgatgacgtgttagtatccaagtaactgcacttttgaggtagcggtctcagaagcgcacacctctgcgaaaccacatagttcgagatagaattgaccaaagtgcgtttgcatatgactagaaggacatccaataacaccctatgctaagatggacatccgtatacgattttacttgacgcatgacatcttattcaatatccattagtacagatccttctattgcaccaggat

SEQ ID NO: 4580 - DNA, 418 bp, Diabrotica virgifera
  Clone ID: LIB149-033-Q1-E1-H1
gacggacccttggggaaacaacgaactacaaaggaactcaaagcaaaggaaaggaaaattctaattttagagcaagctaagaagaataaagagggacccagaattgttaaaatccttaaaatcagctgtagacgcagtactaccatacaacgtgacacagtgtgacaaacaaaatttcgaccaatcacgtgccgaattttatacaattttcgatacaagaacttgcatattgtcatacagggcacaaatgtacgtacaagaaacgatacaagaaaatgtatatcagaaacgatattagaaatgatacaagaaaatgcatagtgtcatacagccataagttggtaaattatttaaagttgcagcagattttatgagacaaaacaaagatgacttcataccatttatgtgcaattaatta

SEQ ID NO: 4581 - DNA, 415 bp, Diabrotica virgifera
  Clone ID: LIB149-033-Q1-E1-H3
tacaattatttattgaaagcaggattacccgaattgggattacaacaacacaacccctacttcaaactaagggacctacaatggagtggaaacctcggtgttgccaaagcccatatcgagctccatgataatagatggtatggtcttgccgactgggaaattcaagcttaccaaatcagtgctgacactgacaacgaggctgtctttgactacaccacatcatggtcaaatggatttcaactctctatgaactacaatgcaaccattaaggaacttttcctttcacagcactactcaggaaccatcaagataaccatgaaacaaccagtatggactggaagaatcagcgcacaaaaaacccccactgacttaaaacctaacaccactgtagacagttttaccgtctactggcacg

SEQ ID NO: 4582 - DNA, 326 bp, Diabrotica virgifera
  Clone ID: LIB149-033-Q1-E1-H5
agtcacagccaagataactgcaggaattggatttcaggttacagtagatgaattggtttttgaatcatgggaaccatcaacctgtaaaatacaaatttatacttcacatgcagatcttacatctgcttaaattacactacaaaaaaaatattttaataacaaattatcacatttcatttaccattttcaaatttatcaatttaaatttattaaaaatgaataaccattttcaatttattaatttatgaaatgtaggcaccaatgggcttatttgtcgagctactttgtgtacatgaaaaaataaataaattactaaactaaaacga

SEQ ID NO: 4583 - DNA, 419 bp, Diabrotica virgifera
  unsure (1)..(419): unsure at all n locations
  Clone ID: LIB149-033-Q1-E1-H7
acatcacataatcccttcgtcgttatcagaaacgtatcatggactggatcaatcggtgttgcaagcacccatatcgaactcaataccaataaatggtatggtcttgccgattgggatatctcagctaagcaaatcaatgacgacgaagatttcgaggctgtctttgactacaccacatactggcccagttttagaatcgtaggcaactacgaagcaaccgttaaagagcttttccttacacagcactacaaaggaacctacaatataaccatgattaaaccaaaatggactggaagaatcagcgcacaaaaagtccccactgtcttaacacctaagcccattgtagacagttttaccgtcgactggcaagttgcagatgtaaaatgcanaatcactggtatgggaataattggagacac

SEQ ID NO: 4584 - DNA, 144 bp, Diabrotica virgifera
  Clone ID: LIB149-033-Q1-E1-H8
taaattaagtctacccttcgacgttaactttttacgtagcatggactgggatcaatctgtgttgcaagcaaccatatcaaactcaataccaggtcggtggtacggtcgtgccgattgggatatctcagctaaacagatcaatga

SEQ ID NO: 4585 - DNA, 387 bp, Diabrotica virgifera
  Clone ID: LIB149-034-Q1-E1-A2
cgggtcgatccaagcctctaaattaagtcgtaataattagatgtggcagtttgcatgacttagtatatatttgcctcttaaggaaaggaaaataattcgggattcacgaatgttctacataatgagcagtctgaaagaaaatttcatttctgattgcagaatttgtcttttagaacctaaaattcagatcaattacgacaggaaagttccgttggatttataagtattatactgtgattatactctgatcatttatatcgaataatttaccatgtgttaaatatgtatatctatcaacgaaatgtcaatataaatggaatgagtatgaagcgaatttaatgccgccacgatgagatagcgtactcaggaagatagtcaccatccttc

SEQ ID NO: 4586 - DNA, 333 bp, Diabrotica virgifera
  Clone ID: LIB149-034-Q1-E1-A4
acccaagcgtcaggcgaatggcgtgcgacgagaggttcgttttactgggcgatctgatatgccggagcggtggactgaaccccttccaagcgggccttcgtttccccgtcacgaagatgcccgcggtagaaccggatatgctgcaattgcagtatctgacgcagatggctttcaaacaggcgcagaccagacttctcaccgaaccatggaacgcgatatccctgcaacaacagcaaaaacttgctgcgcaaagactgattatgcgacatcaacaggtaacaccatatcgccaatacctacaacaaccacacgcgagcaaatctttaatgcaca

SEQ ID NO: 4587 - DNA, 338 bp, Diabrotica virgifera
  Clone ID: LIB149-034-Q1-E1-A7
acccactcctccggaaatcaattgtatctactaactaacaatagtcttaaatggcaataatttgacattattggaattaaacattttaatggataatgcttaatgatacatattgagtacgttctaaattttagataaatatttagattataaattatcattttctaccaaatctaaatacataattcgatcaatgattagttgtattatacatactttaaataatagttcagggattgaagtcagttcaatttaatatagatcgaactcttataattagaaaattatatgtacctcaccaatatacaaggttccatttagaatgctgtatcatttat

SEQ ID NO: 4588 - DNA, 371 bp, Diabrotica virgifera
  Clone ID: LIB149-034-Q1-E1-A9
aatgcttttccgctggaaattttattcaaggatttaagaactcaggtgattccaaggaagaagcaaaacaacaaagaaattttatctgtaacctgtttaacactgacgagctaatgcaaatctgtatgagcacttatgaagaggacgtcgaatatatttatggagtaactgacctcagaacagtaactgaaatgtgcatagacatgaacaaatgtaaagctaaaccaaatatctaattgtgttttttaaataaaaacatgtttttattgttttaaaaaaaaaaaaaaaaaaaaaaaaaaaaaaaaaaaaaaaaaaaaaaaaaaaaagaaaaaaaagaaaggagaaggaaggaaagggggatagaaaggggg

SEQ ID NO: 4589 - DNA, 369 bp, Diabrotica virgifera
  Clone ID: LIB149-034-Q1-E1-B12
aacggacacttgggttatttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataatattagtattaaaaaattgtatatttagtaaaaatatataggtttaataaaggaattcggcaacatttttttcacctgtttattaaaaacatg

SEQ ID NO: 4590 - DNA, 350 bp, Diabrotica virgifera
  Clone ID: LIB149-034-Q1-E1-B2
gaaggtactcattcttctttccgttgttgccttgagcagctgcttaccagcatccagaaatcaacaatacgttgatgtagactacaacagctacaacgctcatcccgtctacaacttctggaggacttggaatcagcaacactatggacaagaaccatggaaccaatgggtacaatatggtgtccagaaccaacccggtaactactggaggcagtacgtgcaacgcagcaaccaagctgaaaatgtcgatttaccttggatgtatcactcttgggatgtccaggatgtgcaaaacttaactcccgttcaacgtgttcagttgctactcaactacgtcagacttcaccaac

SEQ ID NO: 4591 - DNA, 381 bp, Diabrotica virgifera
  Clone ID: LIB149-034-Q1-E1-B5
agaaaactcagactgtgcaatatgtttcctggaatgttgttaaatttatgtgttgatctgtgtgtttattaactgtgctttaagttcaaataccaattctctttttttatgaaggtctggtggctatgccgtacaatgagcagcgggagtagccaaatatggcgtcgtcgcagtggtacagcatggatccgcgctggcctagtaatcttcatcttggtattcatatggatccagatgacgttcctgagcttcgctggttcatcccctcaatactcagaactaaacgatagtaacgcggctattctgagtatggttccagctgttttgcacaagtttctatcacccagaccaaaaaatctttctactattactttcgctaac

SEQ ID NO: 4592 - DNA, 387 bp, Diabrotica virgifera
  Clone ID: LIB149-034-Q1-E1-B9
agatggaagtggtttttgcttcatgtaataggtatatttatcaaaatttctaaaaaatcccaatgcattgaataaattatgataaatatacctattacatggaagtggtttttgcttcatgttagagttttttctttttttcttttcagtatccagtcatttatattctatatattacagctttgcgtgaggtctgtgctacgttgtctatcccataatggttttcctgtgatatcttggactattttcttttcacacgtttccatcagtctttttgtccttgtagtgtcagatcttgtttccgcagtgtaagtcataattggcctaactactgtcctatagatattggcctttgtttctgtccgtagatgtgtgtcgcgccagata

SEQ ID NO: 4593 - DNA, 375 bp, Diabrotica virgifera
  Clone ID: LIB149-034-Q1-E1-C1
atttattagcagaagccaagaataattttctttcatgacaattggatatcattgtgagagaatatttcatttttagcaacgacaaatttactttttgtacctcgcgtatcacggattactaagtactaattctgtactttactaatttcgcatttaaaatagctaaaccattaacagttgtactgtaacctacatatgttaaaccatttttttgtaatgacatgttactcgtttttaactacatctaattttttaggcaataaatcaaatttagttattaccaatatattcatcactaaatatttttagattgtcaacagtaaatatttttagggatgagcttaaaagataaaactttattaacatttaattttt

SEQ ID NO: 4594 - DNA, 135 bp, Diabrotica virgifera
  Clone ID: LIB149-034-Q1-E1-C10
agtgagtcgtattagggtgttgtagtagaagtagtgaatagttttagttaaggatagtgaattagtagtgtgagagaatagtttatgttgagagggggaatggttgaggttttgtaccttgtgtagcagggatgg

SEQ ID NO: 4595 - DNA, 328 bp, Diabrotica virgifera
  Clone ID: LIB149-034-Q1-E1-C2
gatagatattatttttattaaaagaaataaggagataattatctacataacaactaatcccatcattcttaatatttcattcgaaaataatacccattcgcgatatattacatctcattaagttacaaaaccttctattttctttgtttctaaagatatcagagaaattaaggaaacaaaatgttcacaaaacataagactacaatatgattccgatgtatactgagatttttacttcgtcctccctacagggtgtctcaaatttaacataagaaaaacatttattttcttccacccggtataggcacaaaaagaagtttgagtaaac

SEQ ID NO: 4596 - DNA, 247 bp, Diabrotica virgifera
  Clone ID: LIB149-034-Q1-E1-C3
aatataattttaaaataaaataaataaagaggtaaagtaactacatcagaaataaacgaaaaaaaacttaaattttcggggcggccgtcctacggattcgtaacttacttaccgctcattgcgttttctcaccctttctatacttctcctcaatttattttcatgtgccctttttttcacatccttggactgggaaaacccctgggttaaccctctttagcccccttgcatcttatccccgtttccc

SEQ ID NO: 4597 - DNA, 363 bp, Diabrotica virgifera
  Clone ID: LIB149-034-Q1-E1-C4
acttaaaagtgtttattgaggctgacctaactaacaaacaatgttcagaggttaattctctgaaaacagaacttaaagaaaggcagcgtaatggtgaaccaaaaaacatagaaaatcaacagaattaaaagttcaagccacttcgtcaatacctgtttattttcagaacatcagaggtctgcgaacaaaactcaatctactctatgagaatatatcatactcacaatataacattatattgctaaatgaaacaaggttgactagtgacattaacaattctgaactacaaatgtttgaccacaacatccaccgaaaggatagatctttatcaacaagcattttttctcgtggaggtggggtact

SEQ ID NO: 4598 - DNA, 395 bp, Diabrotica virgifera
  Clone ID: LIB149-034-Q1-E1-C7
acccacgcgtccgcccacgcgtccgcaccaccttcgttccgtaccaccattattgctaaagccatctcatgacatatttaccataaatattgaaaaagtcatgtgaaaaaatgcatccttgtctaacctctctctctctctgctctgctctgcagatttttaatgtctgtaggtgtatcggtgcaccctgctgaaatggaccaaagatttattcagctgacacaatcaaatgccttcttatggtcaacaaagcatattgtcataggtacttatataggtaactgagcgctttgtgccgtaatttgaaatttgccagcgcgcacagtatgttcaggtctattcctattctggttcacctgtaacgctgtgaattatgttggggcaaggaaaaacaa

SEQ ID NO: 4599 - DNA, 398 bp, Diabrotica virgifera
  Clone ID: LIB149-034-Q1-E1-C8
agttactcgtctttaaatatatcaaatttttcatgaattaacttaaattcatttactaacattatactcataattaaatatttttatattattgatatcaaatatttttagggatcatcgtaaaaatacactctcactaaaatttaatttttaaatttatattatgattaaatattttcatattttaaaatatgttattacttatttttatataatattatttttatcttttataaattttttaataatatataactttatattatttaaatttagtaatcgatgataatagtactattaataaattgtacatttagtacaaatagataggtttaataaacgaattccgcaacatctttttcacctgtttactaaatacatgtccttttgtaataaat

SEQ ID NO: 4600 - DNA, 371 bp, Diabrotica virgifera
  Clone ID: LIB149-034-Q1-E1-D1
agatgaagataaatttaaagaactatgtgacaaatatgtatccaaactagaagaggcaaatgagatagaatttgtcgattatctgaaaaaacaatacttggctgaacacagaaaaaaattgtggccctattgttacagaagaaatgccgggattaataccaacatggcaattgaatcactcaacaatctactaaagacgaattacctaaagagaaatgcagcactggggattgagaagctactggatacaatggatgagctagttgaagaaaaaatgtggacgaggatagttgatataatacgaccaagcgcaaataattatcaagacaggctttcaataagagcacacaaacgggcagcatcgatgaaag

SEQ ID NO: 4601 - DNA, 375 bp, Diabrotica virgifera
  Clone ID: LIB149-034-Q1-E1-D10
agcggacgcgtgggaaactgtataaatggtagcaggcgatgaaagtgactgaggcgggcaatgtaaataatttagttatgatggggcccgtatttttcgcgtacggggcaaaacaaattaataattttagtaaaaaagactgggcctcttcatcgctgctgtgtccacacacacgactaataattccttatttccatattcatggaaccggtcgagttttcttgacaggtttttgtattaaaacgaattttcttcctaggcaaaataaaggtcttagttactaataggttgttcaaatgaaaatgtacgaaacgacactgtgggtataaatgaagtctttattcaaagtattcaccatttacccgaacacaacga

SEQ ID NO: 4602 - DNA, 365 bp, Diabrotica virgifera
  Clone ID: LIB149-034-Q1-E1-D11
aaggtctttgtccatgagtggatgcaaacaggttgaagaagaagaaaagaagacacgtaaagaaaagacactgtagttaccacagctggtcccaagcccgaatgaaatgtaggggtgattggcaaagttaggaaactaccaatcgtaagaacaaataggtaaggtagtgtcgccaaataaggccagtgtcttaattaggccaattgcaaatattttcttaaatatagatattatattattagagatcaccgtaaatgtctttctcagtcaaaatcgtctaagccattcagtcggtagtatcacatagcagtgtcaagtagactagacacgtgtttgttacggtgcggaagttcgtttataaattt

SEQ ID NO: 4603 - DNA, 311 bp, Diabrotica virgifera
  Clone ID: LIB149-034-Q1-E1-D4
gggtcgggcacgcgtccaagaaagttcattgctataataaaatttaccagaactgcgtagagacatttgagattattcgcgtataaattgtgtgactacgactatgtctaatataatacttcatatgattacaattggagccatggtaattttttccggcgtaaagcatgaaaccacagtttgatattcctgtgcaatttatgaatgaaatttgtgaaatgaactgtacctaactaatcgtaagagagtaagatgcccaaatatgcccccagatcgtaatacaacctcaggtgtagcttgctataagattt

SEQ ID NO: 4604 - DNA, 131 bp, Diabrotica virgifera
  Clone ID: LIB149-034-Q1-E1-D7
tacaccacccaagagtgagtcgtattactactggaaaaagttattttttgcaccttgtgtatcagggattactactccgcaattagatagttacgagtttccaatttagaagagctagtgaaattagaatc

SEQ ID NO: 4605 - DNA, 375 bp, Diabrotica virgifera
  Clone ID: LIB149-034-Q1-E1-D8
atctgccacaagaatcagttgttagacaagaagaacctgacttcttgtctgacttggagtcccaaattattccagatactaggtccagtaagaaaagctcagtaaagagccagcagtccaaaaatgacgccaacccattgtattttggtttaaatgaaatttctgaagaccagccgtccaaaaatgaaatcccagtgtattctggtttaaatgaaatttctgaagaccagcagtccaaaaatgcaatcaacccagtgtattctggtttaaatgaaattcccgaagttggtttaaaaaatcgcaaggtaagggccattgaggtagtagagatcaacgaagtacgacgaccatcaaagagtacagatcaacaagaac

SEQ ID NO: 4606 - DNA, 328 bp, Diabrotica virgifera
  Clone ID: LIB149-034-Q1-E1-E10
aggtttttgaaaatgtcacaatattttaattatttctatgtcgaattgcatcttgcgtacaaaactgattcaggaaaaaaaccgccgtttattaagtaacaaacaaaataataaattaaaaacattttaacaagaataggtactgcatagtataaacatggcgacaatgtggctcaacatgtagttttaatttcaattagaatatagaaaattttggtattaagtactaagtagtgacttgttgcacaacctactatgaagttgtttcgaatcgaacaaaatattattttgttctattttatagtttaaatacatcaccattactggt

SEQ ID NO: 4607 - DNA, 328 bp, Diabrotica virgifera
  Clone ID: LIB149-034-Q1-E1-E12
aacacacacttctgataacgataatttggatttgactgatcaagacattagaggatcattagatggactctacatggcactaaaaataaatgacatcaaaggaaaaactgacgttaaaatttcgcaagtcctagatatgtattactctcctcaacaaaaaggagtttttaatacatcttttagggcatgtaacagaaatattctttattctgaattggtcgattctaaaactctacaacaaaatatcaacaatcttatgtcagtaatggacgataagggccaatatcctggatatattgttcctgaaaaatatccaacactggccgaa

SEQ ID NO: 4608 - DNA, 366 bp, Diabrotica virgifera
  Clone ID: LIB149-034-Q1-E1-E2
acccacgcgtccgcaaccaggctgatgttcttgctgatcttttcagtcaatatgagggtattgtagatgaccagaccttctatagtttgttgaacaaacttcaacatttggtacaagctggagtcatcaacagagtagtcttggatgttgtaagaaactgggatcagcaaggtgtacaaggtgttagtgacattgtctctctgcaaggactctctggttatggcaacttccaaggacaatcaagaggatattccccactcagagagatcttaaagaatggagtacaaggaaggagcttcaatcaacaatggttgaacaattccccagtccaatctttgcagaccatcttgcaacagatccagcaac

SEQ ID NO: 4609 - DNA, 366 bp, Diabrotica virgifera
  Clone ID: LIB149-034-Q1-E1-E3
aaactaacgtcatacaagaattcagttgtacgtgcagatgcttacattcttttttgtggcatgggtaacctggagactttcaaaagattgttgaacagtcttcatactatggtacatactggagtcatcaacagagtagactggggtgttgtaagaatctgggatcattatggtatacaatgtgattcggtcatagtctctcggctaaagattctctggttatggcaacttcattagattatggataagatattcctcactcagggaaatttaaaacaatggagtacattgagggatcttcagttcgcatatggtttaacaattcgcgtatccactctatgcagaccatcgttcaacattttcagc

SEQ ID NO: 4610 - DNA, 396 bp, Diabrotica virgifera
  Clone ID: LIB149-034-Q1-E1-E5
aagacaagtaataacaacaatgctagctgctaaagttgtcttgtttttgggccttgcccttttcgtctcagccggtgaagaccttgacaagggttatgaaattgtggaatgtgccaattacgtaatgagagcaggagtacccgaattgggagtaccacaacacgacccctacgtcaaactcagggacctacaatggagtggaaacctcggtgttgccaaagcccatatcgagctccatgataatagatggtatggtcttgccgactgggaaattcaagcttaccaaatcagtgctgacactgacaacgaggctgtctttgactacaccacatcatggtcaaatggatttcaactctctatgaactacaatgcaaccattaaggaacttttcccttc

SEQ ID NO: 4611 - DNA, 416 bp, Diabrotica virgifera
  Clone ID: LIB149-034-Q1-E1-E6
gggccgacacacgagtcaacctttgtccaaaaaatgtacatattgccacccagttgcctgttataaaatttttaagaaacagttcgcacatcctaatcgcttgtaaacttataaaacgttttcgggatggccaaaccattgtaaatttttctaatttttataattcagagcaacaaaagtgactagtattttatgtaacaaaaaacaagctacaattaccgattatttttcaagactaaataaataattttcttattaagtatattatgtattttaatacgaaaatatttacataatctatatattgcatacatttcatattaattactgtatgcatccacataatataatgtaatttggttttttaataaatacgttacgctattggacctaatattaacattaaaagaacttaa

SEQ ID NO: 4612 - DNA, 76 bp, Diabrotica virgifera
  Clone ID: LIB149-034-Q1-E1-E7
aaaaaaaaaaaaaaaaaaaaaaaaaaaaaaaaaaaaaaaaaaaaaaaaaaaaaaaaaaaaaaaaaaaaaaaaggga

SEQ ID NO: 4613 - DNA, 345 bp, Diabrotica virgifera
  Clone ID: LIB149-034-Q1-E1-F2
aataaaatcagagtaataacaaaatagttgtagactattcgttgacaagatgaattcaagtattttggtagttttaatgtgtttgtgcgctgcacaatttgctttcggctcacagcatgagattaaagatggaaaatgttccaacgcatctcaggatgatctagtatttcgtgatcatataaacaaagcttcaattcctttcattaaaagagatgagaaggttgaatggcatggagacacaaccatttactgcctacaggtcaccaccgatcaagatgaatcaaaaggtgctacagctactgtaaaggaaggaggtgttggtcattcttttgtgaccgtcaaagt

SEQ ID NO: 4614 - DNA, 344 bp, Diabrotica virgifera
  Clone ID: LIB149-034-Q1-E1-F3
aaaaaaaaaaaaaaaaaaaaaaaaaaaaaaaaaaaaaaaaaaaaaaaaaaaaaaaaaaaaaaaaaaaaaaaaagaaaaaagaacaaaaagataaaaaaattaaataaaaatgaaaacaaaataaaaaattcttatatgggggggccctcaattaggttcagtgtttgtttttttgcaatgtcatgtttgggaccttctcaagtgttacccaatttaaatttcttggggcatttttttatttcgccagctggggtaaaaccctggttttccccatttatccccctttgaaaaaattccccttttcgaaagtggagtttaaaccgaaaggtccccccttttttacc

SEQ ID NO: 4615 - DNA, 365 bp, Diabrotica virgifera
  Clone ID: LIB149-034-Q1-E1-F5
acaccaatgacccttggcgaacatcgacacgatcggatagcagtacttataggacctgatccactactcgccgtcccacatactggccaacgggcacaacttggtggccaacagaaagatcgacacgatccgatagcagcacttatacgccttggtccactactcgccgtcccacctactggccaacgggcacaacttggtggccaacagaaagatcgacacgatccgatagcagcacttataggccttggtccactactcgccgtcccacatactggccaacgggcacaacttggtggccaacagaaagatcgacacgatccgatagcagcacttataggccttggtccactactcgccgtccc

SEQ ID NO: 4616 - DNA, 359 bp, Diabrotica virgifera
  Clone ID: LIB149-034-Q1-E1-F6
gaagaccccaaaaaagcgaaaaaagaagaaaatggtgcaaattcagacggtgaggatttagatgaggaagaagaagaggccattgaagaagaggaagacacgggcgaagaagacgtagttgaaggggatgatgaagaaatagaggctgaagatgaagaggatgtagagggcgagggtgtagaagaagaagaggatgatgacgcataataaagtgggtgccgtcaaaccctgtgaactttacttggcggactatctcagtgcaaagtctcgagttactttgtggacattttattttcattttcaagtagtcgttgttcagtgcgccttaaacgccaggatgttccacgtcgccaacggtt

SEQ ID NO: 4617 - DNA, 390 bp, Diabrotica virgifera
  Clone ID: LIB149-034-Q1-E1-F7
agaacgaagcgcgagccctcccaagcgcattatagactccccgtctcccacaagggagcagaaggcgcgacaggcagtagccgaagctacggcctctgcgggggcccagaagtggaaaatgcaaattgccggcagttcgggcaattccaggttcaaaaagaagcccgaaagagcgcctcctgcttctgattggcagtctgatagagacaaacgagagcgggagcgagaacgcgatagagagagggaaagagagagagaacgtgctaagagctcttctgcctctgacgattctccaccaccgaaaaaaatgtctttgcctccacttcctccagctgagaaggccgttagtgtgcgcaaggccatggcattgaaagaaccgccactccaaaa

SEQ ID NO: 4618 - DNA, 326 bp, Diabrotica virgifera
  Clone ID: LIB149-034-Q1-E1-G12
atacaagcctccaaatttggtttaattacactttatacttcgatgttcagaacaagcagcttatgttgttgtctgcacccaatataacgtgaaaccaaataaaaatagacggtttcgatttgattcaattcgaatctcttaccatcctctgatttttgttttccttatatttatataaaaattttccgtaattctaatttctacaacttacactagtgaataaaataattaaggttcacttgttttcaccaaaggtcggccaataaccaaaaccggtggatgaaataaaatggaacatttaggaagtggaattttcaataacaaaa

SEQ ID NO: 4619 - DNA, 91 bp, Diabrotica virgifera
  Clone ID: LIB149-034-Q1-E1-G7
aaaaaaaaaaaaaaaaaaaaaaaaaaaaaaaaaaaaaaaaaaaaaaaaaaaaaaaaaaaaaaaaaaaaaaaaacaaaaagatgaaaaaaat

SEQ ID NO: 4620 - DNA, 389 bp, Diabrotica virgifera
  Clone ID: LIB149-034-Q1-E1-H10
aagctggctgttgtttctgcggcgtgtgctatgagtcatttttaatatcgtatacatattgtagttcaaattacacacataggtacacattatctctcaaatattatattacatacatttttattgttgaaaggtttgtctgataattaactattttgattggaaataagccacaattaaattgaaaaatacaaaatattgaaaatcaaaatgtttatctgatgaaaatcggtccgggttagccggacttccgggttatcgggggccgacttatcggggttccactgtatatacaaaatatcgctagaaataactataaaacaattgctcacaatgtttgatgtgcagtgttagggtttagagtagataactgataactttcttttttg

SEQ ID NO: 4621 - DNA, 386 bp, Diabrotica virgifera
  Clone ID: LIB149-034-Q1-E1-H11
aagcattgttcgtgatactgcataaatgaaaaaagctatattttttgtattcacaatgattagctattaacatgtaaaaagttttatgttcatttctaataaaggttctgagagggagaatcttgggggggtgcttagttttggtcttctaaagtgtactagtaccttagacagatcggtgcagttcgaccttacatattatatcatatctcgactattaaaatttttttcaaatattgaatatttttgtgaaaaacctaaatatttttacaatccacaatatcaagaggtaatttaagatttgtcactttttgcattcttcaaaaccagctgccttaatattgtacataacagagaaattaataaatataaattgttctctacaa

SEQ ID NO: 4622 - DNA, 381 bp, Diabrotica virgifera
  unsure (1)..(381): unsure at all n locations
  Clone ID: LIB149-034-Q1-E1-H12
ctcaacagacactcgtattacggtatattatgtcgctagattcataacaggcataagcttatgangtggatacgttatacaaataacctttataagtgaaatagcgagtaaaaataccagaggttttgtttctacaattgcagctatgatgctcggggtaggagctttggccagttattgcattggaccatatgttccagtaacaactttaaatataattttagctgtcaatccattactagttattttggtagcgatcttgttttgcgaagaatctccctactactaccttatgaagaatcataccgaaaaagcgaaaaatgctttaaaagtatacagaaatcaaggtgtaaacgttgacgaatgaaataaaagaaataa

SEQ ID NO: 4623 - DNA, 381 bp, Diabrotica virgifera
  Clone ID: LIB149-034-Q1-E1-H2
cacgcgtccagtcaaatccacatctcagatgttacctggggcagattggcaagtattttgaatatccgcccttaatgtatcattttgaaccaatgtttccttgacggactacttttactgggctttgacccacatatttttgttgtggttggcatgtacattgcgcgtgggcactgatgatgacaggtaaaccagtcgaaaactagtgttgtgatttttatgtggcgcttttgagggtttttaaatataccttttatacagaattttactgttttttgtattacatggtatacagccaactacaggaaaactttttgcttgtaaagtttaataaaaaattgtcgtatttcatttatataattttaaattcatctatttaaa

SEQ ID NO: 4624 - DNA, 370 bp, Diabrotica virgifera
  Clone ID: LIB149-034-Q1-E1-H5
atgtgaagctaatgctgggataggttgtgaaaaaaactttacatcagttcttcatgaaaactgcacaactggtttttcctgcggtaaaactgtctggaaagttaacgatgtaacaagatatgaaagacgatgcgctgcttcaacatattgcgaggaccaaaaagcaatagcaacaagggaaaacagaacactcgttagttgcagtttgtgtaacgcgacattgtgcaactctggaaatcatgttaacattcctattttcaccttgataatatcattcttggtttcactcaaagtagtctgtaatttttaaataatattatttatataagcaaatattgtcatctttaattctaataaaaatggaatattt

SEQ ID NO: 4625 - DNA, 406 bp, Diabrotica virgifera
  Clone ID: LIB149-034-Q1-E1-H6
aaactgcatcatctagctaggacacttaattgtttcagatgattttaagatgattcaaatcttttttacggtagaaatgttgattaaaatacactgcgtttagttttcaattagatatacgcacttagaatggcaacactgccggcttcccacattcaataaggtatgtaatattattataatttatagacatgtctttataaacattaagagagtagacggcatcaagtcatagagtctcaatttcatcttcaaaatagaggtgactatttctttagttttttaatattcttttaaaaatccttacttgttaattgctttaaatattcatttattaaattaataggattattttgaactaactatctattcagtcattacaataatttatatacaatgcaataaa

SEQ ID NO: 4626 - DNA, 302 bp, Diabrotica virgifera
  Clone ID: LIB149-034-Q1-E1-H9
ggtcaggggctcacgggcccatccacgcgtccacccatgcgttcgtttaatataacatatttggaccgttattgtggacgtaaatcgttttgctagttttccgatagatacttacgtattgtgcgagcatattttgcttttatacaagagggatttaattttctgtccttgtgtgtcagggattactccgtatggtctatcgcattattactttcgatgttagaccatctgatggcttacaatttttattgttccttcaatactttacactgtattctatgtcaatgatctgtcattcgttt

SEQ ID NO: 4627 - DNA, 334 bp, Diabrotica virgifera
  unsure (1)..(334): unsure at all n locations
  Clone ID: LIB149-035-Q1-E1-A9
ggcaaaatgaacaattaaggttaacggggccccctcaagggcaaacaatccaaaccattacaaccaacaaaaggataacctaggatcccaaatttcccaggaaaacctccgggaaaccgaggggcacaaggcaggatacgccaaaggaaaggtgggttggtcaagggggtactaaattcgccgattggaccaaagaagaattcgaggctctattaaaacgccaatctgcttcaaaacccanacttgacaagagtttgggagtgtatactgccgatccaaacgttaaggtgccttcgtctgttgattggaggaccgagaatgcagtactgcctgt

SEQ ID NO: 4628 - DNA, 363 bp, Diabrotica virgifera
  Clone ID: LIB149-035-Q1-E1-B10
tgcagacgcttgggcggacgcgtggggaaagtttcttttattccaggtgtaactcttagttttaatgtgatcaatatttttaagctggaaacgtatttatttcctttgaaatcatccaattttgttgtaaatatgcagccctcattaaaccattttttgtagtaaaaaaaaaaaaaaaaaaaaaaaaaaaaaaaaaaaaaaaaaaaaaaaaagagaataaaaaaaaaaataaaaaaaggaaggaaggactaaaaaattcaagttagaaatcaaaatttatggaaaataaaaaataataaaaaggggggccccctcaaaagttcatggccctgtgtcagcttgaagtcatttcaggaacccccc

SEQ ID NO: 4629 - DNA, 440 bp, Diabrotica virgifera
  Clone ID: LIB149-035-Q1-E1-B11
cgtccgaatccttatatgttcttgttgcgtgtgcaataactttttctatgtttatttgtatttttaagtttactttactagtatttcgcggcaatagtttcttagaaatgggttctacaaggtggttggtttccactcgggtaaaatcagttttatttttcaatccggtgctcaaatttatgttttgacaagtgtattttgcttaatcctcaaaatgaaaaaacaatctataaatttgtaaaatggtggaaactggggattaggtcaataactataagacagttgaagaaccatttggatatcttatccaataactccagaacagttgacaaaccatttgactacatttggtatgtcccttcaacctggtaccgtatcaggtatcttcagtacgtttgaagagctgtaatttttgggtacttcctgttcgtcctctttta

SEQ ID NO: 4630 - DNA, 394 bp, Diabrotica virgifera
  unsure (1)..(394): unsure at all n locations
  Clone ID: LIB149-035-Q1-E1-B12
ttaatccttaagattaaaaattccagaatcctaaacccggcaaagttcccggccaacttaaaacaattaacccagttattagttaacaactccacaacgggtaaacaggttcgatatcccacaaaatcattggtccaatacaaggtccaacgttcaccctccgccctagcaaacccctaacaacaggaaacatcgcagtttcagtangaccagcagttagcagccaagtgaggtgtgctcataccgacattactgtaccagactttagccattatcgcagagatggtactaaagaccccgcaaaatcatcccatgatagtgaagatgctagaaagaattttacctatttgatggctggaggacttggcgttggtgcagcctatggtgccaaatc

SEQ ID NO: 4631 - DNA, 309 bp, Diabrotica virgifera
  unsure (1)..(309): unsure at all n locations
  Clone ID: LIB149-035-Q1-E1-B3
agacaatcacagattagacagatacgttcaactacaaccaaaataatttttaaaaattaaagttttgacaaaaccaacaattaaaggacatatcctagttttggcaattcctccggtcttaaaccgagactatttatggaattccaacagcacatgacgacatcgcagacgagtttgtcaaganatctctggagttgcagctgaagatcgcgaaagaaataaaagacatcaccggccaacagatctacgtcttcgacacatccaacacattcgcagatgcttccatcgttgttatggcgaacatcagag

SEQ ID NO: 4632 - DNA, 422 bp, Diabrotica virgifera
  Clone ID: LIB149-035-Q1-E1-C1
agttatctgtacaatgagatgcgagattttcacactaagccatcgttcaaccaaatctcgaattaaaaaaattcctgtttttatcgtagtcttagaaaaaccaccggtagagaggttttgtgctacaattaatattaacgcattcgttttggcgtattaattaaacgcttttctttagttcaatcgtttgggtcaaatctttggacgttaatttgactactttttgctcaatgcaaatgactaaaaatttgcagacatatgcattcgcggaaacaatacacgataaaaaaattgtttatgtttattaattgtctaaataaaaaaacgattttaacggaaaaatgataaaatatcgtgtttttacactgaagaaacttgaaacttttacagattgtagctagttttatgtacaatacataatt

SEQ ID NO: 4633 - DNA, 421 bp, Diabrotica virgifera
  unsure (1)..(421): unsure at all n locations
  Clone ID: LIB149-035-Q1-E1-C12
aatttttgaacaaaaaaatttaaaatttgtgtaaaataaaacttttaattttggtaataaccaaattgacattcaattgccggaaaaatatacatatatggaataattttaaggaaacatataaaaaaccgtacaccaccaaaaatgaaaaatttgaccgatttaaaatttttcaagataatctacgtaaaatcaaggaacacaatgcccgtacaagaagggacaagaaacatacaaaatgggccttaaccaattcgccgatttgactcgtgatgaatttgtcaaaatgttgggtctcagtaaaagaactcgtccaactcgtccacagaatgttacttttatgagcttttcccgggaagttttggcagatgttccagaatctgtggattggcgagataangggtgcagtacatcagttaaa

SEQ ID NO: 4634 - DNA, 350 bp, Diabrotica virgifera
  Clone ID: LIB149-035-Q1-E1-C2
tatcgacagtctgataaattgccatcttggcaattctctttaccctctgtgccgatgaggttgaaggaaggagaaaaattttgatggggcgaaaaagcattaccaggacatatcttcgtggaaatgctgttcctgcgtatgtgataataatccttgtaggaattggtcaaatcatcctgggagggatattgtacgttgcattgaggaagaagatcattgctgcacctgtaacggcatcatatgcagtggctagacaagaaccataaattttatttgtctagaatattattttctaaatatgcatcttttttaaattattgtctacgtaaataataagtctagagatatat

SEQ ID NO: 4635 - DNA, 417 bp, Diabrotica virgifera
  unsure (1)..(417): unsure at all n locations
  Clone ID: LIB149-035-Q1-E1-C7
agcccacgcgtccgctcaagggaatggtttgtacgaaggactagattggttgtcgaatgaattggccaagtgaataggtagatgttgtgaagagtagcttttatattttttattgataatgtaaaatcctgttttatttccctcagtttggtagaattcatacaatattgcttctatgttgataactttatatgtttctatcattaaaatatggataattttatccaaaatctagctaaaccactatataacgcgttggctgtgttacgagacaaatagacctcgtattatactaacagttggctctgtcgactatgttgtaatacactgtggcattactggacatatatgcctcgtaaagcaatcaatgcgggcttatnaatatctctaaatgcagccaaagtattaatcttagct

SEQ ID NO: 4636 - DNA, 310 bp, Diabrotica virgifera
  Clone ID: LIB149-035-Q1-E1-D2
acccacgcgtccgccaagccttcgattaacaatccataaaggcaagccaaaggactaaaaaggaagaatccaaataataattaatggaattggtaactaatggaaaaggtcaaaaatttaaagaaaatgaaaccttaaaaatttccaaaccaaccaaaatccagaaaccttcaatggaaggaaaaattaaaccaaccttaaaatagaattcaagggattaagttcgaagaattatgagctaaaataaaccccaattatttggaaattaatttaaacccccccaaaagccaagttcccattaaaaaggtgg

SEQ ID NO: 4637 - DNA, 380 bp, Diabrotica virgifera
  Clone ID: LIB149-035-Q1-E1-D5
aggagtaataacaaaatagttgtagactattcgttgacaagatgaattcaagtattttggtagttttaatgtgtttgtgcgctgcacaatttgctttcggctcacagcatgagattaaagatggaaaatgttccaacgcatctcaggatgatctagtatttcgtgatcatataaacaaagcttcaattcctttcattaaaagagatgagaaggttgaatggcatggagacacagccatttactgcctacaggtcaccaccgatcaagatgaatcaaaaggtgctacagctactgtaaaggaacgaggtgttggtcattcttttgtgaccgtcaaagtagagtctggtagaggacatagtttggattagtacgtagaagtt

SEQ ID NO: 4638 - DNA, 289 bp, Diabrotica virgifera
  Clone ID: LIB149-035-Q1-E1-D7
agccgacgcgtccgcacacgctgtcagcggacgcgtgagcaaagagctgtccatcagtcaactggtgataatgagtacacctatgatctacactacatctctgtaagaagacgggcacggcatatcgtaaactataccgtcacactaaagagcatcattagagatcatgatcttcgtctggatgtgatctctcgtaatctctctacagcagatcaaaacctggagatatacaaggtgtgtaaattcacagtataaatagagataaattgattcgcacatcagatatcac

SEQ ID NO: 4639 - DNA, 424 bp, Diabrotica virgifera
  unsure (1)..(424): unsure at all n locations
  Clone ID: LIB149-035-Q1-E1-D9
gtcatcacgcgtcaggaatacccaaattggaattacaaaacacgaaccctaagttaaactcaaggaactaaaatggaattgaaaactccgtgttgcaaagccaaaacaactccaagaaataaaggatgtcttgcgacggggaaaatcaagcttacaanatcagtgctgacactgacaacgaggctgtctttgactacaccacatcatggtcaaatggatttcaactctctatgaactacaatgcaaccattaaggaacttttcctttcacagcactactcaggaaccatcaagataaccatgaaacaaccagtatggactggaagaatcagcgcacaaaaaacccccactgacttaaaacctaacaccactgtagacagttttaccgtcgactggcacgttgcagatgtaaaatgcaaaatcac

SEQ ID NO: 4640 - DNA, 377 bp, Diabrotica virgifera
  Clone ID: LIB149-035-Q1-E1-E5
cccacgcgtccgcccacgcgtccgccttcatacacgtttgtgataaaactattttagaagaagaaaaagctcaaaatacccagaagcaagtttcttataatctagtttaccctgccttcgtttcccataactttttagaaaagggaatttgtttagtacctgtaaaaatcctactgcacagtattgtcgataataaaatccttgatgtctttgtaaatacgacggaaccaagtgtaacgcagcctgagataaataaatcaagtttattttgcacctatgcttccagtaatttctgttggttgggaaatagtaaaaacctcagaacattgcaccctctgacgaccgagagtatttcgttaacagctgctgtgtcggga

SEQ ID NO: 4641 - DNA, 74 bp, Diabrotica virgifera
  Clone ID: LIB149-035-Q1-E1-E6
acaacacctatagtgagtcgtattaaggggtcaagggtagtgcacgttcgggagagtacaaggatagtccagtg

SEQ ID NO: 4642 - DNA, 173 bp, Diabrotica virgifera
  Clone ID: LIB149-035-Q1-E1-E9
ccacgcgtccgcacgtgagagcaggttgggttccatccttaaattaataacaaaattttattacgatagggacaaaatatataaaagaattttaaaatttagataaatattaacacaaattaaattctagtaccttgtgtaccagggattattaattaataaataaaaaataa

SEQ ID NO: 4643 - DNA, 445 bp, Diabrotica virgifera
  Clone ID: LIB149-035-Q1-E1-F11
ctcacgggtccacgcacgcgtctgtactgacgtactattcctgtacactttccttcgagtggtactgaattagaaatttcgtgtttattgatagattgcgatgataatgtcacagcgaagataactgcaggaattggatttcaggttacagtagatgaattggtttttgaatcatgggaaccatcaacctgtaaaatacaaatttatacttcacatgcagatcttacatctgcttaaattacactacaaaaaaaatattttaataacaaattatcacatttcatttaccattttcaaatttatcaatttaaatttattaaaaatgaataaccattttcaatttattaatttatgaaatgtaggcaccaatgggcttatttgtcgagctactttgtgtacatgaaaaaataaataaattagtaaactatgaaaaaaaaaacaaaaa

SEQ ID NO: 4644 - DNA, 374 bp, Diabrotica virgifera
  Clone ID: LIB149-035-Q1-E1-F2
ttttgatccattttaaaagtacacaatcttctatcggacgtgtccttaagcatctgctttacagctacttaattactactgtgagagaatatttaatttttatgctacaacgcatcaactcgtcgacccctgctggtacgaggattaatcattaacactttagacatttatcattttcgcattgagtagagctaggtgtctagaatttttactgtaacatctgtatgtaatacatgtttctcgtcatgcaatctgattctgtctaaatacactatcgaagtttcaacgagggatgtccaatttattcattaacataatcccgatcattatgtacagttacaacactactacgtcatacttttacggatgagcct

SEQ ID NO: 4645 - DNA, 312 bp, Diabrotica virgifera
  Clone ID: LIB149-035-Q1-E1-F3
aatcaatcttcagctgatacattagttattagtgatagtaatgataattgtgaactccagatgttgcaatagtattgtgggataatactgaaattttatggagatccagttcaatacctgtatcatgcgtatcagggattaacagtaaagtgcgatctacctagtattttcgacatctgtttatgcaaatcaggtcgattcctaatgtagcaaaactattccacatacattgattgaaatgacctgcaagtcgattttaactataccgaagtatttgaagcaataggtttaatatatgtagctgcaatccag

SEQ ID NO: 4646 - DNA, 433 bp, Diabrotica virgifera
  Clone ID: LIB149-035-Q1-E1-G10
taaacacacgtctgcaatgttaagcaacagaaatagtcttggacttagtgttctacccctctagaaaatatgataaaagctgattattaatgtgtatgtaatttttgaaaaaaaaattacttagtgcggtatccctccaaagtgcagaaatatttctatgtataccctaaaaaaatcccaaatgcaaaaaactgacgcaactttagtcatgtcagcatcatgtatttgtaacttttggtaacaatagtaaaatttgatttttataatagtttaattttgttcctttttttatttgttcacttaagttgttgaaatcacaaacatttttccacaaaaatatcttgttccataacctaaatcgaagatgtaatatatccaatgctttatagagtggttattgtagaataaaatgtaaaaaatataataaaatata

SEQ ID NO: 4647 - DNA, 382 bp, Diabrotica virgifera
  Clone ID: LIB149-035-Q1-E1-G12
taaaatgcgacttgtctaaaatgctgcttaaaattgtcgtcgtttgctgctgcatttcaattgcactcagtcaagctgttggaaaatgtcccagtgtagatggtagatatccagtataccttcctgatgcaacatcctgctcaacattttatgaatgttctaatggaacaccataccaattcaaatgtgcgtatggaacatatttcgacagccagagcagaatatgcagacataaacgagacgtcaattgtggcagtagaaggagagattagtactccagttaaaaaaatgtaaatttgttttaattctcgtagtacctgtgatacacatattttttatattgtgttaaaaattaaaaaataataaaaaagtgattacatct

SEQ ID NO: 4648 - DNA, 193 bp, Diabrotica virgifera
  Clone ID: LIB149-035-Q1-E1-G3
aacaccctatagagagtcgtattagccgatgcgtcgtgtgacggatgggtaggtgtgtctgggtgtacttttacaatttttgttcatgagtgagaaatggagcgtatctcatacatggtggcagcgtggatttcctcctaatttcaacgtgaattttggccgaccagctgtgatatttttcatcgttatagtg

SEQ ID NO: 4649 - DNA, 448 bp, Diabrotica virgifera
  Clone ID: LIB149-035-Q1-E1-G7
actcgcgggccgacacacgcgtcaacacacacttctacgaacgcgtccggtgacgcgtggcgaggtgtaagtacgtgtagttttacaatttttgttcatgagtgataagtggaacttttctcttaaatttttgctgtctaatttactacctaatatcagtatgactatgagacatcgagctgtgacatttttcatcataatagtgtgtatccaatgccaatcatcattaagtgatctatatgctgacaaattaaaaggtaaaatagagcaaggtctatgagatttaaacatagacattccagatgtagatttaaattctacgagtatgccaaatgccgaggatatccaaaaagtgcttagacgaaaatgctataataaaggatgcaactgacgcagtaaatttaataaaggaagaacaggaaaacgctcgtatttgcatagacaaata

SEQ ID NO: 4650 - DNA, 144 bp, Diabrotica virgifera
  Clone ID: LIB149-035-Q1-E1-H3
tatagagagtcgtataaatggcgttaatttagcgctcgttagtactttcatatgacgtgtatgggcagtttaggtcttcacagtgctttggagtgggatgatgtactgttagacaattgcagagtacggtattgtcagatctag

SEQ ID NO: 4651 - DNA, 338 bp, Diabrotica virgifera
  Clone ID: LIB149-035-Q1-E1-H6
ccgggccgacccacgcgtcaaacccaatcagctgacggaggtgttgtcgacatcatcaaaaaggtcgtgcacaagcttgaagacataatggaaaaggtttttactgaaggtcccaatttcatcgacactttccctgacaagtatgacgaccgccttactaaagtgctagatgttacaagggccgtgcttactaaaatcgctcaagcacttaaagttgttatagataaagttgctgaacaaagtaatgatgctggaaagaaattggtttcctgtgtcgaacaacacgaagctgatctcgtcaatatccgcgtcgctctcgtcgaaagtgccggcaaatg

SEQ ID NO: 4652 - DNA, 422 bp, Diabrotica virgifera
  Clone ID: LIB149-035-Q1-E1-H7
aggggattattaattaataattatatatttattattttcgaatttaaaagagctaaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttaataaaatataaaattaaaataatttaaatttagtaatgatgataatataagtattaaaaaattgta

SEQ ID NO: 4653 - DNA, 313 bp, Diabrotica virgifera
  unsure (1)..(313): unsure at all n locations
  Clone ID: LIB149-035-Q1-E1-H8
cccacgcgtcagaaccaggttgtggatttgatttaggtggcggttgtgctcactctaggtcataccaaataatagccgaatcattgactagcacaaggatttgttgacaacagtgcaataattatgaggaatatcagaagggtanatgtaccggaccaaaaagctagcatgggaatgttccatattgataaaatggcctctggttcctactaccttaaaacacacagcatatctccattccataaacgataaagatgtttattgtactacatagttaaataaacaataaaatctaacgtaaacaacaaatata

SEQ ID NO: 4654 - DNA, 419 bp, Diabrotica virgifera
  Clone ID: LIB149-036-Q1-E1-A1
aaccaagccttcaggaaaacaccaaaatggagaatggtttaataattttggtccccggctgtttggcaaaagccaaaattaatcaagatatacatttccattgggttcaataaaccggggaaattacagagaatgctataataggcggatcaactgctgatggtgatccaacgtatgtagcccgttccttcctcagtgcagatgaagatgatgaaaattactctggaagtgactacaatggttatgtagctggtggtgtgttacctggaaaattgtcgatcgacctctgtactccgcagagtatatacacgctcacaaagaacattgagatactgactgtggtcaatggaacaaaaatcgaatggattaaatcctaccagcacacattcatggacctcctcaactcagacgactatcgt

SEQ ID NO: 4655 - DNA, 409 bp, Diabrotica virgifera
  Clone ID: LIB149-036-Q1-E1-A2
agcccacgcgtccgagtttgtgaaggttctttaggtttagcaattttaattataatagttcgtgtttatggtaatgattatattttaactttttcttctttatgataagatttttatttagattaatttttttgattcctttatgttttaaaaaaaatttttgattaattcaatgattaatatttttttttacatttttatttttttttaattatggtagaggtttaaattatttctctatttcaaatattttaggtattgatttttgatcttatagtttaattttactaagattttgagtttgtactttaataattttagctagaggaaaattatataaatatggaatttattcaaatttatttttattagtattaatttttttaatattaagtttatatttagtatt

SEQ ID NO: 4656 - DNA, 391 bp, Diabrotica virgifera
  Clone ID: LIB149-036-Q1-E1-A3
acaatggactccctaacctccaacagaaaaccaacctaaaatacgaaccttaaaattttgtttgcaaaaagggaattaagttagttaaacataagttgtgaaattgtatttatatgaatatatagctttatgttttagttagatgcatgtctgaatcattggtgataaggcactttaaaaaaacggtgtatctttgtgattgattatatattaccagaataaaagtgggttaaaatgtatcagcttgatgccttgatctaaataaaataattctcaaaaatattgttaaatattatatatcacagacagttttcgacatgttgactagtctgtgttttggcatgaatgttctttaccacttaattgtctctaatgaatctttcgtactctt

SEQ ID NO: 4657 - DNA, 414 bp, Diabrotica virgifera
  unsure (1)..(414): unsure at all n locations
  Clone ID: LIB149-036-Q1-E1-A7
caagcgtcaagcatgtttcgcgccagcgctggtttgagtacccaaacatcacctgaagtaaatttaacaatttattatgaaacttactgtggcccaagtcgacaaatgatagaagatatcctgatacctgcatatgccaagctgggagatattcttaaattaaacttagtctcttatggaggagcaatgtacatgatacattcgaatgggtcaatcgaattcaaatgcagccatggccactatgaatgctttgtaaaccgaattcatgcttgtgctatcaatttatctccaccacaagcacagctattaaaattcattgagtgtgacctcagaaaatcaatgttcaatacaaatgatgaacttttagaattcgcanaagaatgtgccgatgacagcaatttaccttacgatgat

SEQ ID NO: 4658 - DNA, 310 bp, Diabrotica virgifera
  Clone ID: LIB149-036-Q1-E1-B1
aggatcaaaacacctttgcatacattcactccatttggtaaagcagttatttccagtcgacagttgggacctgcaatatcactgttttaaacgcatcgatggcttcatctggtgactggaatcgctgcacatgcattgacatcgtaaactttatgatcgtgatgaagtcgttgggacctggtctgggctatacagtgaatggtttaacatttcgatgttttaaagttccaaaaactctattgtatttttggcagtgtgcagacttgcattgtcctgatgtatgatgattcgccgttgactgatgttttgt

SEQ ID NO: 4659 - DNA, 404 bp, Diabrotica virgifera
  Clone ID: LIB149-036-Q1-E1-B2
ccacgcgtccgcggacgcgtgggctccaagatgaaggtactcattcttctttccgttgttgccttgagcagctgcttaccagcatccagaaatcaacaatacgttgatgtagactacaacagctacaacgctcatcccgtctacaacttctggaggacttggaatcagcaacactatggacaagaaccatggaaccaatgggtacaatatggtgtccagaaccaacccggtaactactggaggcagtacgtgcaacgcagcaaccaagctgaaaatgtcgatttaccttggatgtatcactcttgggatgtccaggatgtgcaaaacttaactcccgttcaacgtgttcagttgctactcaactacgtcagactttcacaacaatggaaccaatggactcatga

SEQ ID NO: 4660 - DNA, 426 bp, Diabrotica virgifera
  unsure (1)..(426): unsure at all n locations
  Clone ID: LIB149-036-Q1-E1-B3
cgggccgatacacgcgtcaacagttcttgttaatattcccattattcttaacaatacaaatacgcagaatataacattatttaatgaagaaactggtctctctacaacattacaatgttgtactgtaattagcccaagggaatgcgtctctagtcctcaacctcgttgttttcattatagaacaaaagaatgcggaagtttttgcacagcatctatagtccataaagaggaacaaaagttgtgttcagttaattacccaggggcggcaccatcttgctccaaacaaatctattatataccccaaccacaaccgaaatgtacctaccaatcagtttggccttatgtatcatgtggaatacagaanaaagaaacctgtcaaggctgctattcncactacgtcaatggaggtactccaaattatctgac

SEQ ID NO: 4661 - DNA, 406 bp, Diabrotica virgifera
  Clone ID: LIB149-036-Q1-E1-B5
agcatggaggtgctgtcgtcgtccaaaattgccttaacaattctttcagtattatttttatgtcaacatactcttagtaaaataactgtatcaacccatgatgcaaggataaaactacatgatacatttttaattgagattacattgccaggtgctgatattaataaagaggacactatttcattagtatcacaacacacggatattatcagtcctaatgtctcggaaattattttaaaggacgtaacggacggcgaaaagtttccagttagtataaatacatcacgtgctggacattctgatctatatgctaatgcttcatctaaccagaccgatgtaagcgacgtatacgttcgctttactgtatacaaaaacgatggattagatacattctcagctattatag

SEQ ID NO: 4662 - DNA, 174 bp, Diabrotica virgifera
  Clone ID: LIB149-036-Q1-E1-B8
tagtgagtcgtattaatgtaagaaatgtaatagagattgtttagcaagatttcaaaatggaggatattgcttccaaagggaatgtttctgcattaaagttgatattgatatttaaactattgtaagtaataaaaataattttataaatttgtataccaataaatatacttaagt

SEQ ID NO: 4663 - DNA, 431 bp, Diabrotica virgifera
  Clone ID: LIB149-036-Q1-E1-C10
taaacacacgtctgctaacgcgtccgtttcagataattaccgaacaaaaatcagtattatgaaagttaccggtactttggtgatacttagcgtttattttgtgttaagtatagtcgactctgcaacagcgagacaagtgcctagaagacagttgctttcagagaataaaagtgacattgaggaggactgtaagaatggactacaaaattattacaattacccttacgactgccagaaatattacacttgtagagaaggaaaattataccttagtacatgccaagacgatttatactggaatagtgaacttcgcagctgtgatattcaagcaaatgtgaattgctcaaagataattccccttccacatccagtgtgcacggattctagaacaacgttctatatttacccttacaactggcaaaaaatttaag

SEQ ID NO: 4664 - DNA, 403 bp, Diabrotica virgifera
  Clone ID: LIB149-036-Q1-E1-D2
agcccacagcgtccggatgctagaaacttttgtaaaaaataaagttttttaaacactttaggaaggttctaatgagttttccacgaaaagtatttgattttttggttgtttcatgttaaaatattcgatttcgaatttgacgtataagaggaacttttcattggctgcaacttttcttttactgggtcgataaacttcatttttttattagctacatttttgctaacaatattcttttaaattaaatacttactccttgaactaattgcgaaagattgcctaaaaacgtgttttgtttgttgaacaataaccattatttttactcataagtaactcgaaaagtcttgagttgaccacttcggtggtgacactgaaaaattacatggtattgctatattttacg

SEQ ID NO: 4665 - DNA, 408 bp, Diabrotica virgifera
  Clone ID: LIB149-036-Q1-E1-E12
acagacacttgtggtacaaacgtcatgatttatttacaaataagttaaatcaaaacattaagtgaaaggtgtgtcgatatgtaatatctttgataataaatatgtactgtcaatgtaataattaggtaatggatattatcggtggacgtattttataaaggtatattgtaaatttatatttaactattttataatatatttaacacaatataactttataatacatataaacacaaaataagttataaatttcaataaacacaacaaatgtgctaatatcactgtcactgaaaatgatacacgtcaaaattcatagtaaacaaggtattaaagacatgccgtattgtttatccttgtttagcttattgtggtttctatggacaaatggcttagttttgcgatactagt

SEQ ID NO: 4666 - DNA, 234 bp, Diabrotica virgifera
  Clone ID: LIB149-036-Q1-E1-E4
agtttattttaaaataataaaatattttttagtaaaagtaaagaaaaattttatttaatgatagttaattagtattgtgaaaagaatatttaatttttataaaagaaaaattaatttttggaacctgtgttacaagggataataaattattaataaaaaattaataatttccgaattaaaaggagctaaaaaattaaaattttaatggtaaaataaatattttaaataattttt

SEQ ID NO: 4667 - DNA, 297 bp, Diabrotica virgifera
  Clone ID: LIB149-036-Q1-E1-E6
tgcaactcctatagtgagtcgtattaatgctagagtaagtaatgagattttagtagatgttaaggtactttttatttattgatagttaattagtattgtgagagattatggtatttttattaaggacacatttcttttttgtaccgtgtgtatcagggattattaaataataacttatatgcttactaatttcgaacttaaaagtgctaatgtaatttgatttttaatggggcatatatagtttacatcatttttttgtaatgaaatgttagtcgtttttaaatatatcgaattttt

SEQ ID NO: 4668 - DNA, 87 bp, Diabrotica virgifera
  Clone ID: LIB149-036-Q1-E1-E9
aaaataaatcatacaaaaaaaaaaaaaaaagacaaaaaaaaaaataaaaaaaatgaataaataataaaaaagggtgagcagcacaat

SEQ ID NO: 4669 - DNA, 408 bp, Diabrotica virgifera
  Clone ID: LIB149-036-Q1-E1-F1
gctttggataagaaacacgcaaaaatgaagactacgtggatatttttaggcctttttttaatttgtgccaatgtcaaaattattttgggattcgattcgacaactggtctctactcttcttttataacgaatcagtggccagaagaagtaattgaaaaatttagggaacataagacactctttgcggtactgactggaaaatatttaaaggatgatatgctttcttgtgttgcatgcaatttattattcaccggaatacttttagaaaagaactatgatatgactagtattcaattatcatctgaagctgaatatttctgtgagatattaggcttagaatctacaaatgtctgtgacggtgttatataccctcatgtagatgttcttagctatataatcgacaacaaa

SEQ ID NO: 4670 - DNA, 405 bp, Diabrotica virgifera
  Clone ID: LIB149-036-Q1-E1-F5
agcggacgcgtgggcggacgcgtgggttgattagtaagtacttcagtaccattcagttttaacctcgagatatcagatatttaccagcaacttcatcatggctgatagagattcaaaggcaaatactgacaatcgggccacacagctaaatgccaacaatgacagattctatcaaagtagagggcttgattctaggccagataattggaaggatactgcttcagccggtggccaaggatatacccaacaggatagagacaacagatccaatcagctgaatcccaacaatgacgcttatggaaaatccaggcaaaattagcaaatatttactaacggcaatgcatattaatactgtgtattttaattcatttttgacatagtgttactttaatatttcaataataa

SEQ ID NO: 4671 - DNA, 408 bp, Diabrotica virgifera
  Clone ID: LIB149-036-Q1-E1-F7
agcttgtagtttctagttctttagcatttcctgcaaaggaagaaatttcaacaaaaaatagcaatgtaagattttatgaggcagccaacaagactcccttttcgacagacaacattacgatcgattatagtacaaatgaagaatttggcctgaatattacagctatttctcgagttaacaatcttgaagattttctattgcttgttagcaatctaacacacaacgtttcaatactgaacattggtcaattgtcattcggacaatcttcaaagcataaattaaatccgtttgaaaagaatgcttacgttgttgcggaaactgtctcgacattcagcgtttctaaagaaggtgatttggttcttaacgcaagtgcaggcactgtgcagtctctgaaacttgtaacagatt

SEQ ID NO: 4672 - DNA, 409 bp, Diabrotica virgifera
  unsure (1)..(409): unsure at all n locations
  Clone ID: LIB149-036-Q1-E1-G1
agcttaattttaacaacgtttttgtcgtctgtacaaaaatcttacacaaacgcaaagtgtgacttatatagatagatctatagatatagaaatatttgcttcaaaagttcgtacacaaaagtaagatgaaatttctttatatacacgacagtttctttgttagaattaaaaacgaatcattatatattcttactatataaaaactgctacgttagaaatatttatcaaatatatattctatgcatatatgcaacaaatggcagctcactcaacaaccaaagcaccaaggacagatgtattatgtagtgtttggtttttgaaatcatgctatttttgcaagtgttatatcaataaatactagcttgtttagaaagttttgtagcgaagtanaccatcgttattccttaaa

SEQ ID NO: 4673 - DNA, 328 bp, Diabrotica virgifera
  Clone ID: LIB149-036-Q1-E1-G11
aggagccattggttcattgtcaggattgatgactgaagccgaaagcatttaattttcccaataacatgttgtgatctactctgtcagatgacttggataagtcagtattggtagtatcgatctgactttgactcgccatcgcgtttaagactttttgttcagagagtattaaagttgttaccgttgatgtattctgagagtgtccatgttgattgtgtattagacactctttacgttatgcattgaatggctggtgcaatgatctctcaaaatcttatggaatagaggattgtttacaagtgcttctataagttgttaggtcttgttt

SEQ ID NO: 4674 - DNA, 440 bp, Diabrotica virgifera
  Clone ID: LIB149-036-Q1-E1-G12
cgggtcgatacaagactctaccataatgtcttaatattagtgcaatgtctaaaaagatcgttattttagctttagtgtgctattttgttgcacatgtccaatgtgaacctgatgtcaattgtccggatcctgcaaatccgggattactgttgtttagccaacaggtctcaacgatatttcgggaccatataagtgaacatattccttcgagtggtacattgaatacaggcatttcgtgtttggtgcttaccagcgataataatacctcaatagaggtagttgcgggaggagttggattcaagtatgtcaaaattgaagttttctcattaaattggttgcaaagatcaaactatggaattgaaatttatgttttacagccagatgttaaattgccttaaataacaacctaaaatattttaataaaaaattggtagcatttc

SEQ ID NO: 4675 - DNA, 316 bp, Diabrotica virgifera
  Clone ID: LIB149-036-Q1-E1-G2
agtgagtcgtattaaggttagcgcacggatcgttagggatgagcgtgagcagacaatttgactacgagggaagttttagataaatattgggccttgcgtctcagggattgtgacgtacgttatgagatagttagagagaggcacagttttacgtcgttacagagttggtattacaatgtaaatttagggttatttaaatttactactgacgagaatattagtattagggaattgtacagttagtaaaaatatataggtttaagacagggagtcggcagcatgtttttcacctgtttattaaaaacatgtcgttttg

SEQ ID NO: 4676 - DNA, 264 bp, Diabrotica virgifera
  Clone ID: LIB149-036-Q1-E1-G3
agcccacgcgtccgaaaaaaagtagaaataaaaattttgaatgcaggaaaataatctgcacaaggacaaattcatgattgaaaagatgtcgaaatgtaaaaaagagttgcaaatttcgacggaacgtaaatatttgggtgactggtacgaacaaggtagatatccaactttactgtaagatgaggggctatgtgttgttaccaatattgcagtaggcaccgatggcactataacgagtcgtacgcaatatatcaattcaattac

SEQ ID NO: 4677 - DNA, 399 bp, Diabrotica virgifera
  Clone ID: LIB149-036-Q1-E1-G5
agcccacgcgtccgctctttgtagatatctcttggaaacattaatatgctgattggaattctttaattattttatgaaaatattatggttgatttatggcacctgactgatttcagatctccaaatacacattaggaaatcatgaggagagaccatttttatttttccatatgaacttttctatagaaatattagcttgctaatatccactaactagtagaagattgtaatgtcacatttatttaaagaaatggcaggatagcaaggattttattttctttaaaaatgataaattgcatacctttgaagaagacaacatattactcctatacatttcatcaaacaatagaacagaagaaaccacgataccagatgaggaaacacatggaattcagttca

SEQ ID NO: 4678 - DNA, 356 bp, Diabrotica virgifera
  Clone ID: LIB149-036-Q1-E1-G8
agcccacgcgtccgtacaaattcaagtagcgagatgatgaaagtgattaaaggttttttaattttcattgttattaccagtatttcctcagaacatgcttcgcttagagctacagaagcagacatcagattctagttgtttacccataaagacctacttcatggtacacatctaaagacttccgacaaaggcgaaatcaatggatctgaattctcgaaagacaaagacacggtgttctatattcatggatggctggacaacatctcctccgaaactctgataagtttaaagaatgcctagctgtcaaaatatgacgttgacatgcttgttgtcgattggagtacgttcgcagatag

SEQ ID NO: 4679 - DNA, 329 bp, Diabrotica virgifera
  Clone ID: LIB149-036-Q1-E1-H1
aaataactcatattaaaaataaaaaccttcataaatttcaaatatttttcgggtgtgtaatgggaacactggctgacctactaaagattttttagggcagctacccaagcggttcatctcctaggtggcaatattacaacgtcacaccacttctgtgatgactcctctgttcatgtcactccacgtctatttacgcactcgtttggggtacaacccaacgttgtgacgaatcagacactattgttaaaagccccagttcgtaaccacactttcacttaatgaggccactccttcttcccgttcacatttattgcgactttccattaggc

SEQ ID NO: 4680 - DNA, 114 bp, Diabrotica virgifera
  Clone ID: LIB149-036-Q1-E1-H11
gccctcactgtagccacaagtgacaatcttggtgccatcgagaaatggactaattatagggtcacccagaatattacttactacgttattgatgcaatttttcggatcacagga

SEQ ID NO: 4681 - DNA, 419 bp, Diabrotica virgifera
  Clone ID: LIB149-036-Q1-E1-H4
cgcgtcagattaatacagagccaaaaatgaagctaacaggtgtatgttttttaatcgtggctttttgcgctatcaacgcattagcaagcccttccgatccggatgatccatcaccagatgaacaaactaatgcaccatctgtttcaacatcagattctccacctgacacagtaactgattcatcatctactgcacctacagattctacacctgacccagcaactgattcatcatctactgcacctacagattctccacctaacccagcaactgattcatcatctactgcacctacagattcttcaactgacccagcaactgattcatcatctactgcacctacagattccacacctgacccaacaactgattcatcatctactgcacctacagattcttcaactaacccagcaactgat

SEQ ID NO: 4682 - DNA, 408 bp, Diabrotica virgifera
  unsure (1)..(408): unsure at all n locations
  Clone ID: LIB149-036-Q1-E1-H7
agcgttgatcttaatgttaccgatttcattgttcatgtttcgaatctgtaattaaatatgggaaaaattaaggctcgtactaatcttattttggtgttcttcgacaagaagtgatctttccagattttcgacaatcgactcatagcgtttttggccatgcctattctcctacgtatttctgtttcacaagatcctgtattactgatgtaggataagacaaattggtaaaaatttggtttaattaatttttgtaaaattaggaaaagtgttgttgattcaaggagtttaagacaatacaactttgaagaaaacttagtaagtttcaanatacttctgaacacggtancttctgaatacttanaanatcatcttgtttgcatttggctacaaccctagatatgcacaact

SEQ ID NO: 4683 - DNA, 315 bp, Diabrotica virgifera
  Clone ID: LIB149-037-Q1-E1-A10
caccctatagagagtcgtattattaacttgcgtcggtttaaccgtcagcgctcccccagagaacgacgtcctgtgtgatggctgcgtagcattgacacaagtgagtcaggaccacttagaacaagacttgccattggacgaacttgcggaaatagtaagggaagggtgcagtgcattaccagatccacttgcagatatatgcaagaatagactgattccagcagtctacaacatataccaccgatttgaggacgcctcgcctggcgaaatatgcacagttttagacttaggtgagacaaattaatatgatagtca

SEQ ID NO: 4684 - DNA, 338 bp, Diabrotica virgifera
  unsure (1)..(338): unsure at all n locations
  Clone ID: LIB149-037-Q1-E1-A11
ccctaagtcgtgtcatattacagcgcacannaggtccccactgtcttaacacctaagcccattgtagacagttttaccgtcgactggcaagttgcagatgtaaaatgcagaatcactgggatgggaataattggtgacaggtatgctctcgctattcaagaaggtattgaaacgggcctcaaccatggtcttatcggaaataccgtcggagacttccttaaaatgagattcaacactgtcgggtatcccactgggaaagtctggcacatgatggcctggtgcaacggcgggtccaccgacgctccaacaacaggtgcaccatacagaaatggaccctc

SEQ ID NO: 4685 - DNA, 202 bp, Diabrotica virgifera
  Clone ID: LIB149-037-Q1-E1-A2
gtcttgtgatagattgtttcaattgtatgtaactctttgtttactttgtgtgccatgtggatcagggattacgagatgataatgcataatatatcatttcgcgacgtttctcagagctatgggattaaagtattaactttcgacttaatagtttaaagccttattttgtcgtgaaaggtgagtcggttttaaatatgtctag

SEQ ID NO: 4686 - DNA, 248 bp, Diabrotica virgifera
  Clone ID: LIB149-037-Q1-E1-A4
ttggtctcatggcatttgcttgtaatttcgttatgagaacattgacagtttggttcctcattcctacagtattagctgcaataatgttttattttcaacgatttgtttagggtaccatatgtagcaaggtttatataggtggtatcatattattatagtccattctttattcatctctctcaatcactacaatgtctaatgtccatcagatcatttagagctcatttttgactcaaaaatgtaattcg

SEQ ID NO: 4687 - DNA, 344 bp, Diabrotica virgifera
  Clone ID: LIB149-037-Q1-E1-A6
tgagtcgtattatgctcgatcatgtaccaagtgcacgaaacattgtaagacattaggtgaattgcatacacatattttagaatgtgtacgagactggacttggatgttagcaaggaagaagtgtaaatatatatatggtgctaaatctacacgaatacgaggatgtttggtactaagggttcatcatcataaatcaaagactgattctaccgaaaagaaaatatataaatatgatcgacccaaccagcgcacaagtgatgctgatacgatccaaaggatgttggccaacctaccagcgaatcgctctactcgaaacttagtatcccactagtaaggaatccgac

SEQ ID NO: 4688 - DNA, 340 bp, Diabrotica virgifera
  unsure (1)..(340): unsure at all n locations
  Clone ID: LIB149-037-Q1-E1-B3
gtattatatnaatgtgggtattcatataaattgtttcaaactataaaaacatgcaaaataggcaaagctattttaatcttaatgatacatttatagaaatgccaagataccaatattgggacagagaattttttttctttatagagttttgataggcagttatcttttttggattattcctactcaattcgtactactttcgttgacaggtttttcttttggttttttttttaagtttctccagttttcaattcgtgttatttttgagatttctaattgcagattgttaactgctttggaaatttccagttaattatccgtatacttttcactattattc

SEQ ID NO: 4689 - DNA, 51 bp, Diabrotica virgifera
  Clone ID: LIB149-037-Q1-E1-B5
ccctcaacctgatctgagtcgtattaagtagtcctctaagcaatctgcggc

SEQ ID NO: 4690 - DNA, 326 bp, Diabrotica virgifera
  Clone ID: LIB149-037-Q1-E1-B7
ctgagtcgtattaaatcaagaggatctgattctcgatttaaattagtcatctgtaattacttcctttactaaatgaggtactatttggtggtactaaagtgtagtatttatgtgctgatactgtcaaggatcactaactagccattatttcgattactatagtgaattgaacaatggccaaaatattgtctcatataatgtatctgatgaatgtgaactactttttttgtaattcggtgttattcatatctacgtaaatccaacttttactgatgttcattcatcttaacctagtcacaatctaattcacattcaatccatatata

SEQ ID NO: 4691 - DNA, 211 bp, Diabrotica virgifera
  Clone ID: LIB149-037-Q1-E1-B9
gtcgtattatttaggccgcgcgcgctttattttttgccccttgtgtgtcacggattattaattaatagctatcgacttactagcttcgagtttaaaagagcggtgggattaagatttttattgtgaaatacagtggttaagtaatttttttgtagtggagtgttattcggttttaaatatatctaattttttagcaaataggctgaccttt

SEQ ID NO: 4692 - DNA, 353 bp, Diabrotica virgifera
  Clone ID: LIB149-037-Q1-E1-C10
acccacgcgtccgcccacgcgtccggtaataacaacaatgctagctgctaaagttgtcttgtttttgggccttgcccttttcgtctcagccggtgaagatcttgacaagggttatgaaattgtggaatgtgccaattatgtaatgagagcaggagtacccgaattgggagtaccacaacacgacccctacgtcaaactcagggacctacaatggagtggaaacctcggtgttgccaaagcccatatcgagctccatgataatagatggtatggtcttgccgactgggaaattcaagcttaccaaatcagtgctgacactgacaacgaggctgtctttgactacaccacatcat

SEQ ID NO: 4693 - DNA, 72 bp, Diabrotica virgifera
  Clone ID: LIB149-037-Q1-E1-C2
aaaaaaaaaaaaaaaaaaaaaaaaaaaaaaaaaaaaaaaaaaaaaaaaaaaaaaaaaaaaaaaaaaaaaaaa

SEQ ID NO: 4694 - DNA, 397 bp, Diabrotica virgifera
  unsure (1)..(397): unsure at all n locations
  Clone ID: LIB149-037-Q1-E1-C4
aacaaaacanaanatatctcgacagcgttactcaaggaatgtcaaaattccagtggattggcaaatagttttgagttaaatgtcaacccctttggtgcagttttgggaaaaacgcgttcaaagttttgacaacttttattttcaatttctttttgctctgtcaaatcgtcaagtgatgcatactggaatatgtttttgaatcgcgtagtaatttacaaaagagaaggggaacagctgttgaacgtttgtcactacgcctacgctcaagcgcgctgatgtgaagctgctgcgaagcgaatcgaagctagggatattcaacacgctctatttccggtaatttttctccaataaatctgaaattttcagagagtattcttgaagttatgtacttttaatt

SEQ ID NO: 4695 - DNA, 374 bp, Diabrotica virgifera
  Clone ID: LIB149-037-Q1-E1-C8
atcgcgggtcaaggtttcatggtacccacatcaacacctaaggaaatttttagccattctacaaagcatagttcatgttgcaaaagccaggtgactctttcggaacgaattagtgacatttcgaacaggagtaactttattttgaatgtcagtttcttgatcgttatgttcagtcaggactgggtctactatttgatgtagtaaggctgcatataatttggtcttatgcaatatagaggataatcatggagagtacaagctttacttatgtaggctggtactcttagacgcccagtttttctacataaggattggtgaggtgttcttgatgtagaggtcaggcatagatttgacatatgtgagggcatgttttc

SEQ ID NO: 4696 - DNA, 411 bp, Diabrotica virgifera
  unsure (1)..(411): unsure at all n locations
  Clone ID: LIB149-037-Q1-E1-D7
ggaatatattctacccatgaagatcagcatacaaggtctcaattttctactactgcaggaatgcaggagactaatcaacaaacagctgctacaagaagacacagtttaacacaaaatgcaacaaataatataagtagttcacaagaaaatggaaaatctgcaccctcagttatttcaacgacacagcaccaggaagatcagatatcctcatcaaaaactcaaaacgcagaaattttgaccaaaactaaatctgaggaggatatatattcatcaagggtgcaacacgctgaaatcgttacaataactcaagctcaaggaacaatccaacccgccaggaaatcaaaacttcattacagaaaaagcaagaattattgaaaaaggaaaaactantgatcgtaattccggaaatgc

SEQ ID NO: 4697 - DNA, 325 bp, Diabrotica virgifera
  Clone ID: LIB149-037-Q1-E1-D8
atcccgggtcaaggtttcatggtacccacatcaacacctaaggaaatttttagccattcgacacagcatacttcatgttgcagaatccaggtgactcttccggaacgaattgctgacatttctcacaggagtagctttattttgaatgtccgtttcttgattcatatgttcatggaatatcgggaccctcagttcattcaacgatatctgaccattaagatgacatatgatcattattgtactcattacgtatgtcgtttgtccatatctagatcttatgacgatataaattcattgtagttgcaactcgcataaatctaaacaa

SEQ ID NO: 4698 - DNA, 362 bp, Diabrotica virgifera
  Clone ID: LIB149-037-Q1-E1-E10
acccacgcgtccgcccacgcgtccgatttattattttcgaattttttagctcttttaaattcgaaaataataaatatataattattaatttcgaatttaaaagagctaaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgtta

SEQ ID NO: 4699 - DNA, 397 bp, Diabrotica virgifera
  Clone ID: LIB149-037-Q1-E1-E2
atcaaaggtcattgtattgtaataattgttttgctttgaggacgtccattagctctttgtggcggtctttatcgaaaggcttgttgtaatctatgaaacagacgtacattcctggtttacatccaagcatctctggattagtagtgtaaatccaaagtgggttccttcaatatccatatcaagtgtttggcaaatgcgtttatgaatgatctttaaaaacattttaagtgtgtgagacatttttacacaaaacgtgtaacctacttagaaaactggagtacaaattttcatgaatttaaactattgaaaagcatagatctaaagcgggttccacactctcggcgaagttacttcgccaaagttgaccgaagttcaaagtaccctctctacacactcg

SEQ ID NO: 4700 - DNA, 65 bp, Diabrotica virgifera
  Clone ID: LIB149-037-Q1-E1-E7
aaaaaaaaaaaaaaaaaaaaaaaaaaaaaaaaaaaaaaaaaaaaaaaaaaaaaaaaaaaaaaaaa

SEQ ID NO: 4701 - DNA, 401 bp, Diabrotica virgifera
  Clone ID: LIB149-037-Q1-E1-F1
gatttactcaaagaagaagatcccaaagaatcattcaagcaactgttagccttgatcctggggataacagtcatggcgttcgtcaccaacgctttcgagtgatggcgaccacaaaacattatcacaaatgtacttgaagcaatagtttatttgaaataatcagaaatttccataattagtggttagtattattagttgcggttttattaagtgtcaactgtcatttgtcaaaatgtcaactgtcatttgtcaaaatgtcatctgttatttgtcaaaatgacagatgacaataactcaactgtcagttgtcaaaaagatggcgtaaaaatatataaattagttctgtagagtataaaagtcctttatgtaattcctactttcaaataaactcctgcactgac

SEQ ID NO: 4702 - DNA, 380 bp, Diabrotica virgifera
  Clone ID: LIB149-037-Q1-E1-F10
actttgagagagagagagacatactttattgatacaatgtaccaaaaggccatcgaccgaagtctttcagccaatttacacaattaatatacattaatacagtatatgttttttgttaatattaatacaatgcaataattaaaaaaaatatatttgtatgtggcggtaatcacatcactgacaattagttacaatacagatgatgatttaaatagagttgttgattgtcttgatgagtagcagatttcttcaaaaagagttcttcctggatatctacgggcactgtcctctggtatcttcacaatgtggggctcaatcaaacttttgttattgtcattaatagagagatatttaaacagcttattgagtctctcattaat

SEQ ID NO: 4703 - DNA, 412 bp, Diabrotica virgifera
  unsure (1)..(412): unsure at all n locations
  Clone ID: LIB149-037-Q1-E1-F2
aggaagcgtggggtcgattctttttattttactgagcctgatgttcttgcgaattgtcgttggcgatgatgttcaatattatactgattcaactacatctgctcctgatcctgctcctttttggacaacggcaccaatacccagatccacaagcattggtgaagatgtagtttacgtacaagatcgacaagttcccgatccaacctatgagatagatgccgtggaagcattcaaagaagctaaggcacttcatccagttgttgacggtacacaattgttagaaacattttccaagttgtttaacaacaaacatccgatagatggaggatggaaagttgttgaaaatttgggcccactttacaatccanatgcagactacatatatattgaactgagagttatagatgctaat

SEQ ID NO: 4704 - DNA, 421 bp, Diabrotica virgifera
  unsure (1)..(421): unsure at all n locations
  Clone ID: LIB149-037-Q1-E1-F4
gggtaacaaaaccgtcaataacactgaacaggaaaaaatatttaaaataggacattccaagggaacatctcattttttggcaagggaagcttaaaaacaaaaatataaggaaaaaatccctttaaggtcacccgtaactccggttgcgtatatgaatcacatgagttctacgagtttgaggattgtgagccaatatcttgatatcttgaaattaatattggtggacattttaaatattcatagtctgctgtcgcattcttggatttatacagaactggccaaattgtatattgtcttaaccgacgttgtaccacaagcaaaagaaatcggagcaatagtagcatttntctctagtgggtttaataatagagaatttgacaggtcatttgtaccaataatattgtctaatggcactgctgga

SEQ ID NO: 4705 - DNA, 393 bp, Diabrotica virgifera
  Clone ID: LIB149-037-Q1-E1-F7
tcgccggtcaatccacgccactaaattcgctctctctacgcgtccgttctctgtttatgctgaaacttgactttaagacagatgaggacttttctgctacaagatctgattttcctaccacaaaccttgagttcatgcaccgtgccgtacatggcatggtacattgtcaatatatcatgaggatattcctggcgaaaacagcgtaacaactaaatttcccattgtaaaatcatgtgtgtaaataacctcattgtcacgtaatgtaattcgtttctaatttaatccaatttattcagaaaatagattactttaattaatatcaatatatttataattaaatatttttatattattaatattaaatatttttagggatgagcttaacattaaaat

SEQ ID NO: 4706 - DNA, 402 bp, Diabrotica virgifera
  unsure (1)..(402): unsure at all n locations
  Clone ID: LIB149-037-Q1-E1-G11
acccacgcgtccgttgaactacgtttagtctgtcaatgattgacagactaaacgtagataagtccgaaaacgttttgaacgtggtccgtttggatttttggaaattttttggaattttttttgaatgtaccaactacactggggagttttacttcatgttaatttttatttaactagatggtatacagccaaccttcgggtattatcccgttttatttttgggaaatttaatgtttgtgactacatatttttaaaccattgcactgaagaaatagtatttatttttatttagtaaacttaaaatacattgtatttaatacacaaacacaatttaatcaaattttcaaagaacagagataaaaaanattaaaaaaagtacctaactacanataaaaactgaaa

SEQ ID NO: 4707 - DNA, 397 bp, Diabrotica virgifera
  unsure (1)..(397): unsure at all n locations
  Clone ID: LIB149-037-Q1-E1-G4
ataaaacacaaaaatgtttggtttggtataaacaattggtttgcttgtaaaaccggaacaggaacaaattccggttaaaaaatttcaagaatttaaaaggagtgngaaaattttcaatgggagaagcctatttgggtgattggatcgaacaagcaagatacccaactttattggaagaccacggagaatgcgttgttaccaatattgcactagaccttaatggagttgtaaaaagtcgtaccacatatactaatagcgaaacacgcgaagtacatgttctcgaaggagaaggagtatcaaattcaaccacaggagaagccaaatttttagtacatttccttaatccagatgtaactgtacctttttgggttcttggtacagaccatacaacatactc

SEQ ID NO: 4708 - DNA, 393 bp, Diabrotica virgifera
  Clone ID: LIB149-037-Q1-E1-G9
aaatgaagctaacaggtgtatgttttttaatcgtggctttttgcgctatcaacgcattagcaagcccttccgatccggatgatccatcaccagatgaacaaactaatgcaccatctgtttcaacatcagattctccacctgacacagtaactgattcatcatctactgcacctacagattctacacctgacccagcaactgattcatcatctactgcacctacagattctccacctaacccagcaactgattcatcatctactgcacctacagattcttcacctgacccagcaactgattcatcatctactgcacctacagattctacacctgacccagcaactgattcatcatctactgcacctacagattcttcaacctaaccagcaactg

SEQ ID NO: 4709 - DNA, 399 bp, Diabrotica virgifera
  Clone ID: LIB149-037-Q1-E1-H1
acgcctctacctgatacagtggtctattaatttgtgtgaccacttgatctttgcctctaatgaggcccggggttgaatgtgttaaaaactattttaagatgatggagatccaatcacagttaagcttttgctctaacagttagttaaaatcatcggcagcgcattctgtatttatttatttttatatttttatttgctagtcgaaaatgtcctaaggggctgataccagtgttaactgaaactattccagatatgcttgtaacttctttaaatttgccttttatcccagtgattaataaacttttatatgaacttaaaatttacagaacatgaactcaaaacactaagggcggccgtacacggactgctggggcagtttaatactgagcgacatacacg

SEQ ID NO: 4710 - DNA, 373 bp, Diabrotica virgifera
  Clone ID: LIB149-037-Q1-E1-H10
gtccaatgaatttagctaacaaatatatatttttttataaattgaggttataaaagggtttggtgacttgttagtgcattcatttaatttctgcatcaaacacttagtatgaatgaggttctcggacaaaataaatgtgatttatttgcaggtgactagttaatcaaataataaaaatttacaattcataaggtgtacatatttgtatgctataaaatatggctgatagtgatgatgaatatgatagaaaacgccgagataaattccgaggagaaagagcagaagctagttatagaggtgctgaaagggtagcaagaccaagggacgaatgggcagaaagagattcatggtctcgtcctagaccaagggaata

SEQ ID NO: 4711 - DNA, 410 bp, Diabrotica virgifera
  unsure (1)..(410): unsure at all n locations
  Clone ID: LIB149-037-Q1-E1-H2
gggtcaaccgtccgacacgagtccgttttttccgaaacattgtatcttttcgttctaattgcactcccctattaagtttattttcatttcagaggtcatccccatacgtacgtttctgtctctccaggcgtcttcagaggtgatcatgtagccccactgaaaacgtctggagggacagaaacgtacgtatggagataatacatcagctctgaaccaaaatgaaacataagctgttttttaatttttaattttactcatattttgagtacacggaatcaactttcgtgtagttggcattcttcctagacgaataaacggaatgtgattgcatattgtagagtcnccttcatcttctttattcatggtatccttgccttacaaattgtaaaagttanggattaaggatgttg

SEQ ID NO: 4712 - DNA, 387 bp, Diabrotica virgifera
  Clone ID: LIB149-037-Q1-E1-H5
aattttaatatgaaaaatatctacaagtaccaaaaaagtattgtttgatttttttggtagatttaaaaaatatttacatagtgaagtacttcaatcgtttttaattgtattgcaaaatgtgataacatctttagtcttttgacctttgtttttaaataatttctgttcgttcttggcgcaaaaatttaggcatttttgaagtacattgaactcgacattaatttggcaattattaataattatataatctaagagacatgcctctacaaattattaggagcttttcttctaattatattgaaaataggcttcaaaaatgttggtgccatcattcatagacttatttttaccaattttttagccaaaactggcactaagaagattgtt

SEQ ID NO: 4713 - DNA, 429 bp, Diabrotica virgifera
  Clone ID: LIB149-037-Q1-E1-H7
gctttgactataacatatacaagtaacttaaatgtttttatctgtttgattgtcatatgcagcagcttaaatttattagttcctaaggttgtaactctttgtaagctttgtccttaaaattgtaaaatttttaggtgacaataacgcatattatttcctttctgtcgattctcagaaaactataaaatatgtaacaactttcgacttataagcctcatgcctcatttatgctttaaagttatatctgaaaaaaaaatgtaaagaggataatgggccagaacaatttggtttaagaaatttatttcacaaatctcctaaccaaattatatcaatatttattatagatttaaacgccaaccccactaaaacgaatgtgaataataaaaaaatttcaaatatgaggtacataagaccttcaacacaaaatct

SEQ ID NO: 4714 - DNA, 140 bp, Diabrotica virgifera
  Clone ID: LIB149-037-Q1-E1-H8
aacagagatgttgtttagccgacatgacaaatattttataataatcattatatctacaaatgcatgtcatatttatgtgctccatctttatttatttctttgttatgtgcaaacctaaataaatatatattttaatggtc

SEQ ID NO: 4715 - DNA, 184 bp, Diabrotica virgifera
  Clone ID: LIB149-037-Q1-E1-H9
acccacgcgtccgcggacgcgtgggtgaagattggggagacaagggattgtttaaaatacgtcgcggaaataatgaatcaggcttcgaggactctattgttgctgcacctgctcaagtctaattttaaacgaaatattagtgttacgtttaatatgttttattttaaataaaaaaattatttct

SEQ ID NO: 4716 - DNA, 372 bp, Diabrotica virgifera
  Clone ID: LIB149-038-Q1-E1-A1
ttatccagctcagtgtcggttaacctaacaatggcttaacctaaaccaattgttccaccgtcctatgaattgggacagactgaatatacagcgttaggaatcgtcatgtctatagttgcaagaggatacatattatggatattgaatgtagtttttgccatcgttttaatggtttctgtttgtcgacagagacggaagccccgtcgatcgttactttcacctataaatgcctatcattcagggccagcgccatttagtctgtacgacaacgtacagatagacaacaccttcgaaaacagaggcttcgactcagaaggaaacctatttagccctccatcaagtgaactccgaagaccttcaaatggtctaaat

SEQ ID NO: 4717 - DNA, 195 bp, Diabrotica virgifera
  Clone ID: LIB149-038-Q1-E1-A10
taaaaataataaaatactttttactaaaagtaaagagaaattttatttagactgatacttaattactattgtgagagaatattttatttttagaagacacaaatttattttttgtaccttggggtgcagggattattaattgacaattagatattcaatcgtttcgtctttacaagatctagacgattagcattt

SEQ ID NO: 4718 - DNA, 83 bp, Diabrotica virgifera
  Clone ID: LIB149-038-Q1-E1-A3
ttttatgggaaagtaaaaattttaaatagttttttggaaaggaaatgttattcgtttttaaagagagtctaattttttaggaa

SEQ ID NO: 4719 - DNA, 137 bp, Diabrotica virgifera
  Clone ID: LIB149-038-Q1-E1-A4
tctgttaggtccgttttcgttggggtatttcaatctctatctgttatgttgtacgttttagacaacgagacaaacacgttgatacgagtctcatgtttagtaagtttgggtaaaaaaatttgggagatatggaaagt

SEQ ID NO: 4720 - DNA, 118 bp, Diabrotica virgifera
  unsure (1)..(118): unsure at all n locations
  Clone ID: LIB149-038-Q1-E1-A5
gctacaacctatagtgagtcgtattaanattcgccgtttggtccagcgctgcgtgccaggctatgtaggtccgtcagattggtagtgcgccccaacaatccattagtgcatagcacgt

SEQ ID NO: 4721 - DNA, 373 bp, Diabrotica virgifera
  Clone ID: LIB149-038-Q1-E1-A6
tacaatacactatagtgagtcgtattataatcgtattttttatattttgatttagtttatgtaattgaatatttattattaatattatttttcatgaaatttcataattgttattttactatattgaatatcttgaagatctataatatttgttttaattatttcatcaatagtaatttattaaagtgatgagaatatattaagtgatttatttatttatcgatttattttacgagttgtgaaagtagtattttcaatattaatattaattattagtcataatttagattcaattttgattaggttgatatgggttatgtatagttgcttagagttaagtaaattagtagcaaaatatgagtcgaattaatgc

SEQ ID NO: 4722 - DNA, 62 bp, Diabrotica virgifera
  Clone ID: LIB149-038-Q1-E1-A7
taaagtgagtcgtattaagtgtgacggtgctttgggatgcaacttttcataatttataaggg

SEQ ID NO: 4723 - DNA, 93 bp, Diabrotica virgifera
  Clone ID: LIB149-038-Q1-E1-A8
tgagtcgtattaaacgtccgcccacacgtccgcgcaaacgtcaagccgagggcgtcggcagacgacggtgcatgcattatgtaagcgtacatg

SEQ ID NO: 4724 - DNA, 328 bp, Diabrotica virgifera
  unsure (1)..(328): unsure at all n locations
  Clone ID: LIB149-038-Q1-E1-B11
cctatagtgagtcgtattaaancaatatatttataattaaatatttttatattattaatattaaatatttttagggatgagcttacgaataaaattttattataatttaagtttttaagtaaaatttaggattatgaatttgcatgttttacaatatgttagtatgttatttttagagattattatttttattttttagagattttttattaaaatgtaaatttaaagttagttaaatttagtaatgatgataatattagtatgaagaaattgtagtatttagtaaaaatatataggtttaataaaggaatttggcaagatttttttc

SEQ ID NO: 4725 - DNA, 78 bp, Diabrotica virgifera
  Clone ID: LIB149-038-Q1-E1-B12
aagtgagataacaagattgctcgtcgctaatgttagctcaagtatcggacttgcatggtcaggcatgactagttttag

SEQ ID NO: 4726 - DNA, 133 bp, Diabrotica virgifera
  Clone ID: LIB149-038-Q1-E1-B2
tattattataatattttttagtaaaagtaaagaaaaattttatttaatgatagttaattagaattgtgagagaatattttaattttataaaagaaaaatttaatttttgtaccttgtgtatcacggaattatt

SEQ ID NO: 4727 - DNA, 78 bp, Diabrotica virgifera
  unsure (1)..(78): unsure at all n locations
  Clone ID: LIB149-038-Q1-E1-B6
actactccctaaagtgagtcgtattaaactgtttgtantaaataaaaaatcaaagaataaaaagagagaaaaaataag

SEQ ID NO: 4728 - DNA, 202 bp, Diabrotica virgifera
  unsure (1)..(202): unsure at all n locations
  Clone ID: LIB149-038-Q1-E1-B8
tgagtcgtattaaaagacangtttttgtatgagtcagaaggtagaagagccagttctatccggtcaacgcatcaaggagaggggactgagatgaacaagagaggtgtgatccaactgggtttagggatgcaatagtcgctggactcgagtagtgtgcgagcgagggttgagggctatagcgcgagatttgggcagtgctggt

SEQ ID NO: 4729 - DNA, 308 bp, Diabrotica virgifera
  Clone ID: LIB149-038-Q1-E1-C1
ttcaaattccaacttggggggacctaaaagattcagattaacatcgttgtcatcggacactgcatttctgggaaatccgcgaccactgtttattgaactttgagttgcagggacttctagctccgtcttatcgacatgttatgcacacagtcacatgatctgggaacacgttatttcttaatgtcctagagtgacaacagctgttttgcctgtgacaatacgcgaatcctcattcactatgccttgttgctgctgaaatgcgatacatagcttgggaccctcaataatcaccatttacaattattttt

SEQ ID NO: 4730 - DNA, 90 bp, Diabrotica virgifera
  unsure (1)..(90): unsure at all n locations
  Clone ID: LIB149-038-Q1-E1-C10
ttactacaacgtatagtgagtcgtattaaacggnncttttttaggtgtggcccgccagcattttcttcaacggttggttactcggactgg

SEQ ID NO: 4731 - DNA, 300 bp, Diabrotica virgifera
  unsure (1)..(300): unsure at all n locations
  Clone ID: LIB149-038-Q1-E1-C2
agtcgtattagaacnagangcggggctacaagaaaagtcattaggaaccagtagggttgaataaaaaacagtgagggttaaaatgtcaatggcctatagtgcagtattgggacaaaagcgtgcattattttgtgaaccttgagtggtcgcggaccattagctctgaagtatagatatgtgatatacaatgtcataggtctttgaaactcagtaatttttaacagtgcataaggggaacagctaatgatcgtgtgaggaaatgccaatccttaagcgcgctgacgtgcttctgatgagata

SEQ ID NO: 4732 - DNA, 267 bp, Diabrotica virgifera
  Clone ID: LIB149-038-Q1-E1-C3
gggtttttaactcctcctccggatggaagttggtttggacttggaatttccctagggtaggcccatgctgatcatggttaagaagtgtggatgggatatgcagtacgttcagtgtcatcgacaatttattctggcttatctccagataatgatcgtagatataggcacttgagtcggagagttattggtgagtaatatgtagcttctatgatttacttgtgctcagatgccactcgtcttgagcgattccacgatgtttgagattcg

SEQ ID NO: 4733 - DNA, 359 bp, Diabrotica virgifera
  Clone ID: LIB149-038-Q1-E1-C4
cagctgatccattcctggtaccgaaatttgccagaaaaaatttggaaagagctagaaggtctgacgatagtttagaagcagctgaatctacattcgcctttcgtcccaactttgccaggcgagaattcagaagaatcaagagaaatattggatttttacctggttttgccagaaaaggtattagaggtagaagatcagcagagttagaagacacagaacaagaaaacaatgaaagaagcaaaagaaatattggcttcctacctggatttgcaagaaaaggtatacgaagcagacgatcagctgaattagaatacgcagtagaggataacaatgagagaagtaaaaggaataatgggttc

SEQ ID NO: 4734 - DNA, 250 bp, Diabrotica virgifera
  Clone ID: LIB149-038-Q1-E1-C5
agataagggcacctttagttgtgtaggtattctattatgatattccagtgaagtcatgtagagtaagacattattggaaatgctaaaatatatattgtacaaaagttctttgtctaattgtgcgttatgcactaatgtggtaattaatactccatattcgtgaaacgtacttttattaccttttaatgtattttggatgtgtaagaagatgggaaaactatcgtacatctcattattcagtagcttgtcg

SEQ ID NO: 4735 - DNA, 296 bp, Diabrotica virgifera
  Clone ID: LIB149-038-Q1-E1-C6
agtgagtcgtattaaatgacatttatttcttcgacgtgcgacattaggtgacaaatcataagtctgtttacggacaagattatttgacagaaggtgttgtcagccgacgttgtccatatgctatcggtcggcacaaccgaggtgatgcattaattttgtcagaggatgttgcagtatgggaaatctatgaacattacgacagatcttgcattccggataggttcgatacaggtgtccacaatgaatactacttctgtctaataattggtttgtcctgaaaatgtgcatgaagcagc

SEQ ID NO: 4736 - DNA, 331 bp, Diabrotica virgifera
  unsure (1)..(331): unsure at all n locations
  Clone ID: LIB149-038-Q1-E1-C8
agtgagtcgtattaangntggattttgcacagctgatgaggtggagattacagccaaaattactggttgggtaagtgtaacagtatacgatgaatatgctcttcgtttggcactcgtggtgcatggtgtagttggagttagcatctacgcagtctatgttatgaacatgctcttcgattggaactcgtgaagcaacgaccatttagtgttagcatcgacgctagccaattgtctgtcagtttttattcacatggatgtctattactactgaaaattgcggaaacagagtagaatatttggactattcggttttagctgttggaataggttt

SEQ ID NO: 4737 - DNA, 286 bp, Diabrotica virgifera
  Clone ID: LIB149-038-Q1-E1-D1
gggaattctcagtccacgatactccttaagccctgtggcagaatatctgaagtcattagggagcaggccaatccactgctcagcggattgcgtgggttccgaagttgaagttgagtgtgcagatctcaagcctggtactgttattttgttagaacactttatgatagtacattgaagattaagggaaaggtgtacatgacactgggtacatcgtttttgcatataccgccaaattcaagacttttatagaaagtcttcgtaaactgggagatgtatacgtaaatga

SEQ ID NO: 4738 - DNA, 357 bp, Diabrotica virgifera
  Clone ID: LIB149-038-Q1-E1-D3
agtaaaagtaaagataaattttatttaatgatagttaattagtattgtgagagaatattttatttttataaaagaaaaatttgttttttgtaccttgtgtaacagggattattaattaataattacataattattattttcgaatttacaagagctaaaaaattaatattgttattgtaaaattaatatttgaaataatgtttttgtaagtaaatgttattcgtttactaaatacatctatcttttgaagaagtaaattagatttatttattaacaatatagttataaataaatattttaatagtattaatagtaagtatggttagggatgagcttaaaaagttaattttattaaaa

SEQ ID NO: 4739 - DNA, 449 bp, Diabrotica virgifera
  Clone ID: LIB149-038-Q1-E1-D5
gcgtaggacaatgcaacaccctaaagtgagtcgtattacatgaagatcagcatacaaggtctcaattttctactactgcaggaatgcaggagactaatcaacaaacagctgctacaagaagacacagtttaacacaaaatgcaacaaataatataagtagttcacaagaaaatggaaaatctgcaccctcagttatttcaacgacacagcaccaggaagatcagatatcctcatcaaaaactcaaaacgcagaaattttgaccaaaactaaatctgaggaggatatatattcatcaaggctgcaacacgctgaaatcgtaacaataactcagcctcaggaacaaatctactcgtcaggagatcaaaacttcaatacagaaaaagcaagaattattgaaaaatgaaaaactagtgatcgtagttccggaaatgcagctgtattgattaat

SEQ ID NO: 4740 - DNA, 344 bp, Diabrotica virgifera
  Clone ID: LIB149-038-Q1-E1-D6
attttgcattagttactggagactgaatttacgggattcgcataatagtgagtaacacgcaggacaagtacagatataggtagaattgatccagacaatgatcagaagcagtgctttgttgttaattgttccctcaaattcaagtcttatcgtattatcccttctcgcagtgttcacatgatcagttgtgggagcaatggcccgagacagtgacgattagataaaaactcgatctgcggtagtacacgcatcatcaaagatgttcaatggtagccacgtaacgttaactcatacggaagaacaagttaacgctacaggtgtgtaagtattcaattctgaattac

SEQ ID NO: 4741 - DNA, 266 bp, Diabrotica virgifera
  Clone ID: LIB149-038-Q1-E1-D8
actgttcatccttgccgctgcccttattgtggttacatgtgccgatctaagtgccgtcgtgtaatggaccatttttaaggcagcccataacagatcatagaacgtgagttgcgaggacttcattatcgctgttttccaagacaacctcttaattttcaatgtacacaatgctaaatactagtgtgggtacggcacctactacatggcagttaacagattcgcgatgtggtccagcgtcgaattccaagccatcttgggccgtcaga

SEQ ID NO: 4742 - DNA, 329 bp, Diabrotica virgifera
  Clone ID: LIB149-038-Q1-E1-E10
agggcactagcaagttcgtatttcggcagttcatcaatgccgatggacgtcagttaggtattaataggttcgagttgatttgagcttgaggattaggttgtatagcagtttcttagatatcttatatgcttgttgtgcagcaatctgttgttcgtttttaattgtatctcattgtttaagaaatggaattattgttagttattaaccctgtatttagaactaaatatttttatgttatcagtattgatcatttttagggatgtgcatagactacttattttattagaatttaacttttaaagtcaaattaggatttaaaattttcagat

SEQ ID NO: 4743 - DNA, 111 bp, Diabrotica virgifera
  Clone ID: LIB149-038-Q1-E1-E11
gttattttttatgaggcagccagtgtggttttcggtggagctagggaattagtattggggcgagagtagtggatttggtgggagggggggtttagtggagggaacatgtgt

SEQ ID NO: 4744 - DNA, 332 bp, Diabrotica virgifera
  Clone ID: LIB149-038-Q1-E1-E4
ttcaatagtaaagcgaccatggctccacggttcgagatcgcagtcggcctcaatttgggtcacaatatcacttcaatctcagacatatccaatctgaataaagttcgtcacgctaggttgaatgggatccagacgatccacatcagtatttgtcagatacatcatccgtgaagtcgtatgacgtgctccatatgaacacgagagccatggatattcgatcaaggtgtcacaggataatagggccctgcaattcctgaagcctcgtcttggcacacacatcagatccatggacgaagctattctaactatccaacagccttacccacatgcgt

SEQ ID NO: 4745 - DNA, 185 bp, Diabrotica virgifera
  Clone ID: LIB149-038-Q1-E1-E7
tgagtcgtattaaatagtgttttattttttgtaccttgagtaacagggattattgatatttaattaggaatgttattattttcgaatttaatagagctaaataattagaatttttattgtctaggaaatatgttaaataatttttttgttatgaaatgttattcgtcttgagctatatcgagttt

SEQ ID NO: 4746 - DNA, 375 bp, Diabrotica virgifera
  Clone ID: LIB149-038-Q1-E1-E8
agcgaaggagcttcaatcaacattggttgaacatttccccagtccaatctttgcagaccatcttgcagcagatccagcatcaacgtggacttcaacaagaattagtgggacaagaccaaagcatgccccaacaatatttgaacgctgaatatctccaaaaccaagacattgataccaaccaaatcttaaaccgcatctacagacaacaacatcaacttggacaaggcagaccagtaccactaaaccaataccacgacattgataccaaccaaatcttaaacctcatctacaaacaacaacttggacaaggtagtgcttacccactaaatcaatacgtggttaagcataggacagttaatggacaacaaagattca

SEQ ID NO: 4747 - DNA, 364 bp, Diabrotica virgifera
  Clone ID: LIB149-038-Q1-E1-E9
tgtcttacttttgggccttgcccttttcgtctcagctggtcaagatcttgacaagggcatggaaattgtgaaatgcgcccagcgagcaataagcgtaggagtacctgaattaggagttccatcacataatcccttcgtcgttatcagaaacgtatcatggactggatcaatcggtgttgcaagcacccatatcgaactcaataccaataaatggtatggtcttgccgattgggatatctcagctaagcatatcaatgacgacgaagatttcgaggctgtctttgactacaccacatactggcccagttttagaatcgtaggcaactacgaagcatccgttaaagagcttttccttacacagcac

SEQ ID NO: 4748 - DNA, 235 bp, Diabrotica virgifera
  Clone ID: LIB149-038-Q1-E1-F1
tcatttattttggacagggtaaaagatttcattttattgaaggtcactaggatcgtcatgagagagagcattttacttttacaccagataaatttacgtttcgtgccttgtgtggcagggattattaattattaattatctattaattactttcgaaattaatcgagctaattccttattatttttattgtaacatagctattttaactaacttttttgtaacggtacgtcatcc

SEQ ID NO: 4749 - DNA, 172 bp, Diabrotica virgifera
  Clone ID: LIB149-038-Q1-E1-F10
ccaatagtgagtcgtattaaaagttagggctatgattctcagattcggtttagaccactctcattcagccaggttccatcaccaatatccagctgaccagtccagggggtgtgagacacaggattttgtgcaccgttggaggggtctctatttgcaggatcctgtgatcaca

SEQ ID NO: 4750 - DNA, 372 bp, Diabrotica virgifera
  Clone ID: LIB149-038-Q1-E1-F3
cccttagcactttcgacttttatggagagaaaggaagatttgtaaggaaatttaaaaatacgctctagaatttgatcttattctgttccagaaaccagtcattttggacccgtcaagctttttgaatataagaaatggcactatggtggaaggtattctagaagatgaacgatacatttaaattctggtgtatgaggggttgaatatacctacatctgatttttccttagaatacaatggtcatagtttttttgcaccatatctcgcttagtttgaatgtaaccggacatttaacagttctcgtagtaatggtcttttcaagcactaaagaaggtattcgtagcagtgtacccctaaaatctacaagttctg

SEQ ID NO: 4751 - DNA, 321 bp, Diabrotica virgifera
  Clone ID: LIB149-038-Q1-E1-F5
acgcacgccactgaacagacgtcgtgatatattttaaaataataaaatattttttagtaaaagtaaagaaaaattttattgaatgatagttaattagtattgtgagagaataatttatttttagaaaagagagatttattgtttgtaccgtgtgtagcagggattattaattaataattatatatttattactttcgaatttaagctagcgaataaattataattttgattgtaaaatagatattttaaataatttgtttgtaatgaaatgtcattcgtttataaatatatctaatttattaagaaataagatagatttat

SEQ ID NO: 4752 - DNA, 327 bp, Diabrotica virgifera
  Clone ID: LIB149-038-Q1-E1-F6
aagtgagtcgtattatgtttgctcttagtgacgtacttgttcccatatgtatacttcacaattattgctgcgacaggcgccatttttatgacaaagtaggttatttcttgtcacttgtgaatcagggagtagacattatgaatcatatagttattgatttccattgaacatttgctaacttcgtaggacttgtatcgtcattgttccaatttcaagtggtttactgttatgatacgtaattcgcttataatgaaaactcatgcgtcaataaatagatcaagtttagtgctgatcacgctaattttaattacggagttgtaacctatc

SEQ ID NO: 4753 - DNA, 280 bp, Diabrotica virgifera
  unsure (1)..(280): unsure at all n locations
  Clone ID: LIB149-038-Q1-E1-F7
tgagtcgtattaagnttgattattatgaagtcattgtttattttagtaaccccctctaatatttcttcataattaatttttggttcattataatgacttagtgtatggaatcagtgtattacggggtgaattgtgagtaggatggactgcttaattgtagatttagaattaatgagagtggatcagatttgccgagatgtctctgattggtgatgactattaacaatgtatggatattggtctgcaattttttttagttgattaggaattcaatttggtt

SEQ ID NO: 4754 - DNA, 296 bp, Diabrotica virgifera
  Clone ID: LIB149-038-Q1-E1-G1
cgtattaatgcggctgtgcacgcttgcaactgatcgtatgcaatatgtgcacgtggacagattcatgttaaaagatgtccagatgtgttaggattagcgaatttcaattaatattgtgatataggtgtttagttgtatgagacaaaatatcaagttttgtaggatgagtaccatgaatgagtagttaccaattatctagatatcagtaacgagctgataggagtaatgccagtggtattaatagtgagacatgcgaagtttatgttattttatgagaatgagttgtaaattgattt

SEQ ID NO: 4755 - DNA, 305 bp, Diabrotica virgifera
  Clone ID: LIB149-038-Q1-E1-G10
aatatatctaattttttaagagagaaattaaatttattgattaacaatatatatagtattatgagattttatatttaaaatatataaatattatttaggggatccctgaccatcatgtatcaagtattattaaatttttatttaataattacgattttcaattttcatatttcaaaatatgttaatagttaattgtatatattataatttttatttgttatgaattgttaatcgttatacaattttacataattcaaatttagtaatgacgatattattagtattaatatattgtatatttagta

SEQ ID NO: 4756 - DNA, 226 bp, Diabrotica virgifera
  Clone ID: LIB149-038-Q1-E1-G12
atagtgagtcgtattaaaatctttgactgagagtagggtcatattaaggttgggtaatctggcagtcaatctcattgtggtcagaaatgtcaatttagcaggaattgagctctgggccagttttaaggcaacactcggttgcatgtgacaagcgttagtgaggacaaacctcgtttgagctcgtagtcgattagaaactccgacagcttcgacgcacataaggcta

SEQ ID NO: 4757 - DNA, 383 bp, Diabrotica virgifera
  Clone ID: LIB149-038-Q1-E1-G4
gtcctttccggctccttggaatccttttgggtcaacaaaccgttggtaaaaaatcggactgacggtccaaattaagacaaggcaaccaaggctgtttacgacaaagatgtagtatcatccgttgtaggaagcaccatccgtgttaaagtaccagacagcttgttcatgaagaaaccaatcacctgcattgttatcgtggacaataaccaaagcgatagcgtaactgaaatcgaagatggtggtgtacacagtacatgggtaaccattaacattgctctcgccatcaccgaatttctcagctacagaatccatttgtataccaaccagtaaataatttatatagtgtactagatttaagtagaattgtgatgttaagtttaatg

SEQ ID NO: 4758 - DNA, 315 bp, Diabrotica virgifera
  Clone ID: LIB149-038-Q1-E1-G5
caatagcatcttttgtcaccgtattgatgttgtttggttgtctgtgttccaattgctatagtgattgtagacaatattgatcctgtcaatataccgagtcgccagattaaatcttgtttacgacattcgtttatcgggagtgtctatcaatgttcgtatgccaccggtaggatattttaatagacccatatcgtgccttcaactaattgatcgatagggaacctctgtttctccaaagatagtgttaggcggatatctctatacatacatggtaatcaagtctacatcattaaatggtcaagtactttattatca

SEQ ID NO: 4759 - DNA, 380 bp, Diabrotica virgifera
  Clone ID: LIB149-038-Q1-E1-G6
caacaccctgatagtgacgtcgtattataaatatatctaattttataagaaataaattaatttgatttatgatcaatatattgaaatgtgagtgattttgtaatatgaatatcagatatttttacggattggcttatgtgtaacattgtatcaggatttacatttaaaataataattaggactaaaaattttcagattttaaaatatgttattatttatatgtacatgggggtaattttattttttataaagtttttattaacgtattgatttatatcacttatgttgagtaatgatcataatattagtattactaaattgtatatttagtaaatatacataggtttaacaagggaattcggcaacacttttttcacctg

SEQ ID NO: 4760 - DNA, 322 bp, Diabrotica virgifera
  Clone ID: LIB149-038-Q1-E1-G8
atagtgagtcgtattatacgtccggtgagcatgtccatgatgcagtcctctatgggacttgttgtaaccatgtgttgtgaccttcagtaaggtagttccatatatttaactgacttctggatatctagtcttactgtgcaatatgctggattactcagttctttagcatctaatgctatcactgttgtttcagatttggatctatccaatgctccttacatttttaagatttagatcatggatgcgtgaagtattggtagctccggaatacggagtttaccctttatatttgtgccgatttcctagtgcattgatgggagat

SEQ ID NO: 4761 - DNA, 258 bp, Diabrotica virgifera
  Clone ID: LIB149-038-Q1-E1-G9
tagtgagtcgtattaaatcgagcctgtcaacgactggcatactaagagtttgacagtccgaaaatcttttgtcatgggcccgtgtggaattctggacatttactggaattgtttttggctgtagcaactacactggggagttttacctcaggttacctttgatataaccaaatggtatacagccacccttcgagtattatcccgttctaattgtgggaagattacagtttgtgactacatagcttttaagccattgca

SEQ ID NO: 4762 - DNA, 207 bp, Diabrotica virgifera
  Clone ID: LIB149-038-Q1-E1-H1
aacaccctatagtaagtcgtattattattgttcgctatatctatgggatcatgttatacaacgatattgaatggaattgggtatattatgtcatcctctaagataactttcagtggatgcaagcacattgtaggagccagcaccagcacttagtcatgatctatagaaggatatggagttgctaagcgatcccatatatgaactttg

SEQ ID NO: 4763 - DNA, 122 bp, Diabrotica virgifera
  Clone ID: LIB149-038-Q1-E1-H11
ttactactacctatagtgagtcgtattaaactgacacggcatacttgggatactactgcacatccaggtcgcagggaccatgtggcacggtaatggcattcgcggcacatgtctcactcatg

SEQ ID NO: 4764 - DNA, 143 bp, Diabrotica virgifera
  Clone ID: LIB149-038-Q1-E1-H5
agtcgtcatgaaatgtaatttgttttaatcaatatctatatttttgcgagatatatttatttgatttatcaggaataaattcatggttaagtatttttatattattaataataattttttggacggatgagcttagcaattaa

SEQ ID NO: 4765 - DNA, 234 bp, Diabrotica virgifera
  Clone ID: LIB149-038-Q1-E1-H6
ctaagtgagtcgtattaagccgtcttgacaaatattttaatttagtcattcgctctacatatgccggtcaggtttatgtgctcaatctacggcctacttccttgtacactttctgcctaaataaagatttcggccacgcgtccggcaccagttttatcacgtgcggacgtactgcaggtcatctagcctttcgtctgccgactggccaggtcacagagcctctgtagtgtcacc

SEQ ID NO: 4766 - DNA, 173 bp, Diabrotica virgifera
  Clone ID: LIB149-038-Q1-E1-H7
ttacaacaccctgaggtgagtcgtattaaaccgagataacaaatattttataataatcattatatctacaaatgcatgtcatatttaagtgcaccatctttatttatttctttggtatgtgcatgcctagataaatatatattttaacggtcaggagaaaataaaataaagtt

SEQ ID NO: 4767 - DNA, 295 bp, Diabrotica virgifera
  Clone ID: LIB149-038-Q1-E1-H9
aacaatcatccttcagaattgtcaataatccatgaatgtatttttgcagttgctaactttcagttgcatcaaggttcacagacagtctatgtttgcgttatagttgagtttagttattattggtgtagtaaagttgtgagagatcaacattggtggtagataaagtgtggttttgagaattattaggtctgggtaaagtctctacaagtctgggtaggtctagcgttgcaatgtgtatcagtacattgcgagtaccgtgcgctgaatggcgattttcttggagagtaatgtaggg

SEQ ID NO: 4768 - DNA, 383 bp, Diabrotica virgifera
  Clone ID: LIB149-039-Q1-E1-A1
attagctggattgccaaatgggatcccaaagaagttattctatcgaacaattacatatcggacttaacacattttattctattgagcaaaagtgtgacatctttagacttaaacaataatttgatacgcgatgtagaatccttaaaagtattaggtttcttcaaaaaattaacagctttagacttacgtggcaatcctgtatgtgacaattttgactatgcttggcagtataagcttgaaatacggaaaatttgtccaaacttaactgtgttggatggtgcggatgtttacgaaaatgtaaattttgactacaaaaaaaattttgtgtgttgcgatgatgctggggagctaacgtctgtattcctcgaacatttctttacttt

SEQ ID NO: 4769 - DNA, 399 bp, Diabrotica virgifera
  Clone ID: LIB149-039-Q1-E1-A10
acggcaattcgcactttcgataccgctgctctaaagagattgtaacccaaaactctgggtattgaggtttggaagaggaagaactgacaaaatagggggaaatctggaagagcagagatttaagagacaaatgaagaatggcttagctcagacgagcaaatcaaataggcaaagagacactatatctcaagtgagtgttcgggctagcttcaatacactgaatattggctttgagatatacaaatagagagatgagataaggaaatgatgaagacgaggaaaaaaaaaatgagacagggtaatacaaaaattgaaggcaactagataagaatgctggagatcgattgagataagagggacgataaagagagaaggaaatgggcgccaactcaaccaaac

SEQ ID NO: 4770 - DNA, 376 bp, Diabrotica virgifera
  Clone ID: LIB149-039-Q1-E1-A12
ttacttatctagctttatatatagtatctgaaactggttatttattacttaagggtatatgaggattaatttgagttgtagttttttagtggaagattattttcttgattagtattttctacgcctaattttatatgtcttccttttttaatatatattataactttgatttttattatagttggagtttgattatgttatgagttagctaaatttaatatttcttatgatttattatggttacataatatttctagagtattattttttagaataatatgaaatataccatttttatctactttaggaattaattattatccagtttaatttggtatattttaaaggaattttttgatataggatgatttgaata

SEQ ID NO: 4771 - DNA, 337 bp, Diabrotica virgifera
  Clone ID: LIB149-039-Q1-E1-A2
acgcgtccgattaactggattgccaaatgggatcacaaagaagttattctatcgaacaattacatatcggtcttaacacattttattcaattgagcaaaggtgtgacatctttagacttagacagtaatttgatacgcgatgtagaatccttagaagtattaggtttcttcagaaaattaagagctttagacttacgtggcaatcctgtatgtgacaattttgacgatgcttggaagtatgagcttgagatacggaagatttgtcgaaacttaactgtgttggatggggcgggtgtttacgaaaagggaaattttgggtagaagaaaggttttgtgt

SEQ ID NO: 4772 - DNA, 398 bp, Diabrotica virgifera
  Clone ID: LIB149-039-Q1-E1-B1
gggtcgggcacgcgtccgagcaaatcaaagttatttagggggtgtttaatgagattttttgggtttacatcatgtacaaaaaattttgtttgtatattacctatcaagatatttcagaaaaccgtaccttaataatattacaaagtcatttgtatttgagtagtatcgttaaatgtcgagaggtgaacatacaatagcaggtataagtaataagcttaagattaaggttttctaaaatatattgataggtactatacagttattttactttatatgccgtttagaagaaactatatacgatgcagaagatattgatgatattatatttacgccaacctgtttttttggtatgagttttcttttttgctataaatattgtataataaatataactgttt

SEQ ID NO: 4773 - DNA, 142 bp, Diabrotica virgifera
  Clone ID: LIB149-039-Q1-E1-B10
acaatactctatactgagtcatattactgtacttaattagataattgtgatgtcacagtttgattagtattgtaatgtctgtaatattgtaattttgtattttagaaaataattaaaaatattctgtaatggcgatttactt

SEQ ID NO: 4774 - DNA, 404 bp, Diabrotica virgifera
  Clone ID: LIB149-039-Q1-E1-B2
atacacgatcgtgcggatgcaagtcagtgttccacacattttcggcctctaaatattcgcttcgcgcgctgctaaatattaccgaatcgataattttaaaataccctgtgactggaatataaaaattataccgtcatcatgactgacaaagatctacagaaaccaactacggacctaaacgcattaaaaattgacgaatcaccggccgcttcccctacaccgggaagcaattcatccctactcacattcgaaacaaacttcaagaacttcgcgaagttcggagacccaaaatcggacggcaaacagataactctatcgaacagcgacaaatggatgaagcaagcgaagatcatcgatggaaagaagattacgacaacggataccggtattcattttagaaagct

SEQ ID NO: 4775 - DNA, 420 bp, Diabrotica virgifera
  Clone ID: LIB149-039-Q1-E1-B6
agatattcttcggctgtaattccagtgtacttggctaaacgattctaaaaggaacagacctacgacttaaatattttgtgttggtgtcgtgtgacgttacctactatgacgcgcaacggtatttatactgtacgaaccataagatgccacaaggaaatagcttgagaacagtatacttacatgcaatagaaaattaagataatttagttatcataagaaaatgcaagacacttgaaaaagacgaaaatcataatttgtcataattcttgaatccgtattagacagacagtttatttttatgtagctcctactaaccaggttaagctactcaaaagctctcagttccaagttcctttctcttttttcttttgctttagtatctatacggtgtattccacgaatatgagactgttttggatt

SEQ ID NO: 4776 - DNA, 439 bp, Diabrotica virgifera
  Clone ID: LIB149-039-Q1-E1-B8
ctcgcgggtcgatacaagcctctaaaatgagtcgtagtagacaaattcaaattggccaccaacccaccatggaccatctcattcaagttatgcaatctgggtggactgctatcttcacagtccgatgcctaactctgcagtcaggggtggtaccgatatagatgggcaaccaatttatgttggtacagcctttcatgaaggtgattggttgccggccaaagttattccgggacgacgctgctgttatgtttcctatgatggaaaggaatatgctaaaactaactttcaggttttatctcatacatctgcacattgggttccaggatttggtggacaagtgccgcataatgcaattgaaggtggtagaactgttaatggccaacagctttacatcggacgagttatgcatcaacattcgcaaactgtggggcaagataca

SEQ ID NO: 4777 - DNA, 89 bp, Diabrotica virgifera
  Clone ID: LIB149-039-Q1-E1-B9
aattggtccttgcttcacgagtgtttacggggttggtgttgtttggggcgtggttggcccgggtgtggtcttcagtagggtgtggtgaa

SEQ ID NO: 4778 - DNA, 351 bp, Diabrotica virgifera
  Clone ID: LIB149-039-Q1-E1-C1
aggtagcgtgggcgggactttgttggcacgaaataagtttttaaatacatagttagatttattaattattaaatttaaattatctgtacctattgctatttgtataaaatattcacttttattatgtaagcacctgtatatgtgtagttttgatttttgtatttgccaataacctattgagatatgaagaaaatacacatacatacattttcagtttgatgtgtattgtttattgtattttatatttctttttttattgtagaaaacgacaatgaaaagttaataaaatctaatttatgtacaaaaaaaaaaaaaaaaaaaaataaaagaaagaaaaaaaaaaaaaagaaa

SEQ ID NO: 4779 - DNA, 394 bp, Diabrotica virgifera
  Clone ID: LIB149-039-Q1-E1-C12
tagttttgttctgcctatgtagaagttaataattttgtagatttagctttttgtacatagatattaagacatcggcttcgaaacactacttatttatttttaattcactgtcactgtcttttttcgttaaaccatacctttctgcaaccttatacccttaacttgtttagttcttctgactgttattcggttgttcatctacttctgtaaaaatacaaaactttttctaataatccacctaaatagtataaggatgtttgtaagtaaaaatcgaaatttatttttatatgtacagaactttatttacttgtccaattttctaattttggaaaacacgaggcgactattttgtgataaatcttaagattaattagactaatgttaggtatattgt

SEQ ID NO: 4780 - DNA, 440 bp, Diabrotica virgifera
  Clone ID: LIB149-039-Q1-E1-D2
gcgggtcggtccaagcctctaaagtgagtcgtagtacgctacatggcttcagggatttttgtgtactgagatgttatgcgtttttaaatacatcgacttgatgaacaaatagggcacctttagttagtgacaacatacctataattaagtagctttagattagtaatattacatagttttagggatgagcttaagcataaaattttactagaatttacttgttacataacgattaggattaacaattttaaggcttgacaatctgttattagttactttcaggtagtagtactcatatttttcacaaatttttgatgagcacataagactaagggctttaaatttagtactgacgatactattagtataacaagatggtctatttagtacaaatatataggtttaatacaggaattcggcaacatttttttcacctgttt

SEQ ID NO: 4781 - DNA, 378 bp, Diabrotica virgifera
  Clone ID: LIB149-039-Q1-E1-D5
cccacgcgtccgcggacgcgtgggcggcggtacctgattaaaaacagtgaacacgcgagtcgtgtcgccggacttgaaagtgttaagacctgaaataattttgcttttccatttaacagtttttctatcagtgttagatgtcaatacatttacaatttgggacatactcgtatcatatttttttactacgactgaatagttttgtattcatctaaatgtgtcgagaacactagtaacactacgggattttcatgtgtggtaattttaagttacaattgattatatattgttgtaaaaaccttcaattcaaaacaacattttcgagtagttaaacgtgtatgatacacacatttcttcaataaaatgttttgttgtaac

SEQ ID NO: 4782 - DNA, 386 bp, Diabrotica virgifera
  Clone ID: LIB149-039-Q1-E1-D8
ctcgcgggtcgatacacgcctctaaatagcatcatagtagacagttttaccgtcgactggcacgttgcagatgtaaaatgcaaaatcactggtatgggattacttggagacacttatgctctcgctattcaagaaggtattgaaggtgccctcaaccatggtcttatcggaaataccgttggagacttccttaaaatgagattcaacactgtctggtatcccactggcaaagtctggcaaatgctggactattgcaactccctcgtgtccaccccagatacaccacaagcctagttttaatcaaataatcaggttaaaaataactaagaaagtattttcctgtgtaacgttaaaatacaattaaatggtaatatttattatttacc

SEQ ID NO: 4783 - DNA, 70 bp, Diabrotica virgifera
  Clone ID: LIB149-039-Q1-E1-D9
acaagcgtctacactgacgtctgataaaaaaaaaaaaaaaaaaaaaaaaaaaaaaaaaaaaaaaataaag

SEQ ID NO: 4784 - DNA, 295 bp, Diabrotica virgifera
  Clone ID: LIB149-039-Q1-E1-E3
atctagtatcacttcgatattatgcttagaaaattttttgtagacgaactttatgaacatcctaagaatacttccagaggagatagtacagtatagctccaagaaaaactgacgtactggaaaagttctagttacgtgtacaaatattcccgaaaagacattctactgctctacaggattgtcactactgttacgttacatatatttgaataggtagaacaacattgttctgtagaaagagatatgtgcagctgcacagttcagttttggataatcaactttcttggttatccag

SEQ ID NO: 4785 - DNA, 68 bp, Diabrotica virgifera
  Clone ID: LIB149-039-Q1-E1-E4
aaaaaaaaaaaaaaaaaaaaaaaaaaaaaaaaaaaaaaaaaaaaaaaaaaaaaaaaaaaaaaaaaaaa

SEQ ID NO: 4786 - DNA, 375 bp, Diabrotica virgifera
  Clone ID: LIB149-039-Q1-E1-E9
tccaagcctctaaagttggtcgtatcaccttcgttcttttggctgtagtagcagttgtggtcttggcaacagctgaggccagccccaaggcagctcatggagtaagtgtctttaaagcagtggctcttggaaaagttggagcatcatgtgattgcgatacctgctcacaagaatgtgaaagcattggctcagattatgttggaggcatttgttaccaagacgactgttattgtgcatacattaattaaatatgttgaaattgaaaaaaaaaaaaaaaaaaaaaaaaaaaaaaaaaaaaaaaaaaaaaaaaaaaaaaaacacaaaaaaaaaaaaaaaaaacaaaaaaaaaaaaaaaaaaaaaaaaagggggggccc

SEQ ID NO: 4787 - DNA, 398 bp, Diabrotica virgifera
  Clone ID: LIB149-039-Q1-E1-F1
aatcgatactggtcacggatttggcagagttgatacccataatgttcatgaagttgtagaatctagccacggacatgatgatgttcacggtgctgttgaaaatgtttttggtggacatggtggtggtcacggtagtgttagcgtacataaggaagtagtagaaaccactggatatggcggacatcgtggtggacatgcttcaaccataggatctggccacaacagtggacaccaagatagttacgtcgaggaaacagtagaaactgtacgcaggcaaccatcacacactgtatacaccagtggcaaacaccaaactggtcaagaagctttcgaagacgtcgatgaagtaactggaggaaaatctaaaatcatcaaaacaacacaatatgttagacaac

SEQ ID NO: 4788 - DNA, 249 bp, Diabrotica virgifera
  Clone ID: LIB149-039-Q1-E1-F2
ttgttttaaatttttcttttacccttttaatcttgtatattacattacccaattaaagttaattgtacagattaagataaacgagtatcttataacatctattagattgttagaatcaataaatgtagtgtaattgttctgttttgaacaaataaatgcatcattactgttgtttaaaaaaaaattaaaacataaaaaaatataaaataaaaatgtcaaaaggaaaaaaaaaccaataaaaattaaaat

SEQ ID NO: 4789 - DNA, 361 bp, Diabrotica virgifera
  Clone ID: LIB149-039-Q1-E1-F3
ttcgatccacgcgtctgaaatgagtcgtattaaaaaaaaaaaaaaaaaaaaaaaaaaaaaaaaaaaaaaaaaaaaaaaaaaaaaaaaaaaaaattcaataagaaaaaatgaaggctaatctagtaagatatctgataaaatcggattgattcaaataataatagagcatttataatagttaaagaggggggggccccttgtggttttttcactttgttgggtttgtgaaaaagcttgtttttctctaatttggcccccttaatttatttcaggggggtttttttttcacgtttttttaggggggaacctggggtttgggccttgtagttcttgtggaaataaacccttttttgggaagggg

SEQ ID NO: 4790 - DNA, 393 bp, Diabrotica virgifera
  Clone ID: LIB149-039-Q1-E1-F4
aatcaatctaattaggttatacatactggtaacatgaaatgtacttcagtgaatatactagctattctgctggtgttctcatcagccgtcattagatgtgacatcgacacattatccaaaatatatccactctcgaccattgagttagactttcttcagcatctacacaagtcgatagaatatatattggacttctggaatgagccatctactttgagaggacttgttgatgtgcgtgtgtctccatcagactagtatagcttcgaacacattagcggtatgaataatttaaattttgaagttattagtgacatcatgtaagacatattccattaggaatctacagtggacaatcttcagactgtgttaagtgttgtccttactttgggatag

SEQ ID NO: 4791 - DNA, 412 bp, Diabrotica virgifera
  Clone ID: LIB149-039-Q1-E1-G1
accaagcgtccgaatgattgtcataaaagctaaataactcgttcagtgtcaacgtatggaaaggtcagacaagatgttaagacctttactacttttggctttgacagccagctatgtttcgtgtgcgaatcacaccatatacaaagattgctccagaataccattttgcaaaaaattaagaaccattgaaaatcactcaaagtttacagctcaattagacaaattaagtcaaactggcaatgtgatctcgattcctctaacaaattctgatagtcaggaactaatcctgcaaatatctttactggtctatgaaactgcaaggataaaaattgccgaaaagggcagtaaacgataccaactggctgatgttttggcggaagaaccacaaactttagagatatcagcaaaaaca

SEQ ID NO: 4792 - DNA, 420 bp, Diabrotica virgifera
  Clone ID: LIB149-039-Q1-E1-G11
gtgggtcgatccaagcctctaaactgagtcagtaatattataaaagtgtacagttcagcaattgtttaaattagaatcgtataaatattgaaattattttcatgatgaaggttgttatttttaattctcgagctattgctgcatttcacgcattacgtgataatgattactgggtacagtttaaggtttaatacggcacatgtcacagaaattaagtccaagaacaaaatcggttcacactttttcaagacattttaacaaaggtctaacatctttttgacattgattgggacggacaatccacttgtacattgggagtaaccaaattttcagatttgactgaaaaagattttaccgctctgtgaggactttctaagtctgacttacccactagactacatgtgacacaatcactcaatc

SEQ ID NO: 4793 - DNA, 412 bp, Diabrotica virgifera
  Clone ID: LIB149-039-Q1-E1-G12
gggccgacccaagcctctagagaaactcgtaatattacagcaaatggtgatagttgtcaaagtaaaacacattttatgagtacctactgaataatcataatacagtgatatagcatgtgtatacttgacacgtataagttgtcatttaaagatatgacaacatttagcaagcaacaatgacgacgacagtgtcatcactattgaaatttttggaaaacgcagataaaaattttgccaaggattcagattcagacattcgatatgccaatgggagaacattggaccatttgagatgggaagaccaattacaatcgaagaatttactgaatcttgtagcaagcccaaacatcactagataggataaaatccaagatggaacacatggagcaagctctccagcagctcgatgtga

SEQ ID NO: 4794 - DNA, 407 bp, Diabrotica virgifera
  Clone ID: LIB149-039-Q1-E1-H1
gcgggtcgacccaagcctctagaataatgcgtaataagttttgttcgctgcttgtttgtcacaagccaaaataaatcaagatatacatttcgattgggtgcagtataccggagaaataccagagaatgctataataggcggatcaactgctgatggtgatccaacgtatgtagcccgttccttcctcagtgcagatgaagatgatgaaaattactctggaagtgactacaatggttatgtagctggtggtgtgttacctggaaaattgtcgatcgacctctgtactccgcagagtatatacacgctcacaaagaacattgagatactgactgtggtcaatggaacaaaaatcgaatggattaaatcttaccagcacacattcatggacctcttcaactcagacgact

SEQ ID NO: 4795 - DNA, 374 bp, Diabrotica virgifera
  Clone ID: LIB149-039-Q1-E1-H10
tagaacacattcatgaagattgttttattagttttgttcgctgcatgtttgtcacatgccacaatacatcaagatatacatttcgattgggtgcagtataccggagaaataccagagaatgctataataggcggatcaactgctgatggtgatccaacgtatgtagcccgttccttcctcagtgcagatgaagatgatgaacattactctggaagtgactacaatggttatgtaactggtggtgtgttacctggaaaattgtcgatcgacctctgtactccgcagagtatatatacgctcacatagaacattgagatactgactgtggtcaatggaacaaaaatcgaatgggattaaatcctaccagcacacat

SEQ ID NO: 4796 - DNA, 441 bp, Diabrotica virgifera
  Clone ID: LIB149-039-Q1-E1-H3
gcgggtcgacacaagcctctacagtaatgtcgtgacacaggacaacatatagccaggctaaaatggagcttcgcaggtcataacgctagacaaacggacagtaggtggaataccacgatacaacaatggagaccatgagcaggaaagagagcaagaggacgatcccagatgaggtggggagacgacattaaaaagataggaggaacgcactggaaacagaatgcactaaacagaagctaatggaggaaactggaggaagcctatgttcaaaattggacgaattaaagggcaaaagaagataatgcttatattttgttgtaaagagtagtttatttctagctcagtttttctcccccgtgtttatatattcaaaagaagattcagatgacggaaatataaataatcttaatttaatattacgttcaatttctccgctacata

SEQ ID NO: 4797 - DNA, 431 bp, Diabrotica virgifera
  unsure (1)..(431): unsure at all n locations
  Clone ID: LIB149-039-Q1-E1-H6
actcaaaaatgccattatatggcattataacaagttattttgattcaaaacaagtttttgatcaaattttatagtgtagaaaaggttaaaataccgttttttttacattttcctccattcccaaaacacatcataatcgatttggctgaaaattttcccgcagatagccaaaacatatgactttaagtggttagaaggatttgaattatattataatacgtaccacggcatcaggattttttttgaatgaacattaatttttggtgctacgcgcaggacaggcagcggtgttagattcgaacaagttgattttcaccaacatttcttccaatctttatgtaatatattactctgtatttactctatattttgttgtattttaatattttaattccacanaaatcaaactaatttgattattgtttgtgaaa

SEQ ID NO: 4798 - DNA, 422 bp, Diabrotica virgifera
  Clone ID: LIB149-039-Q1-E1-H7
ataattttcatgatgtgtggagttgcctggatgatatctgttgttggaagataattgaatgggatatggagaaaagtttcacagttgctaatgcatggtacaaattgcgtttaggtaaatactgtgattatatttatacacttattaaccgaacagcgaagagagctgatgatcttaccaaagaacagttacttagcatctatttctacctcaatgtctatagaaaaagagctgtggactttgaatatgaatttgctctagaaaaacttgtaaatgatatggacattgatgagatgggtgtagttgccatgggatattttaaaaccaaaacaaaaattaagctagtaaatattcaagaagctctggcaaaaaaagtaatagaaaattcaagtactgcacatgatattacattaacagcaata

SEQ ID NO: 4799 - DNA, 400 bp, Diabrotica virgifera
  Clone ID: LIB149-039-Q1-E1-H9
agtacctgccacagtttcacaattatgactacgtcaaaagaaagaatttttcatgttacggaaattttgttccaacagatgatagcagtcttcgtacttcttgtattgtggcagttatttatatcaaatagccctgttaatagcaaaggtacatggcatattatactgtgtgttacgggtttcgctttatgcatggcagaaggtgtacaaatatttcggcatgagagtgtcgttacatttggcaacactagggaagaaaaaaagctggctcatatgatagttatggcatttgcttttgtctgtataactattggcatctcactaaaaattagccagaaagaagattccaatcgggcacactttacttcgacacatggtattttaggtttaattacatggg

SEQ ID NO: 4800 - DNA, 395 bp, Diabrotica virgifera
  Clone ID: LIB149-040-Q1-E1-A10
ataaaataataaaatattttttagtaaaagtaaagaaaaattttatttaatgatagttaattagtattgtgagagaatattttatttttataaaagaaaaatttattttttgtaccttgtgtatcagggattattaattaataattatatatttattattttcgaatttaaaagagctaaaaaattaaaatttttattgtaaaataaatatttttatattattaatagtaaatatttttagggatgagcttaaaaatacaattttattaaaatttaatttttaaataaaaattaggattaaaaattttcatattttaaaatatgttattatttatttttatatattattatttttattttttataaattttttattaaaatataaatttaaatta

SEQ ID NO: 4801 - DNA, 328 bp, Diabrotica virgifera
  Clone ID: LIB149-040-Q1-E1-A2
aaaaaaatataaaaacctttgtttatttgaatatgatattcaaagaaaagcaatatacctattatctcatcttcatgtttttcgcgaattctttatataattttttccatataaagggttgacgacccaaatggttcaagcttagcttaacctgtattgcaaatcatacgtcctccaaaattgtcaccaatattaatttaattgcccttcttttaaaacctccttaactggaaaaccccggcgttaccccaattaaaccccttctacaaaatcccctttccccaaccgggcttataaccaaatagccccaaaccatttccctttccaa

SEQ ID NO: 4802 - DNA, 382 bp, Diabrotica virgifera
  Clone ID: LIB149-040-Q1-E1-A4
atttgaacttaaacataacgttaacatttctataagtatttgaattgaacttttattcagttaaacagaatgtatttatacagtttttcacttatagttttgaacgtacttgtgctcattattagtgcacaaaaggtgcctccaggagtaccgccacagcgttatcagcaacctccccctccacaataccaaccgcaagtgcctcaacaacaataccaacaacaccaagtgcctcaacaacaatatcaacagcccccaccacaacaacaacaatatcaacaacctcctccacaacagtatcagcaacaacaacaatatcaacaggtgccccaacaggtccctgtaccccaacaaaatgtaccagtacagcaacagcaacatc

SEQ ID NO: 4803 - DNA, 249 bp, Diabrotica virgifera
  Clone ID: LIB149-040-Q1-E1-A5
aaaaaaaaaaaaaaaaaaaaaaaaaaaaaaaaaaaaaaaaaaaaaaaaaaaaaaaaaaaaaaaaaaaaaaaaaaaaaaaaaaaaaagacaaaaaaccaaaaacgatgaaaacaaaagggggggtcccccccaggggtcccctcttttatggcgtgggggggtcttcaataggcctcccctattttccccccctgtcgtttgtctggcccctttttttacgggccttactcgggttaccccgggtttttc

SEQ ID NO: 4804 - DNA, 412 bp, Diabrotica virgifera
  unsure (1)..(412): unsure at all n locations
  Clone ID: LIB149-040-Q1-E1-A6
agatcgtgtgtatctctgtttcctatactgcgagatttaactcttctacgtttgcttatagtttttcgtttgctctctcaagtgttagtgtgatttcttcaaaaaaaaaaagaaagagcgtaattctgccgaaagacgccaccgcgccgccaatacccacagcgaattcaatcacgtggtcgtagcagaggttataagtagcgccgtccccgtatattccgtctcttttccaaagtaactaaagaaagaagtacaagtacagtgatcagtggtctgcgaaacatcgaggttcagaatgccagaaacaacatcgacaaatggatattcaaacggccattccggctacgaaatggcggatggtgctgaatttctcttcacatccgaatccgtcggaaagggacatcnagataaa

SEQ ID NO: 4805 - DNA, 412 bp, Diabrotica virgifera
  Clone ID: LIB149-040-Q1-E1-B1
gatcaataaaatcagagtaataacaaaatagttgtagactattcgttgacaagatgaattcaagtattttggtagttttaatgtgtatgtgcgctgcacaatttgctttcggctcacagcatgagattaaagatggaaaatgttccaacgcatctcaggatgatctaatatttcgtgatcatataaacaaagcttcaattcctttcattaatagagatgagaaggttgaatggcatggagacacaaccatttactgcctacaggtcaccaccgatcaagatgaatcaaaaggtgctacagctactgtaaaggaaggaggtgttggtcattcttttgtgaccgtcaaagtaaagtctggtagaggacatactttggattattacgtaaaatttaaccctaagtaataaatgta

SEQ ID NO: 4806 - DNA, 390 bp, Diabrotica virgifera
  Clone ID: LIB149-040-Q1-E1-B11
caaatttttaaaatgtacactaagtttactgttgttgcccttttattgtgtgttgctttaaatgaagtacatagcggagttatactcggcaaaggattaggtagaagttttacagcatgtcctgatccccttaacccaggaatattggtatccgacaacgacatttcaggaggtctcttcgaatctatcaacttaagagttccagaaataggattgttagaaacgcctatttcatgcatattgatcgttgataaaaagaagagttcaactgacccaattattggtgcaggaggtgtaggttctccatatgttgaaataagtatcaaaccaggattcttcgaatctcttcattataggattgaagtgtacaggaaagcacctgataccacg

SEQ ID NO: 4807 - DNA, 397 bp, Diabrotica virgifera
  Clone ID: LIB149-040-Q1-E1-B2
aaaccatcagcagatacacgacaattaacagaagctacggacgcagaagataccggcatccggtgatattgaaagtggtttagaaaaaatagatagataataatatggctttcaagctggtggtgggcgccacggccttgatggccttttctcttctgagccatagcgtagaagccgctcagctgcagggagtagcaagaaataactccagaagaggtatctgtagcttggaagttcctactattgacctaattcctgcagaagacagacatggcgttatacctagaggaaatggatccagaaacggatacagtagaatagatgtgtgctgtagtggatacgaaagagttccaagaacccacttgcaatgtgagcctgtctgtgatcactgcgaaaa

SEQ ID NO: 4808 - DNA, 389 bp, Diabrotica virgifera
  Clone ID: LIB149-040-Q1-E1-B5
cccacgcgtccgcccacgcgtccggtcgaaagatgagacattagataattgtgattttattttcatttcagagttttaacgtattttatttgcctctttatgaagtcggctcatgtgtttcaaattgtaagaagacatatttgatatttttcaatcccattagcaatttatatgaactttgcataatgtgcaatgcttataaataatgaaacaatagataagctataaaattgaaaataaatttttgtgaaaaatctctttgaggatcactcaagtttgaacatttttcatatcgtattttattatacatttctttgtaaacaatacagactagactaaggaatataagataatgaatttcaataatatgaatagttataagttgttat

SEQ ID NO: 4809 - DNA, 381 bp, Diabrotica virgifera
  Clone ID: LIB149-040-Q1-E1-B6
gttaatttcaccattgcaccatcagtatttgtatcatttttagatattttttcaggccatatagaatccataaaacgatacttcaagatccaaattacataaatatgtaggtccaacagcttgaaacaaactaatcaaaatattttctctcacaaaacaacccacggtattattttcatgagcaagtatctacaatgattaaagaatatttgactgttggtgctgagtccaattgtagtaattttattgtgatgatactttggcaagatccacataacaatgatgttcgtcacatgttctaagcatatacaaccaacattcgtcggagtatattcttttaagtacaagcatagcttgtaccttaaaaacattctaaatttc

SEQ ID NO: 4810 - DNA, 321 bp, Diabrotica virgifera
  Clone ID: LIB149-040-Q1-E1-B7
acggacgcgtgggaaaaaaaaaaaaaaaaaaaaaaaaaaataaaaaaaaaaaaaaaaaaaaaaaaaaaaaaaaaaagaaagaaaatcaagatggttactccattaggtaaacatgtaacatacgcttgaatctcttcctatctgtcttctacattcacatcaaagtccatttttttggtctcccttttatgtgaccaccctggttttaccctatttgatcgttttgcctcactccttttgttctaaatttgttttgctagctttttggttatcaccgttgccccttcatatccctttcacatcctatttggaaactggtat

SEQ ID NO: 4811 - DNA, 395 bp, Diabrotica virgifera
  Clone ID: LIB149-040-Q1-E1-B8
attaatattatttcttgttgataatacaaaagagaccatattattagaaactgcattcgaaaaattaaaaaaatgatagatattatgacgcgtagatgagctgacaagtgacgtgttaagatgtattgatatctaaacatgaaatttcaacaaaccatctatgttatagatgtacatatgtttcgtaaaattgacgaaaagctggaaatagattacatataatttgtcataaaatatttgcgtcagagacttgaggttgtgatacaatatatatttactcctacagaatatttgttgaatattaccgacaccattaaaataccttatccgttatgattgtagataaataatttactctgaatttaatacaaaacgatgtcataatttcaattgta

SEQ ID NO: 4812 - DNA, 395 bp, Diabrotica virgifera
  Clone ID: LIB149-040-Q1-E1-B9
agtaattttttgtgttttgtctacataatttaagtttaccgcgtaggtatagtttggtgcttgattaccccggaaatgatcgtcagtataatgtggtgaaacttaaagaaaatgctacacaattaagttaagaaaaatcaccattgtaacgaaaagactgctttatattataacagaataagactacaacatttatggaaggtgctgaattgaggagaaactcaaagagaaaatccaaacttaaattttcatcgttcacctcatattttagaacgagtaagacaggaaatgacttaatatcatcccctactaatttcgagagaatggacttattcccagataacatttctccagtggttgatatccaagaatgtccattcgatgttacgggatac

SEQ ID NO: 4813 - DNA, 392 bp, Diabrotica virgifera
  Clone ID: LIB149-040-Q1-E1-C10
aatttgcaatgggccatttttgaggagggtgttgacaatatgtctagagcagcagagatattagtaaatttggaaaagtctgttccaaatgttttacagattgcttatcggcggataaatttagaaagacgacggggcgatcacgaaaaatgttgccaacttttcgaacactatataaatagtacaaaaaacaaaatcattgccagcagcatatcaataaaatattccagatttgcttgctttatgatgaaggacgttgaaaaagcacaaacaattttaaaaaccgctattgctaaagatccaaataatcctagactgtatttgcagcttgttgatgtcactttacagaagggagatccaactgaaaaaaatatcactgaaatcctaaatat

SEQ ID NO: 4814 - DNA, 335 bp, Diabrotica virgifera
  Clone ID: LIB149-040-Q1-E1-C11
ctctacagtgacttgggctaattcacgccgcttgatgctggacagcttcatcttaccacaagcagatcatgtgatgtcatctaagtttgcgcagtacggctcgatcttcaacgatgtatatcttgtggattatctgaccggcgacttcgtggtggaacaatactatggacaattggacttaactggaaaagtctccaatttacaaaagacgatgggagaacacggaccccttggcgatcggctctagcatgcgatactccaaggaacctcttcataacttcattagatttgtaaatatctttagtgcagtttttgatttgaccgacgtgatactg

SEQ ID NO: 4815 - DNA, 334 bp, Diabrotica virgifera
  Clone ID: LIB149-040-Q1-E1-C4
gtcaaacatcttatgaattataaattatatactgattactgtgcgaattacagttagcaagggggtcaaaatattattgttaaacctgtacatgtaagttgtatactgtaattgaaacgatctacgcttataagttgatcaagatattcagtaaattttgattcttaaatatattgcaacaatataattatttaagaatatatatattattataattaaatattttgatgtataatcttaagaatgatacatttatatcatgtaatttcaatctagtaattaggaataactgatatcatcaatgatgatatgttacaagtgatgtttacatatt

SEQ ID NO: 4816 - DNA, 143 bp, Diabrotica virgifera
  Clone ID: LIB149-040-Q1-E1-C6
aaaatatttaaagtatatttattttctgtatatacttaactaattatttattaggaataaaacctgtatatctttagaaataaatgtgttttattattgttatatgtaattgtgatttagtattgttataaatataactgctt

SEQ ID NO: 4817 - DNA, 68 bp, Diabrotica virgifera; identical to SEQ ID NO: 4785
  Clone ID: LIB149-040-Q1-E1-C7

SEQ ID NO: 4818 - DNA, 375 bp, Diabrotica virgifera
  Clone ID: LIB149-040-Q1-E1-D1
cccacgcgtccgtgaacatcaagaaactcatcgagctgcagcagcagatactttggcttatttgacagaggttgacagcaatcttcagcaggtggcagctatcagtaaccagttagttagtgctctagtcgatctattgaaatgtcccagtgttgctgctcgtggagctgctttcagggcatttgcttctttgggagccaatgatgaggacatcagaaaaaggatcatcgacaccaaatgtttgatggatcgtgttgtggatggattaggagatgacaataaagaaataaggttagcagctgtaagatgtttacactctttgagcaggtcagtccagcagttgcggacaacttttcaagatcattcagtgtggag

SEQ ID NO: 4819 - DNA, 389 bp, Diabrotica virgifera
  Clone ID: LIB149-040-Q1-E1-D10
tgaattttggtattagtatactgttttttacaatatgtgtcaaccaaggatttttggcggcttctcagcgaaaaccttcaaaaccagaaaaattgccttggtcaaacgacagactttctaccaaggagccagaaactagctcatatcgtccatggtccacaacagaatcttatccttcgcgaacatcgtctcgatcagacagcagcactcgtagaatctggtatagcacctctgactcttggcgaacatcaggacgatgggatggcaccactggtagaccctcatattccaccaatgacccttggcgaacaacaggacgatgggatagcaccactggtagaccctcgtattccaccaatgacccttggcgaacatcaggtcgatgggat

SEQ ID NO: 4820 - DNA, 60 bp, Diabrotica virgifera
  Clone ID: LIB149-040-Q1-E1-D2
aaaaagcgtcagtaaacatcaagaagaacatcgaactgtagcagcagctaacatggcagt

SEQ ID NO: 4821 - DNA, 393 bp, Diabrotica virgifera
  Clone ID: LIB149-040-Q1-E1-D4
attaatgtcaagtcaagaatgttactgtatgttgtagtcaaagtaattaatgattttaatcaatgatagataattagtattgtgatagaatcaattatttttattatagaaatttttaatttgtgtaccttgcgtgtcaaggatgattagttaatggttacactcattactaatttcgcatttattgtatctctcgagttataattttgagtgttcggtaaatagtttatatacgtttattcgtcatcagatgatattcgtttttaaatagagcaaattttttaattaacctgttaaatttagttaataacagcataactgtaattagttagttttaaaagattaatgttcaagatctttagggttgatcgtcgcgattaaactttatgaaaa

SEQ ID NO: 4822 - DNA, 408 bp, Diabrotica virgifera
  Clone ID: LIB149-040-Q1-E1-D6
agttttattacccagtaggatgcgtttatttatttcatacgttctatcatttctgccactcaccatcactcccaagtatttgaaacggtgtactctttcaaaggtatatgcaccaaacttaatttctttctcgatgtttgaacacttgagctatttcgttttgctctggtttattactagccctctcttctttgattctttatctagtattaatactaactaaactatactatcgaattatgaggagtgacccattcttctctactagtcgcaaatttcttcgaatatctcatgaggttctggacgaaattcagatcaatttctgtttttcgcaaatttgccatcttaattgttcttctcttgggattcccagcctccatgataaactgttgacagtaaagccaaaaa

SEQ ID NO: 4823 - DNA, 65 bp, Diabrotica virgifera
  Clone ID: LIB149-040-Q1-E1-E1
accaatcggtaaaagtacaaaaaaaagtttgggtaaacttttgcacaactgtgtaaatactaacg

SEQ ID NO: 4824 - DNA, 397 bp, Diabrotica virgifera
  Clone ID: LIB149-040-Q1-E1-E11
agtctagttcttctttccctagtaacccttagtgtagctgcctactacccaagtactggtaggcaggtgacagtaggagtagctggaaatgtgaaactagtcggctctcaaggttcccagattgacattcgtagaagtccttacaacccaagaactgtcgacgtcaccctcagaagtccaaatgctccaaccagaactctgcaaattgatgaagccaggaacggccaacaacttggttattccaacctccaaggtgtcaacaaccaaggtgtcaaccaggctgatgttcttgctgatcttttcagtcaatatgagggtattgtagatgaccagaccttctacagtttgttgaacaaacttcaacatttggtacaagctggagtcatcaacagagtag

SEQ ID NO: 4825 - DNA, 72 bp, Diabrotica virgifera
  Clone ID: LIB149-040-Q1-E1-E2
acaaatataagtttgggtaaacttttgcacaactgtataaatactaacgaacaaaacaaaaaaacagaaaga

SEQ ID NO: 4826 - DNA, 394 bp, Diabrotica virgifera
  Clone ID: LIB149-040-Q1-E1-E3
cccacgcgtccggtcactgtcattacaaatccccaaaaaatccaaagttcttaaaaatattctactgaactaatttcattaagttttttactgactcacgtgttattatacttttaaaagtctaaaccgtcatatattatcattgtgacatgatattagcgtaaagtttactttaatataattacaatgagtgcagctcagaaagaggttaatggggctcctcctggtgagataacagcaagcaatgaagaacctggtgttgcacaaaatgatgctgcccaacaaagagctccaacaaaaatggaatcatttctggctgtagttaaatctctcataataagagcaatgatcatgtattttatattctcattctttagaagtccacaaccccaaa

SEQ ID NO: 4827 - DNA, 88 bp, Diabrotica virgifera
  unsure (1)..(88): unsure at all n locations
  Clone ID: LIB149-040-Q1-E1-E9
tagtgagtcgtattatggagtnctcgcagtaggtccgggcgtggtccggcactcaactgttgggtatcgcctcggtggcgttggttta

SEQ ID NO: 4828 - DNA, 408 bp, Diabrotica virgifera
  Clone ID: LIB149-040-Q1-E1-F2
ctccaacaattcttcctttcccaattacccctaatggtaccggccaacaacccagttactggtaggcaggtaacattaggattacctggaaatgtgaaactattcggctctcaaggttcccagattgacattcgtagaagtccttacaacccaagaactgtcgacgtcaccctcagaagtccaaatgctcgaaccagaactctgcaaattgatgaagccagaaacggccaacaacttggttattccaacctccaaggtgtcaacaaccaaggtgtcaaccatgctgatgttcatgctgatcttttcagtcaatatgagggtattgtagatgaccagaccttctacagtttgttgaacaaacttcaacatttggtacaagctggactcatcatcagagtaatcttggat

SEQ ID NO: 4829 - DNA, 107 bp, Diabrotica virgifera
  Clone ID: LIB149-040-Q1-E1-F6
gtcagcccacgcgtccgattttttaagaaataaattaaatttatttattaacattacacttatcattacttatgtgtgaaatagtaagcttagtcagtgttatggac

SEQ ID NO: 4830 - DNA, 412 bp, Diabrotica virgifera
  unsure (1)..(412): unsure at all n locations
  Clone ID: LIB149-040-Q1-E1-F7
cgacgattacaagaagcgaacccgtgagcagagcgaatgcaatatacgaacccacgagcagtgcgatagtactagcgatatgaatataccgccccgtgaacagaacgacaatggaaaccattcgaacacacgaacccatgaggtgagcgataatgaaaccgattccaataaacgaacgcatgaacaaagctctagtagtgacgcctttaataacagaacccatgaacagagcggtagtggtagcggttccaataaacgaagccttcaacagagccctagtggtagtggttccaataaacgaagccatgagcagagtgatagtggtagcggttacaataaacgaagccatgagcagagcgatcacggtagcggttctaatanatttatccacgaggagagcgataatgatgac

SEQ ID NO: 4831 - DNA, 394 bp, Diabrotica virgifera
  Clone ID: LIB149-040-Q1-E1-F9
actacagtacaacaaagggtcgctgtgttggtttccaaaggtccataggctagcacatgtgactattacagactgctttgataccatcctggaattattgtgattgttggcactcaacacttagattaaatcagacaagatgacaccgcatcagaatgcggtgtgctcgattattgagctagagcaaacatctaaaaattatcgacctatcggcacaagagttgaaggtttcaataagttttgttcacattatcataattattgtaacaatagaccctacgactaaaccacattgaccctttgccacatgccctaagtgtgaagaaattctagcaaatgcttcatgctgtcatggtatttctttatagaagaaatatagtggaaatatttaaag

SEQ ID NO: 4832 - DNA, 385 bp, Diabrotica virgifera
  Clone ID: LIB149-040-Q1-E1-G10
agttacgtagtattgtgaagagaatattttatttttacatgaagaagatttaatttttgctacttgtgtatcacggattactatgtaataattatatatttattagttacgaatttaaaagagctaaaaaattaaaatttttattgtcatataactattttaaataattttcttgtaatgatatgtgatacatttttaaatatatctaattttttatgaaatacattatatttatttagtaacactatatttagacttaaatagttttacattattaataggaactatttttagggatgagcttaaacataacattttagtaaaatttattttctatgtaaaaattaagagtacaaattttcataatttaaaataagttactaat

SEQ ID NO: 4833 - DNA, 93 bp, Diabrotica virgifera
  Clone ID: LIB149-040-Q1-E1-G11
aaaaaaaatcaaattaaaaaaaaaaaaaaaaaaaaaaaaaaaaaaaaaaaaaaaaaaaaaaaaaaaaaaaaaaaaaaaaataaaaaaaaaaaa

SEQ ID NO: 4834 - DNA, 376 bp, Diabrotica virgifera
  Clone ID: LIB149-040-Q1-E1-G4
aaaacatgaagactgctttggttttgactcttttgttttgtgtcggtcttaccgtcaacgccaaaacagctaatatgccagagaaacctacccatcatcccgccacccctgagcccgagcctgacccagaggagtttcagtgcgatgcttgcataacgtttgcaactgttatcgatgagttggtcgaagagagattaccattggacgaagttgagagagatgccagcttaatatgccgcatattaccaggtaccttaggagaattttgcgaacaacacttacttccaaaagttgacaaaatctacgaagaatgccacaagcatgaacctcaagatgtatgtgatcgtttggacttctgttagagagacattaataa

SEQ ID NO: 4835 - DNA, 395 bp, Diabrotica virgifera
  Clone ID: LIB149-040-Q1-E1-G9
aaaaaggtccaaatttgaataatgtctcgctagattctcaaagctatatttgtttaagcaaaaccgaaaagtctatttttatttgaaggatacaaagaaagcttgcaaaatttctggttgaaactgaaatctcccaacaaaatttcaaatacgacgcatacattttttactccccgtttcttataaatctatatcaagaaaaaactacaataaatcttaaatgatacattaatacaaaggtttgacaattttttcacattgaaggggtcgattatttcgaaggtacaataaggtagaactatttcaacactacgatttcaaaaagttatatttctctatgaaaaatcaaaaggtccaaatttgaataatgtctcgctagattctcaaagctatat

SEQ ID NO: 4836 - DNA, 334 bp, Diabrotica virgifera
  Clone ID: LIB149-040-Q1-E1-H12
agttttatggctgcatccaccagtctcctgtgccaggtttccgttgtcataacatctatcagcaagccaccatgtcgagttgcgatggatatctgaatcgtgccatgtccgtggcatgtgcggaagccgtcgattttgtaaccgtcccatgcttggcaggatggttgctctaggacttcacgctgttgttaactacaatgagacggctaagacatactgtctgtacttagtacgcacgtgagacgatctgcatctagtaccaaacacgtcagttgaagtccgtaaccatacttcatgcgtcaagttcactgattctatttacgattcagtgaca

SEQ ID NO: 4837 - DNA, 305 bp, Diabrotica virgifera
  Clone ID: LIB149-040-Q1-E1-H2
ggcaaatttacaaattactataactttacttttaatgttttctaaactcatataaatatacggagtttaatttgttttaaaccccattgttttgaacaattaatttcagatgcatatatttttgcatatataatgtgaatttttcaataaattgtcaatctagtatcacttcgatagtacgcatatataattttttgtagacgatatttatgaacatcctaagtatacttcaacaggagatagtacagtatagctccaataataactgacttactggaaaagttctagttacttgtagaaatatt

SEQ ID NO: 4838 - DNA, 372 bp, Diabrotica virgifera
  Clone ID: LIB149-040-Q1-E1-H5
cttctaactaaaacgaaattcatgccagaacccgaaggatggagaaggagtcacaggccatcgatcagggatataagtataattaacgaagaagaggaaaaagaaccgcaagaagtctctagtgattcggggcagatcaaaactatagctgtcatcaaagaggttgtttaaacaagtaaaatgaatctgtcaaaatggaaaaaatagtttgcttggaattatttaaagttcaattttgatgatacttcatgatctaacgaacctacagaagtaacaaaactgatctaaatttgatctttgtctaagtttaaagagttctcgtagaaaaaaaaatagtgtgcgctgtacaatcaacttatttcgaacaacata

SEQ ID NO: 4839 - DNA, 265 bp, Diabrotica virgifera
  Clone ID: LIB149-040-Q1-E1-H8
acttaagaggtgctgatgtgggatcagaccacatgctaatcaaagcgagactaaaaatgaaattagccagagataaaaaccaaaaaatcagcagaaggaacaagtacaacgttgatgccctaaaacaagaatgtataagaaataaattcagtgagaaactggcaattaaccgaacagtatcacaacaaactggagagtcagtcgaagaaacatggaaatattttaaagaagtgatgacgaatacagcaaaagaaacaatcggatt

SEQ ID NO: 4840 - DNA, 394 bp, Diabrotica virgifera
  Clone ID: LIB149-041-Q1-E1-A10
atattaatagcattatgggtagacttcctaagtgatgcagatacatacaattttagtacgtatttccagtagaactactgcaataacatcaaacaatgggtctattgttatacgaaggggttgtggaattaataccaatatgaccattcaaaattttcataaaattttggataaaatggtacccattagttgttatcagttaagtttaaaacttggcactcatggagagctataccataatatataataggtatatctcatattacatctcatattgttcactacagtagtaatcagtgagcctgcatacacagaaccataataatatattatggttcgtgtatgcgggctcactcattgcaatagtgagcaatatgacatataacatattata

SEQ ID NO: 4841 - DNA, 420 bp, Diabrotica virgifera
  Clone ID: LIB149-041-Q1-E1-A11
ggggccaaccaagcctccggaaaaacttgggaaaccgggttgaagggcaatacaccggggaattacaaaaaagccctttgggccaaatccgactaattccacaattaacccaaaaggcacggtaacctaagataaatcggtacgcctttacactaaaacaaacaaattactagctttcgtcaaactgccattagaataaactcaatttttgatgtttgctgtcgaaagtcacctacatacactgagacgctacttgtttttcttttgagtgtagcctaacttatgtttctttcgcggttacattactatacagaacctgttgccttcggaaactctcaaaggtttcgaaaagagtacaaattaacatgtagaagaggatctgatcacaccaaatataagttagattaagttcaaagttga

SEQ ID NO: 4842 - DNA, 371 bp, Diabrotica virgifera
  Clone ID: LIB149-041-Q1-E1-A6
acccacgcgtccggcaccctgatgatggttgtaatcatgaccgaaagcttggattacggaaacttgaaagagtgcgcttttcatttgctgcatagcccaatatcctaaatttctttctatatatatatatatatttatataaaatagaataaaagttttcaaaaaaaaactctatatattcaaaggtaaaagtgtaaatttctaaagttttaaagtgattatttcgacatttatattaacctgatatttctgatagatttatgtattcaaatctgtatgtatatatccggtagttccctgtaatttgtgtccatgtgggggacttttttataataggttttactacagaatggctattcttcataaggggc

SEQ ID NO: 4843 - DNA, 263 bp, Diabrotica virgifera
  Clone ID: LIB149-041-Q1-E1-B12
tccaagcctccaaaataaattcttataagaaaaagtaaaaaaaaaaaaaaaaggggtggcgcaacgtaaggattaaatttaaagtgggggtagattccaagtgatgagtccgcaaggggggcctcctagaattggtttaaggtgccgtttgtatcaagggtaattaggaggtttccctaggggtaacacatttaaaatgggcggaccttcgtgttcaaggtatttactgggttaaacctagttttgcccgtttaaatggcctt

SEQ ID NO: 4844 - DNA, 384 bp, Diabrotica virgifera
  Clone ID: LIB149-041-Q1-E1-B2
accacgcgtccgaaatttttagaatgtacactaagtttactgtagttgcccttttattgtgtgttgctttaaatgaagtacatagcggagttatactcggcataagattaggtagaagttttacagcatgtcctgatacccttaacccaagaatattggtatccgacaacgacatttcatgacgtcacttctaatctatcaacttaagagttccagaaatatgattgttacatacgcctatttcatgcacattgatcattgataacatcaagagttcacctgacccaactattggtgcaagacgtgtacgttctccatatgttgaaataagtatcaaatcaggattcttcgaatctcatcattacaggattgaagtgttcaaga

SEQ ID NO: 4845 - DNA, 168 bp, Diabrotica virgifera
  Clone ID: LIB149-041-Q1-E1-B3
aatacgcttgggctaacacatgagcggacgcatgtgtccatgttgggaatcggctgacattctgtggcagtagtagcagtttatcacagagaaacatacacggtcagcactggcagacatcattgaactcttacgcgatccctgactacttgaagtgtcatgtgtagc

SEQ ID NO: 4846 - DNA, 419 bp, Diabrotica virgifera
  unsure (1)..(419): unsure at all n locations
  Clone ID: LIB149-041-Q1-E1-C11
aaagttttcattttattaaaatatgaaataaaattggccaattacccgggttaaacggccttgcgggccgggtaaaacttcaatgcgggagcaaatgaaaatgagggaattcaatgatttgcaattcacatcccacctgtcaagcgcggaaaaaatccaacgaanaaatggaccctacatactaatacaaatgagtaatactaatacaaataaaaatgaataaccattttaagttcggtaagagtgcttgtactgctctttaagagaacaggaatataacgcagctttggcttcgtgttgcaacgaaatgaaaatggttattcgaaaatggaaaatcgaagtaaaacaggcatgagcctaatcataattttcctttgattcctataacaaaaaaaatttttttcccctgggtttttttt

SEQ ID NO: 4847 - DNA, 422 bp, Diabrotica virgifera
  Clone ID: LIB149-041-Q1-E1-C12
caagcgtccgaattaatttaaaataataaaataatttttaagaaaagttaagaaaaattttaattaatgataggtaaataataatgtgagagaataatttaattttaataaagaaaaatttaatttttggaacctgggtaacaaggaataataattaataaataaaaaattaataatttcgaaattaaaagaaccaaaaaaataaaaattttaatggaaaattaataatttaaaaaaattttttggtaaggaaaggtaatccgttttaaaaaaaaccaaattttttaagaaatacatagatttacttaataacaatataattaaaattaaataattttatattattaatattaaataattttacggatgagcttaaaaataaaattttattaaaattaaatttttaaataaaaattaagatt

SEQ ID NO: 4848 - DNA, 229 bp, Diabrotica virgifera
  Clone ID: LIB149-041-Q1-E1-D1
acaccttccaacaaatgtggatagagaggccaaaatggtaccaacgatggatacagagtattttctatctgtgggtgcgatgatcgtaagcgacattgtacgatgatccagtggagtgatttctgtccgcagtctttcagcgcgagcagtgaactttgaagtgtctggattcaaaagtatagcagatagagactgagactaagtattagtatctcaattgatgtaagtt

SEQ ID NO: 4849 - DNA, 438 bp, Diabrotica virgifera
  Clone ID: LIB149-041-Q1-E1-D10
aaatatctatatcactatacatatcttcgtcatatatttctacttccattatatcatcggctgtttttactttgcttatatatcttagtacttcttcagtgtttcctaagtctaattctatgttcacttcgtctatggtcatctctttgaactccgtttcaattcctactatcctcttcatcagaaactagcactaggcctcttcaaggtacacattgtgtacaattttacaggattgtggactcagtgtcctagttttcacgtcacttgtaataattatgtttaaaaaatatggtaaatgtaatcaccaacacgttcaactgacgtcccctttccttgatttactacctgagtgagcttcgccgttgcagatatttctgcacacttgtacgttgtttccttcatgttaggtaacactaccttttaataataataata

SEQ ID NO: 4850 - DNA, 215 bp, Diabrotica virgifera
  Clone ID: LIB149-041-Q1-E1-D11
tttgaatggccacggcattttaagcgggttaaggtagtataatcattatctttataactgaaagctgggacacatggttggatgaaaaggttactgtctttattgactttagactgaatttatatttatgttcataggtttaaatttttttataagagcagtagagcctatatagttttaagaattagtaataagtttttttaggactaaattta

SEQ ID NO: 4851 - DNA, 341 bp, Diabrotica virgifera
  unsure (1)..(341): unsure at all n locations
  Clone ID: LIB149-041-Q1-E1-D12
cttcaatggaccaaccttcccttgcctccccgccttgggccccgaaaaattttggcaacaaagacgcaatttacgcatgcaaccaactgctggcaatatgtgacagttgaattgtacaccaaaatttgggctatcgatgcagttgaatctgacctacagaagtcatanaccatcatttcatcagatccttcgagtatctactcctagccaacaattttgccacatatganaganacagagcaagattcgaaaaacttttccgtggcttgtctgacaacaagtggcatgaaggtattgaatttattaagtatcttacctctcgtggtggacacatgaacttc

SEQ ID NO: 4852 - DNA, 351 bp, Diabrotica virgifera
  Clone ID: LIB149-041-Q1-E1-D4
agcgtattgagcgttgaataacgttagaaataacattagaaacaaaaaataaacaatatacttgccactaacaacatcaagcgctagaaagtaatttatcaggtaatatttatgtaccaagtcactaaagtgactctttatcgaacgcgtctgatattacgagcagagggagcgaagcgagcgaggcgagtaaccgactagttctataaagagtctttactggcgtggtgcatacaaaattttatcgccaatcgcaaaaaacataaatacttacttaacacttacttaattacatcatccttctaataaaaaaagagcgtgtgtactttgtacacacttaattatacttct

SEQ ID NO: 4853 - DNA, 374 bp, Diabrotica virgifera
  Clone ID: LIB149-041-Q1-E1-D7
acccacgcgtccggttttatacaaattattgatttatgcatatatctgaaaaaagattttgtggtaataataccacattatttatgaaaaaatgtaactttaagactccttagcaaagacctgacaaaatatatatttttgccagggatattttctgaagttgaggtaataatttgtaaataatgtagtatttcaaattagttaattttatagattttcaatatattgctcatctggaagaagagagtcacaactcaaaaaacagcttttttcaggaaacgcagttagtatacgcacatgaaaaaatggcacatacaaagcaaacagcccgaaaatccactagtggtaaagcaccacacaaacagttggcaact

SEQ ID NO: 4854 - DNA, 347 bp, Diabrotica virgifera
  Clone ID: LIB149-041-Q1-E1-D9
ataaaatcagagtaataacaaaatagttgtagactattcgttgacaagatgaattcaagtattttggtagttttaatgtgtttgtgcgctgcacaatttgctttcggctcacagcatgagattaaagatggaaaatgttccaacgcatctcaggatgatctagtatttcgtgatcatataaacaaagcttcaattcctttcattaaaagagatgagaaagttgaatggcatggagacacaaccatttactgcctaaaggtcaccaccgatcaaaatgaatcaaaaggtgctacagctactgtaaaggaaggaggtgttggccatcctttggtgaccgtcaaattaaa

SEQ ID NO: 4855 - DNA, 417 bp, Diabrotica virgifera
  unsure (1)..(417): unsure at all n locations
  Clone ID: LIB149-041-Q1-E1-E12
aagccttcgaaggaggccaaaacaacaatggagaaaccgtcaaactccaacaaaggttggactggcaatgcaaaacaacctcaacctaacgggggtaaaatatatgcaaggaatcctaatccaaaggaaaatccacaaccaaaaggactttcaaataaaccttgaagtatccaacaggcattgagttaattttaagttacatataagactatataaataatttatgtatagttatttacggtatgttttttacgtcacggtattgaaatttgtataaatcatatttatgcacctacatctaacagaatanatatatgaaagtttacaaaatatgtttttttatgtataatttatcgataatgtatgtttatcggtaatgttcaaattttttatacattgttaatataatcatccaat

SEQ ID NO: 4856 - DNA, 218 bp, Diabrotica virgifera
  Clone ID: LIB149-041-Q1-E1-E4
tcgacccacccgtccgaaaaaatatcctacaatttggaatacattttgtcgtctacccgtcgcctacccgaagtatatgtgtagcctacccgcatactgaggtcacgagccgccactgacatctttgccaagtatgccaatttcaaggaaataattaacatttagacgcactcgcgacccctattaaagaaacggcgaaaccaagcgactccattttc

SEQ ID NO: 4857 - DNA, 84 bp, Diabrotica virgifera
  Clone ID: LIB149-041-Q1-E1-E5
aaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 4858 - DNA, 386 bp, Diabrotica virgifera
  Clone ID: LIB149-041-Q1-E1-E6
acttttctacatggttgtattggttaatatttctgttcagtttatttaaggaaaacttttattgccactacataaatgtggagcataccgcaaaatgaactgatatcaaattctaaacagattgtacacatttttttatatcgcctataaatagataacttgcttattataaaatgcatcaatgcgatcaataataccgttaggttttttactacataactattttttcaaatttatgtgtaggtcataacaaattttggtccatgagtgtatctactctagtctgtgatgttatttgagaaatatacttgtaaagattctgtaaggtgctaaaattaatatgacgagatattttcagtagtcctatgagcaagaacatttcaaat

SEQ ID NO: 4859 - DNA, 366 bp, Diabrotica virgifera
  Clone ID: LIB149-041-Q1-E1-F1
gagcgaaagtgccattggtggaaaagataccaaattattgataatcatcggtggtctagttgcagcagtgggagtcgcagcttttgcttataacattatgaaaaagaggaaagctactgctgcagagtccagagttcctacccaaatgaacggaaatggggacaggaatgatcccgaagaaggacgagagatgaaacctttgatgaagtctcctcagccaaacagcagtgtcgaatataaagatgaaaaataggaagtgtgtgagtgggaaacaaaaactctaatatttattatgttatattaatgaataggttgcattatgttaaccgtataagcatggacaaatgcattaaagtacaaacggga

SEQ ID NO: 4860 - DNA, 358 bp, Diabrotica virgifera
  Clone ID: LIB149-041-Q1-E1-F10
acgcgtctgaagtaacttgggcaatgtatttataataggtaatgagttttgaatcgtattagtattatgctagttgaatagtaaatgagtgactataattatatgttcgtagagtgtaaatttacgtagagtttgatgttggtcattggataatttaataataaagggggggggcccccctaggggtatatattcgagtttacttttaaggagtgttaatgtccttcaaatggggtccacaatttttattttcggggcgtgtttttctaaagtttttacgggggaattccggggagatccccaccagttccccttggaaaaaaatcccttttgttaacaaggggtatatttataaggg

SEQ ID NO: 4861 - DNA, 412 bp, Diabrotica virgifera
  Clone ID: LIB149-041-Q1-E1-F12
ttcggggaataataaataataaataaaaaattaataatttccaaatttaaagaacctaaaaaattaaaattttaatgtaaaataaatattttaaaaaatttttttgtaatgaaaggttattcgtttttaaatatacctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataaatatagtaat

SEQ ID NO: 4862 - DNA, 287 bp, Diabrotica virgifera
  Clone ID: LIB149-041-Q1-E1-F3
ttatatttttatttattttaacataataaaatattttttagtcaaagtatagaaaaattttacttagtgatagtttattactaatgtgagagaatattttagttttatcatacgaaaaacttagatttttgtaccattgtgtatcaggggattattaattaactaattatcatatttattcactttcgaactttaaaacgagctacaaaatcttaacaagtttttaattgtaaacaataagagtattttaacatacactttttattgataattgacacatgttatat

SEQ ID NO: 4863 - DNA, 176 bp, Diabrotica virgifera
  Clone ID: LIB149-041-Q1-E1-F7
gctcctgctcctggtataccacacagtcatgctaagccattggtacattccaagggacgcaaatttgagagagcacgaggtcgtaggcgctcatgtggttacaagaaatagacttaagttaatcattttgtttctgctgtattcatatttgttgttcaataaataggaattgcagt

SEQ ID NO: 4864 - DNA, 330 bp, Diabrotica virgifera
  Clone ID: LIB149-041-Q1-E1-F8
acttaaaataacaataaatacacaattttgcgtaaagtttactttaaaaatatattgtacatttatgtataagtcaaaaatccacgtaatttttacataatattcatttaactggtctcagtctgtttgctagaaataaatcagttttttgtactattaatttttactgtttttttttttataaaatagacaatggtttttgactgagttattctacatatcgcacctccgctcaaagagtgtcataactcaaaaaaatttaaaatcggttttattgcaccaacagtttaataaaactataaactcatatctcacaaaagtgtcacgttt

SEQ ID NO: 4865 - DNA, 381 bp, Diabrotica virgifera
  Clone ID: LIB149-041-Q1-E1-G1
aggacgcatcgggtcacgcctacagttttaacaagctccatagtaggcagcaccgctggatcggcgttcgcgtgcgtgaacgtgtgtatcactatacaccgttgaactgttgatagatcggcggagtgcaggtcggcatgctgttggtcaagcgcatgatccagctcaagatccaagtctgaacaagatgatgctaaagttgaccctagacaagataacgcaagtgacaataccagttgtaggagcccatatgtcatatgttaagcaagtgttcgatcagctgcgcaataaggaacacttgaagccagacctcatgatacttggcaacgtacgcgtggaaataaattaggcgcaaaatcattcacagcatcaatgtctgga

SEQ ID NO: 4866 - DNA, 449 bp, Diabrotica virgifera
  Clone ID: LIB149-041-Q1-E1-G12
cgggtccatcaaggcgtctaattttttactatatatttaaattcgtggtaatcacttttttttacttctattttttttgtttattttttggtttttttatatttcttttctttttttttgtttccatttttttatttatttatttttttttgttattattattttattaagtatatgttcttttttatatatatttttctttttaattttttcaaaccaaattaacaaattattcctagtttacaacttgtatttacataatttaacattttacagaaaaccttaatcataagtttattacaaagtcatttatatgtgagtagtgtggttaagtttccggcacaggtagaaagaaataaaggttaatctgttgcccatttaattattatacctgctattcagtatatttactcctcaaaacttaacgactcaactcaaatacaaacgat

SEQ ID NO: 4867 - DNA, 51 bp, Diabrotica virgifera
  Clone ID: LIB149-041-Q1-E1-G4
aatttaaaatcataagatcttttttagtccaagtgaagcaaaattttagtc

SEQ ID NO: 4868 - DNA, 87 bp, Diabrotica virgifera
  Clone ID: LIB149-041-Q1-E1-G6
aaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 4869 - DNA, 396 bp, Diabrotica virgifera
  Clone ID: LIB149-041-Q1-E1-H1
aaagacgcatgagttaaaatcaataatgatgtttttaacaataataaaacaatgattatattaactgataataaacgattattgtacgaaatcagcaacattttattcacatgtaattaattttcaggaccttgagtagcagggatgattaattaataattacacacctgcccattgcgaatttagaatagccacagtattaagactgtgcttgtgaagcaaatacattaattaatttattggtaactaaaattaatgctttgttaaatacaacactgtctttaagaaatatattaattttattaattaacaatacattaacacataaattatttttataatcataagaccaaataattttaaggatgatcttaaaaagaaaatttaattaaaaat

SEQ ID NO: 4870 - DNA, 443 bp, Diabrotica virgifera
  unsure (1)..(443): unsure at all n locations
  Clone ID: LIB149-041-Q1-E1-H11
agtgacccgagttccgagagccaagcaccaggcttaagagttgaggatgttcttgtcccaagccgtttgctcgctttacgtctcaaagtgccagtgccacatcagaatgttaccataaacagaagcggaggtaaactaatgcccccatccgccatcttgttagcaggtttaagagtangagtgtcatccttcagcctcaagcagatgcttcattccaaacgtccaaaattgctatgaacctctcttaaacattgacttgtcagttttgtgacaatgttatcataattttttgttacatgtactgagtacgttctcaatgatgtgtggctagtctttttatcaaagtggaaaatggttaaatttatacagattccgatactagcgtataaacgatactactttaaatttatttttacaaaaaatttggtacattttggccccgg

SEQ ID NO: 4871 - DNA, 400 bp, Diabrotica virgifera
  Clone ID: LIB149-041-Q1-E1-H4
tcgacacacccgtccaaactttcacataggaggtcttgttgcataataacgttaaatctttaaaatcagaatttcaagatgctaaaccctgctaacgtccctggctactttacagcagttagccaagtactaagtaaccaactcaacactggtaaacatgttgcgatactcccacaaaagtcagtggttcacataccatggtcgagcagttcagcctctgcccttagcaaagccctaccaacaggaaacatcgcagtttcagtatgaccagcagttagcagccaagtgaggtgtgctcataccgacattactgtaccagactttagccattagcgcagagatggtactaaagaccccgcaaaatcatcccatgatagtgaagatgccagaaagaatttta

SEQ ID NO: 4872 - DNA, 355 bp, Diabrotica virgifera
  Clone ID: LIB149-041-Q1-E1-H5
aatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataatattagtattaaaaaattgtatatttagtaaaaatat

SEQ ID NO: 4873 - DNA, 381 bp, Diabrotica virgifera
  Clone ID: LIB149-041-Q1-E1-H8
aactactcgtccgcatggggtacccgcgaggtcactgtcgcagccaaagcgcacgatgcaactcaagatgctacaccaagtgcatcacctgctcctgcgcccatttcaagccaaccattatcattttttggtaactccaaagataatgcgggatccctcgagttttctttcggacgactttttaaactagtgtgttgtacctacgatagtagtggcgaagaaacggaagtactcacgatcatacaaacctccattcagactatgcatgaattcttggcccagatggacaatcataaactatgagctacagattcgatcctgaaaccaagacaaatcgctagtcacactcagcattttgtgggtttacaagcttgaagattt

SEQ ID NO: 4874 - DNA, 198 bp, Diabrotica virgifera
  Clone ID: LIB149-042-Q1-E1-A3
agtcaatacacagtttgaaatctaggaatcttttttgacagtgtccaacggcatggagtaatgatagtcccgtagtcatgccagagggtattttaattctaggggtgatcaacttcatttttgcaacttgtgtaactgggatcatgaattcatccgtaaattaggaataatgacgtactagttagggctaaaccctta

SEQ ID NO: 4875 - DNA, 367 bp, Diabrotica virgifera
  Clone ID: LIB149-042-Q1-E1-B1
aaaatttataaattaaaaacgaagaatatgtataatgtttctaattgtgtaaaaggcaaaacaaaaaactgcgatatctgctttaacaaggaaaaaaggatcaaaattttaagttatgttactttttttttaaatattggtaatttttttaaaattaaagaaaaatacatagggcatttctcgaaatgcaacggttctcgtgatagataacgacacgttcacgtcgaacgtcagagaataactgaaaagtgtcattgttgcggaataaacatacatattcattttactgccaaattttccacttttcctggtaaaagtatagaatttttggagtgaatttaacaagaaactggaattatgagttttt

SEQ ID NO: 4876 - DNA, 362 bp, Diabrotica virgifera
  Clone ID: LIB149-042-Q1-E1-B10
agtactttttgccttagtactttactgctgttcggaagttttatgtaataatgataaacctcaatgtgaaggtatacaatgtgatatgccaaactgcccttttggagatatattgaaatatcccggagaagaagatactgcttgttgtccctattgcgaacataatccaaactgtgaagtttgcggcgatctaccaaggtgcgctcctggatcttcattgaggcttaaacaaaattcttgttgtccctcatgcgaaccattcgctgactcataataaatcaacgaaatattgtaacggtccgaaacaatgacttacatcaaatgaaaaattaccaataaactaatgaattatggcaagactc

SEQ ID NO: 4877 - DNA, 326 bp, Diabrotica virgifera
  Clone ID: LIB149-042-Q1-E1-B4
ccggatgagttttatgtttatgttagatagcttagtttcgtttaaaagacagctagacgctttagagttttattgtagtataaatatgttagttaagtattatgtttagttatgtgaggcgtttatttaaatggggtgatttataagaaatgtttagctttttatatattaggatcataattattaatttttagatccaatttttttgaatataatagtatcatggagtagggatcacatcgtaatttaaatggatagttcagatcgataataattgaggcgaccacgatgatggtttaaagtttatgattggtgaagcagatata

SEQ ID NO: 4878 - DNA, 378 bp, Diabrotica virgifera
  Clone ID: LIB149-042-Q1-E1-B8
agtgtgatatgagtatgatgtgtcaagtttaagataagttctgcataattgcgttcgactacaaaattatcatcggtgttaatatgttattttttttacacaaatatgtgtattgttccagtttacgataagtgcagcgttgattgttcaaatatccaattatcgaacctacctcgcacatctcctagttgtgagtagtctttcgtggcaacaagatggttttaactaagtacctcgaaacgaaatgtcaacagcacatagttggagatgatcattttaacgaatccgattattggaatagtagtgccatattatttcctgaagatgattatacagaaaatgctactaccactatttagggttccacgattcggatat

SEQ ID NO: 4879 - DNA, 188 bp, Diabrotica virgifera
  Clone ID: LIB149-042-Q1-E1-C3
acttacagaagaatgatcataatgaagctgttcatcctagctgctgcccccattgttgctacatgtgcccatctacgtgccgtcacataataggttaattttacggccacccactgtaatccttgcaccttgcgtgttcacgaccaccgtttcgctcattatctacgcaatatttacgaactcaatgc

SEQ ID NO: 4880 - DNA, 408 bp, Diabrotica virgifera
  Clone ID: LIB149-042-Q1-E1-C5
agcccacgcgtccgatgaagactgtccattcttttagctattttagcgttgcgtcggtttaaccgtcagcgcccccccaaagaacgacgtcctgtgtgatatctgcgtagcattgacaatagtgatccatgaccacttacaacaagacttgccattggacgaacttgaagaaatagtaacggaggggtgcagtgcattaccagatccacttgcagatttatgcaagaataaactgaatcgagcagtctagagcatataccaccgatttgaggacggctcgcctgtagaaatatgcacagttttagacttatgtgagacagattaatatgaaagtcagaataaactctaaagttttaaaaacatttttgaacctttttaggcaaaaaacttcatattgggggaatcaag

SEQ ID NO: 4881 - DNA, 409 bp, Diabrotica virgifera
  Clone ID: LIB149-042-Q1-E1-C9
acccacgcgtccgcttttcagtccgggcttctcgggcccgggatttgtttcgggcttctctaatatgtcgtataatccgtgtaatgccctattgtaatatgcccgtgtaatgcgtaatagaagcgttgtaatgccctattgatcgtaattagcgtttgtcgtatttcatttgagagtaacgtacatttctgtaataaagaaaatcatattttattatttctgtttttttatcaatcaagttctgttgaccacttgtttgatgaaaaaaaaaacagttttgttagactaaaatacagagaatacaaggaaccgccaacttgcacaataattaaaacgtatttagaaagttttatactaatttttttaataattgctcataagaatttaaaaaaattcccatgtgatgttt

SEQ ID NO: 4882 - DNA, 351 bp, Diabrotica virgifera
  Clone ID: LIB149-042-Q1-E1-D1
aaaatatcacccagcgttgtcacttctttcaaattttctctttttgttagaaacaggtaccttcctagaaatatctatgggaaaggaggaagacctaacccttcggtcctaacttaactttcgggtattagagtgtagagcgcaaaccggccgatttcaggtaagagcgcaaaacggtcgagcgcataccggccgacaccgataatttgtgttaaaattgccgcatatgccaatgttgaactaaaacaaactctaaaagtatttgtctaaaagtataattttcctataaaaagcctatatcactatgtaaatttcctaagcagtataaatattacacgatttggaaacaat

SEQ ID NO: 4883 - DNA, 418 bp, Diabrotica virgifera
  Clone ID: LIB149-042-Q1-E1-D12
taatctttgtgtggataccctgcttcttttagaattaaagcgtttatttgaggcttttggatagactttaacgcctctagagcttttttgttttgtttcaacagatactcaaaccttttccaaattgaacttcttagcagtttttttattcgttcctagtctacacatgtcccaggagaagttactgagtcgcccctagcttcaactcgaccgtgcgcaccttataaatggcgcgtatacgtataatcctttcccgggcctagcacatcgaataaaaatgtttcttgattgatcgattacatgtttcttacattgtctgtgtatatgttgtaaatgcttgtttgtttgatgtgcctaaatccgttctatgtagaaatacattcctagatacttcttatgagtgatgaaatcatagtga

SEQ ID NO: 4884 - DNA, 215 bp, Diabrotica virgifera
  Clone ID: LIB149-042-Q1-E1-D6
acccacaagtcagcgtcttctgagggttgtttaccttacgttatagctttcataagcatacggcagcaatgtatctgcactgactacaacatttgcgccatgatacttcaagaagtaagacttacgtacaagctctctaaactgaccctacatccaacaagtcagatttcaccacacgatgattccaacagatgtatgctagtacatgagtaatt

SEQ ID NO: 4885 - DNA, 269 bp, Diabrotica virgifera
  Clone ID: LIB149-042-Q1-E1-D7
tagtgagtcgtattagactaccctaggttatggcattaataagcatacggcaccagtggacgtgccaatgagtaacatcgtttcggcgatagagtactgtcatgaagtaggagctacgtagcaggtgacgaaactgacactggaaccagcgagtcagatatcaccagcagagggagctaagcgagggaggcgagtacctgggtagttctactagtagtcgctacgggcgcggtgcatgcgatactcgagcaccaatcgccatgcagatg

SEQ ID NO: 4886 - DNA, 137 bp, Diabrotica virgifera
  Clone ID: LIB149-042-Q1-E1-E1
aaaaaaaaaaaaaaaaagaaaaaaaaaaaaaaaaaaaaaaaaaaaaaaaaaaaaaagaaaaaaaagctagaaagattaaaaaaaacataaaaatacatgaaaaaatcatcaatggtgtcaagtgtcattcaaatttt

SEQ ID NO: 4887 - DNA, 418 bp, Diabrotica virgifera
  Clone ID: LIB149-042-Q1-E1-E12
agtgcctttgttagtttagatgagtctgatctttataatgacaatcaaggttacatagtaggcccagtggaagcaggagttttacaactcaatgctagttttcctgatttaacttaccatattaccgacaacattgagatcctaactgttgtggatggagccaaagtcgaatgggttagcacaaatcaaacatttttaccaaaatggtttgatagtgatgactaccatccagtgcactccaactggcatcaaattgttaatataaattcaaccatttatataggaagaatccacgactcggatataggtggtacatttggacatataccggtctccactgagttatacgatgacgacgatgtggcatactatgcttttggcgatgatgtccgcgaatctaatgtatacgatattttac

SEQ ID NO: 4888 - DNA, 424 bp, Diabrotica virgifera
  unsure (1)..(424): unsure at all n locations
  Clone ID: LIB149-042-Q1-E1-E4
aggcatagcctcatttgtttattatattttttaccattcttttctaagttcatcccttcatatgacacattatcttcaatttaatggatccgccgaataacgtaagcaccacattattcatttttaagaaatcgaacaagaactgttgaaattataataatggtaaatgtctaacacagcgtttcttaaccggtgggtcacgacccactagtgggtcgcggtgtggctcttacagtagctgaataacatacatatatatcatcatgggtgagggatggatcgcgaatataaaaaaacgtcagaaggtgggtcgccagacataaaaggttgggaaccactggtctaacagtttaagggttagcaatacagtacacagtaagtanaagttacaaactgtactactaacccttaaaatgtataaatt

SEQ ID NO: 4889 - DNA, 414 bp, Diabrotica virgifera
  Clone ID: LIB149-042-Q1-E1-F10
aagttgtatcaacaccttcctgaacacttatggagctccaacgagcaaattgtaccatacatgatgaactacttcaaccaatacccaatgaaatacaacgacattatgcatgaagttatgcaaaccccatgggctcaccaacaacttatgttccacgttatgtctgaattataccagcacttcggtcaagccccatggtcccacgaacaaataatgaaccagatcatgcaacaccaatacctctacggtacaaccttatcccaacaacaactccaacaattggtagaattcgtactccacattcaatacgaacttactcctttacattaccaacaacttgaacaagttcaaccctggaagcgtgaacaagtactttcatggaaccaaggacaagtactcccatgggcctacaga

SEQ ID NO: 4890 - DNA, 358 bp, Diabrotica virgifera
  Clone ID: LIB149-042-Q1-E1-F12
agaaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataatattagtatt

SEQ ID NO: 4891 - DNA, 342 bp, Diabrotica virgifera
  Clone ID: LIB149-042-Q1-E1-F3
gacccaagcctctaaaattactcatattattctttttgtgtcaattaatttaattaaaaaaatgattttggacaccctgtataaataatcatgtaaatatttatattactgaatagggaattgaataacctttcaaatgagctagcaaacgacccccattctcagtttaaaaaatagtcgattacgtcatggtaaacacggaagacatggtaaaaggtttccatttccttgtggatacttttccagctcgagccaagagaatgaacaaaattctcaaagtgaaaaggaagaacaaaatcccctatgtgacaaggaaggtactccgggccgccggcgccgata

SEQ ID NO: 4892 - DNA, 323 bp, Diabrotica virgifera
  Clone ID: LIB149-042-Q1-E1-F7
aggcttcattcatggcgctatttcaaagtctgcctaacgggttcaaaatccgttctagtggatatggaacatctgacggtcacgaacatgccctagatcatgctcaataaggaggcattcgtcatcgcgatactgccagcgtttatcagcgcgaagctcttacagggaacgttttacagaaatgggttcgcaatataatacatggggaagatatttttagtagcatggtgtttcaaacaagagatgacttggatcgagaataagctcgtaaagaaagcttagaagatcttcagctggattacgttgatctatatctaagtcat

SEQ ID NO: 4893 - DNA, 414 bp, Diabrotica virgifera
  Clone ID: LIB149-042-Q1-E1-F8
agtgagtcctagtattagcttgtaatgtactcaaatagtcttatgataattactctgtattagttattaataccccttatttgttaaagtggtcctctcgtttaaaaaataattacgaatataacaagtggtcatgtttgctgtatcgttgggaatcacgagttaagtttcttgttttatttcacaatcaatataattttctaacaactaatattgtgattcagaaacatttttttataaatcgccttcaagttggttttgcttttgtatcaaccgtaatagatagggtgattcattaagaatgtccagtctctgggttgtagattctagacctcaaaatattacgattctgcccaatatgccttattttaatagtcaagctattgcaaatgtcctagcaatatctacctgttt

SEQ ID NO: 4894 - DNA, 415 bp, Diabrotica virgifera
  Clone ID: LIB149-042-Q1-E1-G10
gtatattccagttaccatggttatggtggaatcgtcaactggattttagtccgacctactttacagataactgcaaagttatcttattgcatgtatctaattcacggtttagtaattacacatgctacgttgataacaagagacaggctatttttcagcgattgggtagagtttaataattggtgcgcatattttatagtatcttttctacttgcatttgtatggtcattggctttcgaatcacccttaattataatagaaaaattaatttttggaggagctaccccaagaaaatctaaacctaaaaataaaagtgaaaacgctgaaaatacacaagatgttcaaaacgcagcagtgtaagaaatatcctattggaggttaatgtaacataaatactcaaatgtctgaaatgtat

SEQ ID NO: 4895 - DNA, 414 bp, Diabrotica virgifera
  Clone ID: LIB149-042-Q1-E1-G12
aaataattacagccgtccataacaaattgtatgagttttagtaagtactaatgggaaatgtaactttctagatttgtatttgataataatattttaaaattagaaaaaatgttttattcataatgaacttctaaaattcatgaaaaacttagttcgtaaattgccgctactagaaagtttaaaagcgccccctttaggagaattcttaaactacatagttcacggtatttggcgccagtgtcagtgtagacacttttagcgccctctttaggagaaacgctgaactacgtagttcacggttttgccgcagtggcgctagtatcgactttttagcgccctctttcggagaaacgctgaactacgtagttcacggttttgccgcagtggcgctagtgtcgactttttaagcgcctc

SEQ ID NO: 4896 - DNA, 418 bp, Diabrotica virgifera
  unsure (1)..(418): unsure at all n locations
  Clone ID: LIB149-042-Q1-E1-G2
agattatctgtagttacattgttaacacagatcgatactgaaaaagagcaaactttgtttttcgttggatctatgattttcgcaacaatgttaaactgtttcacaggtttggcgttagctagcttatacgaattaataaccaaatttccgtgttcatattatgcttcacttcagtcaggtaacaatatatgtggaatcttgtcagctgttttacaaataatccttcttagttttcggctaaggccaaatgaaaacggtgcaattcagttctccgttggctgctttatcctgatttttactacaatttactattttgttgtgttcaagaattcanaatattttatatacaggatagatacaaaccatgaagatcaaagaaatttatctactgcagaatggatgcaaattatacctaaaa

SEQ ID NO: 4897 - DNA, 430 bp, Diabrotica virgifera
  unsure (1)..(430): unsure at all n locations
  Clone ID: LIB149-042-Q1-E1-G8
ccgggccgacccacgacgtcagattttagttctcgtagctactttagcattcgatagtgcgattgcaaatgatgtagcaaaaccgtgtgagtctgattcttgtacgatcggcaacaattgtagatgttctagtcaagcgtcacctctaggtggaaatctcacagagtatcctcagctgattagtttaacatttggtgaagctgttacacaacacatctacgacaacagttggattacattgctcggaaatatatataagccagatgatgagccacttagtggaacattccttgtatcacatgagtatacgagctatcaaagagttaatgaattggtcaactttggatttgaaattggagtgcactcaattacgaaggaattttagacnaattactggagatatgcaactctagacacactaacaaaagaa

SEQ ID NO: 4898 - DNA, 324 bp, Diabrotica virgifera
  Clone ID: LIB149-042-Q1-E1-G9
gactacgcgtccggttctttcagaataaaactcataatgaatctgttcatccttgctgcggccactagtgttgcgataagtgccttcctatgttccatcaatttattggctacttataacgtgtcgtacaacgtggctgaggatattattcatgtcgctgttatttacgctgttctcagagatatcgacgtacacattgcgtagtacgatgcttgatttgaatccttatacttggctgatatcatattcgccgtttaggtcagtcatggtttctaagctatgtttgaccgttagttagcaaaaatacctttacaatcctttatt

SEQ ID NO: 4899 - DNA, 395 bp, Diabrotica virgifera
  unsure (1)..(395): unsure at all n locations
  Clone ID: LIB149-042-Q1-E1-H10
acccacgcgtccgcccacgcgtccggcgataacgcttaacctaaagggcagacgcaagattgcaggttatataaaaaccttggttactacttggttaccgacactcacaactagagggtttataacttcgatccggtgtaaaaagaaatccattaaaagagcagccgaagatgagtgataacgagaatccaccaccagaaaacaacaccgagcagactcctccacaggatgcgactgatgacgtaccagaagagagccaaaaacctcattctaggggaaaacgatcgattgtggatgttcccaatangaacaatattggaccagatggangagaggaagtagatttttaaaatcgattagatgcacaagtattttttattagacatatgtctttt

SEQ ID NO: 4900 - DNA, 386 bp, Diabrotica virgifera
  Clone ID: LIB149-042-Q1-E1-H11
ctcgcgggtcgacacaagcctctatgatgagtcctaatcattcgatagaagatggaacttaaagaagaagatcaagaaaaacaaaaatcagaatttataagactgttatcagtcctacagtaacatacgcatgcgaaacatgggtgctgaaaaattcagaaacagacctttcagaaagaaggaagagaaaaatcaaagagtaatatatgggggtgtgcaaatagaaggttagtggagaataagaaccaacaaagaatttgaagaactgtataaagagccaaagataacgacgacgatcaaagcacagaatatacgatatttgagccacatcgaaagaatgggaagttaaagaatgccataaatggtactctcacgaaagacaatac

SEQ ID NO: 4901 - DNA, 329 bp, Diabrotica virgifera
  Clone ID: LIB149-042-Q1-E1-H12
gttacataactctattggagttgcaaccgcaattggataaaagtgaaattcgaataatgccagaaagactataactgtccaaagtgatagtgtgaaattaaaatcaaatgattacgtataaatcatatttataataattataaatagtagctgtattttttaaataaacagatttgataagttaaaaaaaaaaagaaaaagaaaaaaaaaaaaaaaaaaaaaaaataaaaaaaaagtaaagggaggcagctctaaaggctacaatctataagggagcgtgcatgaaaagtgatcaaccttcaataaatgtgaatgaattcaaatcactg

SEQ ID NO: 4902 - DNA, 332 bp, Diabrotica virgifera
  Clone ID: LIB149-042-Q1-E1-H5
ctgagtcgtatgaggtcttgttgcataataacgttaaatctttaagatcaaaatttcaagatgctgaagcctgataacgtccctggctactttagagcagtgagccaagtagtaagtaaccaactcaacactggtaaacaggttgcgatactcccacaaaagtcagtggttcacataccatggtcgagcagttcagcctctgcccttagcagagcgctagcaacaggaaacatcgcagtttcaataggaccagcagttagcagccaaatgaggtgtactcataccgacattactgtaccagactttagccattagcgcagacatggtactaa

SEQ ID NO: 4903 - DNA, 275 bp, Diabrotica virgifera
  Clone ID: LIB149-042-Q1-E1-H6
cgacccacgacgtcagaactaaaaaaaaagaaaaaaaaaaaaaaaaaaaaaaaaaaaacaaaaaaaataaaaatttcaaaaagcaaaaaacataaggacgtccctggctacctttccagcagtgtagctaagttggtatgtaacgaactcagcagtggtaaccatgttgcgattctcccacattggtcggtggttcacatactttggtcgagcagttcaccctctgcccttagcatagcccgacttacaggatttatccgaattgcactttgacc

SEQ ID NO: 4904 - DNA, 295 bp, Diabrotica virgifera
  Clone ID: LIB149-043-Q1-E1-A10
tgagtcgtattaaggttttcacactttagaataggtcattatttatatttatacagtattatttatacgttttataagttttttattagaacaaaaattccaattggttagatctagtaatgatgatcctatcagtcgtccaatattgtaaacagagtaaactgatacaggttgaatactggaattcggtaccattttttgcacctgtttatttgatccatctcgtggtggggatcctattctctcgcgccagcccactgagcaatttggtcggccgcagttatatgaccgtgct

SEQ ID NO: 4905 - DNA, 361 bp, Diabrotica virgifera
  Clone ID: LIB149-043-Q1-E1-A2
aaacctggacaacaaaaaaagaccaattacaatcctggacaaaacaattaaaatggtaaattttttccggtaaggtaattaaccaaagaaattaacccttaaacttgtaaaataacaccttgagacgtgaatctgcgataatatcaaacacatctgaaattgttttgatttttcaattttatttgaataattacaaaaaacaccgttttttttgtaataaaaaacgcaaatattttgtcagcgtgtcgactgtacttatgcatcaccttatgctagttcagttaatatttatttataaatgaaataattaaatcgttttaaatgtatatattttttgttgcagttttttttatatttgtat

SEQ ID NO: 4906 - DNA, 326 bp, Diabrotica virgifera
  unsure (1)..(326): unsure at all n locations
  Clone ID: LIB149-043-Q1-E1-A4
caattgtctaaggctcaatattatttgcaaccgaatcctttggagccggtgggccaattaccaaaagccaaggttggcttacaacttacggtgtaaaatggtgggcaaaattttggcttcaaatcgcctttggagtctttgcttttatagacataaaggataaacgataatttcaaaaacccaagtgaacaagcaactggatactttgtttaatacagctaaggaccagaataaacacgaattaacagatttaattcanaaagaatttgaatgctgtggtcctgacggtccatcattttggggagctaggtatacaaaatcatgtt

SEQ ID NO: 4907 - DNA, 404 bp, Diabrotica virgifera
  Clone ID: LIB149-043-Q1-E1-A7
aactgtccagcattcacctaaaatgaaatattttgttttgttggtaagcattgtcgccattacagcatccgacttacaaggtacagccgtagaccaatgtttatgcagagacgaactcactcaaatctacaatcaactcgtcgaagctaatgccgaattgaaggaggccaacgatgaaatgattcagctggactccgatatggaatacatggacaataggttcgaagcccagaacgaaaatttggaagaactcgaaagtgcacttaccatgcttcgttacatccaactccaaactctacaagagctttccagtcaagaccagattctcaattgcattgtcgtcactgttcaaaacatcgatgtccaggttaaaaatgaaacaacacatgtcaaccagcagacag

SEQ ID NO: 4908 - DNA, 249 bp, Diabrotica virgifera
  Clone ID: LIB149-043-Q1-E1-A9
agctgggtgaatggtgatacatctggagattgttatagagaccttttggccatactcgactatgtctacaaggaaacttttaagcactgtaatcttaggaggaatctgtacgcctttacacggaaacaaacggattactagcgttcgtcagactggcactagaataaacgcggtttttgagggttgccgtcgaaagttatctacaggcactgagacgcaacgtgtttttcgtttgagtgtaacctaacc

SEQ ID NO: 4909 - DNA, 404 bp, Diabrotica virgifera
  Clone ID: LIB149-043-Q1-E1-B1
ggtccacgcacgcgtccgatcatatacgtcctgaatcttattttcggtaatgacattgggaaattgtaacaaaatgtctgaaaattaatttagaaataaggtgaatactattaaaaagcaaattttattttagtgataacaaaatattgaaatataccaaacatctaataaaaaacattgcctactagaattttttaaataatatcaaaaatataccaaaacagtagatatctactaaatgtggcaacgctgttaaggagaatgatgcacttcattgcactggtcacaatgacctctgtcacagcatagaaaacgcaacagcagtgacacactagtaggcgggaaaagttcgcgcactattactgcgcagatcgtcggccattttgtgcgtagtacagacaatg

SEQ ID NO: 4910 - DNA, 429 bp, Diabrotica virgifera
  Clone ID: LIB149-043-Q1-E1-B11
gtttcgatctttgttttattattaaaggactcttaaatcaatagaaacactcgatcatatatttgattttatatttacctaatatgttactcattaaccattacagaatgctgaatagaccatcgctacactaacaatccaaaatatctaccaaaatgccatgactagtgtaagactagctgaacaaaaagcaaattttgtatacagggaggagtgcgacaaggagacgctgtttctacaaagctcttcacaacataactcttttacgaagtttctgaagccacatctgaacgagtttggtattaacctaatgtttgttccaactcgacgaagaaccgtcatgtaacgattacgttactataacattaatgttccatgggaacgaattaatacgttccatggtactgcacaggacggtgatcgttacat

SEQ ID NO: 4911 - DNA, 167 bp, Diabrotica virgifera
  Clone ID: LIB149-043-Q1-E1-B2
atagcacatgactatagatctaccataacaattcaaacaataacaacttcaaagaaacaacaagtcacactgggaagtcattcataattctaacaactacgtacttcagttctgacaacataaatatctgtagttctcgtttaactatggtttttcaaatcttccta

SEQ ID NO: 4912 - DNA, 441 bp, Diabrotica virgifera
  unsure (1)..(441): unsure at all n locations
  Clone ID: LIB149-043-Q1-E1-B8
aggacgcgtgggtttttatctagagtgttgaacaaaaattgattttcttaacgaaagtgtgttggggaatttagttttaggtttcataatcattcataaattccgttttcaacttcattttaatcttaattattctacttctaagatatgtagcatagaaattttatttgcgtattttatagttgacacaaaattatgtattatctagtatgtatttactaatccatcatgtatcattaaataatatatttagattgattcattacatttataacatttgacgtagtttaccgaatttcaatgagaggaaaaccatgtagattactcacatttctaaacagctcacatagagattgttaatgtagaatttatattttggtttccttgatttttttaccacgcattttgacatanaaaaacttggtctcgtctcaataaaaa

SEQ ID NO: 4913 - DNA, 436 bp, Diabrotica virgifera
  unsure (1)..(436): unsure at all n locations
  Clone ID: LIB149-043-Q1-E1-C1
cacgcgtccgaattttatttattttanaataataaaatatttttagtaaaagtaaagaaaaattttaattaatgaaaggtaattaataatgggagagaaaaatttaattttaaaaaagaaaaatttaatttttggaccctggggaacaaggaataataaataataaataaataattaataatttccaaattaaaagaagctaaaaatttaaaattttaatggaaaaataaaaatttaaaaaaattttttggtatggaatggtattcgtttttaaatatatctaattttttaagatataaattaaatttatttattaacaatatatttataattaaatatttttatattattaatattaaatatttttaaggatgagcttaaaaataaaattttattaaaatttaaattttaaattaaaaatttgggattaaaaatt

SEQ ID NO: 4914 - DNA, 399 bp, Diabrotica virgifera
  Clone ID: LIB149-043-Q1-E1-C3
aaataaattaaatttatttaataacaatatatttaataattaaaaattttaaaataataaaaattaataattttaaggaataacctaaaaattaaaatttaataaaaattaaattttaaattaaaaataaggattaaaaatttccaaatttaaaaaaaggtaataattaattttaaaaaataataattttaatttttaaaaaatttttaataaaataataaatttaaataattaaaatttagtaatgatgataatattagtattaataaattgtatatttagtaaaaatatatacgtttaataaacgaattcggcaacatttttttcaactgtttattaaaaacatgtcattttgtattaaatataaagtctcgcctgcccactgattaatttgaatgg

SEQ ID NO: 4915 - DNA, 373 bp, Diabrotica virgifera
  Clone ID: LIB149-043-Q1-E1-C4
cgtccgcacacacgtccgcattgagatactgactgtggtcaatggaacataaatcgaatggattaaatcttaccagcacacattcaaggacctcttcaactcatacgactatcgtcctgtaatgatctgctggctagcatacggggatacgtggaactccactctttatttgggcagctctttaagcgccggtgtctaaaccattggacacatttatgacatcggcaattccaacatacaataatcaacagaattggtatccattttacggaagtcaattcggggaccttatgtataaagtatgagtttattatatttacatacttaaaaagtactctttttaataaacaatatgacattatgtaataaatat

SEQ ID NO: 4916 - DNA, 431 bp, Diabrotica virgifera
  Clone ID: LIB149-043-Q1-E1-C5
atagtttcaagcagccccggagtgttatacggactattgagtttccaaaatcggaaagtgaccaccagaaagcgatcaacgcattcaaacgtattactactttagatacgcagtgggccaaaaggtgtttggaagatcgtcagtataatatgaaaatggcgttattgctgtttgtagacctttacaaacaaaataaaattcccccagatggttttgtaaagacaggtacaaataatacatatgaaggagttggaaacgaccagtacaaccaaaataagaagatgagggtgtaaataagtttaccaaaaatgtacgcccaacaaaatataactttatttggtttgatccaagttgaaatatcgtatatttttggtattttgaaatcatgtttcaaggtacaagtgtgtgtgtattaacattttatagtgaaa

SEQ ID NO: 4917 - DNA, 449 bp, Diabrotica virgifera
  Clone ID: LIB149-043-Q1-E1-C7
cgcgggtccacacacgcgtccgaacacgcgtccggttctagcatcttagttcccgattataagcagcatattactgcctgtctttttttcgtccacgtttaaatgattcagtattattttcacttcagatgaatcacgaaaaataatgcactttttagaatgactacgtcgttaccaacagttagttgacagatctgttaggattagttatgtcgcttttgtctgtagtaaagatctaaatttctctaagcagtcaacagtagaggatgttactgaatgagttgtttgtatagagtttagttgaattaacatgccttataatttttctgtgatggaaaatgtaatagtaaggtaaatgaaaggaattgtaaaaagtagggaattgatgatttgtatgttgctagtatcagtatgtacagtgtacgacgtggtcaaaataacttctaaat

SEQ ID NO: 4918 - DNA, 345 bp, Diabrotica virgifera
  Clone ID: LIB149-043-Q1-E1-D9
acaagcctctacagtgactcgtgttatatcatgtaagttgatattccctatgtaaattattggcacaatgtaacctccaacttgatttatacatttattttacttttgtttgtctattttttctgtaatagagtggaagaattaacattccattaaatgtcattgcccaatgtataaagcaatatacctcttaccattcgatgctttttcagtattttaattctagatggtgaacggagatttttcttgatgtaggttttgacattttcgatgttactgtaaaaatctaattttatgttaaatagattagtgtacaaaaatgtgaataaacactatacatatgtt

SEQ ID NO: 4919 - DNA, 445 bp, Diabrotica virgifera
  Clone ID: LIB149-043-Q1-E1-E1
gggtccacgcacgcgtccgcaaaatggcaaaaatcgtcctcttcttctgcgccatcattttggcttcagcagctgctttaccaacccaatcagctgacggaggtgttgtcgacatcatcaaaaaggtcgtgcacaagcttgaagacataatggaaaaggtttttactgaaggtcccaatttcatcgacactttccctgacaagtatgacgaccgccttactaaagtgctagatgttacaagggccgtgcttactaaaatcgctcaagcacttaaagttgttatagataaagttgctgaacaaagtaatgatgctggaaagaaattggtttcctgtgtcgaacaacacgaagctgatctcgtcaatatccgcgtcgctctcgtcgaaggtgccggcaaatgcgtaaaagatagcgtcgtcgctttggttaacactggcgcaccttt

SEQ ID NO: 4920 - DNA, 316 bp, Diabrotica virgifera
  Clone ID: LIB149-043-Q1-E1-E12
accaaaaatttcacaatgaagctcctgagtctgcttgagctgatgtagcttgattttatgagtattgattttttttaggctattagtttaggttgtacttattttatttaatattaacttatgtaagctacttgattgttatacaattctttacacaaactatatgacatgtttacatattgtttttattgaattggtttatatttttgttatattttaataataaaactttctgatataaaaaaaaaaaaaaaatttttaataataaataataaaaaaaatataaaaaaaatcaaaaatacataaaaaaaataaa

SEQ ID NO: 4921 - DNA, 304 bp, Diabrotica virgifera
  Clone ID: LIB149-043-Q1-E1-E2
cgtccgaaaaaaataaaaataaaaaaaaaaaaaaaaaaaaaaaaaaaaaaaaaaaaaaaaaataaattaaaaaatgaaaaaaaattttaaagggtataatattttatttggaaaattgtcaatgtaaggggttgttgtaagttttgagtttagtttgttttgaatgtgagtaattttttaggttttttaatttggtgttttttgttattttgcctacctttttgtttttttgtttatttggctgtttgttctgattggcttttttgctattggggtttttttgttttgcatttttttggttttt

SEQ ID NO: 4922 - DNA, 435 bp, Diabrotica virgifera
  Clone ID: LIB149-043-Q1-E1-E3
ccaagcctccgtgtcaataattttgtaacaattccaccaatttactgccaaaattattacaaaggcgaactgtataactccctaaacatccaaaaggaattaaaataattggaatttttccaaaaataattaataaaatgccccaaccggctagtgtccaaaatttacaagcaaaatatacccggaaaaattcatttagcaagaatcctgcacaaaaatttaacaccctctttaagcaaagctattaactgttaatcgaaacacaaaaaattaaggaaattttggaaaaacgaaaagtcaaaaattagaaatcttacaagggactttacaaaatgcccggaaaaagaactgaatgccgattaaaagactgctgtggctaaattcaatgaagtgacgaatacattagactttgctagagatttatgtaaacagttc

SEQ ID NO: 4923 - DNA, 435 bp, Diabrotica virgifera
  Clone ID: LIB149-043-Q1-E1-E7
caatcacattttgaatggtgcacccggtgtacagtggcagtttgcctgtctagcaacaatattattacagcgatattgttaaagaatgaggctattattaataggcatattaagaaatcacttaaatcggaacaggtttaggaaattcgagacatcaaaaatgacctatttttggggtcgtgcgttaatttcttggagtagtatattatagttttaattgttaaaaagttatcttcattccagtgatgtattaatgtaatgtgatgtaattaaatatttatctaattatccaccaacagtgtcttgaatttctgaagctatttatgttatcagttatgccggaagtacatattcaattgctttttgtcaaaacggttaaatttattattcaataaattttacacacatttgccaactcttgactaaattgctatg

SEQ ID NO: 4924 - DNA, 316 bp, Diabrotica virgifera
  Clone ID: LIB149-043-Q1-E1-E9
agatatcttcagatgagattaaaaacgtttatctacacattcgaaagtatacagaatccgtggtgcacctagtaacatttacagtgtcatggtatgtttaggtctactgcatcgaggatgtactactgtatttataatgaactctcgttcaagatcacagctctcatatctttaatggtcatgacacttacgcattgacattgactgcaattgatataactcacgatggcccgtgtttggaggtgtcaaaagttcgcatgtcactgtagttgtgatattagataataggttgtcaacatggttcggttcctacgta

SEQ ID NO: 4925 - DNA, 421 bp, Diabrotica virgifera
  unsure (1)..(421): unsure at all n locations
  Clone ID: LIB149-043-Q1-E1-F1
gcgtccgaatttacaataataaaatattttttagtaaaagttaagaaaaattttatttaatgatagttaattagtattgtgagagaataatttaattttaataaagaaaaatttaatttttggaacctggggaacaaggattaataaataataattatatatttaataatttcgaatttaaaagagctaaaaaattaaaattttaatgtaaaataataatttaaataaattttttgttatgaaatggtantcgtttttaaatatatccaaatttttaagaaataaattaaatttatttattaacaatatatttataaataaatatttttatattattaatattaaatatttttagggatgagcttaaaaataaaattttattaaaatttaatttttaaataaaaattaggattaaaaattt

SEQ ID NO: 4926 - DNA, 145 bp, Diabrotica virgifera
  Clone ID: LIB149-043-Q1-E1-F10
caattggacgattacaatgggaagttgtaactgagtcctcaattgatattctacttcatgatacctattattttgttgcacttattcatgatgaatgaactacaagagctgtattggctattacatcgggatatatacgattaat

SEQ ID NO: 4927 - DNA, 429 bp, Diabrotica virgifera
  Clone ID: LIB149-043-Q1-E1-F2
cggacgcgtgggaaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataatattagtattaaaaaattgtatatttagtaaaaatatataggtttaataaaggaattcggcaacatttttt

SEQ ID NO: 4928 - DNA, 439 bp, Diabrotica virgifera
  Clone ID: LIB149-043-Q1-E1-F4
gggtccacgcacgcgtccgaaaaatatgaatttcactcaagagtaaagtatcgttaaatttcacaatatcgaaaattgttattaagaaaagttgtttggaatttaaaaatttgttatagtgttcaattacatccttctaattaaaatattgtgaataataaaggcacttaacaattgagaagaattcatattttttacatacctcgtataaaatttaaaaaatttgatatctgatggttgtatcttagattttagaccagggagagcattttatgaagaatgactttttttcgtaaaagtgataataaaatagttatcataattgtaataaaatgatgatgagtatccgtaatttgagaaaaaatttaaaaatttttttcgattagaataatgtaattgtatatttaaacatagttttttaattcaaacacaacacctc

SEQ ID NO: 4929 - DNA, 236 bp, Diabrotica virgifera
  Clone ID: LIB149-043-Q1-E1-F9
acacgcgtccgcattctcagaacttttttatcataataggtgtttaaattaattaaattttttaataccactcatgacagcaatactacatttccatagggtacatttatagtttactgctgagtttagtgcaatatacatttatattattgacctttagtactgatgatggtagtagtacaggcaaattgtatatctcgtgatgatatctaggtttaatgtaggaattcagcacc

SEQ ID NO: 4930 - DNA, 413 bp, Diabrotica virgifera
  Clone ID: LIB149-043-Q1-E1-G2
gcacgcgtctgcacatcgcgtctggtagcccgttgggactctttgaccgaattagacattagagataatccatggacttgtgactgtgaaaaccaatggctaatagacgaattaatgcctatttacattaaaatcgatgaaaattctgccaagcaggttatgtgtgctgctcctattgagatggaaaagacttccttccatcagcttctagttcgccaaagtcagatgagatgtttagacagttatggacatagaccagaaaaggacggactactacttgtaggagtcttaacagataagaatgtggaagagaccaacaaaccaccagacgcattaccagaatcagatgagtcactgaaatttatttttatacatgagcaagaaagtgatgacgattatgttgaaatgaatga

SEQ ID NO: 4931 - DNA, 411 bp, Diabrotica virgifera
  unsure (1)..(411): unsure at all n locations
  Clone ID: LIB149-043-Q1-E1-G3
atcgaaacaatatgattacaaatatccattccggtaattgtgggtgatcaatgtcaatcctccgcatcaacttttgttttttttaaatatatattcagtactgtaatggtttttaattttttatatattaaatgtatattatctccttctagaattttgaaaatttttttttganattttagcaccttttaagttgtaacttgttaactattacatttattatttaataacattgttttaagttatcttttttattttgtatttgttcattgttgaacttctccccagaacttacctctcggggtaaaggcaaatacagcggttttaaccaaaagtttttttaagagttggaattacgttatgtgaaatatatattttgtagaacaaatatgcagatcaaggtctatctgt

SEQ ID NO: 4932 - DNA, 357 bp, Diabrotica virgifera
  Clone ID: LIB149-043-Q1-E1-G6
gttaattactattgtgagagaatattttatttttataaaagaaaaatttattttttgtaccttgtgtatcagggattattaattaataattatatatttattattttcgaatttaaaagagctaaaaaattaaaatttttattgtaaaatagatattttaaataatttttttgtaatgaaatgttattcgttttaaatatatcctaatttttaagaaataaataaattatttatacatatattataataatattttatatattatataatattttaggatgactaaaattaatttataaattattttaataaaatagattaaatttctatttaaatagttatattattttaaaatat

SEQ ID NO: 4933 - DNA, 411 bp, Diabrotica virgifera
  unsure (1)..(411): unsure at all n locations
  Clone ID: LIB149-043-Q1-E1-G7
aaacatgaaaaccattattcacaaaatagtggaatacggcaggcttttttctagtcgtgactgattttctaaataaaaaggaggcaaccacttttaaattgcatagaaacagtaagtatttacaaagaaaatgttgaatcagacaatgatccaaaatcacctaaactttttgattaggttctggaatgacaaatgatatgctacatccattcattaagacaattgtaaagcatggtttaaacataaacatatcttacactatcatgattacaaattgagtagtcaacagcacgttaaaatcaaaaataaaacgcatgagatatgatttacagagaaatccaaaaccatcaattaaaaaggcgaatctgtcttcgataataggttaggttcaatattantgggtgtataaac

SEQ ID NO: 4934 - DNA, 382 bp, Diabrotica virgifera
  Clone ID: LIB149-043-Q1-E1-G8
caagcctctaacctgacgtcgtaataaaaaaaaaaaaaaaaaaaaaaaaaaaaaataaataaaaaaaaaaaaaaaaaaaaaaaaaaaaataaataaaaaaaaaaaaaaaaaaaaaaaaaaaaaataaaaaaaagggggccccccaagaggatcaagccttacttttcctagttatcaagttcaaattccttcaaaattgtcccttaagttcatttaatgggccgcctttttaaaaattcctaactgggaaacccctggttttaccttattaaatccctctacatttatacccaattactctaattgacttaataccaaaaaggttttacaggattagcctttcacaaaatttgcactacctatttggatagaggaacccacc

SEQ ID NO: 4935 - DNA, 317 bp, Diabrotica virgifera
  Clone ID: LIB149-043-Q1-E1-G9
gcttatcgatatttgggtaagtgtcgactaagcagactcagttcaattactacttcttccatgagtgttacgcttttaacctgaaccaagtacatgttgtataactgatagactcttaagtacatcattttttgatcagtctggtgatagggatcaatatctcaagcagacattatttagagattgtaggcatcatgacttatgaagttgaattacaccatagattggctttcaatgctcagtcttgtgaggcacatgataggtcaataagtgacatttggaactttcgaaataatatatgctacgactgcaattgg

SEQ ID NO: 4936 - DNA, 391 bp, Diabrotica virgifera
  Clone ID: LIB149-043-Q1-E1-H1
acgcgtctgcacagacgtccgatttttgaataataagtaaaattttaaccgggaataataattttaatttaaatccgaaggcatttatggtaagaataataaatttaaaaattaatggtaatggcttagatattcaatttttttttaattaagaaatataaattacgaatattttttttcgataactttttaacaataagagtttgtaaggttcttatgtttagcaattttaactagaataattcgtgtttatggtaatgattatatttaactttttcttctttatgataagatttttatttagattaatttttttgattcctttaggttttaacaacaatttttgagtaattcaatgattaatatttggttttacatttttatttttttt

SEQ ID NO: 4937 - DNA, 428 bp, Diabrotica virgifera
  Clone ID: LIB149-043-Q1-E1-H10
aaccgaccacgcgtccgcgaagatgaaggtattagttctcttttctttagttgcactcagcgttgctctaccaacactccttggtagaaccgtaagagtcacagaagatggaactgtatctctcttcgactctagaggataccaactcgtaatcctcaagagtgttaccgatcccagacaagtcgaggttgttctcagaagtccaaacacaagaacccatatgttccaagttggggaaccactgagaactggagaagctatcgaccgtcgtaccctcgctggtgtttcagtttaccaaaactacaaccaagctgatattcttactgatatttttcgtcagtatgaaggtactcttgacgacaccaaatactatagccttcttaacaggattcagatgttagttgaagctggagtcgtcaacgaaacca

SEQ ID NO: 4938 - DNA, 387 bp, Diabrotica virgifera
  Clone ID: LIB149-043-Q1-E1-H3
acactcgataaacaatgcactgaattgctgtttgggctgccttcgccagcggtgaatctgaaagggtatgaaatgtggatgtgcaatatgtatgagacaagagtaccgaattgggagtaccacaacacgacccctacgtcaaactcagggacctacaatggagtggaaacctcggtgttgccaaagcccatatcgagctccatgataatagatggtatggtcttgccgactgggaaattcaagcttaccaaatcagtgctgacactgacaacgaggctgtctttgactacaccacatcatggtcaaatggatttcaactctctatgaactacaatgcaaccattaaggaacttttcctttcacagcactactcaaggaacatcaaga

SEQ ID NO: 4939 - DNA, 396 bp, Diabrotica virgifera
  Clone ID: LIB149-043-Q1-E1-H4
gtccgcagccgagtgggcggacgcgtgggggacgatccattcccgttccattttccattatccatatctgttgaagttgaactttaactaaactttttgttattagtgaggccaatagaaaaatactagagagttacaaataattttctaaaaagtgaaagttccagtcatgcttctgccattgttgttgtgcagatgctggatgatggtgccagtgtcattcatcattcagtgctatcaagcctttgtgtgaagtgtaaccccataattgggcgtgggtgtcgctgagttaagattttatgaatgttaagagcagaagcagtaccatcacaatcttaagatacacaaatggatttttggttattaacgaaagcttacaatcacatcaaggtgttt

SEQ ID NO: 4940 - DNA, 433 bp, Diabrotica virgifera
  Clone ID: LIB149-043-Q1-E1-H7
cccacgcgtccggtattaatgttgacggaggctcttgtgaacatttattataaattcaatgattttatttttgttagtaaatattttgtattatatctcattttattggtatattaaacatcacttcactttgatgttgatttgttaatgggcataaaagtttgatttagtatggttgtaatagcaatatcatcttgtgggtttttattaatattctacatgtaccaacaatattactgcttaggtattttgatatcttttcaatatttacataagtgtcagtttaaggatcatgcacttcacggccaacctaataacattgaagcttatttttgttgcagttaatgttgggctcaaaaatcaagaatgacttaaaaattaaatcagttagttatagactgcttaagaaataataagtatcataaaatgccat

SEQ ID NO: 4941 - DNA, 426 bp, Diabrotica virgifera
  unsure (1)..(426): unsure at all n locations
  Clone ID: LIB149-044-Q1-E1-A10
gggtcgacacaagcgtctaaagtaaatcatattatctggtcagtttgcattgttgccaagttgtgtctttattcccttgatcttccgaaaaaccaagaggtctagaatgacaataaaactatcagtaggatcgtaattcactgcaactgtttctcctgtgcacgcagttgttcttgacagccttcagtgtttccacgttgtatatgtattgtcttgatctgctacaatnagaaaaatacaagaacactatcagtatgatctgatttcacttaattaaaactataaaatagacttcgtgtcaaatatcttgcttaaatgtcggtcacaggcgtatttatatagccgcaacactgttacatcgtagattttatctgtaaataaggaattttgattgctaacttgtcctgaaagatttacgatctacaa

SEQ ID NO: 4942 - DNA, 395 bp, Diabrotica virgifera
  Clone ID: LIB149-044-Q1-E1-A11
tacataagatagtatccactgccgtatcaaccaatctcatcacgcaacaactgaacatatcagttttggttcctgatcttactatcaacttcggagctgccgtcaacgtagtggttctggagctggtaccactttacggtagtggaaaacaaaacatcaatattggagatgtgaaactatcaataaatgccgtagccgatctctcaaaaatacccaaaattcaagtttcgaaggtggacgtagttttgaacgtaggatctattacattcaacttgaatggtctcttggacaacccagaattcacagctttggtcaatactcttctcaacgacaacgtggctaaattcatcgatgagcatggtaactttttgatgccaattatcgacgatgccatc

SEQ ID NO: 4943 - DNA, 67 bp, Diabrotica virgifera
  Clone ID: LIB149-044-Q1-E1-A2
cacgcgtccgaagaagcgtcggattttatttaaataatgtatagttatagtataaggtgagaaaaat

SEQ ID NO: 4944 - DNA, 179 bp, Diabrotica virgifera
  Clone ID: LIB149-044-Q1-E1-A3
tttataaaggaaaattaatttttggaacctggggtacaagggataataaattaaaaataaaaaattaataatttccgaatttaaaggagctaaaaggtgagaattttaatggtaaaataaaaatttaaaaaaattttttggtaaggaaaggtaatccgttttaaaaaaaaccaaatttt

SEQ ID NO: 4945 - DNA, 427 bp, Diabrotica virgifera
  unsure (1)..(427): unsure at all n locations
  Clone ID: LIB149-044-Q1-E1-A4
ttaaaacctgaagaaagatttatgaactggtgatttacaaaatcttttttctctctttgacacacgtacattcaaatttgattttagatttatttatatcaatttacgccagtattaatcataattcagagttggcgtagtgatgtggaatgattgtggtttccagacgagtttattcgtgtaaattttaaattttaaattttaaaaataaaaatttgaattgtagagaaacactcattgatatttttcttaccacaagttataaacagtaagtttgtttaataattaaacatttttttcgaattttcttgccaagtttttggtttttaaacctttccgaatgtattgcatttgacgattattatcannaacacagagtcttagttgatatggatacggttttagtatatttggaatatttggcata

SEQ ID NO: 4946 - DNA, 290 bp, Diabrotica virgifera
  Clone ID: LIB149-044-Q1-E1-A8
acggacgcgtgggaaaaaaaaaaaaaaaaaaaaaaaaaaaaaaaaaaaaaaaaaaaaaaaataaaaaattaaaaaaaaaaaaaataaaaaattttaaaaaaataaaaaaaagggaaaaaaaattataaaataatttaaaatgtgttaaaattttttttataattatttaatggggttactctttttaatttttaattttttttttcctttttttgctttttttatttttttttattttttcccaaattttttttttttggctttttttttataatcttttttttggaaaa

SEQ ID NO: 4947 - DNA, 282 bp, Diabrotica virgifera
  Clone ID: LIB149-044-Q1-E1-B1
attgatgagttgaaggatgctggatttgatgcaactcatgaaacggtcttttgatttacagttatggagatcatcagatttagaaactaaatggaagttgtcgagttcaatttttggagtcgttgctgatctgaatatttttgtcgtcgattggagtaaagcaactacaagagattacttcgaagctcaaaaagatgtgacaacagttggtggatatattacagagtttcttaatgcacctgtatcaaaatatacattaaacttagatagagtcaccaatca

SEQ ID NO: 4948 - DNA, 414 bp, Diabrotica virgifera
  Clone ID: LIB149-044-Q1-E1-B11
cccacacgtccgtccagatccttgagacccatccacatcatatttatttcgttggtgcaatgatatatttgttcacatggttatctaatttttacatattgatatgagattgcaaactgaatcttcgtcatctgtctaaagctaaaacaataattgtagaagatataattcctaaatattgaatattagcgaaagtaataatgagtttgttgatggctctgacatgactgtactcgatctgtcatattgtcttagatttgtgataaaaagaaattctatagtttgacaatcactttgtgagttatctttatttgtagtttttatatatagcactacaataatttgagtttttcaagcagaataaatctatgacctatatttagattctttgtggtgcgaacttttttggtaact

SEQ ID NO: 4949 - DNA, 421 bp, Diabrotica virgifera
  Clone ID: LIB149-044-Q1-E1-B12
aggacacgtgggtttttatttattttaaaataataaaatattttttagtaaaagtaaagaaaaaatttaatttaaaggataggtaaatagtaatggtaagaaaaaatttaagttaaagaaagaaaatttattttttggaacctgggtttcaaggaataataaataaaaaataaaaaattaatattttccaatttaaaagaagctaaaaattaaaaattttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaa

SEQ ID NO: 4950 - DNA, 439 bp, Diabrotica virgifera
  unsure (1)..(439): unsure at all n locations
  Clone ID: LIB149-044-Q1-E1-B4
aaacgaatggtaatgtaaattttttcaaatggttctcaatataccaaacggtattcatcaacattaacattcaaccctttcctcaaaaatgttcaacaaaataaataaacgagcggtgattaacttggttaaaattgtgaaattaagtgttactattatatttatgttctcagacgatcacgtaacagaaataagtattaagacaaatagtgaaattaaagagaaacatgccattatatcatataccataaataatacgactaagacgactgctactagtacttctacaactactaatactgctactgctacttccattagtactactcctagtgccgatatacactgctacagagaaacaagtttagcttcccttcccgatatttctganataagccctagacaagggaagtcaatttttcttcacgaaacttcctgt

SEQ ID NO: 4951 - DNA, 350 bp, Diabrotica virgifera
  unsure (1)..(350): unsure at all n locations
  Clone ID: LIB149-044-Q1-E1-C3
aactcaattgatagtcggttctaagccactcagtacagcgatgaccgttcagcagtttcaacangtaatcaggtcgccgttgaatgttagtcagggaccggtagttttggcaaaaagaccacctactagagttataccggtgaacacgcagggatcaaagcagactatacaggtagtagctgccggatcgtctcaagcattaaacaccgcccttcgaccccaagcgggcacatcgacactggccggcgctttaacaggcatcaaagtacaaggagcttcgggaaccactcaacaagctttattatctcaagtatcagcagctttgaaccagaacgtagctggaatgcgac

SEQ ID NO: 4952 - DNA, 418 bp, Diabrotica virgifera
  unsure (1)..(418): unsure at all n locations
  Clone ID: LIB149-044-Q1-E1-C7
acccacgcgtccgcccacgcgtccgatttatattgagggacatacatcttacatccattaacatgattttttaaaatataaaacagtaagaacacagattctcattaaagtataatatatatagttaaacaataatttaaaaaataaaaacaagtttaaaacagtatgcacgaccagcatgcacaagatgatgaaaaatatacattcatttagttatattctttaggaagaaggtagtaggtagataagagttaggtacatttatttgtccgattatgaaacacgatatgcactttttagaattaacattcacagttttctgagtaaaanatgtcntatgtcaccattgtcaacactatggcgtgtaagcatccatcattcgcctttggtaggcttttggggaaacattgggttcatc

SEQ ID NO: 4953 - DNA, 421 bp, Diabrotica virgifera
  unsure (1)..(421): unsure at all n locations
  Clone ID: LIB149-044-Q1-E1-C9
accacacgtccgtttttatttattttaaaataatagaatattttttagtaaaagtaaagaaaagttttatttaatgataggtaattaataatgtgagagaatattttaggtttataaaagaatgattcatgtgttgtaccgtgtgtatcatggattattaattaataattatatcgttattattttcgcatttaaaagagctattttattgaaatttttattgtaaaataaatattttagataagttttgtgtaacgaaatgttattcgtctttaaatatatctaattttttaagatataaaataaatttaattattaacaatatatttataaataaatatttttatattaataataatggatagtcttagggatgagcttataantaaaattttattataatttaatttttagattaaaa

SEQ ID NO: 4954 - DNA, 447 bp, Diabrotica virgifera
  Clone ID: LIB149-044-Q1-E1-D5
tacacgaatctatattgagtgctcctaaaagacaaaagcatgaaaactaaatgtattaaaataagaaataaaatatacacaaaatttaaatctacattaaaatctacctaaataaatactcttcaaaaactgtattaaaatgttccgaataaactcatcattatgctcgtaaagcaatttagtctagtcacaacataggggatcctgtggggaattctaggttttttgggtcactgaatccaatggaagtggtctggaagcccaaatatgctgcgtttaattttcattaacaaattatggtaaaattagctatttttcaggaattaataaattattaaatatatttcttaagttagtagagtaaagttattatacaaactggaacatgaagtaaaaaccacttctatgtgaaaatataagtcaaaaatgacttaattgaaatgtaaa

SEQ ID NO: 4955 - DNA, 308 bp, Diabrotica virgifera
  unsure (1)..(308): unsure at all n locations
  Clone ID: LIB149-044-Q1-E1-D7
acccacgcgtccgcccacacgtccgaatttaatttattagtatatgttttaataaattttaattaatgttttatatatagaaatgtgagtaataatgtgagatataatggggattttattaattattgtaccatgtgttgcacggagtataacatggattataaattaataataatatcgatattattttcgcttttaaattagcttttttattgtaatttatatagtttaattaatattttatgtatgttatgtganacgaaatgatatacgtctaaatttatatcaaattttttaagtttaattat

SEQ ID NO: 4956 - DNA, 439 bp, Diabrotica virgifera
  Clone ID: LIB149-044-Q1-E1-D8
acccacgcgtccgattttttgaaattagtaggtgccatgtctaaaacgattcttattttagttttcgtgtcttgcttcgtagcacatatccaatgtagaatctttatggattgtcgagatcctgataatccaggatacctgcagtttgacaaacaaataatagcctcttttcctatgagtatttctgtacattttcctgcaactggatatcaacctgactcagactattcgtgtttaaagataaactgcgataaagatactacagtgacgctaattgacggaggagttggattcagatatgcaaacattaaagttgattttaaatcgtggcaaacattaacctgtggaattcaaatttatactttacagccagaagtttcatccgtttaaatgacaatctaaattgtttttataagaaattgtcccaattcattttcaa

SEQ ID NO: 4957 - DNA, 413 bp, Diabrotica virgifera
  Clone ID: LIB149-044-Q1-E1-D9
agacagtgcattgtgcaaaacgataaaactattttgaaacagtaaaacagagcagtgtcagcataaaggcattgttcgattttaactgtattgtgctactgaaagtgcacgtcaacttgtttttaagtgcactcgattacctacaaactaaagtttaaatcaatttttacgagttcgatttataatatggtgaggataaaacaaagatataacttgatatgatccaggtcgaatccaatagcatgggctctccgatatcggacttcacggatgacaacttcgaagaagaactagcagaagcttgcgaggagaacttggacagtctgatgttttgttcgacttcatatccagaagtcggagatactgctcccgaaaagttttctgagatttcgagatacgggatcgtcgatgtc

SEQ ID NO: 4958 - DNA, 51 bp, Diabrotica virgifera
  Clone ID: LIB149-044-Q1-E1-E1
ctctaaagtaagtcgtattatacataaaaaaacaattacaaaagaaagaaa

SEQ ID NO: 4959 - DNA, 71 bp, Diabrotica virgifera
  Clone ID: LIB149-044-Q1-E1-E3
aacaaacatccaaatgtggattattccttcatccagtacactacatatccacttgccaacatctgcagata

SEQ ID NO: 4960 - DNA, 444 bp, Diabrotica virgifera
  unsure (1)..(444): unsure at all n locations
  Clone ID: LIB149-044-Q1-E1-E4
agacaagcgtctaatcaaagtctgcagatacgttaagtttcacaaaaaattggtattgtgaggattagcgaaccgactatacctgtcctccacgtacccatctatgattatggttatgtttataagtttttaaatttgataattttataaacggtacttacaggaaccattttatagttcatatttattcaaattgattgacttttattaacattccaatatataggatgaatcaaaattagttgttttaaataattgtgttattagtgttttaaaatcgtttattcacattgaacaatctctgtacttgtaaaaatgtcgttattgtactttttttaatacctactaatgtaactctgtactaaattgttaatattttctttaaactttctcaattcanataataaaaatgtaatttgtaaaattaaaagagaaacaagtgtg

SEQ ID NO: 4961 - DNA, 431 bp, Diabrotica virgifera
  unsure (1)..(431): unsure at all n locations
  Clone ID: LIB149-044-Q1-E1-E5
atattgagtagattaaattcatctgaatataatcacacccacttataacacagctaaaacaggtctaaacatacttaataacaacaacacgtgcaagtcattaaaaattctgagaaagcgaaaccttagtcaaataaagaaatatatctctcaaatctataccatcccatttatgaatttcgcaccaaataggtacctaatcattgttttatttttctttaataatacattaataaaataggtattctaaaatcagtctcctttaactgattaataaaaggtcncatttttttggtccacgaataattaacaatccgcatatgaatttcgcancanataacattcganatactataattgttttatttttatttaataatgcagtaacaggtattttggaatcagtctccttttaaaagactctaaagaac

SEQ ID NO: 4962 - DNA, 152 bp, Diabrotica virgifera
  Clone ID: LIB149-044-Q1-E1-E6
atttttactatttgagaagctttttcttttcaacgaaaaagagtatgacctttaagaataacttctgcaattgaatgactacaatttaaccctccagctgaacacgagaggtctgaattgccaatattatcatcacattataaaagaaaact

SEQ ID NO: 4963 - DNA, 368 bp, Diabrotica virgifera
  Clone ID: LIB149-044-Q1-E1-E7
acccaagcatccaaaataatccgtataatgtacggtgccggcaaaaaatctttacaaagtgaataaaacgcattcctcttcttcttcggccttcagtaacccaactttggacatagcctcccgcaattcaatccagtgttgtctattttgtgccacctgtttccagttgtgtcctccaaacttctttatgtcatcggcccatctcatttgtggccttcctctacttcttcctaaccacggtctccattgttgtagttcgtgattccatcttttatccttcagtcgggcattgtgtcctgcgaagctccattttaatttggcagcatggtctcctgccgtctttcacttttaaacgcataaatcaggat

SEQ ID NO: 4964 - DNA, 356 bp, Diabrotica virgifera
  Clone ID: LIB149-044-Q1-E1-F12
acgcgtctgaatcgatactttctaaaagctatattggtctaagcaaaacctaaaatgtaaatcattgttcaatgctacaacgacagcttgcaatattactggtacaaagtgatatctcgcaaaaacatttcaaatacgacgcatatattttttactccccgtttcttataaaactatatcaagaaaaaattacaaaaaatcttaaatgataggttaatataaaggtttgacaattttttcacattgaaggtgtcgattatttggaaggtacaataaggtagaactatttcaacactacgattccaaaaagttacatttctccatgaaaaatcaaaagatccaaacttgaataattt

SEQ ID NO: 4965 - DNA, 422 bp, Diabrotica virgifera
  Clone ID: LIB149-044-Q1-E1-F3
atggactgattaaacaatggcttccaaaactgttcttttcggactcttggtagtccttttggtcaaccactctttggctagagatctgactgtctgtcccaactcagacaaagcaaccaaagctgtatacgacaaagaagtagcaacatccgttgtaggaagcaccatccgtgttagagtaccagacagcttgttcttgaagaaaccaatcacctgcattgttattgtggacaataaccacagcgatagcgtacctgaagtagaagatggtggtgttgacagtacatgggtgaccgtaaacattgctcccgccattaccgaactgctcagctacagaatccaagtgtacaccaatgaataaatatagattgtaatatgtctgaattatgtaaagtggtgctaataaaggctaatgtgtatat

SEQ ID NO: 4966 - DNA, 324 bp, Diabrotica virgifera
  Clone ID: LIB149-044-Q1-E1-G1
aaacagatcctccaccaagcagacgtccaagaccaccaggtcctcctccaagcagacgtcctagaccaccaggtcctccaccaagcagacgtccaagaccacctggccctcgagggggcagacgccctagaccaccaggtcctccaccaagcagacgtccaaaagcaccaggtcctcctccaagcagacgtcctagaccaccaggtcctccaccaagcagacgtccacaaccaccaggccctccaccaagcagacgtccaagaccaccagggcctccaccaagcagacgtccaaggaccacagggcctccaccatgcagacgtc

SEQ ID NO: 4967 - DNA, 412 bp, Diabrotica virgifera
  unsure (1)..(412): unsure at all n locations
  Clone ID: LIB149-044-Q1-E1-G2
ctcttatcaatatattccagagccacaaaatatcgttttacaaggctaaaaaccctactgctacgttctctcggtgaagaagctactactgagagtgaactctcttcaactgagacataacattcaactcaattttacagtggaattttgatggacttttccatcgcttaccaatgctcaatatcattcaatgagaacactttcccgaaattatatgtctacaggaaactaatcctgtatcttctaacccatattcgcaaatacattttatatgctttcgtaaagaccgaactaacacagctcgcgcaagtgagggagttgcaattttagtaccacttatttcgactttcccgcagtcgttggagtttcacttatctcaacanaatggtagaatagtcaaactcatttggac

SEQ ID NO: 4968 - DNA, 388 bp, Diabrotica virgifera
  Clone ID: LIB149-044-Q1-E1-G8
tctaaaatgagtcctaatagtccaaaatgctgcttaaaattgtcgtcgtttgctgctgcatttcaattgcactcagtcaagctgttggaaaatgtcccagtgtagatggtagatatccagtataccttcctgatgcaacatcctgctcaacattttatgaatgttctaatggaacaccataccaattcaaatgtgcgtatggaacatatttcgacagccagagcagaatatgcagacataaacgagacgtcaattgtggcagtagaaggagagattagtactctagttaaaaaaatgtaaatttgttttaattctcgtagtacctgtgatacacatattttttatattgtgttaaaaattaaaaaataataaaaaagtgattacatct

SEQ ID NO: 4969 - DNA, 435 bp, Diabrotica virgifera
  unsure (1)..(435): unsure at all n locations
  Clone ID: LIB149-044-Q1-E1-H11
gggtcgagacacgcgtccaaattaattcgtagaaaattattagcgttattagtgatgatgtggcctatgtgattcccataccaaaacaagatacagttatctataaactataaaaaaaaatagcaaagcaaacaattttgcgtgtattgtttcagagtaaagtgtttttgtgtagctgttatcaaccaaccaacttttgaaaattaaatatttgctgaccatggctaacccattttctaccatgtaccacagtttggattcaattctgagcattttgagaaaacctgaaaatttagcaatacatggagttaaagaactattacagatttatgaacatgccaaagaaaataaaaacaaatctgaaacatcaggagacagtaggagacnacctttcatagtattagagggtttggatggctcaagaaaatccactgt

SEQ ID NO: 4970 - DNA, 221 bp, Diabrotica virgifera
  Clone ID: LIB149-044-Q1-E1-H12
gatttaaattccaccgcccttactgtaatttttacaaattttaaacttaaatttagtagcctaaaatgttcaaagaagacgctaatcccctagctaggcataagcactcattagtaactatctttagtgttaacattaatggataggaaaggttcattaagttgagcgtgcttcaatataaaattaactgtttttagagaagcatataaattaactatttc

SEQ ID NO: 4971 - DNA, 159 bp, Diabrotica virgifera
  Clone ID: LIB149-044-Q1-E1-H3
actggatcttcattgaggcttaaacaaaattcttgttgtccctcatgcgaacaattcgctgactcataataaatcaacgaaatattgtaacggtccgaaacaatgacttacatcaaatgaaaaattaccaataaactaatgaattatggcaagactaag

SEQ ID NO: 4972 - DNA, 78 bp, Diabrotica virgifera
  Clone ID: LIB149-044-Q1-E1-H7
aaaaaaaaaaaaaaaaaaaaaaaaaaaaaaaaaaaaaaaaaggaagaagaacaaaaggataaaaagcttaaataaaca

SEQ ID NO: 4973 - DNA, 402 bp, Diabrotica virgifera
  unsure (1)..(402): unsure at all n locations
  Clone ID: LIB149-045-Q1-E1-A1
aacgatcgtggttgttttattgagcctaatttccttggcacttgttgcttgcgatgattcagttagtacttcgacagacactccggtaatatcaacagaggtaccagcagcgatatcgacaagccttcgtgaagatacagtttacgtagcaacttcaaatgttcccgacccagtcttccagatagatgccgtggaagtattcaaagaagctaaggcacttcatccggttgacggtatagctttgttagaaacattttccgatttgttttacgccaaacataaagtatctggaggatggaaagttgctgaaaaatatgattacttttataatccanatataaactacgtgtatattgaattgatggttaatgatgctaatggagaaaggagggttatgatatt

SEQ ID NO: 4974 - DNA, 334 bp, Diabrotica virgifera
  Clone ID: LIB149-045-Q1-E1-A2
acgatattgaccacaattataagaaaccgactaaatcaatacacagaaaaaattataggaccatatcaacagggttttagaacaatagatcaaaggaagatcaacaatagatgcaatacacgtactgacacaaacaattgaaaaaagctatgaacatgacatagaattacacatactattcatcgacttccaacaggccttcaacagcatatacagacaacttttaattaaaaaaaaaaacaaaaaaaaaaacaaaaaaaaaaaaaaaaaaaaaaaaaacggcagatgcccaaaaggaatccaagctaacgtaaacatataagaaaattcacaa

SEQ ID NO: 4975 - DNA, 398 bp, Diabrotica virgifera
  Clone ID: LIB149-045-Q1-E1-A3
aaattcgctatccagtgcagacaattataacaaatgtcctgaaaccagccatatacgatccctaatttaccagaatacattgaaggggagagttatacatgtacgcattccaggcacaggtttctttgaagctccaatcacttgtcttcaggttaccgatataaatgaaagtttcagtacaccagttgtagaagaaggtggatatggaagggagtacgtagttttacgtattgacccagttgaatcaggagaacagttacaatacgatgttcagatttatattgacgaagctgttacagcctatcctcaataaatgttcggtataaatgtttaagaaattcgagtagcccctttaaagataagcagttgctggtattttaacagcattacggattgta

SEQ ID NO: 4976 - DNA, 376 bp, Diabrotica virgifera
  Clone ID: LIB149-045-Q1-E1-A4
taatcataatacttgtaagttgaactggacacattcttaatttaatgatcatgggataatgatgagatagaatacttaaatcgaatgatacatactctaagcataagattgtcggcatacagggatacgtagtgaataatatacagtatagtatttactgtattaaaatttcgatttcatccattcattaacagtgtgccatacacatcaagtaattccttcgtggtgacaagttactcgaatatatttatatcgaatttttcatgacatgactcacatttatttattaacactagatttaccattgattacatacatcttactagtattatgcaattctatggatgagcttaaatttaaaatcatataattctca

SEQ ID NO: 4977 - DNA, 243 bp, Diabrotica virgifera
  Clone ID: LIB149-045-Q1-E1-A8
tgaccacgacgtctgctaaccctaaattgtaaatgatttaatgcaaatgaaacaccaaatagaattcaaaaataaagataaataaaaaactaatgatttggatttattttaaacagcaacattgaagaccaatcaaaatctcgatcttctgaaatatgacataattgtcctacattcgttaatggactcagatatcaaatgtaggacaattatgtcatatttcaaaggataaatattttgatt

SEQ ID NO: 4978 - DNA, 368 bp, Diabrotica virgifera
  unsure (1)..(368): unsure at all n locations
  Clone ID: LIB149-045-Q1-E1-B11
atagtgagtcgtattaaactggncganccacttctagtgcaagtcaagaacaattttacttaatgatagctgattactatcgtgatagaatattttatttttagagtacgtgactttacttcttgtaccttgtatagcagggattattaattaataattatatatttattactttcgaatttaacagaactaaacaatgaaaatttttattgcacagcacagactttacatcatttgtttgtaacgatctgctattcgttgttaaatatatctaatcttttacgagataatttcgatttatctattaacaatatatttataattaaatatttatatcttaccaatattcaatacttgtagggatgagc

SEQ ID NO: 4979 - DNA, 410 bp, Diabrotica virgifera
  Clone ID: LIB149-045-Q1-E1-B4
accacgcgtccgcggacgcgtgggctagctgctaaagttgtcttgtttttgggccttgcccttttcgtctcacccggtgaacatcttgacaagggttacgaaattgtgggatgtgccaattatgtaatgagagcaggagtacccgaattgggagtaccacaacacgacccctacgtcaaactcagggacctacaatggagtggaaacctcggtgttgccaacgcccatatcgagctccatgagaatagatggtatggtcttgccgactgggaaattcaagcttaccaaatcagtgctgacactgacaacgaggctgtctttgactacaccacatcatggtcaaatggatttcaactctctatgaactacaatgcaaccattaaggaacttttcctttcacagcactactc

SEQ ID NO: 4980 - DNA, 434 bp, Diabrotica virgifera
  unsure (1)..(434): unsure at all n locations
  Clone ID: LIB149-045-Q1-E1-B7
gtcgacacacgcgaccgaagacgcgtgggataattttgcagccaggtataagataagaaattggaattaagcccaaattctctcgaaacaatttttgtcgtaacattatgctgtaataactgttgagaagtaatggtggaaattcggtatttttagatatttatattaaataataattcctaggtgaatgcaagttattatctagaaaatttgaaggtaacaatatagtttcattagaatcatttcagtaactcttttcgcaatttttgtcttaaaaataattgagaaacgctgtagggttaaaaatttaagttacaagaagttagattttaggtgtaggcttaatgttttgttttaaatactgctctggatggtgcagtgaagatgaacgtanaaagaaagtaagcccaaattctcaattgaaaaatttttac

SEQ ID NO: 4981 - DNA, 411 bp, Diabrotica virgifera
  Clone ID: LIB149-045-Q1-E1-B8
cgcgtccgaagaaaggttaattcttgtcttgaaatagcaagttaatcttatccacaaaccacttataatcttcggggtataaaagcgaaaaaatcgtttattagagaagcctttcgaattcagcaaaatgaatactttattggtagcttcagtcttctgcgccatcttcgccatcggcctgaccgtacctgttctgacaggtccaggtccagctttccaagttaccgatggagaatgtgagaatgtctcaagagacgaattggtccgccaagagcaagtaaataagggtggttttccatttgttaccaaacaggctgatgttgaatacttaggagatccttcaaaagttatttactgcgttcaagctctcagctctgatgacccaagcgttgaatctgttgctgaaattac

SEQ ID NO: 4982 - DNA, 165 bp, Diabrotica virgifera
  Clone ID: LIB149-045-Q1-E1-C10
aactgtctctgtaccttcctatcaatgcgttattcactttacttacacgtatgttactctgtcatacttctgcttcatgcaccacttaaggtgcggcgcattacacgtttcattcaatcattgagggcatccttcatcttgctgttcactcattgaatctaccct

SEQ ID NO: 4983 - DNA, 421 bp, Diabrotica virgifera
  Clone ID: LIB149-045-Q1-E1-C7
accacgcgtccgagaacacaaaaatgaagattgttttattagttttgttcgctgcttgtttgtcacaagccaaaataaatcaagatatacatttcgattgggtgcagtataccggagaaataccagagaatgctataataggcggatcaactgctgatggtgatccaacgtatgtagcccgttccttcctcagtgcagatgaagatgatgaaaattattctggaagtgactacaatggttatgtagctggtggtgtgttacctggaaaattgtcgatcgacctttgtactccgcagagtatatacacgctcacaaagaacattgagatactgactgtggtcaatggaacaaaaatcgaatggattaaatcttaccagcacacattcatggacctcttcaactcagacgactatcgtcctgt

SEQ ID NO: 4984 - DNA, 419 bp, Diabrotica virgifera
  Clone ID: LIB149-045-Q1-E1-D8
cacaagcgtccgcccacgcgtccgcccacgcgtccgtggaaatccctttgaaggtaaaatgcccataatacgatctgactccttagaagtactagctttagccaagtgtcaaataacagaagtaacagcagaagcccttagatatttgccgaatctcagattgcttctgcttccagaaaacaacatccagtacatacagcccgatgtattccaagacgtgtctgaatacttctccatcagactctcctacaacacctgggaatgcaactgtaggaccatggaactgtttaggttcctcgcagacaagaaatacctcgacttgaccgaaccctatcaatgttccacaattgatggtaaaattattaatatctccgattttcagagtatggatgagtttaaaaatggatgtaacgctacag

SEQ ID NO: 4985 - DNA, 256 bp, Diabrotica virgifera
  unsure (1)..(256): unsure at all n locations
  Clone ID: LIB149-045-Q1-E1-E11
atagtgagtcgtattaaaccnggnncngccggcagggctgtcagccgggcggccgcgcggccgggtcgtgccgtccgtccccctgcacgccacttcatagccctggggggggggctgcgaacttcagttcgaagaacggggttttcccccgtccttactggtaacgccctgtcgttactacaccctgagcgccttgcctcacatccccctttctccagctggcttactcgccaacatgacctcacctatcgccctt

SEQ ID NO: 4986 - DNA, 408 bp, Diabrotica virgifera
  Clone ID: LIB149-045-Q1-E1-E5
accacgcgtccgcggacgcgtgggtttcggactcttggtagtccttttggtcaaccactctttggctagagatctgactgtctgtcccaactcagacaaagcaaccaaagctgtatacgacaaagaagtagcaacatccgttgtaggaagcaccatccgtgttagagtaccagacagcttgttcttgaagaaaccaatcacctgcattgttatcgtggacaataaccaaagcgatagcgtacctgaaatcgaagatggtggtgtagacagtacatgggtaaccattaacattgctcccgccatcaccgaacttctcagctacagaatccaagtgtataccaaccaataaataatttaaatattgtaatatatttaagtagaattgtgatataaagttaatgtgtgcat

SEQ ID NO: 4987 - DNA, 404 bp, Diabrotica virgifera
  Clone ID: LIB149-045-Q1-E1-E7
aggtcgagtaggtatatattttcaaatacaattaaaaaaatattttttggttggttattagattgtgaatatacaagagctgtaacattatggtagacaaggaagatatcaagattagacgggcgcgtgctgatgaagaaaacgcagttcgagatcatcttcgagcatccttttacaaacaagaacctacttgtgcatctcttggagtagtaacggaagaacgaccaatttgtcccgatttggagtcgtatacactacagtattttaataaaggtttaaatcttattgcagaatataatggacggattgtgggagtttgtcttactgcactattggaaaaagataaatatgagttcgaagaataccctgtaacggacaaaaaatttgaaaaaatcttacgaatg

SEQ ID NO: 4988 - DNA, 153 bp, Diabrotica virgifera
  Clone ID: LIB149-045-Q1-E1-E9
tgggattcacttcatctactcacaacctaacttgtttatcatttaatgttcatgtttacacttagtctaattcactcatattctttattcaatcactagctttatttttacggcattgtctaccttttattactacttaatgtctcttttact

SEQ ID NO: 4989 - DNA, 401 bp, Diabrotica virgifera
  Clone ID: LIB149-045-Q1-E1-F10
acggacgcgtgggcttttttctaaaaacaaaagatgtttcttttcaactgatagaaatacattgttatttttgcttgtaattttgacagtcgtcatgtattggatgacagatgtcaaaattgagagtgatttggtttcacgtgacgccatctgtcgaagattagattaatgtccaaccacccatgaatatttttataaacttgtaatcatgcatatcaagatctaattatagacgtatatattgacatagacagcagtctgtagagctaagtaacgacaccattgttttttcttgtcggacgtgtctctgtcttagattagttaaggatagcgacaagagatcttgtcgccagcatgcgctgtcggtatgatcggtctacgttaatgtatacgtctaattt

SEQ ID NO: 4990 - DNA, 313 bp, Diabrotica virgifera
  Clone ID: LIB149-045-Q1-E1-F2
tcgcccgtcgacccacgcgaccgacctcacgttcctctcacgcgtccaggttaaaaacctgacataagaatcttaaaacattaatacagttttttaagtttacattacatgtgtgaaagggaggccgcatctcccaggttcacagtttaattatccatacatgcaatatgtgcactctcagaacaatcgctcaagatttttatcgatgacctactattaagcacgtgcctcttcggtgcactttgtcatgatattttttaacctcctagtatgttagcgcgacattgtcggaaaggtctgttcaccatgttgc

SEQ ID NO: 4991 - DNA, 238 bp, Diabrotica virgifera
  Clone ID: LIB149-045-Q1-E1-F6
gatgataatattggcaattcagagtaacggtgtccagcaggatggtgggggggtggtcaatcaattgaacaagttatccctaggagtcttaatcattttcgatgaatataataatcttctcacttaatagaacttaacactaatactccatttagtgaaattagtgatccactccaatatactgtatttcacatgttctactacatcaggataatctgaatttcgtccaggtatccct

SEQ ID NO: 4992 - DNA, 413 bp, Diabrotica virgifera
  Clone ID: LIB149-045-Q1-E1-G1
aacaagcgtccgcccacgcgtccgatctttaagtacatttaccatgtaaacaccgggaatgatcccgaagactatccagttaaacatctcatctacgaacaagaagactcactcttgaacaaaaagccaaaattgcaaagagaggcaaatataccaatatgattgttgatattttagataatagtaaacagttgtttgtttcaccaattttgaaattcacagttatttcaattaccatcaactttacatttcacattggatactacggtcttatgatgtggttccccgaaatgtttaacagatttgacgaatacgctaaaattcacgatggtgcagaagctggtgtatgtgaagttgtggactacgttgtcagtagtggcagccacagtgccagtgttttatgcagtgacaag

SEQ ID NO: 4993 - DNA, 332 bp, Diabrotica virgifera
  Clone ID: LIB149-045-Q1-E1-G11
atacaacaccctgacgtgagtcgtattaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaagggggggggaaaaaaaaaaaaaaaaaagaaaatgggggaccctgtgtaacaaggataatcaattaggaagtataaaattagtaatttcgaatttaagagagctaagtaaataccatagatagtgtaagagaaatatttgaaaaagacgtggctgaaatgaaatgacactcgtagtgaaaaacccaaatgttttaaggaaataacggagataga

SEQ ID NO: 4994 - DNA, 421 bp, Diabrotica virgifera
  Clone ID: LIB149-045-Q1-E1-G3
cacaagcgtccgcggacgcgtgggtttaatttacatgtatgcacgtttagtaatcagaattttaactattctcatctaaatttcatttgatttattcttgtcatctgctactctttctgacgattagaacggcagatggcacacgttggtttttcttcttgatgattgatatgtgtctctattttatagttttttggaaagaaaccacttttctccctccgggagtttcaacaaccctcaaatcgccggcgatacaacaacgaggaccatgtcatcagggctgcaaccacataaccaagactgcaacgaccaacatccgtaggcctggtggaatacaacacctacaaccccagagcccgttgcagaaccagcagcagtaccatacgacatcaagaagataccatcagttgccaaaagccat

SEQ ID NO: 4995 - DNA, 83 bp, Diabrotica virgifera
  Clone ID: LIB149-045-Q1-E1-G4
tgagtcgtattatattgatatcagattatttcttagtcctagtagctattccttttagttgatgatagcttattactgttgtt

SEQ ID NO: 4996 - DNA, 398 bp, Diabrotica virgifera
  Clone ID: LIB149-045-Q1-E1-G5
acacatctggggcatctactgtaccgaccgaatcacctactaatgcacctatataagcacctactgatgtacctaccgttgcacctactgcacgacctgcaccatactagatgacaccagatcttatatgtccagaggataatacctatttcccatctatttttgactgctccacatagtacgattgctcaaacggacacccatttctaatgacatgtcctgctggtcagttatcgtgtaatttacgaagtacatgtgattgggccgcacatgtcaattgctcatacctcgtaaccactcctgatccatatacagcaacaacttattacattatttatatgataatccctgtaaatcttttatttattttagtttcacttgtgtcgaaaatcatgata

SEQ ID NO: 4997 - DNA, 436 bp, Diabrotica virgifera
  unsure (1)..(436): unsure at all n locations
  Clone ID: LIB149-045-Q1-E1-G8
cacgcgtccgatttattttcatccgcttttcagatcatctgacgttttctagttcctagtgtccattcttgtttgtcgtcccaatcttctgactgaattttcacctcttacatttctctttgatctaattatggctgtttggtcttcctcttttccttccttcaactgacacccatgtttttgcttangaagtcatctgtcatcaatttttttgaacaaatatgttatgtgcgttcattttcgtcaataataattgatgatacttatattttgtcgtatttggtcattgggtatttttacagtcttgattttctggcagattttcgtcagaagtccattttcaaggacaataagcttgcaatggatgtatttgcctgtcataccattcatagagtacgatacttttaaatattgagttaaataagtgttttccttt

SEQ ID NO: 4998 - DNA, 310 bp, Diabrotica virgifera
  Clone ID: LIB149-045-Q1-E1-H11
aactattctgcaatctattagtaatgtgacagtaagcgtctttgttgataaatgattatgacatgtacaggatgctccattaagcaccctgttttataatgtagcgattgttaactttgtgatattacctctactatttacaatattttactatttacaaaaatatgtatattacaaattacttaaacctattaattaagtctcttggattgaatttttttaatcttctttcttcatgttcatgtaagtcttcaaacaaccgcttggctaactcgttaggatgtacagacactctttcgcgttttgttca

SEQ ID NO: 4999 - DNA, 424 bp, Diabrotica virgifera
  unsure (1)..(424): unsure at all n locations
  Clone ID: LIB149-045-Q1-E1-H3
agtaatcactatttattatttctcttacttactcttccaagtattcttccaatatttacattttccattatttagtacacatacataaatatgtacgttaaacagtttttcaacaaaactcttacaaatgatccacaaagaccacagtagtgctctggttaagttttttaacgatgtatgtgctactgaaaatgcccaagaaatagctgaacagtccttcagcccttccgaataaacaatgagctaaaaggtgcggcgaatacagattaattagtctgatgagctacacatacaagatttttcttcgcgtggtacatggaaaaataaggagtagatgcaacatcgaacatggacctaaattaaacccagttgggctatcccaatgctcttcacaagcgtgagacancttttgccttaaatagac

SEQ ID NO: 5000 - DNA, 411 bp, Diabrotica virgifera
  unsure (1)..(411): unsure at all n locations
  Clone ID: LIB149-045-Q1-E1-H4
tttgtgtattaaagtagaaattctcacagtttcgctagtttttaaagcatttaactctatttaactagaagtatgtaattgtctatttcaaatcaaaacggtaaacggtttaaatacgagtatattgtaatttccgcagatgttttttttattttattattcattttacacttataagtcttccgatttatacaaaaaaaaatatgtatctgtaggtcagctcctatgtataggggtgagtaatgtcttgttctttttccaggtataaatcttctgatttgccaaaatttcttaactgagtagttttatagcttaaactctttgtttttagttttttgacttcacagtatagtgatttgactttgtcgaaacttcttaactaaccaattgtgcattgctgtcaantaattt

SEQ ID NO: 5001 - DNA, 336 bp, Diabrotica virgifera
  Clone ID: LIB149-046-Q1-E1-A3
aaccgatactgggtcgtcacacgcgtccatgtttgatctgatttaaatacactgagcggcacatcattgtattttctactgacgtttattatgtctcaattattaatattctatattctgtctactttggtgcctgtgcttgtttgtcagggattcttatttaacaatggggggtggccctacaggggaccttgcttaagttacccgggtttggatttttactgctctttcaacggttgcccttaatttcttttggcgggcctgtttttcccaatttaactgttggaaaacctgggcgttatcccttatatttcttttggagaaacatcccttttc

SEQ ID NO: 5002 - DNA, 180 bp, Diabrotica virgifera
  Clone ID: LIB149-046-Q1-E1-A4
cccacgcgaccgaatatggtctgcgatcattgtgacaacccatgaggatcttgaagctacaagccgtaatgaacgtacccgatgaatgctattcagtgagaccagaataggtggataaggaagaactacacgttatcgagaatgactctcatagactagcacatggtcgggacatattta

SEQ ID NO: 5003 - DNA, 229 bp, Diabrotica virgifera
  Clone ID: LIB149-046-Q1-E1-A5
aaataggtcgaaatacgcgtccatgtttgatctgattaaaatacactgagcggcacatcattgtattttctactgacgtttataatgtctcacttaaaattatatacgattttgtttactttggagtctatcacagtttttgaagagatagtattgaattgtgtgttttattatgaaaaataaaaggaaaactatgaaaaaaaataaaagtaaaaaaattgtcagacat

SEQ ID NO: 5004 - DNA, 377 bp, Diabrotica virgifera
  Clone ID: LIB149-046-Q1-E1-A7
aaagtgattaaaggttttctatttttcatttttattaccattacttcctcagaatatgcttcgcttagggctacagaagcagacatcaaattctacttatttacccaaaaggatcgactttatggtacacatctaaacatttccgacaaagacgaaatcaatagatctgatttctcgaaagacaaagacacggtgttctatattcatggatggctggacaacaactcctccgaaactctcataagtatcaaaaatgcatatctgtcaaaatatgacgttaagatgcttgttgtcgattggagtacgttcgcagacagtgtaatttataacgtagcctacgacaatgtagaaccgattggaaatgtacttggacattc

SEQ ID NO: 5005 - DNA, 349 bp, Diabrotica virgifera
  Clone ID: LIB149-046-Q1-E1-A8
acccacgcgtccgatttttatttatttcacactactaatatactttttagtacaagtaaagaaaaattttatttactgatagttaattactactgcgagagaatatttgacttttagaaatgacaaatttattttttgtaccttgtgtaacagggattactaactcctaattacatatttactactttcgaatttagaagagctacacaattaaaatttttaatgtaacataaatcctttaaataacttttttgtaatgaactgttaatcgtttttacataaaaccaatttctgaagaaataaattgaatttattcactaacaatatatttacaattcaatacttttac

SEQ ID NO: 5006 - DNA, 349 bp, Diabrotica virgifera
  Clone ID: LIB149-046-Q1-E1-B10
accacgcgtccgcccacgcgtccgcagcaactgattccgcatctactgtgcctacagattctccagctgaaccagttactgattcatcatctactgcatctacagattctcggcctgacccagttactgattcaacagccactgcaccaactgattcaccatctgtgccattaacagtttcaccatctactgcacctacagattctccacctgacccagctactgattcatcatctactgcacctacagattcttcacctgagccagtaactgattcatcatctactggacctacttattctccacctgtgccaacaattgattcttcatctacggcacctgcagattc

SEQ ID NO: 5007 - DNA, 244 bp, Diabrotica virgifera
  Clone ID: LIB149-046-Q1-E1-B11
gtattaagcgtccgcggccgcttgtgacttacctgctgctcctccaggtccttcactaggagcttttacagcatcatctatcaactgcaccgcataattacaggtattgaggttatatacatgttacttcactacgtgattggcttattacttaccctatgccttacatggcattgatgacgatataatgtacaactacgaacttatcaacggcttcatactttagtacttactaaccgtttac

SEQ ID NO: 5008 - DNA, 431 bp, Diabrotica virgifera
  unsure (1)..(431): unsure at all n locations
  Clone ID: LIB149-046-Q1-E1-B12
gtccatacacgcgtctaaaaatgattcattataacgtgttcaatatttttcaaaaatctgtcgaatgacacccctgacccccacgtaggtggggtgggggattaaaagtcttaaatgggaacgcccatttttttatttgcagatttgcattccttatgtaaaaataaggaatttttattcgagacattttttctaattatgggtagatgtcgccataatcggaaacaacgatttttggaaatggaaaattaaattaaaaattggaaatcattactaaaatggaaaatacaacttgactctttttggttttataacctaatcttcgcaatccagcaggtcnccatgacgctttagtaactgcaaatttagcatccaaggctcctctactattattttaataggtataattgccaaccaatcggcgtgtttta

SEQ ID NO: 5009 - DNA, 353 bp, Diabrotica virgifera
  Clone ID: LIB149-046-Q1-E1-B2
acgaccacgcgtccggttttgtgtaacaaatatacaacaacgtgaaaattatattttatattgatgaccatgaaagttttactattgttagcaatttttgtaccatttgtggtaggccacgatgtgaagattacagaactactctctcaagaaatcttgagagatgttgatgttgaattattactaaaggaaatggagacaatttatttatttgaaaaaaagagttctggaaatataacggcagtgttgaatgagttcatagacaaagttttgggaaatgctggaaattacctcatagatcatggatatgatccatgccatataccagacacagttttacatcttccaataac

SEQ ID NO: 5010 - DNA, 198 bp, Diabrotica virgifera
  Clone ID: LIB149-046-Q1-E1-B4
aaaatatacaacagggtggaagctctatttgatcttgatgaccatgaccgtgttacgagtgttaacaacttctgtaccatttgtggggggccactaagtgaacatggtgtaacaacgctctgattgggtcttgccagacgttaatgttgacttactactttccgaaatggccccattttatatatttggtaataacaa

SEQ ID NO: 5011 - DNA, 374 bp, Diabrotica virgifera
  Clone ID: LIB149-046-Q1-E1-C4
acgacgtaattttgtgtattcctgtattatcaagtaagagctgatttctgagcgatcgagtgtcgtcttaacttctttgagaatcacttctctaacatctagtcatgtttgtgtaacaacagaacataggtataccgggattcttagataggaatttttacttgatctaatggcatatactggaaattgatgatacatgaatgacaaagcccagtagcgtgctagaattagctcgtagagcgtcatcttcagaaagttacgcggtattgactaattattcgcagagaatccatgcctacatagcttgacttatcgaactatttaattggtccagacaattaatagttagatctagtgcagaacgagcttgcgca

SEQ ID NO: 5012 - DNA, 398 bp, Diabrotica virgifera
  Clone ID: LIB149-046-Q1-E1-C8
atagtactgtagttcaaataagtattgataatttaattcctcagatcaggaaaatggttgtgttagtgatgtagttgtgaacttaacagcagtgaaaaatcaccaggatcctccataggtgtagacaaaatatttaaatatatatttttgtgtagataaaaacatcaacagcatatgtcaactatggattccacagtgagcagttctagtcctcctttagatttaaattcaacacaaaataccgagatagtagaatctgctctagaacatgatccaatattcttacaaactaaattatgtcaaactgtagctgggctgtttgtctgggcagctctatttttgacctgtagtcaaatctatcatcatctcaggtggtatacaaatccctctgaacaacg

SEQ ID NO: 5013 - DNA, 421 bp, Diabrotica virgifera
  unsure (1)..(421): unsure at all n locations
  Clone ID: LIB149-046-Q1-E1-C9
agacatattcagtttataatgaaaaaaaaaaaaaaaaaaattcaattaaatatcgaaatggtataaaaatggtattttgctagcatgcaattgattaacgtgttctttttagcgtccgtaacttcacgcatattatgcttttaaatagacaaatctttcatctttagtaactcggggggtattgatttattttaataacatgatatagagggacagattgtaggtggaatttgttgtttcatgttattaaaataaatcaatactttttgagttgttgaaggtcggagatttgtctgtttaggggcacatgcgtgaagttgcggatgataaaaggaacgtgttaatcggttgtgtgttgctaaagtattgtttttgtattatttcgatattataaatttagcanaagtgtgatcgaatatgt

SEQ ID NO: 5014 - DNA, 325 bp, Diabrotica virgifera
  unsure (1)..(325): unsure at all n locations
  Clone ID: LIB149-046-Q1-E1-D11
atgatcgacattggatggatgtcaatgtcangagtgctcctgcacatcctatattagattcattggcatatctaacgaatagtaggtttgcagtgtctaatatgctcttaacatcatgccattattgtacttatttctttttgtcatccacgttattacattgtgcaaatggtactgaaacgactgtcagttgttttacataattacagtttttttattcattgatcatgcaagatcttttacatttgcaatttgttttaaatgtgtatcaagttgtcaatggttaccatcacttagttaactgtaaaaataaattacaaattta

SEQ ID NO: 5015 - DNA, 404 bp, Diabrotica virgifera
  Clone ID: LIB149-046-Q1-E1-D12
gagaaatactgggaaaatacctgcatcacaactgcgcgacttactacaaaactggggaaaaagcctgtcaccaaaagaagtatataggatttttagagaagctaatgttacagctaatagcatggtgcgatatgaagatttcgtaaagatttcctgtgctccagttccagattagtattagatgacagcattgtcagcatacctatatatttagtctactgggcttaaacgagctgcaataatttttgcttacgagtattcgcacacattacatttttatgaaattaatgtacctacgtaagttgttaaataagagcatagtccttcaatttaatcatcttccattgtgtaaccttggcttttttgatattatacaatctaattaacacttatgaatttactac

SEQ ID NO: 5016 - DNA, 300 bp, Diabrotica virgifera
  Clone ID: LIB149-046-Q1-E1-D4
tgtctttaggttctttgcctacgcccctcgttgtgtttcttcagtatgactttttgggtcactatgatgactacgttggggaattcacagtattacgggcctatttttacctatacatttctgcgcacatgtcaaattcgcatttaatacacgttgcgtatcatttgcctggtatgtagcttatggatgattacttacgatgccttacatgcttactcgcgcatcattggattacagatggttagtactccatattgcgcgaggtttcccttataggtcttccaatctggttgtaccttg

SEQ ID NO: 5017 - DNA, 204 bp, Diabrotica virgifera
  unsure (1)..(204): unsure at all n locations
  Clone ID: LIB149-046-Q1-E1-D6
tctcgtccgcctgtgcgtcctttccgcttcctgttttctcgctctggttcgtgttcctgctgccgtctcttcgtggcgcgctttttctggccgggggctgtttgtctgccgggtcntcgtccccggtcttctctggcccctgcttctcgctccgcttcctggtttctcgcggtctncgtctggggtgttgtgtgtctccgtcct

SEQ ID NO: 5018 - DNA, 387 bp, Diabrotica virgifera
  Clone ID: LIB149-046-Q1-E1-D7
taaaatgagtcagtatatttccgtttgctcaggaaacaaaatacgcattttttttctattttattgattattacacgtcgacagaactatctgaaaccgccaaggtcagatcgaaaactttcgttacgcgacgttgtcagattaatcgaagtttaaaggttttccggtttttatttgttacctgtttcacagtaaaattgataacaattctataacgcttttacatttttattataatctaagtaacagtgtatattggttaaattccttttgtcaattatttcagttaaatacaaataaggagtcttaattgtttattaatgactgtgtgacaggtacttcttttaggacaacagactcagtaaaacaggttaaaataaaataaat

SEQ ID NO: 5019 - DNA, 397 bp, Diabrotica virgifera
  Clone ID: LIB149-046-Q1-E1-D8
acgtcgtactatgttccggcttttttatattgcttatacaacaatttggcctttttgaatttatcctcgtttgatccaactacttagtttttattgctacagttgagggtagttgtaactggtgtgcttttccaggccatctttaaaaagattttaagtaaaagacaatggatttcgttagtgatactaacgtttggctgcatgctaaagcagattaacttgacgcagactacctcgaatacctcgtcaagcaataacaccaaagccgcttcagtttccttaggaatagatgccatattcatatttattcagataatatgctcctgtctagcaggtgtctacaacgaatatctcctaaaagataaaggtgcttctataaatattttcgtgcaaaacg

SEQ ID NO: 5020 - DNA, 336 bp, Diabrotica virgifera
  Clone ID: LIB149-046-Q1-E1-E2
taccggtctacttccgggcgacccacgcgtacgaagccgcggaaaaaattaaatttttattgtaaaataaatattttaaatagggtggttgcactgaagggttaatccttattaaacatagctgagtttttaagacacatcttaaatgtaactaatatccatatcattggccgtcgatatatatagacgagtaagggaaaatactgttatggatgaacttaatcgctaatgcttacatcccccttacgttataaggcgtaattacgattaaggccctttcacgattgaccacacgtcagtagctaatcctaaatggtaatagggatacgccctata

SEQ ID NO: 5021 - DNA, 56 bp, Diabrotica virgifera
  Clone ID: LIB149-046-Q1-E1-E3
acgaaataagtcctaataaaaaaaaaaaaaaaaaaaaaaaaaaaaaaagatgggcg

SEQ ID NO: 5022 - DNA, 376 bp, Diabrotica virgifera
  Clone ID: LIB149-046-Q1-E1-E6
acaagcctctagattgactcatacaatacgagtcttacttcgtagaagtaccggtagatccgtctgaaaggtatacatggatttttgagaaaatagttaagatttttcatgaacctggtgaatctattaataatatcaaggaatatttagatacgtggctactaaatacaatatatatcacacagctcagagatgaagctattgcaagaagggaccagcattcgtctagaaacactagtaatgtatgttgcactatttgtagacgacgttattttacacagtcacaacatccattattaacatgtacttcatatattttactaaacttatatacaactggaaagaccatgggatggttcaagggtgtcactccatt

SEQ ID NO: 5023 - DNA, 372 bp, Diabrotica virgifera
  Clone ID: LIB149-046-Q1-E1-E7
agtaataacaacaatgctagctgctaaagttgtcttgtttttgggccttgcccttttcgtctcagccggtgaagaccttgacaagggttatgaaattgtggaatgtgccaattacgtaatgagagcaggagtacccgaattgggagtaccacaacacgacccctacgtcaaactcagggacctacaatggagtggaaacctcggtgttgccaaagcccatatcgagctccatgataatagatggtatggtcttgccgactgggaaattcaagcttaccaaatcagtgctgacactgacaacgaggctgtctttgactacaccacatcatggtcaaatggatttcaactctctatgaactacaatgcaaccat

SEQ ID NO: 5024 - DNA, 282 bp, Diabrotica virgifera
  Clone ID: LIB149-046-Q1-E1-F11
tgagtcgtactaaatttggcacttttgagctgcgttgctctcaccgtttacgctcaacatgagcctacacttgggcctggtcctcgccctgaacctacccgtggaccggttcctgatgaacttaggtgcgacacttgcgtaactttggcagatataattaagggctacgctgatgagcgtattccactggatgaagttagacatgaagcagagaaattgtgccgtgatttgcccgaacaattgagagaagcttgcgaaagagaattgctaccaaatcttgac

SEQ ID NO: 5025 - DNA, 380 bp, Diabrotica virgifera
  Clone ID: LIB149-046-Q1-E1-F12
attcggtaaaattaactaacgaatttcgtgcaaaaatggaggaaacgatttgtgataaatataatacgagtctagttctttatagatataataataatgctttttatttcgagcaaaatgtaaaaataatccaaatggttacaaaatatttattgaagccttctagaaagcgtcacatgttagttaattggtgtttgtccgagattaacgaaaaaaactcaataagcaaagaaataaatttccaagaattaaaaatacttgtcatacaattctgtactcacctattggcagcaggagttctgaagcagttacctgataaagaagtcccgatgtataatatatttaagcctgacttaatatacttctggacgcacactgaa

SEQ ID NO: 5026 - DNA, 442 bp, Diabrotica virgifera
  Clone ID: LIB149-046-Q1-E1-F4
gtacggtcgtaatctccgccccgacccacgcatacgaccacgcgcccgtgacatttgtattatgtcagaagtttaattactattttatcaaaaaattatattaaacaatattaaaaatgtctctaatattcaggttagctggtcaaagatgtggtagtcaatttttgaaaaataatagtggaataattacctgtgtacgacctgtaacattgaaagcctctaacgtctcaagtccaaaagaggaaggacacgatgaacgtaacatgaaattagggaggccccagtcgccccatttgaccatttatgctccccaactaactagtatgttgtctattactcacagagctacaggtatggcattgtccttttatgcaattgcctttggtcttacagctgctgtagcacccgaatcaatttcttcatatattgagactatcgaatg

SEQ ID NO: 5027 - DNA, 453 bp, Diabrotica virgifera
  Clone ID: LIB149-046-Q1-E1-F6
acaagactctaaaatgagtcgctatattaaaagagctaaaaaattaaaatttttattgtaaaataaatattttaaataatttttttgtaatgaaatgttagtcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataatattagtattaaaaaattgtatatttagtaaaaatatataggtttaataaaggaattcggcaacattttt

SEQ ID NO: 5028 - DNA, 414 bp, Diabrotica virgifera
  Clone ID: LIB149-046-Q1-E1-F8
acaacaatgcttgccgctaaagttgtcttacttttgggccttgcccttttcgtctcagctggtcaagatcttgacaagggcatggaaattgtgaaatgcgcccagcgagcaataagcgtaggagtacctgaattaggagttccatcacataatcccttcgtcgttatcagaaacgtatcatggactggatcaatcggtgttgcaagcacccatatcgaactcaataccaataaatggtatggtcttgccgattgggatatctcagctaagcaaatcaatgacgacgaagatttcgaggctgtctttgactacaccacatactggcccagttttagaatcgtaggcaactacgaagcaaccgttaaagagcttttccttacacagcactacaaaggaacctacaacataaccatg

SEQ ID NO: 5029 - DNA, 436 bp, Diabrotica virgifera
  Clone ID: LIB149-046-Q1-E1-F9
gtccgagtacggatacttgcaatcgtataaaaatcgaattaaattcgggtagtattgccaagaaattgattgaagatccattcttaaaaaaaatttacttgcttatattcccggtgaccttatggaaaaaagtgggttaattagttcagttaataatttctgtaacgagaaggctatcctaaaatttattaattctaatgtacttattaaaaaactaaaaggcatgactagaattatccaacaagataacaatatcgaacgaattcctcgtcaaatgatctttgttacgtttaaataaaaatttattccccaatgtattattaataaagttaaattatatattattttaaagttagatgcccctgtagaaacttaaattaccccaattaagtaatgttttttatacctccggtacggtcattccggctaaaagtgt

SEQ ID NO: 5030 - DNA, 372 bp, Diabrotica virgifera
  unsure (1)..(372): unsure at all n locations
  Clone ID: LIB149-046-Q1-E1-G11
tgagtcgtattatancctgggttctaaaaacaccaacatactttttaagacaatccaaacacataacggacacagtggatagatcaataatattcggaagagacaaatttaggtataggggaacacaactttaatcaaaaggggggggccccccagggttttacccggtcaaattccttgaaccaccattttcgaccctcctagagctgcccccattacgatttttagggcgcgttttttaaactgccttccttgggaaaccccgggtgttacccccttttgcccccggtggacatctcccctttctacattctgggtaacaatcaaaagggccccacccatttcccctccctaaattattcccccccgaaa

SEQ ID NO: 5031 - DNA, 419 bp, Diabrotica virgifera
  Clone ID: LIB149-046-Q1-E1-G12
tacaaccctctaaagtgagtcgcattaattcacgtaaaatgaaatactttgttttgttggtaagcattgtcgccattacagcatccgacttacaaggtacagccgtagaccaatgtttatgcagagacgaactcactcaaatctacaatcaactcgtcgaggctaatgtcgaattgaaggaggccaacgatgaaatgattcagctggactccgatatggaatacatggacaatagggtcgaagcccagaacgaaaatttgggagaactcgaaagtgcacttaccatgcttcgttacatccaactccaaactcgacaagagctttccagtcaagaccagattctcaattgcattgtcgtcactgttcaaaacatcgatgtccaggttaaaaatgacacaacacatgtcaaccagcagaca

SEQ ID NO: 5032 - DNA, 440 bp, Diabrotica virgifera
  Clone ID: LIB149-046-Q1-E1-G2
acgattaatgactaattatatatttattattttcgaatttaaaagagctaaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataatattagtattaaaaaattgtatatttagtaaaaatatataaggtt

SEQ ID NO: 5033 - DNA, 393 bp, Diabrotica virgifera
  Clone ID: LIB149-046-Q1-E1-G4
acttatccaatcattggtatatcaccaaaatgtgatctctcaacaagttgaacaattcattcaacaaggacaacgtcttccccaagacttgctttcccaacaagtattagtctaccaacaagttcgccaattgattaaagttttgagcacccaacaacttaacatgatcaacttcatccaatacctagttgaacaaggtaatcaagttgatcaacaattgtacgctgttcaaagaaatttttaccaacaagtccaaagacttgttcaacaggtagttcttcaacaatctcaaatcaaagaacaaatccaggtacttatccaacaagaacaaactgttccacaagaactagttttattccaacaattggcctaccaacaagttgaacaattcat

SEQ ID NO: 5034 - DNA, 403 bp, Diabrotica virgifera
  Clone ID: LIB149-046-Q1-E1-G5
aacaaaatccaccaaacatgttgcggctttctttcttgtttgtagctctcttgatcttttcaacagtgcttgatgcagctgttctgaaagacgattttgactacatcccggataggccgcaagatccaaaagggccgcaagatccaaaagaggtcacatctagctcttcggtggatcccctaagtcctgaaaatggtgaaattgacattctcgaaggaaatttgacggattttaacggcaccggaaaggatttgtttgtgataaaaacggttgtttatgaaattggaattttgacggatattggaaatgatactaacttcgacaatgaaacccatgaacaaatcgatgtttcatttttcgacccagcccacaacggctccatcatagacctatcccaaatccc

SEQ ID NO: 5035 - DNA, 356 bp, Diabrotica virgifera
  Clone ID: LIB149-046-Q1-E1-G7
ccgcatcgtatgcctgattattatagcaataagtacaatgaggaggaagcgcctccacattccagcggaagtaccggtaaaagaagcaacaagccaaagcgagaagtgattgttcaaagggttgaaagcgagcgcccatcctcaggaagaggggatgaatggcaagatccttggatgagatccaaggatcaaggcagaaggaaagaagcaccaggccgtaagaggtcgtatagtacaggatcgtcgtattcatctagcagttcttctagttcctcggattcgagcagaagttcctatgcgtcacgaagaagggctcggggacgtagatcaagatcgcgcaagggaaagcccgtttc

SEQ ID NO: 5036 - DNA, 408 bp, Diabrotica virgifera
  Clone ID: LIB149-046-Q1-E1-G9
cgtccgattaattatagaattctttctaaattcctattatttgacacacctcgtataaaattaacaaacttggataacttatggttgcatcttgaggtttggaccatgcacagatttttatgaagaataactttttttcataaaattattaataaaagagttattacatgtctaataaataaaaatgatgttcggaatcggtaatttaggaaaatttcagaatttttttttcaagtagaaggctgttatttcatatttgaatatggtttttaaatataaataacttttcataataaaattttttgatattttgaaatataaaggtatgtagtttgctcttgagtgaaattcatattttttgacatacctcgtatactgttgacaaaatttgatatctgatgattgcat

SEQ ID NO: 5037 - DNA, 175 bp, Diabrotica virgifera
  Clone ID: LIB149-046-Q1-E1-H12
cccaatcaaaatataaacaaaatgatttcaaaaaacataaccaattttccatccaaaaaatataacaacgaaaaaaattcaaaatggaaagcaaagataaaaggacgaagcgagcggcaaaggacaaaacagaagaccccaaaaaagcgaaaaaagaagaaaatggtgcaaattc

SEQ ID NO: 5038 - DNA, 150 bp, Diabrotica virgifera
  Clone ID: LIB149-046-Q1-E1-H5
aaaaaaaaaaaaaaaaaaaaaaaaaaaaaaaaaaaaaaaaaaaaaaaaaaaaaaaaaaaaaaaaaaaaaaaaaaaaaatacaaaaaaataaaaggaggccggcccctctatagggtcgtttcttttcttctcatgcatcatccttcttca

SEQ ID NO: 5039 - DNA, 365 bp, Diabrotica virgifera
  Clone ID: LIB149-046-Q1-E1-H9
acccgtccgacacgcgaccgcccacgcgtccgaaaaaaaaaaaaaataaaaaaaataaaaaaaaaaaagtaaagaaaaaaggtcgacgagcctcaagagttacaacctcatttatcctacatggggggtcctcaatcctttcaactaggggcggctgcccagatcgttcgatgttaatttacagcctcaggaaagggcaaacccctcccatattctacccaaacctccattcccggaattccctttttcacctccgggcctggaaaaaccctggctttacccattttaattccctatgcagtacaacccccttttgcaaaatgggatcttcccgagaatgccccacacaatcccccttccgaaaa

SEQ ID NO: 5040 - DNA, 156 bp, Diabrotica virgifera
  unsure (1)..(156): unsure at all n locations
  Clone ID: LIB149-047-Q1-E1-A10
caatggaaagatatangtgtgatatgtcaagtagtggacagataagccaaccactggatgtggttttgagggatttttgcagtggggtttgtanggtgctatgccgcgctgggtttgggatttgaaataaaacgaagggagatgtgccacgctctt

SEQ ID NO: 5041 - DNA, 232 bp, Diabrotica virgifera
  Clone ID: LIB149-047-Q1-E1-A9
acacatcggaccacgcttcagatcacacctcagtgtgcgtgtcatccaacgtacggcgagctgatctgactcttaccctgttttatgaaggggggtgccctgcttgtcatgaatttattctaacacaactataaccttcatacgctaagttaacatgtagcttaaaattggcacttctgccctttggatggagatgaatcttcacgtggcgcaaatggcagaatatcattta

SEQ ID NO: 5042 - DNA, 318 bp, Diabrotica virgifera
  unsure (1)..(318): unsure at all n locations
  Clone ID: LIB149-047-Q1-E1-B12
gatgcagagtatggctacaaaggggccaagctttccagtgaagatggtaagtatggtggaaacagtggtcgaaattatagtaagattctaagtggccaggatatgcttgagagcctttctactgctacgagtttggacttgttaagtgatgctggagaggtggttctgagtanggaattgaaaaggtgtccaacttttagcaacctgaagaccctgtcccttggtgaatggtgtatggccgctgattttgatgcattaattttcctgctacagcattcacctaatataaagaggctttttctccaacttaaattgaac

SEQ ID NO: 5043 - DNA, 394 bp, Diabrotica virgifera
  unsure (1)..(394): unsure at all n locations
  Clone ID: LIB149-047-Q1-E1-B4
actactcttgggccttgcccttttcgtctcagccggtgaagatcttggcaagggttatgaaattgtggaatgtgccatgtaggtgttgaaatcaggaatacccgaatggggataacaaaaaaacaactactacgtcgtactcgnggacccacagaggactggtaacgtcggtgttgccaaagcccatctcgatctccatgactataaatggtatggtcttgccgaccgggaaattcaagcataccgattcagtgctgacactgacaactaggctgtctctgactacaacacatcatggtcaaaaggatatcaactcactatgaactacattgcaaccattaatgaacatttcatttcacagtactactcatgaagcatcaggataaccatgaaa

SEQ ID NO: 5044 - DNA, 406 bp, Diabrotica virgifera
  Clone ID: LIB149-047-Q1-E1-B7
acccacgcgtccgcttcagaccatcgcgagaaagtaaaaaagttcgttctagtgaaaaagttcaggccttttcgacgttatgtagtttgtaaacgtacaaatttcaaattgacaaatggccctaaacgactttgttaacacgactataaaatgtctcactctgccggctgctatcatcactgggattcaagcagcaatatggttcacgttatcattattagcaatattttgctataataatatcattggaagatcggattcattagaaaaaacaagctatggatatatcatttatacgtattatctacaacccactgatgaaatacaagaacagtatattgtacatcctaaagcacttaacatatttatgtacgtctatttggtgctcagcttcatatggttggtg

SEQ ID NO: 5045 - DNA, 313 bp, Diabrotica virgifera
  Clone ID: LIB149-047-Q1-E1-C1
atttaaaaatgtacactaagtttactgttgttgcccttttattgtgtgttgctttaaatgaagtacatagcggagttatactcggcaaaggattaggtagaagttttacagcatgtcctgatccccttaacccaggaatattggtatccgacaacgacatttcaggaggtctcttcgaatctatcaacttaagaattccagaaataggattgttagaaacgcctatttcatgcatattgatcgttgataaaaagaagagttcaactgacccaattgttagtgcaagaggtgtaggtttcccatatgttgaaat

SEQ ID NO: 5046 - DNA, 396 bp, Diabrotica virgifera
  Clone ID: LIB149-047-Q1-E1-C11
gggtcggccagaaatattgatcagtggatgactccatgatatctactccagcttcgtcttcataatcatcatcactatcggggttggagtcggtgtcgtcaattatgatgttgtctttaggatggatgtcctcctcgggttcgggatctcccatgaatattcctagcttcttcttctggtcttcactcttctccacccgtactgctatttcctcttcatatccatcgcatgtagacttgagttcctctcctagctccatgttcctggtcatcactttcttcatgtctatcttgctggcatacatctggttctcctgacgaggaatgtgctgatttaactcctggatgtaggttgcaatggatctaaccttcctggtgcaaatcatctcccaatgtt

SEQ ID NO: 5047 - DNA, 385 bp, Diabrotica virgifera
  Clone ID: LIB149-047-Q1-E1-C3
tataacctcacactttggacgagtgacacgcaaggcgaagctgatgagcctcaagaagctggtgataattaaaagtgtggagcgtcattttttaggggaggattcgttaataatgaaatttcatgtgagttgacgtattcgtggaacttggttgtgaagtttcattgacagttttaagtttcatcctgctgaaacttcgatatttaaaatgttttatgagatatgtaaatcgttaaatttagatttcacattatcacacaaccgtcatacttttcgcaacaagtaatttaagccataaaaaccaaatgtagtcatatagtttagtgatcgaaacaatatgattacatatattcatttctgtgattgttgtgtgattcaatgtcaa

SEQ ID NO: 5048 - DNA, 399 bp, Diabrotica virgifera
  Clone ID: LIB149-047-Q1-E1-C4
agatgaaacaatttttagtgcttttggctttggcttgtgccgttgtggcaatgccatcaattgagtatcttaattcaaatgaatttgcacaacagtttgaaacggaggagcaactaagagattttataggcgatattatcaacagcactctaaatggggccatttctaagatgtctgatcccatgacaattgctgatatacacatggaccagaactctgaggctctagccggaaccattgatattaaagacattgctatctctggtatacataagatagtatccactgccgtatcaaccaatctcatcacgcaacaactgaacatatcagttttggttcctgatcttactatcaacttcggagctgccgtcaacgtagtggttctggagcctggtacac

SEQ ID NO: 5049 - DNA, 166 bp, Diabrotica virgifera
  Clone ID: LIB149-047-Q1-E1-C5
cccacgcaaccaaacacacgtcctactaactcgtgctcggacaccttggccgacacctcggttttgttgttctttatgaaccatccaaatcaaaccagtttgccccttcccacccagccaggtttcccttaattccttttcaccaagggtctattggaaaacctta

SEQ ID NO: 5050 - DNA, 67 bp, Diabrotica virgifera; identical to SEQ ID NO: 3929
  Clone ID: LIB149-047-Q1-E1-C7

SEQ ID NO: 5051 - DNA, 347 bp, Diabrotica virgifera
  Clone ID: LIB149-047-Q1-E1-D11
cgggtcgagccgtacgtatagatcagtacattctgttcttcgtactaaagagtgtgtgtgtgtgtgtgtgtatgtatgtatcaaatgttcagagtcgagcagtaaacattttgcaccttgcttgtccatgcaaagtgtcggtggtacgcaggctcaagggaagggaagggaagggaccaaatcaattagagaaaaggggacgggacgggaccaaataattgtaatcgccagatgctcgcactgttgtgccctgccgcccctgctccaacttgccttgctgctgctgttttccctgtaccgtacccgccaattccctctcagacatttggcggtacagattgacagat

SEQ ID NO: 5052 - DNA, 353 bp, Diabrotica virgifera
  Clone ID: LIB149-047-Q1-E1-D12
aacgagagcaaatggcccctgcagaagaacggagtcttcaacctgctcctttctttcaccgtggagagcaacgtgtcaacgaagtccattactttcgacgacgagccagctgctacacgggtgagcaccgtcccgacggtgctgcgcggcggcctatacctcttctttgtctcggccatgatcctcatgttgagtttcaaagtagggtcctgcatctacagcaggtaagttaagagcctgcccttggggccgttcttattttggtttagcggaactatacatggcgccccctcgacgacggcgtgggagcaaacgactcggaagacagttttacatttacgcacttagtttgt

SEQ ID NO: 5053 - DNA, 411 bp, Diabrotica virgifera
  Clone ID: LIB149-047-Q1-E1-D4
taagcagaatcttaagtagctgttgaaatactggccctaagtaacggtatctttctttttataaatattttctctatacaaaggcatatcttttcagaacttttaattcgattaaaatttgttctttctgaaccaaaaattaaatatgtatgtagtattttatttcttccgagcattcacggataagtaagtacattgatgactttattcagtaataattacaacacaattgtctaaaaatagattattgtcattatatttactttggtcttttacgattttagcgtacagtgtatttttcagagaaataaaatttcagtttattattaatgtaaatcgtaaaaaataattttaatcaatttaactcctacataacaacaaaaataatgtctgaatccttttattattcat

SEQ ID NO: 5054 - DNA, 415 bp, Diabrotica virgifera
  Clone ID: LIB149-047-Q1-E1-D7
acaacacccaatagtgagtcgtattataatgaatactttattggtagcttcagtcttctgcgccatcttcgccatcggcctgaccgtacctgttctgacaggtccaggtccagcgttcgaagttaccgatggagaatgtgagaatgtctcaagagacgaattggtccgccaagagcaagtaaataagggtggttttccatttgttaccaaacaggctgatgttgaatacttaggagatccttcaaaagttatttactgcgttcaagctctcagctctgatgacccaagcgttgaatctgttgctgaaattacagttggtggagttggtcacgatttcgtaaatgtacatttgacatctaagaaaggaggacccctacattacgatgttgaaatttacgccagggccccaaataat

SEQ ID NO: 5055 - DNA, 351 bp, Diabrotica virgifera
  Clone ID: LIB149-047-Q1-E1-E11
ggacgagataccgcgcccaagtctagggttccccctttcttcttctccacgcgaatcagatactagcaccagcatcgatggcggcggcagcgccggcggacgcgaaggcggaggccgccaagatggacctcctcgaggacgacgacgagttcgaggagttcgagatcgaccaagaatgggatgacaaggaagatggcaacgaagctgtccagcaatgggaggatgactgggatgatgacgacgtgaacgatgatttctcactgcagctgaggaaagagctggagggaggcaacactcagaagagctgaactatttccccatccatatcaaagctgtagtaaactttatcct

SEQ ID NO: 5056 - DNA, 261 bp, Diabrotica virgifera
  Clone ID: LIB149-047-Q1-E1-E12
agcgtgtcatgcaagaatggtggggtgatctcggatatcgagttcccacatgtcggtggcaggcaaaagaggggcaatgtgcaccgatagttcagactcaaggcaaaacaagtgtgcatctcatacagcatgcattcattcgttcacgggcgtcgtctcgaggttataccttcaaagcatacaaacggaacgattctcgttcggtgccaagtagaggaagtatacgttctcgggacattgtggaagtagggggtacacgac

SEQ ID NO: 5057 - DNA, 109 bp, Diabrotica virgifera
  Clone ID: LIB149-047-Q1-E1-E2
ctctatagagagtcgtattaataaaaaaaaaaaaagaaaaaaaaacaaaagaattgtacactaaaagactaaaaacttaggtaagcataatcttggcggtcatcactac

SEQ ID NO: 5058 - DNA, 380 bp, Diabrotica virgifera
  Clone ID: LIB149-047-Q1-E1-E3
attatgacgctggtcctttgggctggtgtcagttatgcaaaagatgtcaaaaatgacctgagtgacggtattttatttaattctgcagatgataaggtagtgtttccatcattaatagacccaaagccaacagaaataccaccaccacctcctatcaatctaccaggtccaccagagcctccaagtgacgtaccggaggccctatataacaaacgtcccatacctccaccaagcaaacgacctacaccaccaggtcctccaccaagcggacgtcctaaaccgccaggtcctccaccaagcaaaagtcctagaccaccaggtcctccatcaagcagacgtccaagaccaacaggccctccaccaagcagacgccctagacc

SEQ ID NO: 5059 - DNA, 304 bp, Diabrotica virgifera
  Clone ID: LIB149-047-Q1-E1-E9
actctagagtgattcgtattatgcctgctcacgtgttcatggattgcaggctcttgcacttcgatatcgcacataccccattggttaaggggccaaatctatcaacgttgggattaggactaagcacctctaaagcagtgaccgtgccattcaacggtggcagcaatatctattggagttcagagagtaggagggcgcataggattgtaagattactaggcaaccagatttcgctacgaatgtcgctcgaaccataagttccattgacattagtcatttacagtgggatcggtcacttcgactt

SEQ ID NO: 5060 - DNA, 313 bp, Diabrotica virgifera
  unsure (1)..(313): unsure at all n locations
  Clone ID: LIB149-047-Q1-E1-F10
aggggatctaatcatttggtatgttgagcagcagaatgcccaaggcgcatatagttctacagaagaggtgaaggangaagtaaagtgcatcaaggccattatagagaggctgatacagagggaatgccatcttgtagtcatagatgaaggaacagcggcagcagaaggtgctacggcaagggcatcggagcacagaatcctggctgttaacccaaactacgtcattgattgattaaccagctgaggtcacacagctaactagatccatcatatgtggttgaccaatatagcagacattcaaacggaagacatc

SEQ ID NO: 5061 - DNA, 381 bp, Diabrotica virgifera
  Clone ID: LIB149-047-Q1-E1-F11
cgggtcgaccgggctgcagattgaagaaggctccatgccgcacctccgaaggcttctcattgacttccagtcatcggaggatgatacagatcactttgtgcttggtatccagcatttctcttgtctcgtgcaggtccgtgccaccatctactgtgagcctacttcaacaacagtcgtttctgccgcagagacccacatcagagatcaagtgtctcagaaccccaacaatcccctactggaattcaacagaaaacgtcgaggccgtttggtgaggcgtctaaggccgctctctaatgtgaaggagcagccatcggcggtgattaagatccgcagcctggatgactggactatgatgatctagcacaaggggaagaaactgct

SEQ ID NO: 5062 - DNA, 380 bp, Diabrotica virgifera
  Clone ID: LIB149-047-Q1-E1-F2
acaaaaagtcataataattacctacagtgaaaatctccgataactacatttttgtacattggacataaaataatttcggggtacagcagaatttgcccaatttgacagtgggtaggaacatttagaaaaataataatgtcatcatgctcgaaacccaaaaacccattcctcggtaatggaaataattgacaaatatctctacaatctatactaaatttgcaatcagggtgcagtggaggtaaacgagccaagacacgttaaagtgctccctgtaaatattctctttactctgtcactggataaaaaagaaaatttttgactgtttggtatctttcttgtcggatagtaaaatattattgtaattagttttaggtaattgt

SEQ ID NO: 5063 - DNA, 368 bp, Diabrotica virgifera
  Clone ID: LIB149-047-Q1-E1-F9
cgggtcggccggacaccacaggtcacttactctcccaaggcaaagggagacgatgaggtgctctcccaaaggaccttcccaggccagggagaggtttaggaacccgccatggcggtgccggagggcgacacctcggccgccgggcacatgggggaacagtcccccatggagattaccgacgggggtcgtgctcaattcggcccccatatgagcacggatctggagacccatacggccccgaagcccgacaagcagcttccttcaagagaagggggcgtgcccgtcccttcggcgacctctgtccaactagaggcgccggacaatctattggaagcgctacgaggcgcttccattgtggaagaacaccg

SEQ ID NO: 5064 - DNA, 369 bp, Diabrotica virgifera
  Clone ID: LIB149-047-Q1-E1-G10
aattggcctcattgtcgcatgtagctctggatcacagagccgaggacagatcctcgcacgggcaactgccgtccaaggagagattccttttttttgtgtctttattccctgttttaattcggcacctaggccatcgctggacgctagtagtatttttgctatggaaggcctagaccaaaatactaatgcgatggactcctagtattttgcacgatagcctagatttgatcggtggattgtagtaattcaagtactactacttcacgtatggatcagaaactagtctcttcttggtactagcttgtactagttggtacagaccgcttccttttatatgcttcggtctactatggtcatcgcttgttaaac

SEQ ID NO: 5065 - DNA, 315 bp, Diabrotica virgifera
  unsure (1)..(315): unsure at all n locations
  Clone ID: LIB149-047-Q1-E1-G11
agccgccaaggaaacacggacggttgctgccgctggttcgtatctcccacacgtgtctcctcgatgtanagcattgtttcacacttttcgatccactcgcatctattcaacgtggcaagtaaaccctgttggcaattaaagtggcatatcgatcgacgcgactcgtttgaacgtagcaaatccgaagcgcgaccggtgccactccccttcccttcccctttccctatttaaaccaccacccctccacctattctccacacatccatttgcgccgcccccttctcttcttcacccaaacccagagcactctcaaag

SEQ ID NO: 5066 - DNA, 288 bp, Diabrotica virgifera
  Clone ID: LIB149-047-Q1-E1-G12
cgtattatgttcataatcgtgcacaagcacaatggctcccactccaagggccgtcaaacttaggaggtcattgagttttgtattgactttattcctgaccttaggggatggaaaaggcacgctaggaggggaacaaataatatgtatggacggacattctctcactgaagcacactacacagttctacagaattccgccttggtggctccgtatatggatgaacactagaatttgctacgctccaaacacccagaacggtctgatgactggattgcacgtgaacaaac

SEQ ID NO: 5067 - DNA, 409 bp, Diabrotica virgifera
  unsure (1)..(409): unsure at all n locations
  Clone ID: LIB149-047-Q1-E1-G2
agataaatttaagagaaatattacaaaagatcttttttgttcgcaatggtccaaacagcctaaagtggtgtntgcccgggccaaaaattgatttttataatttgttaattttttttaaacaaataaataatcataaaaaaatcagtatttcttggggacttcagggcgcaaagggtatacagtgtgttccatttgaaatgagagggttcattggatttccagaggaacggaaaatatgacaacgatgtgatttgcactataatattggccgcattggaaaacccctacctaccaaaaaatataagaatcgtccaagccgttttcgagataattgagtgtttccatacatagaactcactctgcatacataaatgtatatttatttattaataataactaatacacgaac

SEQ ID NO: 5068 - DNA, 398 bp, Diabrotica virgifera
  unsure (1)..(398): unsure at all n locations
  Clone ID: LIB149-047-Q1-E1-G5
acccacgcgtccgcttttatatccaggacatcctttgggtttccatattcttgtcaggcaagctttttaagaaaaggcattcctgaggattcgatcccaactattacaacaaatcactaaatctgtatgatacagttttcaagagatggcgacggtttagtataaaatagtaaccattttgcttatgaattatcaaattttaattttattaaatctatcgtagaacaggattataattatagctcgtataaacattcacagtgctgcattggcgttgatagaagatatcctagaatattataaaaacatttttaaattttttttttacaaatgtatatataacctcaaaccttaattgcccaaatattaattaacttgggaacctctnacagtattac

SEQ ID NO: 5069 - DNA, 319 bp, Diabrotica virgifera
  Clone ID: LIB149-047-Q1-E1-G7
gacccacgcatccagtaaaaatcaaaaaaaaaaaaaaaaaaaaaaaaaaaaaaaaaaaaaaaaaaaaaaaaaaaaataaaaaagataaaaaaattttgaaaacctataagtttcaacacttgttcgggaatacaatcaaatttggttcttttccaagggtttcaactttaattattcctttgggggaattttttgccttttctaaacttccgtctattttttatttatcggcctttctttttttactttttatctgggtttccccgggttttttgccaatttaaccgctttcacaaattcccctttttaactattgggc

SEQ ID NO: 5070 - DNA, 408 bp, Diabrotica virgifera
  Clone ID: LIB149-047-Q1-E1-H3
aattttgtttattttgaagtctatttcaagatgagggttgtgtctgcaattgtggtattcctctgcgtcgtccttttgataattcaaactatatccgcggcacctgcgcccattcctgggggtggcggtggcggaggctgtggtggcggtggcgggggtggcagtggtggtggcggtggcggcggcggctgtggcggtggaggtggcggtggccgctaacgtataattaaaatacctaattttacatgtggaaactataaaattgtatattttatctatctttattgtatattgtaaaattgtatagttattgtatattgtaaaatgttttgcaattagagtatttattcctattttttgatattatgaataatactctattacagtagtacctatgtgataaattta

SEQ ID NO: 5071 - DNA, 385 bp, Diabrotica virgifera
  unsure (1)..(385): unsure at all n locations
  Clone ID: LIB149-047-Q1-E1-H6
cacgcgtccagaaaataggtgttaaaggtatanattttgcaaaaactctcattaaaaatggtttttaaagtatcccttttgtgtacactgctggtgttagttgcttattcgagtgcatacgattacagcaattgtcctggaaataccaacagacaaaaaaatctgatatacagctctttactgccaccaggatatagcgtgaaaactcgtatcccagcaactggatattaccaaagacctatcacctgcttactgctaatcgatcaaaaaggaagcgccagctcaccaaaaattatagaaggtggatatctcgacacttttgctgtaatacgtatcacttcatcacgctttgtagcagatcctcaaatgactgttccagaatcaa

SEQ ID NO: 5072 - DNA, 376 bp, Diabrotica virgifera
  Clone ID: LIB149-047-Q1-E1-H9
gggatgacacggaaggcgggcataagggaagataacatctctccttcgctgaatccagattccaccaagtcccagactgggtctatttgagtactcgttctggcggttcaaataaaattagtctctaagcaactccacactgggatcctcttgaaggtacacctcacagaaacttggaaattgcatatgtttgacacggaattgggtccgatgtcttgaggatgaagattaaaaaggtgcagagcatcccagaagaatttagagccaagcggtgagaagccccgtttcatatgatcagtaaagacaatgacttcttcctcttttggctgaggtttctcctcttccggcttatgggcgcggtaatacatgacaattt

SEQ ID NO: 5073 - DNA, 374 bp, Diabrotica virgifera
  Clone ID: LIB149-048-Q1-E1-A12
acaagactctacactgagtcgtataaaacaataaaaacttggatgacgtcataagcacaatggaagatataactgggatcgctcataggaggacatataaagaagaaatgttaaggaaactgaaaaatattaaggatgcgagaagagaaatattaatcaaggtaactaatagagaagcatttgaaaaatttattaaagaaattaagaattctcaaccatcagcgtatgatagttatggaggtggagcatcaattattccagttactagtagaaaagatgatttaactatatttaacgaaatagcataacacatagaagacaaacaattaaattttggattaacagaacataacagaacgttaatggaagacatt

SEQ ID NO: 5074 - DNA, 391 bp, Diabrotica virgifera
  Clone ID: LIB149-048-Q1-E1-A3
gatatgcccactaactattgcttcgatggacactctggtagcttaagagatgttgtcagcatagccacaaaagattatatgtgtatcatatctctgtggatattgtgcaccgcgtatatgaaggaatatcaatttcaaattagaaattttattacatttccagtttacaagaactttaatatttgaattcatattgcatgatgtacattacacatctatttcttgaaaggacatattattcgttatataatgtatctacttttttaagaattaaatttgctttatttaacatcattatagttacaattatctaatctgagatcactaacaatgtttctttttaagagatagcttattacatgaattttattaaaatttaatttttacgttt

SEQ ID NO: 5075 - DNA, 418 bp, Diabrotica virgifera
  Clone ID: LIB149-048-Q1-E1-A5
agttcataccatcttcctttcatcagtttttatggttttcatgctcctactccacttagtgttcacatcgactttttagttctctccaccatgcattatcctttcaaaaagtattacctcataaaatactcctagatattacatccaattaatagcagcagttcaatttttgtcaaatctttttggaaattactcagttccattttgcaatagatccttgcaccatagcatgcttaattcttagaattttgggcctaactgatcgtttaatattttaaagtcattagtgtataatccttgttatggtatctggttttacctttagtttatttatgcttacgtttattaaatgtagacggctcacaaatcgagtatcacaatgaactagattttgaatagtttacattcagttttgttt

SEQ ID NO: 5076 - DNA, 169 bp, Diabrotica virgifera
  Clone ID: LIB149-048-Q1-E1-A9
aaacaatacctgtgctatcattgtaaattctactaactatacaattaatttaataatagtggtgacccgccatgaaaatgaaattaattgtatagttagtagaatttaggttaccgtttttcttttaatataaaagctagactctattgagcctaggaagtatttgaat

SEQ ID NO: 5077 - DNA, 398 bp, Diabrotica virgifera
  Clone ID: LIB149-048-Q1-E1-B1
cccacgcaaccgttgacatactctaatttagcaaaacttacaaaatcatttaaagtttcttatttaccatatgtacaaaaccccatcaaggctttaaaacatctggatgttacagttactgaagttcctctagacaagtttggtaaaaacttcgaaattccagagactgatatacttattgttaaccttaacgatgctaaggattctgaaagccgaacagatatgttgaaaaggcatgatgctgctatatctaaaatttacgaagatcttgcaaacactaacgacaatgtattgggaatgtacactgctcaccacacatcgtgggttgtatctgaagaagttattaaatctagacaagcaagatcattaatggtggcagaaaatgctgaagctgctaa

SEQ ID NO: 5078 - DNA, 422 bp, Diabrotica virgifera
  Clone ID: LIB149-048-Q1-E1-B12
acaacaccctacagtgacgtcgtattaacgcgtgggtaatgctgatgctcaaaacgacgccgcacaaggtactgccaacgaagccaacgcagaaaataatgccaatgcagatgcccaaaatgatgctgcacaagctaatgaaaatggagctgccgcagaaaacaacggtaatgccgatgctgcccaaggtaccgacaatgaagctgctgcagaaaacagtggcaacgagaatggaacaggcgcggaaaataatgctaatgcagatgcccaaaccgacgccgcacaaggcagcaccaatgaagccaaggcagaaaataatgccaatgcagatgtccaaaatgatgctgcacaagctaatgaaaatggagctgctgcagaaaatagcggtaatgctgatgctgcccaaggtaccgataatggag

SEQ ID NO: 5079 - DNA, 350 bp, Diabrotica virgifera
  Clone ID: LIB149-048-Q1-E1-B5
acaagcctctatactgacgtcgtactacacagtcatcaataaagatgacgtggaagtattcaaagaagctaaagcacttcatccggttgacggtataactttgttagaaacattttccgatttgttttacgccaaacataaagtatctggaggatggaaagttgctgaaaaatatgattacttttataatccaaatataaactacgtgtatattgaattgatggttaatgatgctaatggagaaaggagggttatgatatttaactaaaaaaataaactgttttaatagttaacaattattgttaactcttagttttaatttcgtctttccacataaataaaaataattc

SEQ ID NO: 5080 - DNA, 229 bp, Diabrotica virgifera
  Clone ID: LIB149-048-Q1-E1-B8
aaccacgcgtccgcgccagctcaccaaaaattatagaaggtggatatctcgacacttttgctgtagtaaatatcacttccacaactgcgcaaccagttagttactatgcaatagtatttattgattagcctattgattagcctttagtagtatttagatatatttatgcactactattatttatttaaatgatatattttcgttgataaaataaaaaaattataatatt

SEQ ID NO: 5081 - DNA, 408 bp, Diabrotica virgifera
  Clone ID: LIB149-048-Q1-E1-C1
gggatggtacaatatttacaaagctcaatcaggtcgttgcctacgcagatgatatagacataatcagctggacattaaacgacctagaaaaaacttatacatattttaaagaagccgcacagactatgggtctagaagttaatgtctcaaagacaaagtacatgataacaactcgggaaaaggtacaaacgaaaggcaacatatctctgagcgggcaaatatttgaaagagtggaccgtttcaaatatttaggatcaacaataacagaaggaaataaaaacagtgatgaggtaacagcaagaatttcgcttggaaacaaatgcttctacagcctacaaaatatcataaagtcaaaatcagtatctattaatttaaaagtaaaaatatacacaacagttatgagaactg

SEQ ID NO: 5082 - DNA, 366 bp, Diabrotica virgifera
  Clone ID: LIB149-048-Q1-E1-C2
aacagactaactctaacgcgtgggcgggcgctgtgggtgacgcgagggattgccgacgattccgtaaattctgctgatctagatttaatcgtcaacaaaaaatcattgtgtccagattgtatcattattatcaatatataggtctaccctgcgaattccacagtatttattgcacctgtatacttaaaccatgtgcctttggggtaagcatcgggtctcgcgtgtacagggataaggttcattagctgcggtcatatgacagttgaatggtagcgtaatcatgtacattcatgattcaatgctggtacgtcgggttggatgagtatcgaactggccgtatgtactttagactcaagttaagcttta

SEQ ID NO: 5083 - DNA, 422 bp, Diabrotica virgifera
  Clone ID: LIB149-048-Q1-E1-C5
acccacgcgtccggttatgtggaagtaatgtatatctagaaaggaacttacaataattagtcagctgtacacaaacaataattagcttatgcttatgcgattagaaaattctttacctattattaatttttaaattatacaacttgtatggtattagttcctgaaaatttaatagaggcaaagaccagtaaattacatttgacaacagtgcgctacacgtcatttatgtcaatattgtcatgtcaatacagggcagtatttattatggtagagaagtttattttgttagacgtcaaaattatgtgattttctaagttattttctataaattgttaatataacttaaaacctttaagttattacaacaacatggcttctagaagtttaacagacgtgtttttattaatgcggaataatgcaat

SEQ ID NO: 5084 - DNA, 430 bp, Diabrotica virgifera
  Clone ID: LIB149-048-Q1-E1-C6
aaagcagttgttttatttctacgtttagaatagttcctgcgttctctttcagggttcatttgataatgtaagaaaatgctttggcttggttcttttcagaaccagccaaagtctctagaagcagcgttttatttttaggtacaattattaatgtaagaaacgacactgagttcttgttagaactcagtgtcccctttgcacaggcctttatcaaggcctggtgcattttccttcccattgccttagccctggagggctgaggcgtagcagatgacctgcgattccgtccatactttgaaaatggacgaggatacggataggccgggggtgaattgagtagctccttgtatggaataagttagagacccagacttttgcctaacttattccccctatccgtaacatggcgcccgactcgtggaggaaccct

SEQ ID NO: 5085 - DNA, 355 bp, Diabrotica virgifera
  Clone ID: LIB149-048-Q1-E1-D3
aaacacacttctgctaacgcgtccgcccacgcgtccggttttttacaatatgtgtcaaccaaagatttttggcggcttctcagcgaaaaccttcataaccataaaaattgccttggtcaaactatagaccttctatcacagagccaaatactaactcatatcgtccatggtccataccagaattcttatccttcgcgaacatcgtctctataagacagcatcactcgtttaaatcaggtatatcacctctgactcttaggcaacatcaagacgatcggattttatcactggtagaccctcataatctaccaatgacccatggagaacaacatgactataggatagcaccactggt

SEQ ID NO: 5086 - DNA, 427 bp, Diabrotica virgifera
  Clone ID: LIB149-048-Q1-E1-D5
gacgatgaatgcaaataggtgaaatctattttgcatgtaaaaaaggtatttgcatgcaagggcggatccaggacagattttcgggaggggccatgaacttttttttgagaggggtaccggagggtctggggaaaatttttaaaaatgagggttgtaatagtgagttttaaggcacttttcacagacttttgagtgccataaagacattccaaacttatagttattaaagtattattaaagtcaggacacatttcttcggatctaagttctttcaacaagtttaatactatttttccagtgcttcacctgtcaggccttgttcttcccctctttctgattttcactaattatttttatgttctcataagcgtcaatgaacttgacaaagtcttcacgaatgttgttaatgtgtatgtatctcacattt

SEQ ID NO: 5087 - DNA, 370 bp, Diabrotica virgifera
  Clone ID: LIB149-048-Q1-E1-E11
ctcgcgggtcgacacacgcctctatactgactctgtctaaaatttttactcacttcgcgatgtgaacaaagtgaattacccacgtcgcggagtgagcattttattcggacattggccgaagcgaaatacccagaacgcgttgtgaataaacgaaagtactcaattgccgaaataaacacgttcaacggagattgagcaaaaccataatacccataacccgacgtgggtaatatattttacacacgtcgggttgtatgtatttgaaatttgcgcaaactccgaaaagcttccaaacacaaacataccctacgttaatttcataataacaagtaaaataaaatcaaattttccttgaaattcaatttatttt

SEQ ID NO: 5088 - DNA, 389 bp, Diabrotica virgifera
  Clone ID: LIB149-048-Q1-E1-E2
accacgcgtccgaaaatatgaagactgaaaaccacaagcaaatgcattcggccagtaaacttgtcaattataatggtggaaaattaattgattttaaagaaactaaaaattaatttttggtacctggggtaccagggataataattcaaaattaattgattaataatttccgaatttaaatcaccaaataacttaaaattttaatgggaaagtaattaattttaagttaattttttggtaaggaaaggtaatcctttttaaacaaaaccaaatttttaaagaattaaattaagttaattaataacgatggaattaatcactgaataagttcaaaataatgataattgataattttaaggaagtacctgataagcaaacttttataaaat

SEQ ID NO: 5089 - DNA, 401 bp, Diabrotica virgifera
  Clone ID: LIB149-048-Q1-E1-E3
tctagttcttctttccctagtaacccttagtgtagctgcctactacccaagtactggtaggcaggtgacagtaggagtaactggaaatgtgaaactagtcggctctcaaggttcccagattgacattcgtagaagtccttacaacccaagaactgtcgacgtcaccctcagaagtccaaatgctccaaccagaactctgcaaattgatgaagccaggaacggccaacaacttggttattccaacctccaaggtgtcaacaaccaaggtgtcaaccaggctgatgttcttgctgatcttttcagtcaatatgagggtattgtagatgaccagaccttctacagtttgttgaacaaacttcaacatttggtacaagctggagtcatcaacagagtagtcctgg

SEQ ID NO: 5090 - DNA, 389 bp, Diabrotica virgifera
  Clone ID: LIB149-048-Q1-E1-E5
taaagaccagcgtcagcaatgaaatacttttacttgacatacgtcttgatcacttacttctactatataaatgccgaagagtctccaagtctagcagctcttgcaccaaaatgtgaatgcggggacatcattgacaagattctgtgccaattgacagaaaactctaaagaaattctcacactccaggtaaaactagtgtcaattacagtagaatcaacagaacttcagaacaacgtacctgagaacacgtgtctggttaactcgatcgaagcagacgtcacagtcattgacaagcaacagaagcacactgtgaccgttgtcaataaccatacagctatcatcgtcgacattgagacagtcctagaagtcatcatcgaggaacaaaatgt

SEQ ID NO: 5091 - DNA, 402 bp, Diabrotica virgifera
  Clone ID: LIB149-048-Q1-E1-F12
ggtcgatacacgactctagagtgagtcgtgtgactttttttatcacgggttattttttcgtgtgttgcgctcatcgacaaaccacaagaatgaaacttatcgtaggattattattaatagccacagctctggcatacccagtagcggaaaatgaagaaaaactagcccaaccagtaattgcacaagacgcgaagccagcagagcaagaactaccactaccagaccaacttcttcccacatcagaaaaacttcttccccaaaaacaagaaccattacctgccagcagcgattcctcatcagaatcttcctctgagagcagcgatgagtctggagaaaagaaatcatcctccgagtcctcctcgagcgagaaagaatccagcgaagtaaaaatccaagaaaaga

SEQ ID NO: 5092 - DNA, 398 bp, Diabrotica virgifera
  Clone ID: LIB149-048-Q1-E1-F2
tattaaatcaaaagtctttatgtccgatatggcagatttttattataaatcatggatgcaggttatgcagccagctgaatttagattgtattgcacctggcatgttgacaaggcatggagaaaaaatttagaaaaagtgctcaataaggaaaaaaaagttcaggtgtatcatatgctcaggacattattgcaagaaactgattccactgcttttaatcaattattattgaattttctgaaatatctgaaggaagattcagataccctggaatttgcgatgtatttcgagcagtattatgcatgtaaagcagagcagtgggcatactgttttaagttgcattgtggcctaaatactaatatgcatattgaaagaatgcaccgaacgaataaacacattt

SEQ ID NO: 5093 - DNA, 423 bp, Diabrotica virgifera
  Clone ID: LIB149-048-Q1-E1-F7
gatgagggcatccaaggcgatttcttcgttaaaggagttaacggtctaaacaatgctacttggtggaatggaaatgggaatggccaccaaatcgattttacaaatccaaaagctgctgagtggtacacagatagactaaaaaaattacaaaccaatcctggaattgatagttttaaatttgacgcaggtgaagcagactacgctgaacagccagctgttttcccctacgtatcacgagccgaacaaaatctcttgccaaatttactcaccactgaatacataaaaacttgtgctaattttggagatttgattgaagttagatcagcatttagaaatcaaaattcttccaattttgtgcggatgttggacaaggatagcagatgggacatgcagaatggtttaccaacgttggttaccactttg

SEQ ID NO: 5094 - DNA, 378 bp, Diabrotica virgifera
  Clone ID: LIB149-048-Q1-E1-F9
agaatacctagaggtaactgcaaagtataaaaatgaagcaaatacttattctttcaaatgtgtgcgtacttgcagtccattttgtaagttccgttagtctccaaaagggtacacttgatatcatagagggcaattgcaccagtccaaatccagaacaggcagtattgaaagattatgtccacaagactagcattccttttgtcaaaagagacgaaacagttgaatggcacggtgatcaaaaaatttactgcgtaacagccatcagtcttaagagcgccgaaaaaggttcaactgcttggatctcatatggtggagttaaccacacctacatcgcaatcgatctggaatctggtatagggcatggcttggaatacaacg

SEQ ID NO: 5095 - DNA, 408 bp, Diabrotica virgifera
  Clone ID: LIB149-048-Q1-E1-G11
aacttaccatcaataacatctaaaatgaaatacatctactttttgttcatttatttcttggttgccttagcaaaggcagaagaaactgttagcttagaaggaaaactcccaaaatgtgagtgtagggatataatcgatgagatcttgtgcaagctaacagaaaactcagaaaaggtcctcaaaattcaagccaaactagccaaagtagtgaaagaaaccaatgaaattctaacagaagctaaagaaaactcagcccaagtgaaagaaatcgtctctgttagcaccttgcttaaatctcaagtcaactctacggtcacagtcgttactgccaataccgcagctatcattcaaattaaaaatcaagtccacgaccatgtccttgacaatggtggcgacttggaacagacc

SEQ ID NO: 5096 - DNA, 360 bp, Diabrotica virgifera
  Clone ID: LIB149-048-Q1-E1-G12
acaacacccaggactgagtcatattatatttttacagttattttgattgggattctcataaggatcaagtttagagaaaaaaagaaaactcaacatgagcctactgccccaacagcccaccaacaagatgatatttataacatcagtggcagagttcaaaaccaggaacagtggcccacacacgatgctcatttatcaatagaccacataagtgtcttgaaccaaatgaacaaaccggtatatgatgatgcacctccctcttatgaggaagttatgaaaacatcaattcaagttgtcggagagacctccacaccaccatactcaccacctcaaccagcaagccaggttgtaatagttgtg

SEQ ID NO: 5097 - DNA, 389 bp, Diabrotica virgifera
  Clone ID: LIB149-048-Q1-E1-G3
cacccgcccgtccgaacacataaaaaagcgacctgtccaaaacgccgcctagactaggcggcgttggccgtggcacattcactgaactcaatcaaactggtggaaactgtccaactgttgatggcacaaatccagtacaacctcgcgatctggaacctgctcaacaatctaataaatgccaaatggacaaccacatcggtccacactatgctcatggtacaccatttcgacaccatagcaaaaaattgtgacattcacccaacctcaactcaggtagtactgcgcgattactaccagcaaattaaacttatatattattgcaataagcacagcatcttcgtctgatcatacagctcactatgatcacctggattatacgtatttatgaa

SEQ ID NO: 5098 - DNA, 428 bp, Diabrotica virgifera
  Clone ID: LIB149-048-Q1-E1-G5
cccacgcgtccgcggacgcgtgggatttgtctgatcttgggtaaccaaaggacaaattaaatttcgtgttaaaaatttgccgatatgtaacgtaataaactttattggtcggatgtttttctttaaacaagttgaacatttttgtaatattcaaactctctggtaaatactagattcgtgtaaactgtaatgggataatctagttttaaaagactttgtggttataatatattgcttcacgcgattctggatgcaactttctatgctgggaactacgtttaccacgtttgtcttgtccaaaagttcctgcagcttttaaatttttttgtaggtgttcaattttgcccttagttacgccatgtgttgacatgaatgctttaaaacacacattaatttcttgggaaactccattacgcttaactgtaact

SEQ ID NO: 5099 - DNA, 422 bp, Diabrotica virgifera
  Clone ID: LIB149-048-Q1-E1-G9
cacacgcctctacacacacgttctgatatttataattacgtatttttttatgggaaataagccacaattttactaaaaaatgaatttattaactatttactggatgtaagaaaaattgtagaaatttatgtttacatttacacatatttttgtaaaaaaatattttaaataaaattatttttgtctttttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccccccaaaaggttcaagcctaacttacccttgaatgcaacttcaaacccctccaaaagggcccccaaattcaaattcaagggccgtccttttaaaaatttctgaccgggaaaa

SEQ ID NO: 5100 - DNA, 413 bp, Diabrotica virgifera
  Clone ID: LIB149-048-Q1-E1-H10
taaatatgttatgaaaatcacgaatgaattgaaccccaaaggcatttttaattataaatgtacataattcattataacaagaaaagaaaaaaattaaaccgaaaatacctgtagacgcattatcttgtttcatatatttatattaaaaagtttatatctctattttagaaatgtattttcttttttacatattttttaaagttttaaccatcttttttatatattatatttccactatatagacttattttttctatcgattttaaagacttaacttatctcgagtgtttctttaatatacactgcgaggcataagttaggtatgtagaaaattatgcttgattttttcgtgaacagatcaacggatttcgctaagtttttttattattttagatttttctttggtatttaca

SEQ ID NO: 5101 - DNA, 426 bp, Diabrotica virgifera
  Clone ID: LIB149-048-Q1-E1-H11
ctcgcgggtcaatacaagactctacaatgagtcgtatcagttgtgacgttgcacaaatatatactttcgaaaaacttcaagaacactggcagcaatactccttttatggattttgcctttcgatcgcctatttggaactgggttcaataaacttcgaaaaacattttaggaaggaaaacgaagagagttctgaggtagaaaaacctgcagtaggtgctccaaatgttgcaagtgctaatgcttatagacaaaaacttgaaaagatcgtagagttctttttagaagctcaacaagaattttattaatatggtaaagtgttttatatactccgtctaatatacttacagctgcacgtcatccgcgtcatagcccgtgatgtcacatgataccaacacgaaataattagcggtaggtgtgttccttttc

SEQ ID NO: 5102 - DNA, 429 bp, Diabrotica virgifera
  Clone ID: LIB149-048-Q1-E1-H5
cccacgcgtccgctttatttttgttcttataataattgtctaaaattaaacaatagattgatttactgaaaatgtatttgtgaagtaacaaaaatcattaaagaaaccaaaatgaccgttgccgaattttttggatgcacattcatggccttcgggcccccctttgcaatgtttatttttacaatcgcccatgatccaataagaataataatcctcatagctgcagcattcttctggttggtgtctttactgttatcatcaattatttggtctgcaataccattaaaaacacatctggaatttgctatattttatactgtcttgttccaagaaggttttagatttgcaatttacaaaatattgagaaaagctgaaaatggcttgaagaaaatcactgacaataacacaactttaatttaaaacaaacac

SEQ ID NO: 5103 - DNA, 152 bp, Diabrotica virgifera
  Clone ID: LIB149-048-Q1-E1-H6
aatgtttgttcgtagcgcaattgtctaacgttaagcactagatctgattcacggacagtgcagttgcggggtaacaagtgtcattcgggcaacggggctgaccgttgccgagctgtttggatgcaggggcacggccttcgggcctccctttg

SEQ ID NO: 5104 - DNA, 425 bp, Diabrotica virgifera
  unsure (1)..(425): unsure at all n locations
  Clone ID: LIB149-049-Q1-E1-A10
aataacatctaaaatgaaatacatctactttttgttcatttatttcttggttgccttagcaaaggcagaagaaactgttagcttagaaggaaaactcccaaaatgtgagtgtanggatataatcgatgagatcttgtgcaagctaacagagaactcagaaaaggtcctcaagattcaagccaaactagccaaagtagtgaaagaaaccaatgaaattctaacagaagctaaagaaaactcagcccaagtgaaagaaatcgtcgctgttagcaccttgcttaaatctcaagtcaactctacggtcacagtcgttactgccaataccgcagctatcattaaaattaaaaatcaagtccacgaccatgtccttgacaatggtggcgacttggaacagaccttgattggaagcagctgtaaattgaatc

SEQ ID NO: 5105 - DNA, 437 bp, Diabrotica virgifera
  Clone ID: LIB149-049-Q1-E1-A4
cgttgaaaaaaattgcattaataaaacaataaccagaaaaccaaaaatttaacaacaggtaagggacaaaaaatttgcatcggttgataagaaaataggactcaagtataagtaaataagtgtcatattgttgaaagttgtgtgttatggaaggtgattcgaaatcggaatataaaaacaattttgagtagaactcttctttttaagtttaaagaaaccaagcctggagcagggattcgatcctgagcaagcagtacagatcgataagtcactagatatacgatatactaagtcactagagtcactaacctgcattgatcggggtaagatttcgtttgtgagtccttgtatccaggactcccacataataagcactttgctgatagagagcccatatagcgcatcagagtgctatcggaggggaagtggatagtatg

SEQ ID NO: 5106 - DNA, 130 bp, Diabrotica virgifera
  Clone ID: LIB149-049-Q1-E1-A6
acgcacgcgtccaccgagttgcacataaaattacaaattatccaaaaacggccttacatatacgttgtccagcaactcatttcactacatgccgccatttttgagttagatggacattttggtgcttttt

SEQ ID NO: 5107 - DNA, 284 bp, Diabrotica virgifera
  Clone ID: LIB149-049-Q1-E1-B1
actaccgacgataatacaccactgatgataacggcaatgaaactaccgtagatgatattactaccactagcctagaacccgaaccgtcggctgaaacgacgagtgctcaagcaggttcaactgctacggagcgctctgtagattttgtgtgtgttaacgcaagaaaatttgctcaccctgtagattgcaataaatattatctgtgtgtagatacagttttcagtacagtgaagtatttgttagcgtgtccacttggtaccttatatgacgcagacaatgaaatt

SEQ ID NO: 5108 - DNA, 380 bp, Diabrotica virgifera
  Clone ID: LIB149-049-Q1-E1-B11
gaccgacccgtccacgacgaaatcaaaaacttgattgtgtaatttgtttttcattgctacaagaatcgcgcatcattatcaacactccaatcgatttttcctaggaaatatttagccaaattcgatgatatattcttctagccgtgcttgtttcaaaccattccgggtggaggcggaccattttatagacctttagagctcactgagatggttttgctgtcaccccaccccttgctgagcacgacttggaggagaatgtatatagttgtacatttatttatttttttgattgccgtaaataagttcaacatcctcgcccgggcgaagatgttgaacttatttttgtcattcggaaactgcaaatattgcggtttctttgt

SEQ ID NO: 5109 - DNA, 312 bp, Diabrotica virgifera
  Clone ID: LIB149-049-Q1-E1-B9
tccacccacgcatctgccaacgcgtccgcccacgcgtccgcagacacgtgggcggacgcgtgggagaatgtttagttcgacgtgagtatcttccagagctttttgtgtaggaaattttatgcgtttctacatatcccgaattttttctcagttaacctaaaattatttaacaacattacagttaatatgagataattttatattagtcacattcagtatttttaaggatgagcttatacatacagttttagatacgatttaatttttatatacaattacgactactagttttcagactttaaaatctgttaa

SEQ ID NO: 5110 - DNA, 335 bp, Diabrotica virgifera
  Clone ID: LIB149-049-Q1-E1-C12
aattataaaccaaattattttaaaactaaaaaaactaatttaaaatccaattgaaaatgataataaattaatttcctcctttcgaccctacatctaatttaaatttacaaataaactgattaagaacagtattaggtctattaattattcatctagattttgattaatcccctctcgttataattatttatgaataaagattattataacattacataaagaatttaaagttttaattggaaattataaatcccaaggaagaacattaatttttatctcactatttagattaattttatttaataattttcttggattattcccgtatattttta

SEQ ID NO: 5111 - DNA, 405 bp, Diabrotica virgifera
  unsure (1)..(405): unsure at all n locations
  Clone ID: LIB149-049-Q1-E1-C3
attaatttaaaataataaaataatttttaagaaaagttaagaaaaattttaattaatgataggtaaataataatgggagagaataatttaattttaaaaaaggaaaaattaatttttggaacctgggtatcaaggaattataaataataaatatatattaatatttcgaattaaagagctnaaaaattaaaattttattgtaaataatatttaaataanttttttgtaatgaaatgtattcgttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaa

SEQ ID NO: 5112 - DNA, 435 bp, Diabrotica virgifera
  Clone ID: LIB149-049-Q1-E1-C7
actgaaacaaaacgaaaacactacttgttttcgttaagcggactacattgtattcgaattttgtttttgttttcggtccttttccattgaccgtcacgaggaagtcaaattacagttttctcttcaataaccaaccaacacctttagagaagaagactttctctttttagatgtgtttggtcgataccgaattcctttggaaaagggtatatttccaactcattgcattttaaccaaaccacttgggtgttaaattatgtcctgtgccagtgttcttcattttttatggttcctttttttacgctgacgttatgaaattatgtttttaattttctttcaatttctatccagttggtgtcaaacaattcgacaatttctttgtacgaatcctttttttaatcaggctagtaaagcgatattaataaacacaacatg

SEQ ID NO: 5113 - DNA, 436 bp, Diabrotica virgifera
  Clone ID: LIB149-049-Q1-E1-C8
ctctaatccaatacagatgaagtgtttatgttttatttttatatgtgttatattggggatatcccaaaatcagtatggagttcatggtgaatgccgcccagtaacaggaagagttacaagaagcgcttttgttgaaatgggtctacattttgttgaacttctcaagttaagaataatatctaactgcgttgcaaatggcttttatattgaggatgagttaaaggaatcatttaaagatttgggagtatgtttaaacaaagaaaaattgtatgtatctccaagagaagattttcttaagaatcttaaagaatgcaacgttgaaccaattaaattagtaaaatcatgtttaacaagggaacaaagttattttcccgatttcctgtataatatggctaaagctcaaattgacttaatatacgataatcgtgacgttata

SEQ ID NO: 5114 - DNA, 229 bp, Diabrotica virgifera
  Clone ID: LIB149-049-Q1-E1-D5
agtgagtcgtattataataatgataaaattaaagacaaaattaaaatatttgggtgaaaaaataatcatcatggtaaaaatactaataaaatttcagatcatggcggggacagtactgggaggcagcccaatgtctgtaactttaagctacaggtgaaggcacattcattacttcttaaattcgtatcaacagactaagtcagagcaagtcgatattatacacacgaca

SEQ ID NO: 5115 - DNA, 425 bp, Diabrotica virgifera
  Clone ID: LIB149-049-Q1-E1-D9
aattgacatcaatagtaataacaactattttaaacttttaaacacaatatagtcaaagttcagagtcagtgtcatcacatccacggttaagcatgtcttgcacacaaataaaacagttagaaacattattaagcaaacaactagttaaaaaaactattaaaaatgttaatattagcaggcttacagctccaggtgaaaactttggtagtataatgtacaaattggatattgtcctgaataataacgataatgataccgaagaaatacttcgcgcagtggcaaaaacccttccagagactgaattttggaggcaaatatttaatattcaagtaacttacacaagtgaaatggctttttatgaggtagttctgcccacctttcaggaattccagcgcagtttaaggattgataacgttatcgactgt

SEQ ID NO: 5116 - DNA, 439 bp, Diabrotica virgifera
  unsure (1)..(439): unsure at all n locations
  Clone ID: LIB149-049-Q1-E1-E5
aaggacgcgtgggtactaagggtggtactaaaggtggtactaaaggtggtactaaaggaggatacggtcaacaatctcaaactagccaagacttcgattacgagagtgaatggaacaatggtcaaaagattgtctcacaacaaacatctgatgattgggaacaacanaaccaacaattcggtggaagtgacagctacgttaaaactacaaagactgttgttcattcttcgatacctgaccacagccacattcacaaacaaaccacacataactcccattcccactcctcgatagaagagactgacgtcaacttgattatcgaaagacaagaaggtgaaatcactcacttaagaacagtccttgccaacgctcatgtcgctctggatgctcatgagcatagaattgatgacttagaacttaggattgatcaattattgca

SEQ ID NO: 5117 - DNA, 209 bp, Diabrotica virgifera
  Clone ID: LIB149-049-Q1-E1-E6
ttgcaacatcctatagtgagtcgtattataatggtggaactaagggtggtactgacggtggtacgaagcgatgatacggtcatcaatctcaatctacccatgacgtctattacgaggtgagtggctcaatggtcacatgattgtctcggttaggcatctgacgattgggacctacattggtacgattcttgggttctgttcactacgtt

SEQ ID NO: 5118 - DNA, 351 bp, Diabrotica virgifera
  Clone ID: LIB149-049-Q1-E1-E8
cgggtcgacacaagcgtccagcatacgtcagcataatattgatatttttgactttagtttaacagatgaagaaatggctgttattgatgagttcaactgtaatgttagagtctgccatgctgaagaattaaaagataatcctgagtatccatttacattgcaggagtaaatcttcttctttctaattttttatcataactgtataatttattcaacacgcttttatttatataattacaagactagtatctatatgaaattaatatcagtatattgtttttcaaaagtaaacggtacgtaatatacgaattattatctaaaaaaaatatactaaaaaaaaaatatgttaat

SEQ ID NO: 5119 - DNA, 438 bp, Diabrotica virgifera
  Clone ID: LIB149-049-Q1-E1-E9
cgacacacgcctctacagtgaatcgtactaacgcgtgggctccctgtcaacgtatagtcgcaaatttttcaagatgtgtaagtttttagtggtagctgtttgttttatggtagctgaaacaaaaacagtcagaagattgagtgaggtgttagaagaagatcttcaaagtgtgcaaaatgttaaagacagatctttggatggttccaaacggtatttagaaccagatgtaagtaaacatagtgctgatcataatatagtcgagagatccctagatgatgatttaattgaacgagttgcaccgtatccactgtttgaaagagtttcaaaaagagcagctatggaaccagatacagcatacaatacatatccacatcaacgctttagacgaggttctattgttcgactaaggactctaatattaccagcaaatgaaagatt

SEQ ID NO: 5120 - DNA, 426 bp, Diabrotica virgifera
  unsure (1)..(426): unsure at all n locations
  Clone ID: LIB149-049-Q1-E1-F3
tgagtcgcaatatttaaggcctttgggctttggcttgtgccttggtgcaatgcatcaattgagtaccttaatccaaatgaatttgcacaacagtttgaaacggaggagcaactaagagattttataggcgatattatcaacagcactaaatggggccatttctaagatgtctgatcccatgacaattgctgatatacacatggaccagaactctgaggctctagccggaaccattgatattaaagacattgctatctctggtatacataagatagtatccactgccgtatcaaccaatctcatcacgcaacaactgaacatatcagttttggttcctgatcttactatcaacttcggagctgccgtcaacgtagtggttctggagctggtaccactttacggtagtggaaaacanaacatcaatat

SEQ ID NO: 5121 - DNA, 442 bp, Diabrotica virgifera
  Clone ID: LIB149-049-Q1-E1-F4
taatttcaaacatggttggtggaaaaccatgcaaggtaaaggacggcaccaggttaatccagaaaacccaaatttggcccaaaaccggcaacaattggaagcccaacccttcgaaccggaattaaaggttgttgcaacattcggagagctactgaacagcgagttttacactcaaaatgaaaatttactaacacctttaataaactactttgaggatgtatggataggcagattggatcgacgacaacaaagaagaccgccaatgtttccaaggaatctttggaattgcttcgaatttatagaggaagatctaccgcgtactaataatgctgtcgaaggttggcacaacagcttcccctcgatattaaatgcagcacacccaaatctatggaagtttattacggggctaaagaaagaagagagtttaaatcgattaaaagtg

SEQ ID NO: 5122 - DNA, 335 bp, Diabrotica virgifera
  Clone ID: LIB149-049-Q1-E1-F5
aacgaagaatcaacaaaaaaattaacttctcttaatgaattaaacctaagtcacaacaatcttacagacatattcagtaaagcattgtcccacatgcaggatctttcagtaattgacctttcttacaataagttgactaaacttcaagataatattttctctggaaacggtaaactcatcaaagttatcttagatggaaacaatttcgacaccttaccatctttctaccgccaaaaccatgaaagtttctctacttacacgttctcttgtaaatcttgtaacttacgaattctttcagccaacgtcttccagaatatggatggtttgattaatct

SEQ ID NO: 5123 - DNA, 361 bp, Diabrotica virgifera
  Clone ID: LIB149-049-Q1-E1-F6
aagtccaagacaaatgatatgacaagaaccatatgcagaatgggatttaaccactgtcttacaccatcatatatatttaaacttaatatagctgatagccctcaatgtatttgtggtcagtttggtaacctacaacacaaaattttgacctgttctcttatttctaataaagttaatatgtttttaaattcactgtattctttgactgatgtaaaccatcccattaatttaaattatttattaacattagaaaataatgagttggtatatcgactattgtataaacatattttagatattaaacttaagttgtaattgtaaaatatagtttaagtatttcttgtaaattgttatataaaaa

SEQ ID NO: 5124 - DNA, 442 bp, Diabrotica virgifera
  Clone ID: LIB149-049-Q1-E1-F8
acccacgcgtccgtacggacataccgaaaataacatgaatgtgcgcggtggaagtcgcggtttaggtttacatcgatggcataccgaagagaacataccgaagatacctttctttcagtgttctttgctgtttctgtggtgactgacacgtgttccgggagagttagctttttttacattataagattatgggtcgcccatgtttctccaactgtcatcaatacgactaacttcacgcgtaactttgatacgagaattatgaaaaaaaatttgcattgaaagccagatcccgtaattttttaagcgttataaacatcatggttccgaggtgttgttttgtctaatgatgaaaataattatgagatttcatctgtagattgtggaaatctaattacagcgactagggcaaatataagaagttttcctgctgctctgaaaaaca

SEQ ID NO: 5125 - DNA, 437 bp, Diabrotica virgifera
  Clone ID: LIB149-049-Q1-E1-G3
aatttgattttttacgaaaatgacaagtatcgagactgtggggaccattgtcctgaaattgctgaagttggtgatcaatttgatatgtctcatcttgtaccgaaccggatatcaaggctacttcttgggagtaggaggaacctggaatctaaacgaagaaaaaaatcccgatgcagaaattgtggcttccggcgtattcgtaggatttatgatttacacattcgtctcgctgatcagcctttgcttcgctagtggagatcacaaaacgacattcactgatattctgatgaatatagtagggatttttatgtggatagctgttggagctacagctcttcattattggcttgggtacttgtccgaatacaaatacacgacaatagattctgaacgacaagttggtttggcgttaggagcgatgtgtataataaatggag

SEQ ID NO: 5126 - DNA, 430 bp, Diabrotica virgifera
  Clone ID: LIB149-049-Q1-E1-G4
acattttaggcgtaaataattccaatataccaaggataatcagcataattgcagaggcattcttcagggaggctatggaaccatccaaacctgaaggctttagaatggtaaacatcgttaggcaagttcaatcaaacgaatcgtttttccaaagcgtggtccaatctctggctccagaactgcagcaagctttacacgtggccctacatacaacagcagcagcagcgacatcttagctgggaatataaatttaagttattgtttttaacattcatttgattaattcagagttgaaataaaacattatgaactgttatcggacagttctaaagaaatttgcatccataaacgacatttagacttttgtcgcttattacttttggtaatcgaaaaatgttggcgattcatggcattgtttgtggttaacacc

SEQ ID NO: 5127 - DNA, 124 bp, Diabrotica virgifera
  Clone ID: LIB149-049-Q1-E1-G8
atcagattccaactgttcatcgttgcctctgcctcaatgtaggtgaattctgcagggctgcgtgacttccattgttggatcaatgtttttgcatggtataccttgtcgtgcaagtttattcaag

SEQ ID NO: 5128 - DNA, 115 bp, Diabrotica virgifera
  Clone ID: LIB149-049-Q1-E1-H1
aaactattgaattaggaatactttgaattcccttaggaggtcaaagtattcctaattcaatagttggtgctactgaattaggaatactttgacaacctaggggcctgcaggcgtt

SEQ ID NO: 5129 - DNA, 287 bp, Diabrotica virgifera
  Clone ID: LIB149-049-Q1-E1-H11
ttatcctgcacctgatcctttagtatttaagagatgggaagattctgatgaagaccaagcatagatacattttctagagggtagccattattagaggttactgaagtctcccattccctattggaatgtatcctacgatgataagttggaaatgatacaaactaatatcataaacttgttgatgtgattggggaatgctcttgcatatatttgtccagatctctaattctggttttagatacatctaatcatttgtacaatggtctaccttgttagtttaagcgata

SEQ ID NO: 5130 - DNA, 415 bp, Diabrotica virgifera
  Clone ID: LIB149-049-Q1-E1-H12
gacgcacccgtctacccacgcatccgcccacgcgtccgcggacgcgtggggaaaaatttacttttttgacttaagaccttttggaatccacctcttcaattgtatattgtgatttctaaaaataatttcagtttcagttgaaaatattacattgagattatttcaaacaagctttacctcataagatatgtacttttttgaagttaatataaagtagcgcttatttgtgactttccgtaagtcttggccctagactaacaagcaaaatatgtccatatggttaaaaaaaaactcgcaactaaaaattacatgttacttatttatactgtgctgtttgtgtaaaaaatagtggtattcgctcaccacggacttttgtgataagaatagttaaagtcatgttctagaattcaaaatg

SEQ ID NO: 5131 - DNA, 444 bp, Diabrotica virgifera
  Clone ID: LIB149-049-Q1-E1-H3
taacatagtatcatattgaagcaaatacttattctttcaattgtgtgcgtacttgcagtccattttgtaagttccgttagtctccaaaagggtacacttgatatcatagagggcaattgcaccagtccaaatccaaaacaggcagtattgaaagattatgtccacaagactagcattccttttgtcaaaagagacgaaacagttgaatggcacggtgatcaaaaaatttactgcgtaacagccatcagtcttaagagcgccgaaaaaggttcaactgcttggatctcagatggtggagttaaccacacctacatcgcaatcgaactggaatctggtagagggcatggcttggaatacaacgttaccatttatgctaaataatgttattgaggtgtttaaaagagtttgtgtgattataaaataaacgaaataaaaccataaaaa

SEQ ID NO: 5132 - DNA, 242 bp, Diabrotica virgifera
  Clone ID: LIB149-049-Q1-E1-H8
cccacgcgtccacggacgcgtgggaaaaattttcatattttaaaatatgttattatttatttttatatattattatttttattttttataaattttttattaaaatataaatttaaattatttaaatttagtaatgatgataatattagtattaaaaaattgtatatttagtaaacatatataggtttaatataggaattcggcaacatttttttcacctgtttattaaaaccatgcctttt

SEQ ID NO: 5133 - DNA, 449 bp, Diabrotica virgifera
  Clone ID: LIB150-001-Q1-E1-A1
cccacgcgtccgattttgtttaggtttaatatattccagataaatgtagtgaaatgctttcttaatgaaaaattagagtttttttgaaagggccgtatacgagataaggtgaaaagataagacggatggttctcaatataccaaacggtattcatcaacattaacattcaaccctttcgtcaaaaatgttcatcaaaataaataaacgagcgtggatcaacttgtttatatttgtgatattaagtgtaactattatatttatgttctcagacgatcacgtaacagaaataagtattaagacaaatagtgaaataaaagagaaacatgccattatatcatataccataaataatacgactaagacgactgctactagtacttctacaactactaatactgctactgctacttccattagtactactcctagtgccgatatacactgctac

SEQ ID NO: 5134 - DNA, 132 bp, Diabrotica virgifera
  Clone ID: LIB150-001-Q1-E1-A10
ggtctacccaggcctacgcaaaaattgaggcgaagccattgtaggtttgagtttagattaagatttctgaataccagccgtccaagaataaactcccactgtaatctggtttaaatgaaatttctgaaaacc

SEQ ID NO: 5135 - DNA, 273 bp, Diabrotica virgifera
  Clone ID: LIB150-001-Q1-E1-A11
cccacgcgtccgttacgattcaaccaaaactgttacatttgacatgcagcaatgccttttcattccactcgtgcatagttctgtaaccttctacaaacgccaactttggactttcaatttaacagtctacaactggagtcatgccacaatttactgtccttttgttatatataaatttatttctgaagctataaaacctgttgtaaaaagtttgaccatgtactcagatacatgcggtgatcaaaacaagaatactcatgtagctgctatgcc

SEQ ID NO: 5136 - DNA, 403 bp, Diabrotica virgifera
  Clone ID: LIB150-001-Q1-E1-A12
gtattttaccttccagtattcgcgtagattttcaggagaagcatagttgcatcgagagaccaatattaattaaacgttagtttttgaaaaaaaaaagccccaacaacttgggcttttaggatgaataatacgtacatattcttcaagaaacagaaattttaatcagataaactaaatccagtattactgttaatgcagagaaggttcctatcttcaatgagatgatggcgaccacattgacccatcttattctattcacatcagtcttgcctattcacaatcttgccttgtagaatcaactgtatgaaaattaaaaatctaatttttatattgaaatggtgtagaagacgatgcttaaaaattgagaaaattgtcattacttaaaaacaacggtatttgaaga

SEQ ID NO: 5137 - DNA, 450 bp, Diabrotica virgifera
  Clone ID: LIB150-001-Q1-E1-A3
cggacgcgtgggtcatcatgaaggccttgattgtccttagcgtttgcttttgcttaactctagctgccgaatccgagaaaaaggaagtaacgcaggagagtaaaaaacaagagaaacgcggtctttacggccttggtgatcatggtggaggattcggcctaggcggccacgattttggaggcggccatgattttggaggcggtgattacggaggtcatcaagaacaccacgaacacgtaaaaacggtcgtagttgaaaagaaaattccaactccttacgaagtagtcaagcatgtgccttacaccgtagaaaagaaagtaccatacgaggtcaaagtaccagtaccacaaccttacgaggtgtacaaaaaagtaccatatccagtaaaggaaattattaaggtgcctgtaatcgtaacacaaccgtacgaagttattaaaaaagttacat

SEQ ID NO: 5138 - DNA, 413 bp, Diabrotica virgifera
  Clone ID: LIB150-001-Q1-E1-A4
atcaaggtgtcatgtgttttgataaattttgtttccgcagctatatggatcagtcgaggagctcgtgaaattctagtcagggaaactgtgtccgatcaggaagaaagtcgcagtggttatcaagaaatcacacaagtaatattcaaaatattgtagactttttagaacgagtaaaataacctagaaaaaatggaaaactctacaaatatttttgacgaactgcacaaagtgataaacgtgcatgaagattccagaaccaaagatttctttctaatagccagtccaattccttcaattgctttatcagtagtatatttaatctcagtgacggttcttataccaacttttatgaaaaacagaaaaccatatgagctcaaaaattttggtaaaatttacaatgggttccaaatttt

SEQ ID NO: 5139 - DNA, 437 bp, Diabrotica virgifera
  Clone ID: LIB150-001-Q1-E1-A5
aaagagtttgaaaattctcagcagtcccctttccgttcttgtcattagctctacatcgtccgcaaatcccagaacctggtttctgttatcaaagatcataccttttgttcgtattccactctcttgaaatattgcctccaacaagaaattgaagagtactgtggacagcggatctccctgcttttaactttcctattaatctttcttttaactttaaattttcctgttaggcttccttctatccttactctattgtcggtcttcactaaggtaatttttacgggtctgatcatcttttacggaattacaagtactcttaaggcctggtacaaacaccttcttgtcacaccttcttgtaagcttgtttaaaatctataaagaggaggtttaactttaactgtttctcatacgtactgctctgaatcattttcagcacg

SEQ ID NO: 5140 - DNA, 332 bp, Diabrotica virgifera
  Clone ID: LIB150-001-Q1-E1-A6
atatttttatttattttaaaataataaaatattttttagtaaaagtaaggaaaaatttaatttaaggatagttaattagaatggtgaaagaaaatttaattttaataaaggaaaaattaatttttggtacctggtgtaccagggattattaattaatatttatatattaaatattcccaaatttaaaagacctaaaaatttaaaatttttagtgtaaaataaatattttaaataatttttgtgtaatgaaatgttacccgttttaaaagtacacctaatttttgaagaaataaattaattttatttattaacaatatatttatgattaaata

SEQ ID NO: 5141 - DNA, 226 bp, Diabrotica virgifera
  Clone ID: LIB150-001-Q1-E1-A7
caataacagaagcaacatgaggattacatattttattgtatttgtactagcctttgtggcaactggaatataccaagtagaagcaggaaggtcatctaaaccagtcacccaagcaccaggaagaaaacacggccataaatagccttattttaatatgtataattaatttatattaatgcattttaatgttttattgtacaaatacaataaaaatgttatttgactg

SEQ ID NO: 5142 - DNA, 384 bp, Diabrotica virgifera
  Clone ID: LIB150-001-Q1-E1-B11
cggacgcgtgggcgcaaatttagctgtgttgtagttgttggttgtgttatcagttattgtattgaacaatacaatttcttatattgctgatttcaactggaagcttgctcattgcagtggatggttacgatggctactatgaccgtcgcttcgaagattctcgtgacatgtacgaacgtcgttattccggaatgccgtctagccgcgacgtgggcatgcgcggcgctgcaagcgcgcgtgacttcatgccgcctccactgcccccacgcagagaacctctgcctccaatgccgtccatcgggttgagaggaggaccttccagcggtatgggaggcagtctaagagacagcggtttttcgagaagcgcaagtgattatggtatgt

SEQ ID NO: 5143 - DNA, 310 bp, Diabrotica virgifera
  Clone ID: LIB150-001-Q1-E1-B2
cccacgcgtccgcccacgcgtccgcaatatttaagttacggaaaattcctaggtgaaggaacgcctttcgaaaacagcagcagtttcatcaacctcagtacaacgcggggcgggatcgagagcgagcaggccttgtaaacccacatcccactaccaatttgccgagacatggaaatgttctagagaatgaagtagtttaagtaaatttatctaacaatagggcagctgtaccacttggtgtggcaagtcaaagttctggagccatgaatttagcaaaatgtagaggaaaaggtgtaaatatataccattt

SEQ ID NO: 5144 - DNA, 297 bp, Diabrotica virgifera
  Clone ID: LIB150-001-Q1-E1-B3
aaaaacaacaaacaccgccttcaacatgaaacgatcccagcaagttacggtcactgaaaccaccccaggatattcagtggaaaagatgtattataaagaatacaaatatgaaaccgctttctccatttcgcagttatcgaaactggagaatttcgttttacctcctagaactactatcttagcattatctcagaacggaggagacaaggaagaagacaaaaagtatgtcgtcaagaatcacggaaaagctgatctttttggtgaggtaatacatctcaataaccaagatgatgctcc

SEQ ID NO: 5145 - DNA, 414 bp, Diabrotica virgifera
  Clone ID: LIB150-001-Q1-E1-B5
aaccgattattttcgaatttaaaagagctaaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataatattagtattaaaaaattgtatatttagtagaaatatat

SEQ ID NO: 5146 - DNA, 448 bp, Diabrotica virgifera
  Clone ID: LIB150-001-Q1-E1-B7
ccttaagccccttacagaggggtccaaaccaattcgagatgaagtgttttttgctgttggtgattgtaggaagcttcctaattgtacctctgaacagtaatcctgttagtctttcgcgctcaaagagatcctttagtagccaacccaaaggatactggagcaaaaagttgacatggaaaaccgagtgggtaaaagtttggaagcaagagaaaaagctcaagtgggtttccgagtggaagaagacccaagtacctgcatggaaagaagtccaggtcccaatttggaaggaaatacaagttcccgattggaaagtgatttctaaaccaatatggaaggaaattcaagttccagcatggaaagagatacaagttcctgattggaaggaagtgaaggttccggcttggaaggaaataaaggtgcctgattggaaagaaattcaagtgccaga

SEQ ID NO: 5147 - DNA, 412 bp, Diabrotica virgifera
  Clone ID: LIB150-001-Q1-E1-C10
aggagttcctggtatttaaagatgaggaggactttgacggaaaactcgatgagatggacatggataactccaccgaacaagagatctcaaagatccttgaagatatgggtagaaagttcgagagtatccagccagagactaaagactctctgggcttcttcggcaagatcatggaatctgtcaaggggtacctctctaaggacaagaaggacatgtttggtgctgcggattatgggggattccagaagaagggttttatagagccggacatagatgattttacacacgcggaagaccctcctaagaagagaatgaggttggatccggatttagggccgctaaatgaaaatatagtcacgacgaccacgttgaatacgcgtgctctgaatacaaaggaaaaatgaagtttttg

SEQ ID NO: 5148 - DNA, 405 bp, Diabrotica virgifera
  Clone ID: LIB150-001-Q1-E1-C12
gggactggcaggacgtcccgggacgctacacgagagtcgtattacgtggggttcagagttcagcgttttcaagtaacctcttgaaatttcgcacaaaatgagatttaagattcagttggtatcagcgtttttgtgcgccagtttagtttaggcatacatagaggagcctggtcgacgatacccaccaaccaaaggagagctttggccaagaccataccagcaaattaagaaccatagtttctttacagtcaggaaggagcacttcaactttaagataatcaataacacgtgttcaatagtagaaggaagcaattgggaactacgagtcgatcattttctcaggatatagcttgatgcaggaggacttaggacctatccagtcatcatttagaacaggaaccggtg

SEQ ID NO: 5149 - DNA, 433 bp, Diabrotica virgifera
  Clone ID: LIB150-001-Q1-E1-C2
ccgggcgttagtatatgaacatcagcagcttgacagatgacaattggcatgaactgtcaacaggtcaaacaggaaatattaccgagttaaacaaaaaatgaccaggaaaatgttccaataaaaaaactgtaataaacgcaatattgaatagtttcactcatgaattactagaacttcctcctcagtatctagatttggaccatctaactatttatcgagaccaaattgtatacaagataccagcaattgtcagtgattaataaatacctgttgtatttttgaattctcgatattttgttgctgttaacgctgtgatatattcgcataacatattcccaattaattaagttttcatgacatattaaacagttttcatgaaatattttaaaccactaagaaagaatttaatagtggatataattatatatagtca

SEQ ID NO: 5150 - DNA, 246 bp, Diabrotica virgifera
  Clone ID: LIB150-001-Q1-E1-C4
gtacatttcccgaatgtatgcttgtttgtatgtttgttttcttagttattatcatgtatttgatcttttttatattcatttttggtccatattcttcacagaaatttttttttgtttagtagtagttggagttgttcagcagagcttgccataatcacggtgtcatctgcatatcttatgttgttaatagatcttccgttaattattattccctcactttgagatagcattgcttcttcaaaaatg

SEQ ID NO: 5151 - DNA, 427 bp, Diabrotica virgifera
  Clone ID: LIB150-001-Q1-E1-C5
cccacgcgtccgcccacgcgtccggctttttgcacgaaaatcacttccggaaaattaagaatgaaacctttgataacgctctggttcttagtccttgtagcagtggcgataaacgccgaggccaaggagaagaaaagcgcagaagccgatgacaagaaacagaagaaacgtggtctcctcagcttaggatacggatatggtggagattttgataatggttaccacttaggacaaggtggatacggtattgacggtggttacacactaggattaggccagctagacttaggacacactacttctattgagaagaccattactttggttaaaggagtaccagtaccatacccagtagagagacacatcccttacccagttaccagacacgtaccttacccagtaaaggttcttgtaccacaaccatacc

SEQ ID NO: 5152 - DNA, 396 bp, Diabrotica virgifera
  unsure (1)..(396): unsure at all n locations
  Clone ID: LIB150-001-Q1-E1-C8
aaccggtttggcatagcacaacatttgacagaacctaaaaaatctaaaattttagaatattttagtacttttgactttgttgatttatattaaaatgataaaatgaatattaacgttttgttcagaaatgtgcgaaattatagtaatttaaatttgtgtaaatttaatagtacaataacaaatcatttcttatgtaaacatgcaagtttttgtaccaagcagccttcatattttttaaataacaaatccttaaattcaggccttaatcaaagaagatggtattcagatgatccaagttctccttcanacaaatttactccactactgccagactctcncatatttgtttggccttctttatttanaactataagaaattttaatcttgctaccttt

SEQ ID NO: 5153 - DNA, 415 bp, Diabrotica virgifera
  Clone ID: LIB150-001-Q1-E1-D11
cccacgcgtccgcataacaaaagacgtatccatttggcataagggaaagtaataaaaatgctcaaatttactcaagtaaaatatatctaaagaaaaaagatcgatactatactatatacttcaaaaaatgatactctagaattcgaaaaggcagaaatgaaagtgtaaggtactacactgacatttaaatacaataagcggaaacaaacaaactaaaatgtgtcaaactattattatctattagcaaataataacacgaaaatatattgtcaataaaaatagctgcaaattagccaaacttgaacaaaaaaagaaaatcaggtctaataggaacatgataaaaaagaaaatcatgcttcacgcatagacaagaaaatatatatagcccgtgaaaaggcaattgacaaagctctac

SEQ ID NO: 5154 - DNA, 447 bp, Diabrotica virgifera
  Clone ID: LIB150-001-Q1-E1-D2
cgttttcatcaacccggagaacatgcatcgaaacgcagtagcatttaataatcaacaactatacactgacgccgatatttattcgcccacagcgtcagaaaatggtacatacattgttaaacagtccccggacaactcatccatgttcgacatggacataaacagtagtgttagtgttagaagtagtagtagtagacattcttcttatccatcgtcgccggtgggctccgtcgtccgccctgcggcgacggagacccccgacgatagtgaaatgtcgttccagtccagttcttcgtcgaagcctaggctgtccttggatctcggtctggtacaccagaccaactttttagatgtcaatacgcctagcatcatcgccgaagtggttagcttggaatcgactggttttaacatcttggatctcgttaaagaggacgatatacaattcgt

SEQ ID NO: 5155 - DNA, 436 bp, Diabrotica virgifera
  Clone ID: LIB150-001-Q1-E1-D3
cacacatatactaaactgattgagaacagatttgttgaggtttggtttaaatatttctttgccatcgttgtgtcaattaaataactgctttgtcggtaacactcaaaagatatttcagatgtaatcgagatagaattgttcatttgagaatttaaattgatttaagaaaatgtatataaaataaatatattccgtctcaatatttatgattatcctaagacctatcacttgtgggctgttatattagtcccccttgctatttaatcatttaaattaacgttgttgtttgaactaagagctccttttaatctagtatacaaaaagttctcccgcacttccatagatttcttatttttaatcataactcaattttcatcaacgttatatctacacaggctacaatgttatcgtgcaatcaggaagtacaatcaccata

SEQ ID NO: 5156 - DNA, 382 bp, Diabrotica virgifera
  Clone ID: LIB150-001-Q1-E1-D5
attattttcgaatttaaaagagctaaaaaattaaaatttttattgtaaaataaatattttaaataatttttttgtaatgaaatgttattcgtttttaaatatatctaattttttaagaaataaattaaatttatttattaacaaatatatttataaataaatatttttataatattaatattaaatatttttaggggatagcttaaaaattaaattttattaaaaattaaattttaaattaaaaataggaataaaaaatttcataatttaaaaataggtaataattaattttatataataataattttaatttttaaaaattttttaataaaattataatttaaattaattaaaattaattattgagattataataataatt

SEQ ID NO: 5157 - DNA, 442 bp, Diabrotica virgifera
  unsure (1)..(442): unsure at all n locations
  Clone ID: LIB150-001-Q1-E1-D6
ccacgcgtccggggatttccaatttactgcattgcatactatagtgatagttcaatagttgcactgcaaaatactcaaagaacaagtaaaatgtgaagtgcttttggtatgaaaaatagtaccttttgtatattttcctttattgatagtctgttttaaataaacatgttatcgttcttacaagatctggattttgttgctgtaggcgaaggcatccatacgttcgcagtgtcatttttgttctttagtttatattttaataaaggatcgctgggtgtttcagctaagacccagatactgttcctagtgtcaataatagccaagagctggtatgtcattcaactggggcattacgagccaatctactggtggcttcagttttcgcatatagcattcacctgnggcactcttcttttctatttatatcgaggactgctaaccg

SEQ ID NO: 5158 - DNA, 421 bp, Diabrotica virgifera
  Clone ID: LIB150-001-Q1-E1-D7
gaaagttctggtgattcctcttctgatgaggaggaagtaaaaaaaccatcagtgaaacctttacaaaagcaagcacagattccagtcaaagcagcagtaacaaaagatagttctgaagattcttcagaagattcatcagatgagccagaaaaggctcctgctaagccagttcaaaagaaagcaccaccagtacccaaacaagctacaaaaaatgttcaaaagaaagaaagtagttcagaagattcatccgaggaagaagttgccagtaaaccagtgccaaccaaacaaccacaaaataagcctcaaaaagaagaaagttctgatgaaagttcatccgaggaagaggctcctaagaaaccggctcctaagaaaccagctcctaaaccttcagtggttaccagaaaagctgaatctagctcag

SEQ ID NO: 5159 - DNA, 413 bp, Diabrotica virgifera
  Clone ID: LIB150-001-Q1-E1-E12
cgatcatcatgaaggccttgattgtccttagcgtttgcttttgcttaactctagctgccgaatccgagaaaaaggaagtaacgcaggagagtaaaaaacaagagaaacgcggtctttacggccttggtgatcatggtggaggattcggcctaggcggccacgattttggaggcggccatgattttggaggcggtgattacggaggtcatcaagaacaccacgaacacgtaaaaacggtcgtagttgaaaagaaaattccaactccttacgaagtagtcaagcatgtgccttacaccgtagaaaagaaagtaccatacgaggtcaaagtaccagtaccacaaccttacgaggtgtacaaaaaagtaccatatccagtaaaggaaattattaaggtgcctgtaatcgtaccacaa

SEQ ID NO: 5160 - DNA, 428 bp, Diabrotica virgifera
  Clone ID: LIB150-001-Q1-E1-E6
cggacgcgtgggtcatcatgaaggccttgattgtccttagcgtttgcttttgcttaactctagctgccgaatccgagaaaaaggaagtaacgcaggagagtaaaaaacaagagaaacgcggtctttacggccttggtgatcatggtggaggattcggcctaggcggccacgattttggaggcggccatgattttggaggcggtgattacggaggtcatcaagaacaccacgaacacgtaaaaacggtcgtagttgaaaagaaaattccaactccttacgaagtagtcaagcatgtgccttacaccgtagaaaagaaagtaccatacgaggtcaaagtaccagtaccacaaccttacgaggtgtacaaaaaagtaccataaccagtaaaggaaattattaaggtgcctgtaatcgtaccacaaccgtac

SEQ ID NO: 5161 - DNA, 431 bp, Diabrotica virgifera
  unsure (1)..(431): unsure at all n locations
  Clone ID: LIB150-001-Q1-E1-E7
cccacgcgtccgcaagtgcttccctatcgaacttaaaacgttcgtaataaaagtgttattatacattataatatgagctgcttttacctgataaaacatttaaattttataattaaatttagttaactaaattacaataattaaataatttaaaatattgattttcaaaagtgttgaaagcttcgagatgatgaaaagaactggttattacattttatttataattattcaaaagtaaaaaaagatgcgattaagacaataattcgtcaagactagatgcgataagactgtgctgtagttttcaaatagctaattctatactcttgctaataagatgggccattttcagaaggatggactattagctatggtgtttgtattttatattgatttaattataagatttggaacaacanattcaagcaattttt

SEQ ID NO: 5162 - DNA, 449 bp, Diabrotica virgifera
  Clone ID: LIB150-001-Q1-E1-E8
ggcgcataaatcgtttgaattttcaatattttttatgaaaatttttttacacgtacataattctttctctaataaatgacaattgacaaaaacaattggtatattactttttattttggaaattcccaaaaaagtgtatgattttcgtactttcacactaggatagccccttaatttcactgatttgttctatatattaatttttggacagttaggaaaattgataagatatacaatggtgtgttttgtacaaaaatgaaacccttgtttggtaagttcgggctcaatgcctagctaaatgagactgttatgtttttaagaaaaaccatcaatagtttagctcggattagaggaacttacctacgggacaatattttatttgttgataaatatttttgtttcgttgtgttagggaagtcatttctatgtaaaatacaagataatcgata

SEQ ID NO: 5163 - DNA, 395 bp, Diabrotica virgifera
  Clone ID: LIB150-001-Q1-E1-E9
gtaaaatcattctgtttatggcaggatcacatgattactgtagttctgagttctattggtattaaaacttactatctattaatcttcgaagacctttagctgtatttaactagattattgattatatgtccgcatacacatagccatcttctatttcttcgagtgcttccctgaataattgattagtagtggcgacagagtagaacgttgaagcactccaattttttacggaaatctctctatatagagatggatattattctgttatactggattattaatccagtattttggtcatcaggctcattctataagtttttaatgcttgactgtatcgaatatctttatgaagtcaatgcaaatgtgtctcacgtcctttggattaaaacctgaat

SEQ ID NO: 5164 - DNA, 334 bp, Diabrotica virgifera
  Clone ID: LIB150-001-Q1-E1-F1
tcgacccacgcgactggtgagtttccatcaagagaccgtttgtgttattatccaccttgatggctcttgccagtgtcagacctgaggcaggttacagttacagcccagcctccggctcctacggagctccatccggtggcggtggaggctttggacgcgggatcgggggtggccactgtggcggtggcattggctgaggtagcggattcggcggtggcggattcggtggcggaggtcacggacgcggtggaattggacgaagctgtatcagttgaggcagtattggacgcggaattggtagcggaagccgcattggtggcggccttggcggtgg

SEQ ID NO: 5165 - DNA, 328 bp, Diabrotica virgifera
  Clone ID: LIB150-001-Q1-E1-F12
atcagcacacttccaatctagcgttttgtcagttatcagtactcgccaaactgatgatgcagtcattaaagctggacgacgacatgttaatgacgatcttgacgatttatttataactattgatgagaacgcaaaatctgcacttcctcgtacaccaacaagtttggccaggttcaatttagtcacaagttcatccgtcacggcattgatgtatgatcctaatgatgtcagcctttccaattctcaaaaattcactgttaccaactactgaacatctgacacatcagttgacgtgacatacactgacagtcaagatcgttccaatgat

SEQ ID NO: 5166 - DNA, 425 bp, Diabrotica virgifera
  Clone ID: LIB150-001-Q1-E1-F3
cccacgcgtccgcccacgcgtccgctctcacgtcgttctctagccgcgcacagtgccaaactcatcctcatctcgcagcagcatgttcggaggtcttgaccccactgggctatattgagagattttgtgccatttttaacaagttctttctgatttttcgtaaatttaaacacgacattttcgcaatcatggacggagacaagttagattctaccggacagtactagtgtgtgacagttaacgaaaaaaagacttttaacgatgcagaaaacgggaagcaagggcctagaccccacaggactatactaaaattaaggatgtggccccaccgaagcaacggtggacgacaaacttccagttgccgcccgtaaagaacatgatcttggttcgacaaatacacagattaacatctcactgccacacaa

SEQ ID NO: 5167 - DNA, 453 bp, Diabrotica virgifera
  unsure (1)..(453): unsure at all n locations
  Clone ID: LIB150-001-Q1-E1-F4
ctcacttccatcttcgacgcagctaacagggatgtccaaactatcgtccgataatccgttgctaagtgcaaccaaacccatcgataacacacctatgttatcatgcaccaaaaaggaacctcaagaaccagaatattatcctcatataactaaagtatccgatgacggttccggatggtactcaaagaacaattcggttcatgtaaagaaagaaaaagaaaatgaatacgatacagaactacaagacttcgttaatttatttaagaataagatagttgtaggtgttttgtctggccgttcgatgagacagcctagttcgagtgatgaagtcgattgtagggcccaaaccaatggtaaaaactttaaaaagtttaaaaagataaagcctttacatcctcaaattaccgtcatangtaatgacttcttcaacaattcacaatttggcaatacaac

SEQ ID NO: 5168 - DNA, 355 bp, Diabrotica virgifera
  Clone ID: LIB150-001-Q1-E1-F5
cccacgcgtccgcagtttgttatttgtgaatcttttaaacttttttaaaacaatttttttgataaaatggaagttcaacagatagacattagattagattttaattctatgaagatagatttagtaaaagcaattcatgcttgtgcacaaaggggcttatatcattcggtgaagtggttatccgaaataaatttctctttaaaacacatacaactatccaaagaagacactgtggacatatcagacgatctagatgaagaagtagatgcctatttagtagctaagtcaaattttgatctgaaagaatacgatagatgttctcagttttggttaagactgtatgaaaacccaaatc

SEQ ID NO: 5169 - DNA, 409 bp, Diabrotica virgifera
  Clone ID: LIB150-001-Q1-E1-F6
atccgcccacgcgtccgggacgttttgcacgtaaaccagcagtatcccgtcctcgtaaacaatcaggtagcccagcaggtttaggacgtcgtccattccgtcgtccatcttgcaggccaatgatacgaccagcccatctttcaggtcaaggtggtcaacatccagcgcaacaagagcaccaccaagctcaacaacagcaccaccaagctcaacaacagcaccaacaaggtcctcaagctcgacaatgcagaccagcgcgcagaccaagaattgttatgcgccccgctgcccaacgtaaacccgttgctcatgatagatacacagttgctaatcatggaactcatgcttttaccgctcagatcgttcacgtgaaaggaggacagcacgagatagtacgcagtcaagttgt

SEQ ID NO: 5170 - DNA, 422 bp, Diabrotica virgifera
  Clone ID: LIB150-001-Q1-E1-F7
cgacgatgaaggtattagttcttctttctttagtcgcattcagcgctgctctaccaacacttcttggtagaaccgctctggtcaaagaagatggaactgttactctcaccgactctagaggataccaactggtaatcctcaagagtgttaccgatcccagacaagtcgaagttattctcaggagtccaaacacaagaacccagatgttccaagttggggaaccacttagaactagagaaactatcgaccgtactctcgttggagtttcagcttaccaaaactataaccaagctgatattcttactgatattttccgtcagtatgaaggtactcttgacgacaccaaatactacagccttcttaacagaatccaaatgttagttgaaactggactcattaatggaaacatctacgatatcatc

SEQ ID NO: 5171 - DNA, 162 bp, Diabrotica virgifera
  Clone ID: LIB150-001-Q1-E1-F8
aaccgatctaagtgtggtgtgtttcttatataattccaatgaacacataagaaaaggtgtacttatatgtgtattttattatgtatttgtttttaagtttatttttattcagttgctttaccatcacgcgactcataagaaatatattattttttgtttcat

SEQ ID NO: 5172 - DNA, 437 bp, Diabrotica virgifera
  Clone ID: LIB150-001-Q1-E1-G1
cccacgcgtccgatcaccaaaatgtgatctctcaacaagttgagcaattcattcaacaaggacaacgtcttccccaagacttgctttcccaacaagtattagtctaccaacaagttcgccaattgattaaagttttgagcacccaacaacttaacatgatcaacttcatccaatacctcgttgaacaaggtaatcaagttgatcaacaattgtacgctgttcaaagaaatttttaccaacaagtccaaagacttgttcaacaggtagttcttcaacaatctcaaatcaaagaacaaatccaggtacttatccaacaagaacaaactgttccacaagaactagttttattccaacaattggcctaccaacaagttgaacaattcatccaagtattgatcaagcaattcatctaccaacaggctagccttagacaatta

SEQ ID NO: 5173 - DNA, 69 bp, Diabrotica virgifera
  Clone ID: LIB150-001-Q1-E1-G3
cccacgcgtccgaaaaaaaaaaaaacaaaataaaaagaaggaaaaaaaaatcattagggagaaaatata

SEQ ID NO: 5174 - DNA, 215 bp, Diabrotica virgifera
  Clone ID: LIB150-001-Q1-E1-G4
ttaagcaacagtagactggatcctgaaacaatttagtccaatagacaagtgtgtcagcaacatttcggaactaaagagttttggaagtttgtaaaagattataaggtaatatttatctaaacaatcagccaacaagcctctttcaaaaaatttcagtgaactcgagtgagattagtgctttcaagtgacacatagcagatagtgtttaacagttt

SEQ ID NO: 5175 - DNA, 324 bp, Diabrotica virgifera
  Clone ID: LIB150-001-Q1-E1-G5
ctgaaggtggtctcgttattgacgacttggaaaacaacattgaagaacttctagactcagacgaaacagaagttgaaatagtcgttctggaaaacttttctttaagcccaagaactgctgtcactgttttgagtcaaaatgttgaaggaagcgatgaacatcctggaaagtacactgtaactaaccttggtaaagctgctttcgatattgagttgaagcgtacttcaccagttcagactctagaactccaccgcaaaaccgttgagcctaatacatctgagtcttttgaactcacagctcaattcaaacctaccgttttggaag

SEQ ID NO: 5176 - DNA, 449 bp, Diabrotica virgifera
  Clone ID: LIB150-001-Q1-E1-G6
ccacattaaaaaacaatataatggatcctgaaacaatttattccaatagacaagtgtgtcatcaacatttcggacctatatatttttggaagtttgtaaaagattataaggtaatatttatctaaacaatcatccaacaagcctctttcaaaaattttcattcaactcgatacagatcagtgctttcacgtgacacatagcagatagtgtttagcattttgaaaacaaattggaatatttgaagttttcagtaaaatatggaataaaacattgaattgtctttctgttgttttaatttcctgcgaaatttcatcaaaaatcccgcaaaatttataatttgaaattctgacgtaactaaaattgatcaatttagttcacattccaatcaagagatggcgttaattcgattcgaaagattaacatggtcgtgaaacgtctgtgagtatgta

SEQ ID NO: 5177 - DNA, 413 bp, Diabrotica virgifera
  Clone ID: LIB150-001-Q1-E1-G9
ccacgcgtccgaccaaatcttaaacctcagccatagacaagaagaacaacttggacaaggcagaccagtaccactaaaccaataccaagacattgataccaaccaaatcttaaacctcatctacaaacaacaacttggacaaggtagtgcttacccactaaaccaatacttggttagccaaagacaagttaatggacaacaaagactcaccgttcctgaacaattcgttaaccaagaagtgttaaatcaagtatacagcgaacaatccttaattaaccagagagcacaacaacttgtagaacagaaccaaccaatttctcaagaaatatatgtccaacagtatggtttgaacaaacaagtagatcagcttatccaatcattggtatatcaccaaaatgtgatctctcaacaag

SEQ ID NO: 5178 - DNA, 413 bp, Diabrotica virgifera
  Clone ID: LIB150-001-Q1-E1-H11
cggacgcgtgggctccaagatgaaggtactcattcttctttccgttgttgccttgagcagctgcttaccagcatccagaaatcaacaatacgttgatgtagactacaacagctacaacgctcatcccgtctacaacttctggaggacttggaatcagcaacactatggacaagaaccatggaaccaatgggtacaatatggtgtccagaaccaacccggtaactactggaggcagtacgtgcaacgcagcaaccaagctgaaaatgtcgatttaccttggatgtatcactcttgggatgtccaggatgtgcaaaacttaactcccgttcaacgtgttcagttgctactcaactacgtcagacttcaccaacaatggaaccaatggactcatgatgtaactgccaatgaacgtc

SEQ ID NO: 5179 - DNA, 327 bp, Diabrotica virgifera
  Clone ID: LIB150-001-Q1-E1-H4
ccaagcgtccgatcgcgagcggtcgccctttttttttttttttgtcttgctctatcttatagtttattatacatattaataacatctttagaatatacttattaataattaaacattagactacatacttttctagtaattggtaataatcctctatcacatatcatttattgaaattgcattagatccgcatctaaactaattctactccaatcgagcaacgataacgtattgtatatagaagttggtgttttttaaaataatagttgattaaaaagtgcagataagaatacatataatctaatggtaactatactatttaacatc

SEQ ID NO: 5180 - DNA, 150 bp, Diabrotica virgifera
  Clone ID: LIB150-001-Q1-E1-H5
ccacgcgtccgccacgcgtccgcggacgcgtgggctggtcattggtgtgggttaaggcaaccgaattataaaattaacctttaaattagaaaattaattccaaatggcttcacaaaacctttgtatggcggtccgcaacttcagcaccat

SEQ ID NO: 5181 - DNA, 223 bp, Diabrotica virgifera
  Clone ID: LIB150-001-Q1-E1-H7
cccacgcgtccgccacgcgtccgcggacgcgtgggcaaccacggaaaatctgatatagaagttgaggttacatacactgacagcgatgaccgtgccaatgatcaatataaggtagtcaaaccaaatgaaactgtaaaacttgaacataagaaagacgctggagtagctctgttaaatatattgaacagacattacacagactctgctattatcaccccaaagg

SEQ ID NO: 5182 - DNA, 429 bp, Diabrotica virgifera
  Clone ID: LIB150-001-Q1-E1-H8
atccgccacattaaaaaacaatataatggatcctgaaacaatttattccaatagacaagtgtgtcatcaacatttcggacctatatatttttggaagtttgtaaaagattataaggtaatatttatctaaacaatcatccaacaagcctctttcaaaaattttcattcaactcgatacagatcagtgctttcacgtgacacatagcagatagtgtttagcattttgaaaacaaattggaatatttgaagttttcagtaaaatatggaataaaacaatgaaattgccttccggtggtttaaattcccggcaaaatttcatcaaaattcccgaaaaattaataatttgaaattctgacgtaactaaaattgatcaatttagttcacattccaatcaagagatggcgttaattcgatccgaaagattaacat

SEQ ID NO: 5183 - DNA, 111 bp, Diabrotica virgifera
  Clone ID: LIB150-002-Q1-E1-A12
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 5184 - DNA, 326 bp, Diabrotica virgifera
  Clone ID: LIB150-002-Q1-E1-A3
gcagatcattgttgttctggtcgacactatcagatctaatgatccagtttacaatgcaactatgtaagaacccacttattcaaagagcttaccaagggattagctgccaaaggattaacagatgttgaaacccaccttattacctacggaggtgagaaccaatggcccagtcatgtcaccgttggtggaaagcttgttttcaaaggaaaagctcccgagattaaagtctccgaaaatccccaggaaccaccagttgttgttcaactatccaaatctgtacatgccctcagtactattcttagagacatcaagctggtccttggtca

SEQ ID NO: 5185 - DNA, 412 bp, Diabrotica virgifera
  Clone ID: LIB150-002-Q1-E1-A5
cccacgcgtccgattttgtttaggtttaatatattccagataaatgtagtgaaatgctttcttaatgaaaaattagagtttttttgaaagggccgtatacgagataaggtgaaaagataagacggatggttctcaatataccaaacggtattcatcaacattaacattcaaccctttcgtcaaaaatgttcatcaaaataaataaacgagcgtggatcaacttgtttatatttgtgatattaagtgtaactattatatttatgttctcagacgatcacgtaacagaaataagtattaagacaaatagtgaaataaaagagaaacatgccattatatcatataccataaataatacgactaagacgactgctactagtacttctacaactactaatactgctactgctacttc

SEQ ID NO: 5186 - DNA, 273 bp, Diabrotica virgifera; identical to SEQ ID NO: 5135
  Clone ID: LIB150-002-Q1-E1-B1

SEQ ID NO: 5187 - DNA, 392 bp, Diabrotica virgifera
  Clone ID: LIB150-002-Q1-E1-B10
gtagaagtagttgtgctcgtttaatttttaattgttttttacgaaagttgtgacttgtgaccatgtgtaaatttaaattggcgatgaaacacgcattacggggttaagttgatatgaaaataatggatagtgatgtacaaaattgtgtccttttaaacacgtttcatacccgaaagaaaaaattgaggataatttttcatcaaggaaatctcgtctgggataacgaaaaaccgccgtcagataagactactgttcctatagaaaatgtaatatctgtccaacagaattacaggaaaacgcatcctagtgaaactagagagttgaatcctaatgcattcactaaccattatgcagaaagagaaaaaaggcccagaatgggtctataaaaacct

SEQ ID NO: 5188 - DNA, 392 bp, Diabrotica virgifera
  Clone ID: LIB150-002-Q1-E1-B11
ggaaaatctcgctgtgaatcgcccaactcgcggcagtgcgattttatatattttttcgaataccacaacaacgttgcgatgacagtaagatcatcagctgatagtgagcttatccgtgaatttcgagtgataagagatgccatctgtatcggcccagatacttttcagtatagaagtaataggatcagtgtcaatcgggtagtgtagctttgcgcgactactatttttttgttttgtagtgctcaaaaaatggagagacacaattcggtggcgccccccgacggtggttgggggtggatggaggagtttggggccgctctcaataccatggtgaagcaagccatgtttgccaacttccgagtgataatcggaagagtacgaagaagaatcgg

SEQ ID NO: 5189 - DNA, 398 bp, Diabrotica virgifera
  Clone ID: LIB150-002-Q1-E1-B12
gtctagttcttctttccctagtaacccttagtgtcgctgcatactacccaagtactggtaggcaggtgacagtaggagtagctggaaatgtgaaactagtcggctctcaaggttcccagattgacattcgtagaagtccttacaacccaagaactgtcgacgtcaccctcagaagtccaaatgctccaaccagaactctgcaaattgatgaagccaggaacggccaacaacttggttattccaacctccaaggtgtcaacaaccaaggtgtcaaccaggctgatgttcttgctgatcttttcagtcaatatgagggtattgtagatgaccagaccttctatagtttgttgaacaaacttcaacatttggtacaagctggagtcatcaacagagtagtc

SEQ ID NO: 5190 - DNA, 391 bp, Diabrotica virgifera
  Clone ID: LIB150-002-Q1-E1-B4
atttaataagtagagcgatgtgttgtgataatggaaacagatgaagaaatttaaaagttggaaaaatgtttatcctggcaatatttatataccaaatgggatgatatccaaaaactaagtgttattcagtcactaacgtccctaatgcaaaaagatcgcaaagggactctcacaagaatcataccgaagattcaacaagaacttcctatcaatacatcctccgaatttcatttggccaccatcaacgtttttaaaatccttatcgagatgaaactcgatttaaacttgatgcggcctgtttttcaaagtatagacagtaaagatctcgttgtggcaactgcctggagcgaaaacttaatccaagtcaacaaatgtgtatcccaaaatgaca

SEQ ID NO: 5191 - DNA, 411 bp, Diabrotica virgifera
  Clone ID: LIB150-002-Q1-E1-B7
cccacgcgtccgcggacgcgtgggtagagccacatcagagattgttcagctctttaaatagctataattaccaatctcactcttgttatttcgttttagttaacctcattccaaatcgccaagatgagtttgcagtggacgataatcgccgggtttttgtacgcagaaatcgcagtagtacttcttttggtactccccgttgcttccccaagaagatggaactctttcttcaaatcgaagtttttgcaaggtttacagaagcaagccggattttacttcttgatgcttctgggcattctggtattgttccttcttgacgccattagggaaatgagaaaatattctaatctagaagctgaagaacatggccatgcccacctcgatcgtgagatgcaaggcagcatgagactc

SEQ ID NO: 5192 - DNA, 409 bp, Diabrotica virgifera
  Clone ID: LIB150-002-Q1-E1-B8
ggctacgaaaaagaagactatgtccccaaatgtgataattgcaaaacacgtttgccaagttcccaatcagacggaacagaaaaccaagttaaagatgatgccatacgaaaaaaagtctctcgaatatctttaaacgaagacaatagccctcaaacgtggtgcacaaaatggcacaatttttgtagaaactgcggaacacagctacaacacacgccgagtaaagaagaagtacagttcgagaaggtagtggtaggagcccatggtgatataaattcgaacgaatccggcctctttatgtacattgatttgcacgggcacgcgtcgaagaaaggtatctttatgtatggcaaccatttcgacgatattgaaaggaacgtggaatgcatgttgttacccaagttgatgagta

SEQ ID NO: 5193 - DNA, 239 bp, Diabrotica virgifera
  Clone ID: LIB150-002-Q1-E1-B9
agtaaattgaaatacgcgaagattttgtttgatgtgcatttcttagttagttaagaatttaacctattctgaagtttacttatttcccatggtagcttgcaccttgcagtgcgaagttacaattcagttgataatggtcacaaactttatattctccgtacgactctaaatctcattatacctgaacactgtccagcctagaagtaggcatacgtcgagcagcgagcccacctaaattc

SEQ ID NO: 5194 - DNA, 376 bp, Diabrotica virgifera
  Clone ID: LIB150-002-Q1-E1-C1
cggacgcgtgggttttgtgtatagtcgcgtctatcagtgcgttacccacggcacacgatgaagcgcgcggtaattcagttcaaaccgaacacgatcttttggatgccgtttacaacgactgccttaaaaaagactctatgtcttgtctgaagtataaagtttttaatttcgtggacaagatgatcggcaacaaggaaacaattacagtgatggatggggttcaattcgtcaaaactcccgggtggtaacaagatggtgctccacgcgctattagcagtgacgacactaacgaatctgtcaatttcaacaagattacatcgttcttggggtcccagacttttgaaatcgatttgaaagggagtgaagttgtcaacgc

SEQ ID NO: 5195 - DNA, 390 bp, Diabrotica virgifera
  Clone ID: LIB150-002-Q1-E1-C10
ggaaaatctcgctgtgaatcgcccaactcgcggcagtgcgattttatatattttttcgaataccacaaaaacgttgctatgacagtaagatcatcagctgatagtgagcttatccgtgaatttctagtgataagagatgccatctgtatcggcccatatacttttcagtatataagtaataggatcagtgtcaatcgggtagtgtagctttgcgcgactattatttttttgttttgtagtgctcaaaaaatggagagacaaaattcggtggcgccccccgacgggggttgggggtggatggtggtgtttggcgccgctctcattaacatggtgaaccaagccatgtttgccaacttcggattgatattcggagagtacctaaaagaaatc

SEQ ID NO: 5196 - DNA, 398 bp, Diabrotica virgifera
  Clone ID: LIB150-002-Q1-E1-C12
cggacgcgtgggtttcagagttcaccgttttcaagtaacctcttgaaatttcgcacaaaatgaaatttaaaattcaattgttatcaacgtttttgtgcaccagtttagtttatgcatacatagaggagcctggtccaagatacccaccaaccaaaggagagctttggccaaaaccataccatcaaattaaaaaccatagtttctttacagtcaggaaggagcacttcaactttaaaataatcaataacacgtgttcaatagtagaagaagcaattaagaactacgaatccatcattttctcaggatatactttgatgcaagaaaacttaaacctatccaatcatcatttagaaaagaaaccgtgggtaagtaatcccaaatacctgggaatattaaat

SEQ ID NO: 5197 - DNA, 405 bp, Diabrotica virgifera
  Clone ID: LIB150-002-Q1-E1-C2
ggagaaggaagggaaataggaaggtggttgtcttacacgccccactgccgaggctcattaatttctcttttgttgtctttcgtcttatagattcattttcatttaatatatacgattataaactatgtgcaacaaatcttagtttataagattcattcacttttaattgaaatatatttaaaatactcttgtcagtgacagttattgtagctttttttataaaatatataggacacttattcgcaagatatattcattaacagttaagacaattgtttgtataaaataattttagctaggttttttattgtaagcaaatgtatgtctaaaaaaattgacgggcaggaaagattttatgaagacaccgagttcatcactctttcgggctctcaaggtttattcatg

SEQ ID NO: 5198 - DNA, 391 bp, Diabrotica virgifera
  Clone ID: LIB150-002-Q1-E1-C3
ccgggaaatggaacggaaatatgaaggtggttgtcttacacgcccgactggcgaggctcattaagttctcttttgttgtctttcgtcttatagattcattttcatttggtatagacgattataaactatgggcagcaaatcttaggttagaagattcattcacttttagttgagagatatttagggtactcttgtcggtgacagttattgtggcgtgttttatgggatatataggacacttattcgcaagatgtattcattaacatttaggagaattgtatgtataaagttatttgagctagggtttttagtagtagcaggagttagtttaagggatgtgcttaacaggaatagtttttttaaggtttatgttttaaataggtctttaggg

SEQ ID NO: 5199 - DNA, 415 bp, Diabrotica virgifera
  Clone ID: LIB150-002-Q1-E1-C7
acaccgccttcaacatgaaacgatcccagcaagttacggtcactgaaaccaccccaggatattcagtggaaaagatgtattataaagaatacaaatatgaaaccgctttctccatttcgcagttatcgaaactggagaatttcgttttacctcctagaactactatcttagcattatctcagaacggaggagacaaggaagaagacaaaaagtatgtcgtcaagaatcacggaaaagctgatctttttgttgaggtaatacatctcaataaccaagatgatgctccacaatggtttgtagtccagccagaccaaaccactgagatagatattgaggacaatcttgaacaaagcgtgttgaaagtaagcaacaacagttacgaacaggaagtatcattttctgctaaaggtggtca

SEQ ID NO: 5200 - DNA, 158 bp, Diabrotica virgifera
  Clone ID: LIB150-002-Q1-E1-C9
cacaaacacatcccaactccggttcgttttggggtaaaactttttcgggtttaagcgatcacaagactcctgcaatgaggattttaggttaaagtacgcaccagtgtccaaggttttccttcctggattaccaaagaagaagatgttcgaaatctggg

SEQ ID NO: 5201 - DNA, 238 bp, Diabrotica virgifera
  Clone ID: LIB150-002-Q1-E1-D1
atcagttgtaaaagcaacatgaagattgtaagttatattttatttgtgcttggtcttgttgcattgggagtattccaagcggaagctgcaaaagctcctccaattaaacccattcttaaacacgttcatgtagacattcaccatcatgaccatgactaggaccataattaacacatttttcattaactttgttataacatgaataaaatatattcttacattgaaaaaaagagggaag

SEQ ID NO: 5202 - DNA, 390 bp, Diabrotica virgifera
  Clone ID: LIB150-002-Q1-E1-D10
gatgaaaagaaaaacattattatattctaatacaaaaacaagaacatcaaaaacaaattgtaacatttcttcgagaaaaaagcatttaaagttgggtattttgcgcagtagtaccgcgccgtatacgtataatatataaaacagaacgcatttaccgatcttgcgatattcaaatctctataactacggtaatattgctccaatgtactttaaatttggcgtgaatccttttgaagtactatacttttatacgagatagtataaaataccaaccgttaaccattttcacgtgaaactgtactccagaagttggttacatgtgtccacgcttcgcttttatacagaagtgaaaatacttaagtctcctttaacattggtaggcgagattcc

SEQ ID NO: 5203 - DNA, 373 bp, Diabrotica virgifera
  Clone ID: LIB150-002-Q1-E1-D12
cccacgcatccgcccacgcgtccggacatacagaaaatcaaagaagttttttttaaccatctcattcccttagacccggaagatttgctaaataaagtggataattttatcaaatttacacagccagatttgtctgcaaccgaaactttggcagtaaaggcgttcttttatttgcttattggtattttgggatccagcagtgttcaattgacatctcttctggttacagcgtctaccgaattaaatgcaggtgcaggattaggcagttcagcttcttttactgtatgcctttcagcagccctgctacagctaattaaatcaaaaataccagaggaatccttctcaattgaagggtagaaatcaatcagggggg

SEQ ID NO: 5204 - DNA, 410 bp, Diabrotica virgifera
  Clone ID: LIB150-002-Q1-E1-D2
cggacgcgtgggtttaaaataataaaatatttttaagtaaaagtaaagaaaaatttaatttaaggatagttaattagaatggtgagaaaaaatttaattttaagaaaagaaaaattaatttttggtacctggggtaccagggattattaattaataattatatattaataatttccgaatttaaaagagctaaaaaattaaaattttaatggtaaaataaatattttaaataattttttggtaaggaaaggtaatccgttttaaaaaaaaccaaattttttaggaaataaattaaatttatttattaccattatatttataattaaatattttaagataattagaattaaatatttttagggatgagcttaaaattaaaattttattaaaatttaatttttaaataaaaa

SEQ ID NO: 5205 - DNA, 398 bp, Diabrotica virgifera
  Clone ID: LIB150-002-Q1-E1-D6
ggactaaatatgaaggctttcgtttgtctgcttcttgtagctgctacagccagctatgtacaaggtggcttccttagcggcggaggcggtggcggctggtccggaggtggcggaggcggaggctggaaatcaggaggcggcggcggttggtcaggtggcggcggaggatatggaggcggcggtggatacggaggcggcggctggtccggtggcggatctagcggctggaaatctggaggaggcggtggatggataggcggaggtggtggaggatacggaggcggcggcggtggaggatacggaagcggcggaagcaccgttaaaataattaagatcctcgtaccaagcggcggaggcagcggcggcggtggccacggaggttggtccggaggcggcgg

SEQ ID NO: 5206 - DNA, 389 bp, Diabrotica virgifera
  Clone ID: LIB150-002-Q1-E1-D7
ggactaaatatgaaggctttcgtttgtctgcttcttgtagctgctacagccagctatgtacaaggtggcttccttagcggcggaggcggtggcggctggtccggaggtggcggaggcggaggctggaaatcaggaggcggcggcggttggtcaggtggcggcggaggatatggaggcggcggtggatacggaggcggcggctggtccggtggcggatctagcggctggaaatctggaggaggcggtggatggataggcggaggtggtggaggatacggaggcggcggcggtggaggatacggaggcggcggaagcaccgttaaaataattaagatcctcgtaccaagcggcggaggcggcggcggcggtggccacggaggttggtccgg

SEQ ID NO: 5207 - DNA, 406 bp, Diabrotica virgifera
  Clone ID: LIB150-002-Q1-E1-D8
tttcaaacggtcataatgtactaaaaaagcaatttaaaaccgtacaaaatgctcactatattatctttagatcaatgcatcttacttatttataacttagttacgtataataattcttatacaaacaatatttgttgatcaagttgggggaaataattcgcaaaaaatttatcaacacgcggcaaaagtgacgattattgaagagtgaaatttttaattgaagtaaattgatctggtgtgtttggattcgcagacaattgactggcagacaattatttattgtatttattgattaatttatttattgtacatttctgcactgccaaatactacgtttcttgcaagaggttgtacgtcttggtgatgaaaatggaagaattagttaaattcatcggtacctcggata

SEQ ID NO: 5208 - DNA, 400 bp, Diabrotica virgifera
  Clone ID: LIB150-002-Q1-E1-E2
ctcgtttaccaacagagattggtttaccaacaagttcatgaagtaattgaacgtttgacctaccaacaaatcttcttgaatcgcctagccgaaagcactgaagcaactgaagtcgatactatttccattcaaagatgggttgtacaacaaaatattattaacgagcagatccagcaattgatccaacaagttttgtaccaacaaactcacgtaaggcaacaaatccaagtattaattcaacaaggacatgttatcccacaggaacttgtcctctaccaaagaattacctaccaacatgttgaaaggtttcttcaagttttgattaaacaattcgtatatcaacaaacctactacaaacagttgatccaggtcttggcacaacaaaaacacaccattcccc

SEQ ID NO: 5209 - DNA, 406 bp, Diabrotica virgifera
  Clone ID: LIB150-002-Q1-E1-E6
cccacgcgtccgttttttttcaaagttttcaaaagatttttttataaatataatatacaattttcaatttcaatactgtattatggataattgacttagttatacagaatgtctttaatgtcatctccatatttaataagattgcaagagttaaaattatggcaaggattatgacaatttattgcaaaaacaacaagaaaattcgcaagaatgtatagatttatcagatattgattccctggatggtgtaacaccaataaacgaatcaaaatctccaagagtttcgaaagatatgaattgtgttgatttggacagacaagttatattgcccactacaaaaccctttaatgaattgcttgaagataaacttgcagatgaccagccatatttaccaccagccaaacga

SEQ ID NO: 5210 - DNA, 410 bp, Diabrotica virgifera
  Clone ID: LIB150-002-Q1-E1-E8
gagctttgatcgttacaagtggaatcgatcccaatcaaaatataaacaaaatgagttccaaagacaatagcgatgttgcagtcgacaaattagacaacgaaaaaagtacagatggcaaagcagagataaaaggaacgaagcgagcggcagaggacaaaacagaagaccccaaaaaagcgaaaaaagaagaaaatggtgcaaattcagacggtgaggatttagatgaggaagaagaagaggccattgaagaagaggaagacacgggcgaagaagacgtagttgaaggggatgatgaagaaatagaggctgaagatgaagaggatgtagagggcgagggtgtagaagaagaagaggatgatgacgcataataaagtgggtgccgtcaaaccctgtgaactttacttggcgga

SEQ ID NO: 5211 - DNA, 276 bp, Diabrotica virgifera
  Clone ID: LIB150-002-Q1-E1-E9
gagcattgatcgatacaagtggaatcgatcacaatcaaaatatagacaatgtgaattccaaagacaatagcgatattgcactcgacaaattacacaacgaaaaaagtacagatggcaaagcagagatacaaggaacgaatcgagcggcagaggacagaacagaagaccccaattaagcggaccgaaaagataatggtgcaaattcagacggtgaggatttagatgaggaataagaagaggccattgacgaagaggaagacacgggcgaagaagacg

SEQ ID NO: 5212 - DNA, 401 bp, Diabrotica virgifera
  Clone ID: LIB150-002-Q1-E1-F10
ccgttttggaagttatcaacacaagccacactgaagattggaattgagctgtgagttcaaaagactcagatgtattaggctcaattccaatctaccgttttggaagttatcaacacaagccacactgaagatgcagtttttagagctgaaggaggagatgttattgaagatcttgaggatttagttagaaatattgatgagcaaaaagaaactgttgttactcatattctaacaactttggagagcttccatttagtctcacgttcgtccgtcactgctttgatgtatgatcctaatgatgttaccctttccgaacatcataacttcactgttaccaacaatggacaatctgaaatagaagttgaggtgacatacaccgacagcgatgaccgtgccaatga

SEQ ID NO: 5213 - DNA, 403 bp, Diabrotica virgifera
  Clone ID: LIB150-002-Q1-E1-F2
cacaaaacgaagaaaagaccttggtctacgttttggtcaagaaaccagaagaaggccccgaaatcactattcctactgctgcaccaacacaacccagcaaaccagaagtatacttcatcagatacaagacccagaaaaccgccggaggtggaactggattcggaggtggaagcggtattggaggtggcattggaggcggtattggaggtggtattggaggtggtattggaggaggaatcggcggaggaatcggaggaggtgatggcattggaggaggcatcggaggtggtatcggaggcggtcacggaggcggaattggaggcggcatcggaggaggcggtatcggaggtgggatcggaggtggaatcggcggtggattcggcggtggtatttcatccagcta

SEQ ID NO: 5214 - DNA, 410 bp, Diabrotica virgifera
  Clone ID: LIB150-002-Q1-E1-F4
cggacgcgtgggctccaagatgaaggtactcattcttctttccgttgttgccttgagcagctgcttaccagcatccagaaatcaacaatacgttgatgtagactacaacagctacaacgctcatcccgtctacaacttctggaggacttggaatcagcaacactatggacaagaaccatggaaccaatgggtacaatatggtgtccagaaccaacccggtaactactggaggcagtacgtgcaacgcagcaaccaagctgaaaatgtcgatttaccttggatgtatcactcttgggatgtccaggatgtgcaaaacttaactcccgttcaacgtgttcagttgctactcaactacgtcagacttcaccaacaatggaaccaatggactcatgatgtaactgccaatgaac

SEQ ID NO: 5215 - DNA, 408 bp, Diabrotica virgifera
  Clone ID: LIB150-002-Q1-E1-F7
cccacgcgtccgcccacgcgtccgaatttttatgagggagaaacctcgaatcacacatatgtaaggataaatcatacatgaaaaaacagagactttgacagatcctagatgcgcaagcatgccagggatgatcaccacatacagtggaaggatgcatcaatgatcaagaaagaaacagagagcaaaaaatcagtaacagaaacaagcctaatcttacctaacgaagaagaatccatcaacagggtttagcgggctctggttgccaaatgctaaagtcagcaatacgataatatgcaccaacattaatgaataaacaggtcagagacacaccgtctgcaattggctgcatgtgcacacaggggtcacaatttgataatacgagggtacatcgccctcaaaatttcaact

SEQ ID NO: 5216 - DNA, 407 bp, Diabrotica virgifera
  Clone ID: LIB150-002-Q1-E1-F8
cccacgcgtccggcagatttatgaagaaataagtttttttttctgcttttgatttgaatgcttcgcgcattctaggttaattaaagttacatcttgataataaaaatatcgtaattatgaagaggcccaactttaaagtcggcgataaaatcttcgccaaagttaaaggatatccagtatggccagcacgcattgtctccgaagctggaaaaaagttcaatgtcttgttttatggcactggtgaaactggatgcattagtagtgaacacttgttctattacttgaaaaataagaaaaagtttcagaaaccattgaaaagacaagactacattgctgcttttaaagagatagaagacgctataaaaaaggatggcggagatggggatgaatctccagataaaaacgat

SEQ ID NO: 5217 - DNA, 359 bp, Diabrotica virgifera
  Clone ID: LIB150-002-Q1-E1-F9
cggaatgccgggactatccacgagtccgcccacgcgtccggcagatttatgaggaattaagtttttttttctgcattcgagttgaatgcgtcgcgcattcaaggttaattagagttacaacctgataatgaggatatcgtggttatgaagaggcccaactttaaagtcggcgataaaatcttcgccaaagttacaggatatccagtatgggcagcacgcattgtcgccgaggctggaaaagagttcaatgtcttgtttaatggcagtggtgagactggatgcagatagtagtgaacacttgttctattacgtgaaagatgagaaaagatttcagaaaccagttgaagatacaagacgac

SEQ ID NO: 5218 - DNA, 400 bp, Diabrotica virgifera
  Clone ID: LIB150-002-Q1-E1-G11
aacaactaaagaccagcgtcagcaatgaaatacttttacttgacatacgtcttgatcacttacttctactatataaatgccgaagagtctccaagtctagcagctcttgcaccaaaatgtgaatgcggggacatcattgacaagattctgtgccaattgacagaaaactctaaagaaattctcacactccaggtaaaactagtgtcaattagaaaagaatcaacagaacttcaaaacaacgtagctgagaacacgtgtctggttaactcgatcgaagcagacgtcacagtcattgaacaacaacagaaccaaactgtgaccgttgtcaataaccatacagctatcatcgtcgacattgagacaaacctagaagtcatcatccaggaacaaaatgtactcg

SEQ ID NO: 5219 - DNA, 402 bp, Diabrotica virgifera
  Clone ID: LIB150-002-Q1-E1-G4
gcgagcgggccctttttttttttttttttttttttttttttttttttttttttttttttttttttttttttttttttttttttttttttttttttaacggtagctttactttatttacccaatttaccaaatgttaaatatacaaaatacgcggataaacatttcacatttaacaaactatatttattatttaaagcccggaacctgagagcacttatacaatataataaaaacaaagattaactaaagaataattgtcatgaggtaatccagatgttgaaacttcaaaaatcctgtcggtaatccgaagttctcaacaacaaaaggtctacaagcgaaaaagatatcaaatgtgtcaattaacgggacaataattaaccaattcaagagtagaaaatattt

SEQ ID NO: 5220 - DNA, 408 bp, Diabrotica virgifera
  Clone ID: LIB150-002-Q1-E1-G5
caagaaacactgcatttaacctcatcttttaagttggattacaccaaagaaatgacaggtaatggttcctttctggcagatttaatcaattatacaactttagaggaaaacaatgacaattttggtgatgacagtgacagctatgaagacgtctataccttttacggacccttcagcaaggtggttaacatttttaaagatataattttaagtttattcatacttgttcttgactgtattctactgtatctattttgttcctttagtaaaattcgaaaaaaatacaacgtctatattttaaattttgttattttggatgcatttgcacagataaagtccatcattgattttttgtttatttatactttatctgtaaatcaatactacaagtttagctatgtaattttt

SEQ ID NO: 5221 - DNA, 399 bp, Diabrotica virgifera
  Clone ID: LIB150-002-Q1-E1-G6
acctcgtatgtgtgcaatgatgagcctccaatactgtggattggtccttttggcaggtcttttgttggtttccgcccaccctggaaccgactctaaggctgaagccaaggtatcttcagtagccgagaagaaacaggaaaaacgtggtcttcttgatctaggctacggtgggggacacgactttggaggaggacttgaacttggagggcatggtttggatttgggtggacatggtggtttcgacggaggatatggtggagggttaggtggagggtatggtggattagacgaaggtcatgttaagcacattaccatcaccaaagaagttaaagtacctgttcctgcaccatatcccgtacacatcgaaaagaagataacagttccagtgccagtcaaagt

SEQ ID NO: 5222 - DNA, 325 bp, Diabrotica virgifera
  Clone ID: LIB150-002-Q1-E1-G9
tatttatttagttcagcataataaaatattttttagtaagtgtacaaagtaatttcatttacagagaggtaattagtactgtgagagaagatttcagttttaaaaaggaaaaatttaattctatgtaccctgtcgtatcaaggattataagttaagaattatatatttagtatttgcgaatttaaaacagctatcatgattaaggtttttagtgtaaatggaaatacatttaaataatttttttgctaggaaatgttcctcggttttaaatatatccaattttttcggagataaattaaccttagttattagcatataatttaga

SEQ ID NO: 5223 - DNA, 231 bp, Diabrotica virgifera
  Clone ID: LIB150-002-Q1-E1-H2
gcaatgttgaaaggaaccctactcgccttggctctaggtggtatagccgccattgcaagaaaagccttgatgaccggtctgatctctcatcttctttctgttataattggactgaaagctattacccacaaccaatgtagctaccacgtacgagataatatccaagcctgtctaaatccactctaggccacactcaataggactcgacgaacaatccaattatggacattc

SEQ ID NO: 5224 - DNA, 407 bp, Diabrotica virgifera
  Clone ID: LIB150-002-Q1-E1-H3
cccacgcgtccggactagacacccttgagctattaacaagttttcggcttgctattgatcgactttttttcatacgcggaatccagacctattccgtatttctccatcttctgatccgtcggcatatatttctacttccaggtatgtaaactttccaatgtaatcttcatgtataatgttttgtgggactatatttcttctcgtctgtatcattattttgtgtttttttctgtgctaatttccagacctagccttttcgtttgatttttaactctgtgtaagtttcctgtgctcctgtccagtgccaggttaaacaatgatcttactagatcttactgctttagtccctgcgagattttgaaaaagtctgtccgctggttttgtagtcgtacacattccggagtttc

SEQ ID NO: 5225 - DNA, 184 bp, Diabrotica virgifera
  Clone ID: LIB150-002-Q1-E1-H4
cactagcaattcgaattagggagttcacaatgcactagtaaaaccccctactcatgcacttcacatcggattaaccggcacaagaacactatattgtcgatactcacccatgttacctactgcagttaccatcgattggctaccgatgtcaccattggtgaaaaacctgttttcaatagaaagc

SEQ ID NO: 5226 - DNA, 194 bp, Diabrotica virgifera
  Clone ID: LIB150-002-Q1-E1-H6
ccgggcgttaatacatgaacatcaccagcttgacaaatgacattggcatgaactgtcagcaggtcagtcaggaaacactaccgcgttaagcaaaaaatgaccagaaaactgttccacaaaaaaaagggtctaaacgcattattagagaattccacccaggcattataaaaacttcctcacaatcaccaagattt

SEQ ID NO: 5227 - DNA, 299 bp, Diabrotica virgifera
  Clone ID: LIB150-002-Q1-E1-H8
gaacaatgaatgcagcggaagaaatagggagtaaggctagcaataaacacaaataaaacaaaactacttatacaaaccagatcaaatagaccggcgcaacaacactttattgacgatatagaacatgtgaatagattcacgtacctaggaatggatctggttgcaagcaatgaagaagaaccgggaataaatagaaggcttgtgctggcaaataaagcccattttgcgataggccacatattcaaatcgcgagacgtgtaccgggaaacaaaactcccgggatataaaacaataatcac

SEQ ID NO: 5228 - DNA, 339 bp, Diabrotica virgifera
  Clone ID: LIB150-002-Q1-E1-H9
gtcatatactcgtattttatagtacaaaggaatttagcaattatttttgaaaaatgatgggtaataaattaatttgtttgatgatttgctttgcctgcatttcactgtatctgatggaatctgtcgaggcgaaaaattatgaccccaatcctcctcctcgttcgccttcacctcaagaacgaggtcgttcacgtaccgttccagcccatctgcaacaaaatggacagaatggtaaccaaaatgggaacgggcaacataacggtaatggtcacactaatggtaatggacaataaaatggtaatggacatcataaatgacgccgttaacaaatcagtactg

SEQ ID NO: 5229 - DNA, 377 bp, Diabrotica virgifera
  Clone ID: LIB150-003-Q1-E1-A9
aacacgcgtccgcggacgcgtggggtgatttctacaaaggcaagtgaaaagacagtaatttctacaagagtatcgtaaatttcttcaatttggtatctgatggtagtaattgcatcaattgtactttcccatctagtctcggacaaaggttttgatgttatactagaaatatgatttttcagtatagcccaacgataattagaagctcagaaaaagttgtaaatttttgccactaaggaaaagaaaggaactgcaaactgagtctttagcagcattgttcacgactaagttgagtgaatggctaaaacatgggacaaaaatgggtcaaatttttcaaagagctcaacaagctttaaaagattaccattgttgtgacg

SEQ ID NO: 5230 - DNA, 404 bp, Diabrotica virgifera
  Clone ID: LIB150-003-Q1-E1-B10
ccgtcgaagatatgaataaatttatgattatatgtatcttttgcttctgaatcatatacaattaagaaaaatcggtttgtcgaagaataaaagaaaattattaggggggcagagccccttttagacgtacggctatgatatatagatagagaacctactccatgttcggtcgagtaaacctgccaaatttcatgaaaatcggtcaagtggtttcggaggagtttggcaacaaaacctgcgaaagagaattttagatatatagatgtcaaaccacgaaatttgtttaagaagataacggttaaggataaaacggtgaaaatttaggattataagtatcttttgcgtcggaatcatggacaggtaagagaaatcggtttgtcgaaaaataaaactgaaatttaggg

SEQ ID NO: 5231 - DNA, 389 bp, Diabrotica virgifera
  unsure (1)..(389): unsure at all n locations
  Clone ID: LIB150-003-Q1-E1-B12
agtcaaaattgatcatttttttagaaatgatatattttttacataattctgatttttaatcccttttaacaaatttttgtgtaatagaaactttacagaaaatatgaagcgaggtcccctcaatcgtccccgcttatttaacgaagtgattgaagctattgcttctctaaaagaatcacatggctctacgaaggatangatcatggatcaagtggaaaccatcctgagtaaaagaataactcgtttgaagaatgacaaaacacagatacatagaactttgaaacatggcttaacaacgggcctaatcaaagttaaaaaccgaaaatatgttcttgggaataaacaaaaaggttaatggagcttttaagaaattaaaaatgcttggattc

SEQ ID NO: 5232 - DNA, 411 bp, Diabrotica virgifera
  Clone ID: LIB150-003-Q1-E1-B9
aagaaaagtgaaaatttaggattatatgtatcttttgcttctgaatcatatacaattaagaaaaatcggtttgtcgaaaaataaaaaaaaattattaggggggcagagccccttttagacgtacggctatgaaatatagataacaacctactccatgttcggtcgagtatacctgccaaatttcatgaaaatcggtcaagtggtttcggaggagtttggcaacaaagcctgcgaaagagaattttatatatatagatgttaaaccacgaaatttttttaaaaaaataacggttaaagatagaaaagtgaaaatttaggattatatgtatcttttgcttctgaatcatatacaattaagaaaaatcggtttgtcgaaaaataaaaaaaaaatttagggggttcaaaaccccc

SEQ ID NO: 5233 - DNA, 400 bp, Diabrotica virgifera
  Clone ID: LIB150-003-Q1-E1-C10
aacctgggcatcactcggaaaactgtcttttattctaaagaaaaaaaaatacccccaatacctaaaatcaagagtcttcaatcaatgtacactccctctcctcatatatggctcttagacatggacacatacaaaggaaaatatggaaaaaataaaaatatgaaacatgaaaaattccattaattacattatccaatcagcggactgagcaaattgacgtcattaaatctcgcataatatatgggacatcctgttaaaacaatacaatttctgtataatacaatacaataaaatttaaaattgattattaaaagtatataatacttacaaattcaatttaaatgtgcctaatcatttttttaagtactaaagaaatgagacaaaaaatgtattattaaaa

SEQ ID NO: 5234 - DNA, 372 bp, Diabrotica virgifera
  Clone ID: LIB150-003-Q1-E1-C11
ttttaaatatatcaaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataatattagtattaaaaaattgtatatttagtaaaaatatataggtttaataaaggaattcggcaacatttttttcacctgtttattaaaaacatgt

SEQ ID NO: 5235 - DNA, 358 bp, Diabrotica virgifera
  Clone ID: LIB150-003-Q1-E1-C3
gtcactgggaaacattcaaagacatttatcccaaaatgatagtccgactaaatccatagctgaaaaagaaatcatccggacaaaagtacattgcaaaaacgttcgtattggctcatacagatgtattcccttaaaagatatcctgatagattccgaagcggtaaccataaaagtttcgcattcgcacaaggaaaaaggggttaagacaataacgttcgcgaaatgtgacaccgtcaaagtattggtcagcttcaacagttccttgcctgtgatcctctactacctgaatccgtcagcagcctcccaagtaccgacagtgctggatatgatgacagacagtgactattactatgatccg

SEQ ID NO: 5236 - DNA, 85 bp, Diabrotica virgifera
  Clone ID: LIB150-003-Q1-E1-C5
tcggtcaaggcaaaaaagaagactccagcagctcatctgaagaaaatgtcagagaagtagcagaattattgagcaagaaattcaa

SEQ ID NO: 5237 - DNA, 288 bp, Diabrotica virgifera
  Clone ID: LIB150-003-Q1-E1-C7
tggataccccgttgacaccacagtatcctcatactaccaaatcacctggagcagtacccatacccttcaaaatccccttacggatatggatacaacaactacaacaatcttggtggatacggaggagcttacggtgtttaccaaggactctacccatcatgaattattgccactcctgccaaaccctggtccaacatgtggtcctccttgtgccaacaaaaaattgctggcatatcatacactccctcaatcgacaagacctactaaaaactgtagaaaaatatacct

SEQ ID NO: 5238 - DNA, 391 bp, Diabrotica virgifera
  Clone ID: LIB150-003-Q1-E1-C9
ttatgatatatggcatcaatccatccacggtcaaggttgtgtggcgatatgtgcagccatcattagaagaagaaccattacagggttataagattcgtgtatgggaaagtgatcaagatttgagcacagccaatgacacaataattccgtttggaggaaagctggagggatatgtgaataacctatctcctggaaaagtctacaaattgagagtgttggcgtactccaatggtggagatggtagaatgagctctccagcaaaagaattccaaatgggaaaacctcaatattttcgcagcgcagctactgacgtacaaaacagtgtaattatacttgctattgctctagcagcacacttcttctttacggagtcgtgacagtataacaaatt

SEQ ID NO: 5239 - DNA, 202 bp, Diabrotica virgifera
  Clone ID: LIB150-003-Q1-E1-D10
acgcgaccgtgagttctatggcgggtaacgaaaataaggtcaggatgatgatgagggaagagggcgaagcaccagctgccgctcctgctcctgccggttccaggtccgcctcagagagttcctccaataaggccataaggtctggttctaatgtcttctccatgttttcgcagtctcaggtagctgaattcagagaagcttt

SEQ ID NO: 5240 - DNA, 329 bp, Diabrotica virgifera
  Clone ID: LIB150-003-Q1-E1-E11
acacgcgtccgcggacgcgtgggcggactcgtgggttaatattaataatataaaatatttttagggatgagcttaaaaatatttaatagtaacaatataaatatatttataattaaatatttttatattattaatattaaatatttgtaagcacatccctatagatatttaacattaggactattacatatttttaaggatgatcttaaatgtaatgatttattcaaatttaacttatatataacaattacgattaaatattttcatatttcaatatatgttaatttttaattttatatattattatttttattatctagaaatttttt

SEQ ID NO: 5241 - DNA, 243 bp, Diabrotica virgifera
  Clone ID: LIB150-003-Q1-E1-E2
attaaaaatataaaattaaaaatttccaaatttaaagagcccaaaaatttaaaattttaatgggaaataaataatttaaaaaaattttttggtaaggaaaggtaaaccgttttaaaaaaaacccaattttttaaaaattaaattaaattaatttattaacatataattttaaattaataattttaaaataattataaataataattttaaggaagaaccttaaaattaaaatttaattaaaat

SEQ ID NO: 5242 - DNA, 223 bp, Diabrotica virgifera
  Clone ID: LIB150-003-Q1-E1-E6
aaaatttggccacctcctggggaattttcaattttttaaaggaacaagaatcaaccccggggaattttcaatggcaccagaatcaaccccggggaattttcaatggaaccagaataagttacgtaataaaacttccgtaaaatgaaggtgaaaagaaaacccaaaattaaatttaaaaattgggaaaatcccaaaacaaaccagaatcaaaatggtaaaaatt

SEQ ID NO: 5243 - DNA, 397 bp, Diabrotica virgifera
  Clone ID: LIB150-003-Q1-E1-F11
caaattaaaaagtttttcgttttcagtttgttggcgtaaaagtttaaaaagttttcagattgtacgtgtgtatcctcttatgtttaaaacagttattaaataggtatataattcagtgaaaaatggtttaagttcattgtgtatttggatatagttacaagaatttttttacctactgaaataaaatggactccaccagtaaatcaaaattaccaaaaaaatccaagattcctttgcaagaggtccaacagaacatcaataaacctgtaaaaattccttcatctactccgagaactgctggacgtttgcaaagtacgaatatctctgcgaatgttgcaacatcaagcacatctacaacaagtgcagcttctaatagatatgtctctggaagactaac

SEQ ID NO: 5244 - DNA, 319 bp, Diabrotica virgifera
  Clone ID: LIB150-003-Q1-E1-F5
cacgcgtccgaaaacccttattcaagagcttaccaatggattagctgccaaaggattaacagatgttgaaacccaccttattacctacggaggtgagaaccaatggcccagccatgtcaccgttggtggcaagcttgttttcaaagggaaagctcccgaaatttaattctccgaaaatccccaagaaccaccagttgttggggaactatccaaatctgtggaggccctccgtagtattcttagagacatcaagctgggccttggtcaagatcttcaagctaaaacctacactgaaggatacgagtatccattccgtgct

SEQ ID NO: 5245 - DNA, 65 bp, Diabrotica virgifera; identical to SEQ ID NO: 4700
  Clone ID: LIB150-003-Q1-E1-F9

SEQ ID NO: 5246 - DNA, 356 bp, Diabrotica virgifera
  Clone ID: LIB150-003-Q1-E1-G10
acccacgcatccggtgaatgttatggtcataattaagctaaatttaacaacacgctgaacattgaatattaagtaaaattgtgaaagaatcatggccggtgttgtaccaacagaatcagcatctggtcgaaaacaatggacattacgtgacaaatcccaatattcactcaatcgattaagaagtcagctatcatcagatggttgtcccgagtcacaagttgtcttagctaaacaactattggatgaagaatgcgaagttgaagctgatacaaaggaaaatgcttgcctgggagtttattggttaattaaaggatccaaacaaggcaacatcgaagcaactaatcttctaaaaggat

SEQ ID NO: 5247 - DNA, 403 bp, Diabrotica virgifera
  Clone ID: LIB150-003-Q1-E1-G11
cggacgcgtgggcaaaaagtgttataactttacattgttcaagattgggttattctggagtataattaaatactttgtgatggataaccgagtagcttcatgtcttaaaatatcgattttataaaaaaaacatttttcttatttggataattattcaattatcgttgacttcaatttaaagttttaatactttttggtagcactttcaataggttttcatattcatcatttaaatattttaagagttcatgatttcacgttttaagtgaatgtttgtcatcaacatgtattgaacacagattgtatgtaacaaggtattttttatggtaccggtaaaaatgtgatttttgtatataaaacgaataaaactactataataacaaaaaataaaaaaaaggggggg

SEQ ID NO: 5248 - DNA, 320 bp, Diabrotica virgifera
  unsure (1)..(320): unsure at all n locations
  Clone ID: LIB150-003-Q1-E1-G12
atcatctaataatgcctcccggcactcaagcgcgtttggtctgcgaatggccgcacctcaacctgngggacttagtcacaatcatccgctacgacccaacccaaggatattttgtccgaaccagctctagcctggaagagttttggattcctgctcacgttctagccaattacagtaggaaactatggtcttttaggttaaagaaaccaagaaaatctctggaaggaatcctctcggagaactcggaccgttgtgtaccagaatttcgtgatagactgaaagatattaccgttcagagtggatccaaggtggtgtttaag

SEQ ID NO: 5249 - DNA, 176 bp, Diabrotica virgifera
  Clone ID: LIB150-003-Q1-E1-H1
gacaaattatcagcacaacgcatgcgcacttttaaatgatataaatattatcgttagtagataaatatacaaagtatatttacctagtataatttaataattaattattaatagtaattaagagtaaatataccctgtagatttatctattaacggtattatttatattaagtgag

SEQ ID NO: 5250 - DNA, 254 bp, Diabrotica virgifera
  Clone ID: LIB150-003-Q1-E1-H3
aaaactagcccaaccagtaattgcacaagacgcgaagccagcagagcaagaactaccactaccagaccaacttcttcccacatcagaaaaacttcttccccaaaaacaagaaccattacctgccagcagcgattcctcatcagaatcttcctctgaaagcagcgatgagtctggagaaaagaaatcatcctccgagtcctcctcgagcgagaaagaatccagcgaagtaaaaatccaagaaaagaaacttgccg

SEQ ID NO: 5251 - DNA, 215 bp, Diabrotica virgifera
  Clone ID: LIB150-003-Q1-E1-H6
aaaacggcttattaataaaagaattattttagttaaaagctaaaattttttaaaagaacgagaagaccctaaagagttttaataaattaataataagtttttttaataataaatttaattaatatataaatttaattaattggggtgattaaaaaataaatttaactttttttaaaataataaattaattaataattttttgatccaattttttt

SEQ ID NO: 5252 - DNA, 401 bp, Diabrotica virgifera
  Clone ID: LIB150-003-Q1-E2-A1
aagattaatatatattaattaaatatttaatattttcgtatttgtaagggctaattttatttaatgataattgattagtattgagagagaataatttatttgtaaagaagtgttattcattttttgtaacatgtgtatcatggagaaataaataataattatatatttacaatatacgaatttataagaacttttatattattattattattgatttatagggatgaactaaaatttttttgttaagaaatgttaaacgtttatatatatatcaagattattaagttacatattatatttaatgattatcaatatatttataaataaatatttttatattataaatattaaatatttttatggatgatcataataattaaattttagtaatgatgaaaatt

SEQ ID NO: 5253 - DNA, 405 bp, Diabrotica virgifera
  Clone ID: LIB150-003-Q1-E2-A11
cccacgagtcaggtggtcaatgatattggcgaatgatgtgtaacagtatttcatgattttaacagactcataacatctggtgatgatgaagaatagctgttactgcagattgtcgacgctaatcgcaatcaagtccccactgagccaactaagaacgctgttctagaaagcatacagaattcatccatttccatcgtcaatatttagagacgtcatttttattatggtcttgtctagacaatgtacttaattttgagatggcttccaatgttaaataaacagatacattaagtttttgtatccgaacaggtgttgtgatttcttcaaatgtcgacaagcatattcacgtcttcagtcaatacacagttatgagcattgccatccaaataactttcggggttcata

SEQ ID NO: 5254 - DNA, 366 bp, Diabrotica virgifera
  Clone ID: LIB150-003-Q1-E2-A12
ccgggctttaccataatacaatattttttacgtaaaagtaacagaaaaattttatttaatgatagttaattagtattgtgagagaatattttatttttataaaagaaaactttattttttgtacctgtgctgtatcacggattattacttactcactatacatttattattttcgaatttaaaagagctacaaacttaaaatttttattgtaaaataaatattttaaataatttttttgtaatgaaatgtcactcgtttttaaatatatctaattttttaagacataaattaactttacttactaacaatatatttagtattaaatatttttatactattaatattaactacttttagggatcagc

SEQ ID NO: 5255 - DNA, 399 bp, Diabrotica virgifera
  unsure (1)..(399): unsure at all n locations
  Clone ID: LIB150-003-Q1-E2-A2
gcgtccagagcaatcctggttctagccttaataggcatttcagcatgcgcccgcctcgactacctacctccaggacgcggtaatgcaggtggtggtggaccaggtggttacccaggggccgtagcgcctggcactggcggcggtagaggcggtggttatcaaagtggatccggaagtggatatcaacgtggttccggaggaggataccaaggtggttccggaggtggatatcaaggaggccaatgaggcgcangcggtggttatcaatgcgggtcangacgtggaggctatcaaggtggttctggaggtgggtatcaaggaggtagtggaggcgggtaccaaggangtgcangcggataccaaggatgcggctgcggtgctggaggacaaggtggatac

SEQ ID NO: 5256 - DNA, 381 bp, Diabrotica virgifera
  unsure (1)..(381): unsure at all n locations
  Clone ID: LIB150-003-Q1-E2-A3
gacccgtcaggccacgagtccgggatttttgttcctaaatttagaaattattgggggagatttaatatgttttgtcataaaggccaatttactggcttacttgtattgaaatgtacttttagcaattctacactacgtgtgggatttaattgccagtgttatatgttggtaaaattgtgtaatttttgtgtaattgctactgatcagtctgggcgcccttttttcattttcagaagcacgtgcacgatgatcttgttgtaaccttttttgcatacagtgaaattancagtgcaattctgttttcatgcgggtgcctctttacaggctgtcacgccctaactcatgacggttcagctcagaaaatattaatgaagacctttg

SEQ ID NO: 5257 - DNA, 298 bp, Diabrotica virgifera
  unsure (1)..(298): unsure at all n locations
  Clone ID: LIB150-003-Q1-E2-A6
agccaagcgtccgtataggaataattcaattcatattgaacattaacatttctttaaaataatgggttaagtgaacattttataagtagtggagatagtaacgacattatattctgtaatttatgtcgaatttaaggacatatcattganacaattataggataatccacactaagatgtcaacaatggatgactcagctgataaggaagctagtgaagtcttacacacattgttagcagtacagagaattgaaaaacacgatgatgttgtagaaaaccatacatatcaaacttcgac

SEQ ID NO: 5258 - DNA, 341 bp, Diabrotica virgifera
  Clone ID: LIB150-003-Q1-E2-A7
ggacaacgtagatgaccccataattgcgatcataagaagaatatggtgcatcttcagactgttaggatttatatgcggattatgaatacgccattgtctaacaggatgacactcgcgaatatgacgtagttgatagcgatgattcaataatagatgctgaagatgtccacgatgtagaggccgaagttgttgactcagctgaggatgatgccgcataattcagtgggtgccgtcaaaccctgtgaactttatttggccgactagctcagttcaaagtctcgagttaccttgcgtacatcagagctgcagtttcagttagtccttgttcactgtgccataca

SEQ ID NO: 5259 - DNA, 401 bp, Diabrotica virgifera
  unsure (1)..(401): unsure at all n locations
  Clone ID: LIB150-003-Q1-E2-A8
acaaggtttattgacccaacaacaatatttacctcaacaatatctatctggggaataccttcttgaagatcaaatgaacactaaccaaatcttgagccaaatctacagacaacaacttggacaatctccattgaaccgttatttggtaaacatgagacttgtaaacggagagcaagtatacgaagttcctgaagaattcgttaacgttcaacttctcgaaaaactcttcgccaaacaagaattgatcaaccaagaattgactgaaatcaccgaaagaagacaacaagtcactgaagatgttcactatcagcaacanatgattaacgaacagatcganaaactgattgaacaattagcttaccatcaaaacctcattacacgtgaagttgaacaatacattg

SEQ ID NO: 5260 - DNA, 377 bp, Diabrotica virgifera
  Clone ID: LIB150-003-Q1-E2-A9
accacgcgtccgcggacgcgtggggtgatttctacaaaggcaagtgaaaagacagtaatttctacaagagtatcgtaaatttcttcaatttggtatctgatggtagtaattgcatcaattgtactttcccatctagtctcggacaaaggttttgatgttatactagaaatatgatttttcagtatagcccaacgataattagaagctcagaaaaagttgtaaatttttgccaactaagaaaagaaaggaactgcaaactgagtctttagcagcattgttcacgactaatttgagtgaatggctaaaacatgggacaaaaatgggtcaaattttcaaaagagctcaacaggctttaaaagaattacattgttgtgacg

SEQ ID NO: 5261 - DNA, 392 bp, Diabrotica virgifera
  Clone ID: LIB150-003-Q1-E2-B1
acggacgcgtgggtggacattttatgtcaatgctgaattagtgaagtgaatagtgttaaaaatatcttaaagtgattttagacttattttttacgcaaattaatatatttaagagtcggtttacttacttacatattattttttagtgtttaattacgattttaataggctacagtgcaattttaatttccaaggtcattaaaaatgattgatccagaattacaacaaattcaacttcaacaaggtaccatcgacaatcaaccgttgcctcaagagccaccttcaattcaaccgccgcctccgccagctacagaacatcctcaaacacccaatatgtttttacctaaccaaaattgggctaattacaataattatatgaattactatcaaca

SEQ ID NO: 5262 - DNA, 370 bp, Diabrotica virgifera
  Clone ID: LIB150-003-Q1-E2-B10
gacaatttaggattatatgtatcttttgcttctgaatcatatacaattaagaaaaatcggtttgtcgaaaaataaaacaaaattattaggggggcagagccccttttagacgtacggctatgaaatatagataacaacctactccatgttcggtcgagtatacctgccaaatttcatgaaaatcggtcaagtggtttcggaggagtttggcaacaaagcctgcgaaagagaattttatatatatagatgttaaaccacgatatttgtttaaaacaataacggttaaagatagaaaagtgaaaatttatgattatatgtatcttttgcttctgaatcatatacaagtaagaaacaacggtttgtccaaaaa

SEQ ID NO: 5263 - DNA, 343 bp, Diabrotica virgifera
  Clone ID: LIB150-003-Q1-E2-B12
agtcaaaattgatcatttttttagaaatgatatattttttacataattctgatttttaatcccttttaacaaatttttgtgtactagaaactttacagaacacatgaagctaggtcacctcaatcgtcgccgcttatttaacgaagtgattgaagctattgcttctctaaaagaatcatatggctctacgaaggatacgatcatgagatcaagtgggaaccatcctgagtaaaagaataactcgtttgtagaatgacaatatacagatagatatagctttgaaacatggcttaccatcgggcctaatcatagtaaaccacggtaaatatgttcttggtatgaa

SEQ ID NO: 5264 - DNA, 256 bp, Diabrotica virgifera
  Clone ID: LIB150-003-Q1-E2-B5
aggtttttagttattttaaatgcataccctctattctagcattggtaaacatcacttttatttaatgatcactaattagtatggtgagaggatattttatttttacgcacgtcacgctttatttttcgtaccttgtgtatcacggattcttacttaatagttacacctttatgatctttcgacttcaatcaaggtactccattaacacttgtattgtactgtagctatttcccttaatttttttgtaatggattgt

SEQ ID NO: 5265 - DNA, 428 bp, Diabrotica virgifera
  Clone ID: LIB150-003-Q1-E2-B9
gggccgacccacgcgtcaaagaaaagtgaaaatttaggattatatgtatcttttgcttctgaatcatatacaattaagaaaaatcggtttgtcgaaaaataaaaaaaaattattaggggggcagagccccttttagacgtacggctatgaaatatagataacaacctactccatgttcggtcgagtatacctgccaaatttcatgaaaatcggtcaagtggtttcggaggagtttggcaacaaagcctgcgaaagagaattttatatatatagatgttaaaccacgaaatttttttaaaaaaataacggttaaagatagaaaagtgaaaatttacgattatatgtatcttttgcttctgaatcatatacaattaagaaaaatcggtttgtcgaaaaataaaaaaaaaatttaaggggtgcaaagcccc

SEQ ID NO: 5266 - DNA, 385 bp, Diabrotica virgifera
  unsure (1)..(385): unsure at all n locations
  Clone ID: LIB150-003-Q1-E2-C1
agtcacaagtccggtttgaaacttgagacacataatgtcttcagatagttttaataatcattcagattgaaattanatgtataaatcaaacggtttagatacagttacgcgaacttggattagttgcaaagaaatatcaattcggtactacaccctggactacacattttaccggtagtttagaagcacggtgaccaggacgttatcagttggtcataattttaaatgcagtgtgttccagatatatttgattgtgcctattcgttttgcaaatatttagttgccactttatagccgcagagaaagacagagttcattgataatagcggtcatatagtggtactgggaatgttttgattgtatattgtatgtacttatgataaat

SEQ ID NO: 5267 - DNA, 410 bp, Diabrotica virgifera
  Clone ID: LIB150-003-Q1-E2-C10
gggccgacccacgcgtccagcctaagcatcactcggaaaactgtcttttattctaaagaaaaaaaaatacccccaatacctaaaatcaagagtcttcaatcaatgtacactccctctcctcatatatggctcttagacatggacacatacaaaggaaaatatggaaaaaataaaaatatgaaacatgaaaaattccattaattacattatccaatcagcggactgagcaaattgacgtcattaaatctcgcataatatatgggacatcctgttaaaacaatacagtttctgtataatacaatacaataaaatttaaaattgatcattagaagtatataatacttacaaatgcaatttaatgtgcttattcattttttaagtactaaagaaatgagacaaataatgtatta

SEQ ID NO: 5268 - DNA, 374 bp, Diabrotica virgifera
  unsure (1)..(374): unsure at all n locations
  Clone ID: LIB150-003-Q1-E2-C2
acgaagtatatcgaaacttgagaatttcgttttacctcctagaactactatcttagcagtgtctcagagcggaggagacaaggaagaagacaaaaagtatgtcgtcacgaatcacggaaaagctgatctttttgttgaggtgatacatctcaataaccaagatgatgctccacaatggtttgtagtccaaccagaccaaaccactgagatagatattgaggacaatcttgaacaaagcgtgttgaaagtgagcagcaacagttacgaacaagaagtgtcattttctgctaaaggtggtcacgttattgacgacatggaatacaacatggaagaacttcttgactcagatganacagaaactgaaatgaccgttt

SEQ ID NO: 5269 - DNA, 399 bp, Diabrotica virgifera
  Clone ID: LIB150-003-Q1-E2-C3
acccacgcgtccgcagaaactgggcaattctgtaactatcagtccgaaatctaaggaaccgtcactggcagacattcaaagacatttatccaaaaatgatagtccgactaaatcgatagctgaaaaagaaatcatccggacaaaagtacattgcagaaccgttcgtattggctcatacagatgtattcctttagaagatatcgtgatagattcggaagcggtaaccataaaggttccgcatccgcacaaggaaaaaggcgtaaagacaataacgttcgcgaaatgtgacaccgtcaaagtattggtcagcttcaacagttccttgcctgtgatcttctactacctgaatccgtcagcagcctcccaagtacggacagtgctggatatgatgacagacag

SEQ ID NO: 5270 - DNA, 275 bp, Diabrotica virgifera
  Clone ID: LIB150-003-Q1-E2-C4
acccacaagtccgtgaaaataaaaaaagtgtgaatattcctatcaattatagtttgcctgcggtagtttccactcgtgattaatttactcagtatatatgtaacgatagtttgatttacacaaaaaaaagttggttgcgtcagtgattataagttaattaaattttagcagacaatatttactgcggttgactggtaagcgcgtccaatgcacattgtttaacgacatctgagatactacatcacttttagtgaggagaatgtgtaatatgaaat

SEQ ID NO: 5271 - DNA, 428 bp, Diabrotica virgifera
  Clone ID: LIB150-003-Q1-E2-C6
aacggagtcgtcggtcaaggcatgaggcgagagactctgaggtagatcaacgagaagagaggtgtaaaatcagttacagtatatattgaagtttccgattgaacaacatccttcatcgtgtgttacactatggtcgctcattgcttaagcataatggccacacatggaagtaaaccttgcagatatctctggtaaatttaagtcatgcgttgactacatcaaacttggctcaagacattactgcactctcgacagtaacgactgtggctagatgttccatagcaagcatcgatcgaattgcctcatgtgtactagcacgaatcgagtgaccatcctgtgttggcccacataatcatagttgccgtaataatacaagcatgcattaccactgatgagtcaattttagaattgttgaccccaagtgccca

SEQ ID NO: 5272 - DNA, 405 bp, Diabrotica virgifera
  Clone ID: LIB150-003-Q1-E2-C7
acttcaacaacggtgttactcagtatggaaaccaacaaccacttagaaatcctggataccccgtagacaccacagtaccctcatactaccaatcacctgagcagtacccatacccttcatactccccttacggatatggatacaacaactacaacaatcttggtggatacggaggagcttacggtgttaaccaaggactctacccatcaggaattagtgccactcctgccaacccctggtccaacatgtggtcctccttggcccaacaaaaaattgctggcaaatcatacactccctcaaccgacaagacctactaaagactgtagaaaaatatacctctttaattattaagttaaaaaaagtaataaaagttaaaaatactttgttaaaaaaaaaaaaataaaa

SEQ ID NO: 5273 - DNA, 390 bp, Diabrotica virgifera
  Clone ID: LIB150-003-Q1-E2-C9
attatgatatatggcatcaatccatccacggtcaaggttgtgtggcgatatgtgcagccatcattagaagaagaaccattacagggttataagattcgtgtatgggaaagtgatcaagatttgagcacagccaatgacacaataattccgtttggaggaaagctggagggatatgtgaataacctatctcctggaaaagtctacaaattgagagtgttggcgtactccaatggtggagatggtagaatgagctctccagcaaaagaattccaaatgggaaaacctcaatattttcgcagcgcagctactgacgtacaaaacagtgtaattatacttgctattgctctagcagcacacttcttctttacggagtcgtgacagtataacaaa

SEQ ID NO: 5274 - DNA, 372 bp, Diabrotica virgifera
  Clone ID: LIB150-003-Q1-E2-D1
cccacgcgtccggaaaaacctgggaaaagcggcatggaaagttttattgaatatcttcagtttgttaaaaaatctctggagaatctagacagctttggggaaattcacattgtacttggaaacgaatcctgtgatatagactccagtgtttcagctacagctttagcatatcttttacatatcagtagacctaagcacatttccaaagaagcactggtagttgctgtacaaaatgttccagctgaaaactttttatttagaacagacaactgttttttgtatagagaaatccagctacctctggattatttagtatgtagggatcagatagactttgattatttagtgaaatcaaaaaaagtgactactact

SEQ ID NO: 5275 - DNA, 328 bp, Diabrotica virgifera
  Clone ID: LIB150-003-Q1-E2-D2
acccacaagtccgcagcaactagcaatggtcctgtcagcttacctcaggtctctccagcaggccaaaattctcaaactaatcaatttaatgatatgcttaaacaaaaccgaataccaccatcaccatctagctttgttcaacatacacaaagcatgtcacaatcaaatcaacaaaatgttgctcaaaatagtacttctcgaatacctaccacttcatcagattccgttgcaacacctctggctaccagtgctggtcctaagtctgtcagttcttcaaagggtgcatcaccagctcctgcaactccagtacaaccttctcatcagctat

SEQ ID NO: 5276 - DNA, 410 bp, Diabrotica virgifera
  Clone ID: LIB150-003-Q1-E2-D3
acggaggtggtatcggtggcggtcacggaggcggaattggaggcggcatcggaggaggcggtatcggaggtggaatcggaggtggaatcggcggtggatccggcggtggtatttcatccagctacggcccacctggcaaatccggtccatactaattttcttactaagttacctctgcagtggttgccttccagtaactgctgcactacagtttgctgcaaaccacttcatccgctatttgtattttacccaacatagtattgtagattttaggacctaaactgagatgcgttcattggaaagatccgaggtaatcgttgtcgaaagctgaccatccaccccccaaaaaatatggcaattggttacgaagtgacacctaaaggcgcgcaaagtttggaaaaaagaccaaa

SEQ ID NO: 5277 - DNA, 410 bp, Diabrotica virgifera
  unsure (1)..(410): unsure at all n locations
  Clone ID: LIB150-003-Q1-E2-D5
acccacgcgtccgcagaaactgggcaattctgtaactatcagtccgaaatctaaggaaccgtcactggcagacattcaaagacatttatccaaaaatgatagtccgactaaatcgatagctgaaaaagaaatcatccggacaaaagtacattgcagaaccgttcgtattggctcatacagatgtattcctttagaagatatcgtgatagattcggaagcggtaaccataaaggttccgcatccgcacaaggaaaaaggcgtaaagacaataacgttcgcgaaatgtgacaccgtcaaagtattggtcagcttcaacagttccttgcctgtgatcntctactaactgaatccgtcagcagcctcccaagtacggacagtgctggatatgatgacagacagtgactattact

SEQ ID NO: 5278 - DNA, 381 bp, Diabrotica virgifera
  Clone ID: LIB150-003-Q1-E2-E11
cttggttaattataataatataaaatatttttagggatgagcttaacaatatttaatactaataatataaatatatttataactatatatttttatattatcaatattaaatatttttaagcacatccctaaatatatttaaaattactcatattagatatttttagggatgagcttaatattaatcttttattaacatttaatttttaaatattaattaggattaatacttttcatattttaaaatatgtcagtatatagttttatatattactatttttatcttctagaaattttttactagactatcaagtttaaattagttagatttactagtgctgataatattagtattaagcaactgtatatttactatgaata

SEQ ID NO: 5279 - DNA, 357 bp, Diabrotica virgifera
  unsure (1)..(357): unsure at all n locations
  Clone ID: LIB150-003-Q1-E2-E2
ttaaactaataaaatattttttagtanaagtaaagaaaaattttatttaatgatagttaattagtaatggtagaaaatattttaattttaaaaaagaaaaatttattttttgtaccttttgtttcaaggattaataattaataattatatatttattattttcgaatttaaaagagctaaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttaaggatgagctt

SEQ ID NO: 5280 - DNA, 424 bp, Diabrotica virgifera
  Clone ID: LIB150-003-Q1-E2-E6
acgatttgtgataattttcagttcagtgatagtaatgaaaataatatgaagatggcatattttgtcaacttcttggtgatttttcatttttttaatgcatcaagattcatctctggtgatttttcaatgcatcaagattcatctctggtgatttttcaatgcatcaagattaagtaccgtattacactttcgttaaattgatgttgagaagaaatccaaaatttaaatttaaaatttggaacattctcacatcaatcatgatcgaaaatgtaaatattttaattcaaggttccaaagttatatttttaattttggaaccatttgcatattggcgaaagaattcgttttatagaacaatttatttaaattgtccgttttgttcgtttataaatttggatcttcaaacccaggtgatcatagttgc

SEQ ID NO: 5281 - DNA, 416 bp, Diabrotica virgifera
  Clone ID: LIB150-003-Q1-E2-E8
gaggatcatttgtaagagaagattccctacgtcgcatactttctcagcagcgttaagaatcttagttcaggaatgaccctagtaccataaacaagacgaagagagtatactaatctcattcagtattgtccattgtcacactcggtcagtacttcagatctgatggtaaaataagcagcagttatcatgcattttgtactacggtcagtagttacattattccattgtttgaatgaagaactgtacgagattgaatataatcctggaacatcattccattttttacagaacgttagtacataagttgtttaataattaagcttgtaacaatgtttctaagccaggatagttttgagtactacctcgtgtgtgatcgagattgttcctcttagtacaaaattttaacttccaagaat

SEQ ID NO: 5282 - DNA, 420 bp, Diabrotica virgifera
  unsure (1)..(420): unsure at all n locations
  Clone ID: LIB150-003-Q1-E2-F11
gggtcgaccacgcgtccacaaaataaaaagtttttcgttttcagtttgttggcgtaaaagtttaaaaagttttcagattgtacgtgtgtatcctcttatgtttaaaacagttattaaatacgtatataattcagtgaaaaatggtttaagttcattgtgtatttggatatagttacaagaatttttttacctactgaaataaaatggactccaccagtaaatcaaaattaccaaaaaaatccaagattcctttgcaagaggtccaacagaacatcaataaacctgtaaaaattccttcatctactccgagaactgctggacgtttgcaaagtangaatatctctgcgaatgttgccacatcaagcacatctacaacaagtgcagcttctaatagatatgtctctggaagactaacaagaa

SEQ ID NO: 5283 - DNA, 430 bp, Diabrotica virgifera
  Clone ID: LIB150-003-Q1-E2-F2
ggccgacgcacgcgtccaaaaatgtgaaactataccccacgtggttccactattagcggtaccactaggaaataataaggtttgtagacgcaaagaagacgaacattcacctcaaagtaactttaaaacgtgaaactatacccgacgtggtaccactattagcggtaccagtaggaaataggagtagaggtagtccaagactgcgcaaggaagatcagcgcagcaaactggcaacggttcaactagggatgtagcatcagtcctgatgatacccgatgtggcggacggagttcactggctaggtactggcttaccaaatttttcaatttctaaagtaactgggttgtcacaaatgcttcggaggcatgtgaagcccgtcagcacggctacgtagtagtcgttacactaaaacctgagcccagagatgaca

SEQ ID NO: 5284 - DNA, 406 bp, Diabrotica virgifera
  unsure (1)..(406): unsure at all n locations
  Clone ID: LIB150-003-Q1-E2-F3
acttcaacactatggcattttttaagctagctggtttgtttttgtgtatagtcgcgtctatcagtgcgttacccacggcacacgatgaagcgcgcggtaattcagttcaaaccgaacacgatcttttggatgccgtttacaacgactgccttaaaaaagactctatgtcttgtctgaagtataaagtttttaatttcgtggacaagatgatcggcaacagggaaacaattacagtgatggatggtgttcagttcgtcaaaactcccggtggtgaacaggatggtgctccacgcgctattagcagtgacgacactatcgaatctgtcattttcaacacgattacatcgttcttggggtcccatactttgaaaatcgatttgaaaggtantgaagttgtcaacgcaat

SEQ ID NO: 5285 - DNA, 420 bp, Diabrotica virgifera
  Clone ID: LIB150-003-Q1-E2-F5
aaaaaccccttattcaagagcttaccaagggattagctgccaaaggattaacagatgttgaaacccaccttattacctacggaggtgagaaccaatggcccagccatgtcaccgttggtggaaagcttgttttcaaaggaaaagctcccgaaattaaattctccgaaaatccccaggaaccaccagttgttggagaactatccaaatctgtagaggccctccgtagtattcttagagacatcaagctggcccttggtcaagatcttcaagctaaaacctacactgaaggatacgagtatccattccgtgctcacgccgttaaaattatcctggccgttactagcaaaccatgcgaagtaggcaagctgtatccattacagaaattgagaactcttctcttcaaaaacaaccaaatctccc

SEQ ID NO: 5286 - DNA, 399 bp, Diabrotica virgifera
  Clone ID: LIB150-003-Q1-E2-F6
accaagatgaaggtactcattcttctttccgttgttgccttgagcagctgcttaccagcatccagaaatcaacaatacgttgatgtagactacaacagctacaacgctcatcccgtctacaacttctggaggacttgggatcagcaacactatggacaagaaccatggaaccaatgggtacaatatggtgtccagaaccaacccggtaactactggaggcagtacgtgcaacgcagcaaccaagctgaaaatgtcgatttaccttggatgtatcactcttgggatgtcgaggatgtgcaaaacttaactcccgttcaacgtgttcagttgctactcaactacgtcagactttcacaacaatggaaccaatggactaatgatgttactgccaatgaacgt

SEQ ID NO: 5287 - DNA, 443 bp, Diabrotica virgifera
  Clone ID: LIB150-003-Q1-E2-F7
ccgggccgacccaaacgtccaccaagatgaaggtactcattcttctttccgttgttgccttgagcagctgcttaccagcatccagaaatcaacaatacgttgatgtagactacaacagctacaacgctcatcccgtctacaacttctggaggacttggaatcagcaacactatggacaagaaccatggaaccaatgggtacaatatggtgtccagaaccaacccggtaactactggaggcagtacgtgcaacgcagcaaccaagctgaaaatgtcgatttaccttggatgtatcactcttgggatgtccaggatgtgcaaaacttaactcccgttcaacgtgttcagttgctactcaactacgtcagacttcaccaacaatggaaccaatggactcatgatgtaactgccaatgaacgtcttcagaatatgttgtatcaacac

SEQ ID NO: 5288 - DNA, 65 bp, Diabrotica virgifera
  Clone ID: LIB150-003-Q1-E2-F9
aaaaaaaaaaaaaaaaaaaaaaaaaaaaaaaaaaataaaaaaaaaaaaaaaaaaaaaaaaaaaaa

SEQ ID NO: 5289 - DNA, 288 bp, Diabrotica virgifera
  Clone ID: LIB150-003-Q1-E2-G10
acccaagcgtccggtgaatgttatggtcataattaagctaaatttaacaacacgctgaacattgaatattaagtaaaattgtgacagaatcatggccggtgttgtaccatcaggatcagcatctggtcgaaaacaatggacattacgtgacacttcccaatattcactcaatcgattaagaagtcagctatcatcagatggttgtcccgagtcacaagttgtcttagctaaacaactattggatgaagaatgcgaagttgaagctgatacatacgaaaatgcttgcct

SEQ ID NO: 5290 - DNA, 382 bp, Diabrotica virgifera
  Clone ID: LIB150-003-Q1-E2-G11
acggaagcgtgggcaaaaagtgttataactttacattgttcaagattgggttattctggagtataattaaatactttgtgatggataaccgagtagcttcatgtcttaaaatatcgattttataaaaaaaacatttttcttatttggataattattcaattatcgttgacttcaatttaaagttttaatactttttggtagcactttcaataggttttcatattcatcatttaaatattttaagagttcatgatttcacgttttaagtgaatgtttgtcatcaacatgttttgaacacagattgtatgtaacaaagtattttttatggtaacggtaaaaatgttatttttgtatataaaacgaattaaactaacaatattac

SEQ ID NO: 5291 - DNA, 411 bp, Diabrotica virgifera
  unsure (1)..(411): unsure at all n locations
  Clone ID: LIB150-003-Q1-E2-G12
atcaactaataatgcctcccggcactcaagcgcgtttggtctgcgaatggccgcacctcaacctgngggacttagtcacaatcatccgctacgacccaacccaaggatattttgtccgaaccagctctagcctggaagagttttggattcctgctcacgttctagccaattacagtaggaaactatggtcttttaggttaaagaaaccaagaaaatctctggaaggaatcctctcggagaactcggaccgttgtgtaccagaatttcgtgatagactgaaagatattaccgttcagagtggatccaaggtggtgtttaagtgtagagtgaagaattggaataggaacacgaggcaaacttggaagaagatggaaccanatgtcgtagtcctacataacggcaagtttgtgc

SEQ ID NO: 5292 - DNA, 402 bp, Diabrotica virgifera
  unsure (1)..(402): unsure at all n locations
  Clone ID: LIB150-003-Q1-E2-G2
agaggatcatttgtaaaataagattccctacgtcgcatactttctcagcagcgttaagaatcttatttcaggaatgaccctagtaccataaacaagacgaagagagtatactaatctcattcagtattgtccattgtcacactcggtcagtacttcagatctgatggtaaaataagcagcagttatcatgcattttgtactacggtcattatttacattattccattgtttgaatgaagaactgtacgagattgaatataatcctggaacatcattccattttttacataacgttagtaaataagttgtttatcaattaagcaagtaacaatgtttctaagccaggatagttttgagtantatcccttgtgtgatctaaattgttcctcctagtataaattt

SEQ ID NO: 5293 - DNA, 292 bp, Diabrotica virgifera
  Clone ID: LIB150-003-Q1-E2-H1
aatttaagaaaaatctttattgaatgctgttagcatccagtattaagtgcgttcgcggtgcctgtcggcgtctagtcggcgacaaattagcagcaaaacgcatgcgcactttaaaatgatataaatattatcgttagtagataaatatacaaagtatatttacctagtataatttaataattaattattaatattaattaaaagtaaatataccttgtatatttatctattaacggtataatttatattaattgaggttagaaattgtcggcgaaaatttgtcaactgtacc

SEQ ID NO: 5294 - DNA, 362 bp, Diabrotica virgifera
  Clone ID: LIB150-003-Q1-E2-H12
ttatgttaaaatcttaacataattcttagtccgtgtcaatccgtatattacttaccgagagtcaagtattattgcgtcagagtctttcatatgcatagaagtcaaatctatctttagtaccttgtgtctcagggcttactaattactaagtacctatttattactttcgaatttaattcagctaacaacttgatacttttattgtacgataaatcttttacgtaatttttttgtcatgacatgttacacgtgtttaaacatatcgaattttttatgaagtagctcatattcctcgagtaacaagatgttgaaaccaacgtacttgtcaaggagcattctgaaacatttttagggatgagctc

SEQ ID NO: 5295 - DNA, 400 bp, Diabrotica virgifera
  Clone ID: LIB150-003-Q1-E2-H3
atttttatatcacgggttattttttcgtgtgttgcgctcatcgacaatacaaaaagaatgaaacttatcggaggattattattaaatagccacagctctggcatacccagtagcggaaaatgaagaaaaactagcccaaccagtaattgcacaagacgcgaagccagcagagcaagaactaccactaccagaccaacttcttcccacatcagaaaaacttcttccccaaaaacaagaaccattacctgccagcagcgattcctcatcagaatcttcctctgagagcagcgatgagtctggagaaaagaaatcatcctccgagtcctcctcgagcgagacagaatccagcgaagtaaacatccaagaaaagaaacttgccgaacctctcccagctatcaaa

SEQ ID NO: 5296 - DNA, 409 bp, Diabrotica virgifera
  unsure (1)..(409): unsure at all n locations
  Clone ID: LIB150-003-Q1-E2-H4
aacggtgtggtgctagtttgcaacaagtgtgactgttttttgaatttttaaccagttctgtattgtaggaagtttaattgcgcaacttttatgtcagtacaacttttctcgaaaattaataatttaaagttatattcaaaaaacgaagagaaaaatcgaatttgtccttcattttttgacattttgattatttaaacaatgttcctgacatttttgatacggaggataactcaaatattgttgtttgagttatttttaagcaatttctgcaaaaaagggttgagtcactctcaacgtcaaaatgtactaataattttacagatgcgccctggtctatatcctgatagagggataagtagtaatagctggtgctgtaaatatattgaaacatacntatctgttagttttt

SEQ ID NO: 5297 - DNA, 348 bp, Diabrotica virgifera
  Clone ID: LIB150-004-Q1-E1-A10
aggacgcgtggggtggccgtcgaacctgttggtacattccaccaattgttcgttgtagtatgaattgatattccaccagttgaaaatgcggttatattcgaaaccatcaaacctgtgctcgtgaccaatgattgtagcatccttagtctcgattcagacaattcgagattcctcacggataaatgcaacattaacttcaacttcaggacggttgattgagccaacaacagtatttgccccatcagtacctatctagagaatcccttcttgaagatcagatgaccactaaccaaatcttgagccaaatcgacaagacaccaacttgtgaaatcgccattgcaccgttat

SEQ ID NO: 5298 - DNA, 159 bp, Diabrotica virgifera
  Clone ID: LIB150-004-Q1-E1-A11
aatggcgcgtggggtcgccgtccaaggtgtgtgtgtccttcgcgattttgctggtctggtaggagatgttctgcctcttggtcaggggttgcggtatggtgtccaggcaacctgagtctcttgtccagtgtgtgttgcaggcttatgctcttctcaggc

SEQ ID NO: 5299 - DNA, 182 bp, Diabrotica virgifera
  Clone ID: LIB150-004-Q1-E1-A3
caaatctagccaaaagctagtgttatagtcacatactcacaccatgggttctcgttttttgattgcttcattccttgtgttaacccttctaggactctgtttaacaggtggtcaacggggaggagaacacaaacgagtcatcatccacgtcccattcaaagtgaagcacattcaccacaccc

SEQ ID NO: 5300 - DNA, 286 bp, Diabrotica virgifera
  unsure (1)..(286): unsure at all n locations
  Clone ID: LIB150-004-Q1-E1-A5
aggaacatgaagtacttagtgttagttagtgtaatttttttattatccgacgtcaggaccganacgacgcccgtgtatggtggattgcagattttgacgaaggtgtttcggcagtatttgaagagtcagccagatgatgtcaaattgggagatggcgttcatattgtcagcgtcaagagtgaaaacgatgcgaaggctagtgtggatgatggaaacgtcttaagggtcattgaacattaccttgaaaatcatgagttgagaattcaactgccggaactgatgccgg

SEQ ID NO: 5301 - DNA, 264 bp, Diabrotica virgifera
  Clone ID: LIB150-004-Q1-E1-A7
atatattatacacgacatacccataatatgatctactgaattatttttttattataacacaagtgcgaaatatcatatacagattagttgagagttgagttagtgaataaacttacgaaacagattgtcaacgaggcgagagagttattgacgaatatcagcacagcagccgtatgaatgcagttttagtctactctgaaccaaaatgggaataatattcagtgcgaaatgtacatctaccaataggctcgatggaaaaacagc

SEQ ID NO: 5302 - DNA, 272 bp, Diabrotica virgifera
  Clone ID: LIB150-004-Q1-E1-A8
gtacacgacatactgattacatgatctactgaggtactttctcagcacctgacaagtgcgatatatcagctgccgattctatgacagttgtgtgtaagcgggtagctacgacagaggttgtcaacgacgcgagagagttactgacgagtatcagcacttcagtcgtatggatgcagttttagtccactctcatccaggatgggaatatgtactcagtagcgatatgtgcatctaccagtatgctcggtggaaaaccagctattaccacagga

SEQ ID NO: 5303 - DNA, 362 bp, Diabrotica virgifera
  Clone ID: LIB150-004-Q1-E1-A9
acggacgcgtggggtccccgtccaaggagtacgtaccctccgccaatatgctggacaagtaggaaatgttatgcctcttggacaaaatttggaatatggaaaccatagaacctgggctcttgaccaaggtttgttgcaaacttattctccactcagacatttccaaactcttctcggacaaatccaacaacaacgtcaacttcaacaaggtttattgagccaacaacaatatttgccccaacaatatctatctggagaatcccttcttgaagatcaaatgaacactaaccaaatcttgagccaaatctacagacaacaacttggacaatctccattgaaccgttatttggtaaacatgagac

SEQ ID NO: 5304 - DNA, 210 bp, Diabrotica virgifera
  Clone ID: LIB150-004-Q1-E1-B11
cgggtcgaccaagcgtccaatttttacttagttgatgcgtgggagatattttttagtaaacgttgcgaaaaattttattaaatgatagtcagtcactatcgtgagagagtactttacttttagcgaggaacgatttactttttgtgccttgtgtatcagggattagtaattagtaggtctacagttagtacttacgggctgagcagagct

SEQ ID NO: 5305 - DNA, 84 bp, Diabrotica virgifera
  Clone ID: LIB150-004-Q1-E1-B12
cgggtcgacgcaagcgtccagtggtcacctgtgatcactttagcttgggtcttttcagcgagatttttcagcactgtctctcga

SEQ ID NO: 5306 - DNA, 370 bp, Diabrotica virgifera
  Clone ID: LIB150-004-Q1-E1-B4
tcgtatggccggagaaattgctgtacgagacgactcttctattctagagagctggaagctattgcagggaaactgctttttgtcccttgattagtcgagtattagttttatcttgttgtacattgtttgttgtggtgcttatcgcgtgtgttgttgagtgtttatattacttgaaatagaactagcgatggcaactgaggtcgaaaataacgcacccgaaacaaaggaaattaaggaggagataccgtccggcgacaacaaagccgatgaggccggtaaacaagaaaatgccggcgacgcgcctgcctcggcaaaagaaaaagaaccgactcctccaaaagtattggtacacgaaaccaaatttcgaaaa

SEQ ID NO: 5307 - DNA, 301 bp, Diabrotica virgifera
  unsure (1)..(301): unsure at all n locations
  Clone ID: LIB150-004-Q1-E1-B5
agcttttagttcatccacagcagtctgacacaaacccgcgtcccgcaaacaataacaaaccctcttacgagatataagcacgcctttttaaccaaacataaataaatatattattgttcgttgtcttacacttatttaaatttcatttaattgttttcgtaaaccacaacggaacatttcttaataacaatgttatattttgctaattttaatttttaataacttttttaaaatgaaataatacgtcncattttaaaattcacaaaccatatgcataagggcttgttaaattttaagaaac

SEQ ID NO: 5308 - DNA, 392 bp, Diabrotica virgifera
  Clone ID: LIB150-004-Q1-E1-B6
acccacgcgtccgatgaaatgttattcgtttttaaatatatctaattttttaagaaataaattaaatttatttattaacaatatatttataattaaatatttttatattattaatattaaatatttttaagctcatccctaaaaatatttaatattaataatataaaaatatttaattataaatatattgttaataaataaatttataattaaatatttttatattattaatattaaatatttttagggatgagcttaacaataaaattttattaaaatttaatttttaaataaaaattaggattaaaaattttcatattttaaaatatgttattatttatttttatatattagtagttttattttttataaattttttattaaaatataaa

SEQ ID NO: 5309 - DNA, 362 bp, Diabrotica virgifera
  Clone ID: LIB150-004-Q1-E1-B9
gtgttggattagtactgtattagactgatatttatgtactattttaacttctttctcggtcttttttattaacttttctattattagtatactaattttctttgtatattttatgattattctttctttacttttgtacttccaataatgcttaatttcattgctttatttcttctttttttactaattacatacatacttatataggtttatcttattgcatagtttttacactttaatattgctgtatatattatacccttttttcttcctctattgcccctgtagtttattaaaatctactcttaaggggaaaggcgcaaaatgtcgcttgcaaaaattttcaatgtgttttaaatgta

SEQ ID NO: 5310 - DNA, 394 bp, Diabrotica virgifera
  Clone ID: LIB150-004-Q1-E1-C1
cgcgtcgaaagataaattaaaaaaattaggatgcaataatgatgctatagcagaatatcaacttacggacattatgagtaaatctagtcgtactttggaagaagtgtttcaactctttaatgttgcccataatgctacaaaaaccaaagaaaacgtatatcttgctgctaagagtgttatcgaagactttgataaagaacatacaatatatttagaacttagaacaactcctagatgtgaggaggcaatgagtgaagaagaatatgttgaaacagttattaaagcaattacagattgtaaaaagacttgtaaatacgtattagtgaaacttcttttgtcgataaatagacgacccaataaagactcttctatgaaaacgttagatgtaattatt

SEQ ID NO: 5311 - DNA, 148 bp, Diabrotica virgifera
  Clone ID: LIB150-004-Q1-E1-C10
aactatgcttccgtcgataactacttctttagtgtctgtaaggacttggttcctttggtgtcacctaactttggctgcaatatatggtgttaatggtagaggagatggaggtaattattgtgtcttgtgtatcatggcttattacatt

SEQ ID NO: 5312 - DNA, 252 bp, Diabrotica virgifera
  Clone ID: LIB150-004-Q1-E1-C3
ttaagtttgttggtttatgggttgctagttggtgtatacgttgtatagaatcctacatcgaatgttcctggactgggactgtagtgttacgtagaaccgtatgttccgaagaacagtgatacacactgaaaaacatatacctttaaataattgtgtacttaattgtgtaatggtgttaaatgcctttcttaaaaattgttttggagcacaatttgtgttttttcaaattccaaatttccgataaatcccaat

SEQ ID NO: 5313 - DNA, 384 bp, Diabrotica virgifera
  Clone ID: LIB150-004-Q1-E1-C4
ttggtattcgtattacagcaaattgcttgttttctagtgtaatttgaattatcaaacttgaataattaacctgttatcttgacgttgttttatggttgttgatacatttcaattacctttggcattcatttataatacaaatgtcagtattaatataattagaagcattcagtattactataataacggatattttttcctttggaacgatcgcatcttttttttaatatccagcggataggaagttttggtatcaaaggcctcttatctttcttcggcagtacttcatcccttagtgcaccataataaatcctcagcggagtaagaaatattatgttctctagattctagatagtatgttacttgacttgtctgtaaaaatgt

SEQ ID NO: 5314 - DNA, 360 bp, Diabrotica virgifera
  Clone ID: LIB150-004-Q1-E1-C6
agctcatcttaagctttacacaacttacccaagcaagttacaatgaattactttttgtatgtatcattcttagtggctctcgcaaccgtaaatgccggttacgcaggcagttacggaggtcatgaaggctatggtggagaccacggcggccatgatatttcccacacggtggaaattaccaaacacgtgccaattcctgtctacaaacacgaagcagtaccaattccccacaccattccagttccagtgccaaaaccagtagcagtaccagtaccacaaccttaccccgtccacatcaaagttccccaacctattgccgtacctgtcatcaaaaccatcatcattcccgtagagaaacca

SEQ ID NO: 5315 - DNA, 379 bp, Diabrotica virgifera
  Clone ID: LIB150-004-Q1-E1-C9
acccacgcgtccgtctagaactacttcaagaatgtctgcaagagcttggttcctttggtgtctcctagctttggcttcagtttttggagttaatggcggaggacatggtggccaccatcacgtagtattcaaaatcccagaacacattcaaaacgtcaaacacacacataccgtctaaaaaaccatccatcatcatacaaaagggcacgaagagcctcacagccatgggggaaaaccattccattggcactgaagaaatttcacagttgaaatttagataagataattttttgcaagctttaattatggggtaacattccagtatgatttttttttcaaaacctatagattttctatatataagtaatatggaaaactg

SEQ ID NO: 5316 - DNA, 182 bp, Diabrotica virgifera
  Clone ID: LIB150-004-Q1-E1-D10
acccaagcgtccacccacgcgtccgcggattcgtggatttatattatttaattttagttatggtgatattattagtattgtgagattgtatattaattttatatatataggtttaatattgggattcgtgagtatttttgacacctgtttagtaattacatgtctattagtttcaaatttaa

SEQ ID NO: 5317 - DNA, 346 bp, Diabrotica virgifera
  Clone ID: LIB150-004-Q1-E1-D2
cctattagaaatcatattaatataaaagatgagcagtttgttgaagcatagtagagtaaatagaaataaacggcaacattcaaagaaagataaaaaactaataaaacttataaaatccaaatctgaatctgaagatgaaggcagtgaacatgaattatcctactatttaaatgatagagtcaaattaatgaaagaagtgttaaagatcattaaacctagaaagattaaaagtatggcaccggattgcatgaagagtatggacaatgaagaaattaattcaatgctgttggaagaactcctaggcatatctaataaaaggctaaaatatattttcaatggacaaaat

SEQ ID NO: 5318 - DNA, 257 bp, Diabrotica virgifera
  Clone ID: LIB150-004-Q1-E1-D3
aaattgttttggttataaaagttataagacaacatggctaaaaattcgcttctttgtgtcctagttttagtagcagcattaaatatattggcgattatgggtgccccccagcacgatcatcatcatggcaatgaccaccatgaccaccatgaccacggtcattacgataaccattacaatcacgggcatgactacaacaaacaccatcatggacattacaattacaataaccaccatcacaaccacggttatccacc

SEQ ID NO: 5319 - DNA, 388 bp, Diabrotica virgifera
  unsure (1)..(388): unsure at all n locations
  Clone ID: LIB150-004-Q1-E1-D4
acggacgcttgggacangatgaattgtctagttcttctttccctagtaacccttagtgtcgctgcatactacccaagtactggtaggcaggtgacagtaggagtagctggaaatgtgaaactagtcggctctcaaggttcccagattgacattcgtagaagtccttacaacccaagaactgtcgacgtcaccctcagaagtccagatgctccaaccagaactctgcaaattgatgaagccaggaacggccaacaacttggttattccaacctccaaggtgtcaacaaccaaggtgtcaaccaggctgatgttcttgctgatcttttcagtcaatatgagggtattgtaaatgaccagaactttcaatattttgttgaacaaaacttca

SEQ ID NO: 5320 - DNA, 297 bp, Diabrotica virgifera
  Clone ID: LIB150-004-Q1-E1-D5
acaaacaccgtcttcaagatgaaacgatcccaacaagttaccgtcactaaaaccactacgacatatgaagaatacgaatatgaaaccactttctccgtttcgaagttatcgaagcttgagaatttcgttttacctcctagaactactatcttagcagtgtctcagagcggaggagacgaggaagaagacgagaagtatgtcgtcacgaatcacggaaaagctgatctttttggtgaggtgatacatctcagtaggcaagatgatgctccacagtggtttgtagtccagccagaccag

SEQ ID NO: 5321 - DNA, 384 bp, Diabrotica virgifera
  Clone ID: LIB150-004-Q1-E1-D6
aaaaaatgtacagtggaacctcgataactcggattaatcgggaccgcagccgatccgggttatcgataatgcgggttagccggagaataattcaaataacatgaaatatatgaatgcacagcacctacacatctaaattactaaaaacacgcaaacacaaaaaaacacaaacgtaagcaaacggaagcgaataataatataagactgtactacacacaatacagtcacaatcggaacgatgttatggtatttaaagaacagtgaaaactaagattattgtttaaaaaagatttttttaaatagtcttttagtcttttttaaacaatgctaagacagtttgaaatcttcttcttcttaacgtgccctatcaagttccctttgatg

SEQ ID NO: 5322 - DNA, 382 bp, Diabrotica virgifera
  Clone ID: LIB150-004-Q1-E1-D7
acccacgcgtccgtgtttttggtgtgacttttttttatcacgggttattttttcgtgtgttgcgctcatcgacaaaccacaagaatgaaacttatcgtaggattattattaatagccacagctctggcatacccagtagcggaaaatgaagaaaaactagcccaaccagtaattgcacaagacgcgaagccagcagagcaagaactaccactaccagaccaacttcttcccatatcagaaaaacttccccaaaaacaagaaccgttacctgccagcagcgattcttcatcagaatcttcctctgagagcagcgatgagtctggagaaaagaaatcatcctccgagtcctcctcgagcgagaaagaatccagcgaagtaaaaa

SEQ ID NO: 5323 - DNA, 291 bp, Diabrotica virgifera
  Clone ID: LIB150-004-Q1-E1-D8
aaccacgcgtccgtgtttttggtgtgacttttttttatcacgggttattttttcgtgtgttgcgcacatcgacagtccacaggagtgaaacttatcgtaggattattattgatatccacagctctggcatacccagtagcggaaaatgaagaaacactagcccaaccagtagttgcacaagacgcgaggccagcagagcaagaacgaccactaccagatgaacttcttcccagatcagagtaacgtccccaaaagcaagaatcgttacctgcaagcagcgattcgtcatca

SEQ ID NO: 5324 - DNA, 62 bp, Diabrotica virgifera
  Clone ID: LIB150-004-Q1-E1-E12
aatcgctcatttataatcgtcctacgcggtctggatcggtgactcgatcttggatgccctct

SEQ ID NO: 5325 - DNA, 308 bp, Diabrotica virgifera
  unsure (1)..(308): unsure at all n locations
  Clone ID: LIB150-004-Q1-E1-E2
accacgcatccgcccacgcgtccgcccacgcgtccgcgcagaaccaaaagtgataatagcagccagttgtggaatagaacccagtcgcgtagtcaattacataagtgaactgaacgaggccattgctttatccagccacaaaccgtcaaaatgtataatttatccaaagaaaggattgnagatccgagattttattccaaacgagatatgaattgggaaaaaccattcaaaaattgttaaaatgctccttgtatacctgtagaatgcaacgatcccttatatatactgtatacatcaggaacaacagg

SEQ ID NO: 5326 - DNA, 161 bp, Diabrotica virgifera
  Clone ID: LIB150-004-Q1-E1-E3
tacctatattcacatggaaaagcgcctttcgaatctactatactgcacgcagacgaaataaatatgttggtggcaacttttattacatttaaagccactaatttggctttggactctcaaattgcatcgatctatagctgtttaaacaatgaatatggggg

SEQ ID NO: 5327 - DNA, 381 bp, Diabrotica virgifera
  Clone ID: LIB150-004-Q1-E1-E5
acaaggaccttgtctctttttcgtgataattttcacggaaataggcatggtattcgtagggtgcagcaaaatagtgctaaaatttgttgattgacgaaggaccgacgtgttttttacacacttgtttaaccaaaaactcaagattccaccgaaaacctttatcgaacccagagggtggctaccgaagggtcgtaacttggacgaagctagcccagatactagcagccttcttttaccctacaactggaaaattttcctaaacggcgaaccgccttggcagtgctgacaaaaatctaggagatactaagtcacacctaccttaataaacctgtgtgaatctgagcacaggctgcctccttgcttatttcatcgaaaatattc

SEQ ID NO: 5328 - DNA, 184 bp, Diabrotica virgifera
  Clone ID: LIB150-004-Q1-E1-E6
accttgtcgctttttcgtgataattttcacggaaataggcatggtattcgtagggtgcagcaggatagtgctaaaatttgttgattgacgagggaccgacgtggtttttacacacttgtttagccaaggactcaagattccaccgaggacctttagcgaacccagagggtggctaccgaggggt

SEQ ID NO: 5329 - DNA, 364 bp, Diabrotica virgifera
  Clone ID: LIB150-004-Q1-E1-E9
agtaggacattaccaatcggtctagcgagtctcttcatgttttattaaacgaattacagtatgcaacaaaataaacagtctatctatctaatgagccctaaacatccattcttggatataagcctcctcttccttcttccatgcctctctatattgggcaatttgcatccaatttgacccagtgtgtttcttcaggtcaaccgaccatcgcatctgtggccttcccctttttcgtttgttgttccaacggccccattgtaaaatcaacctaatccaaccttcaaccttctgccgtaaggtgtgtccggccaacttccatttaagctttgctacttgggtagagacatctttcacttttgttttg

SEQ ID NO: 5330 - DNA, 254 bp, Diabrotica virgifera
  Clone ID: LIB150-004-Q1-E1-F11
agattcggccagttctcagtttcttggctggtgccaccttgatgtgtgaatattttcaatttagtttcatatatcatttgtaggtttaacaggaaaattcgtcaatatgttccggaccggttttctgctggtattctttttgaatgctgtttttgccgctgaagatatcaagaccgacgatggagttttggtcctcaccaaagacagtttccaacgagtcctcaatgatgatgagttcatcctagtataatttt

SEQ ID NO: 5331 - DNA, 80 bp, Diabrotica virgifera
  Clone ID: LIB150-004-Q1-E1-F12
cgggtcgaccaagcgtccacagtctggcacctcccactgtctagacttatggcacagtttctgtagtggttactttcaat

SEQ ID NO: 5332 - DNA, 215 bp, Diabrotica virgifera
  Clone ID: LIB150-004-Q1-E1-F2
gaaatcccaaagatgcctctatccccggtatgttacacaccggttatctttaattatgtgtgtcatttttgaccatgttgggtacagttctttgtagttttgaaacttgttgtttctaagaaaaacgtctaagacttctacgaaagaacttcatggttcagatagatcctggctcattgtattcttaaacattgtcaaacttggcaaaattcaaa

SEQ ID NO: 5333 - DNA, 351 bp, Diabrotica virgifera
  Clone ID: LIB150-004-Q1-E1-F4
cgatctatatcaagtatatagctttcgctgtgatcgccatatcactaccgttcatagcgttaatcgttttaaaatttttccaaaagttcagtgccggaaaagtgcggagtttggtttgcttaagtggtaaaacggccattgtgactggagctggctcaggaataggatacgaaaccgccctcaacctcgcctccaggggatgtcaagtaattctcgccgacagaaaagaacctgcaaaagctaaggcaaaaataatacccattacgaacaattcaaacatcaaaacaaaaatcctcgatttaccttcattgcagtcggtgaggaagttgccaaggaaataaacccgacaga

SEQ ID NO: 5334 - DNA, 355 bp, Diabrotica virgifera
  Clone ID: LIB150-004-Q1-E1-F5
actgctccaagatgaaggtactcattcttctttccgttgttgccttgagcagctgcttaccagcatccagaaatcaacaatacgttgatgtagactacaacagctacaacgctcatcccgtctacaacttctggaggacttggaatcagcaacactatggacaagaaccatggaaccaatgggtacaatatggtgtccagaaccaacccggtaactactggaggcagtacgtgcaacgcagcaaccaagctgaaaatgtcgatttaccttggatgtatcactcttgggatgtccaggatgtgcaaaacttaactcccgttcaacgtgttcagttgctactcaactacgtcagact

SEQ ID NO: 5335 - DNA, 376 bp, Diabrotica virgifera
  unsure (1)..(376): unsure at all n locations
  Clone ID: LIB150-004-Q1-E1-F6
acaacagcgtagtccacaaacttcaagtgactcagtgagctatggaacggagaatgctcaacattattgatggcaaatccaatgaagaaataagaaaaggcgatcaaaaataccagatgcgatccagaagattaccatgttaaattggaactgggcaggacacacaggaagactggaaaacaaccgttggatgaagcgaattcttgaatggcgaacaagggcaagtaagaaaagtagaggcagacctcaaaccagatggactgatgacatcaagctaatggctggccacgaatggcaacattttatttctgttcccaattcagattcaatgtcatctatanggcatcaacatcttcatagagttaagagaactgac

SEQ ID NO: 5336 - DNA, 102 bp, Diabrotica virgifera
  Clone ID: LIB150-004-Q1-E1-F8
tccacacaagcgtcgtccaacgcgtccgccacagccggtcagcaattgtgagcagccagctattcagcattgctttgtaaaattgctgagaagctaccggca

SEQ ID NO: 5337 - DNA, 391 bp, Diabrotica virgifera
  Clone ID: LIB150-004-Q1-E1-F9
ccaacaaacaccgccttcaacatgaaacgatcccagcaagttacggtcactgaaaccaccccaggatattcagtggaaaagatgtattataaagaatacaaatatgaaaccgctttctccatttcgcagttatcgaaactggagaatttcgttttacctcctagaactactatcttagcattatctcagaacggaggagacaaggaagaagacaaaaagtatgtcgtcaagaatcacggaaaagctgatctttttgttgaggtaatacatctcattaaccaagatgatgctcaacaatggttggtagtccagccagaccaaaccactgagatagatattgaggacaatcttgaacaaagcgtgttgaaagtaagcaacaacagttacgaac

SEQ ID NO: 5338 - DNA, 298 bp, Diabrotica virgifera
  unsure (1)..(298): unsure at all n locations
  Clone ID: LIB150-004-Q1-E1-G1
gacgcatgggatcaaaagaagctttcaatttttcaatttcatactttatattataatttgttaatttgtattgtgttcgtccttcgtgaaagatgaataataatatgggatataataataaagcatgggggagaactaacaactcctccaacttaatgaatcagaatcaattacaatcacaacaacccggtggtctaagaaacatggtcccctttccgggaaatcaacaaatttttcaaaanccattgggacttcaacagcataacctggggctagggttacaacaaattaacaatgc

SEQ ID NO: 5339 - DNA, 277 bp, Diabrotica virgifera
  Clone ID: LIB150-004-Q1-E1-G12
acagcgaatatttacctttcctcaacagttcagtattaacaataaattgttttgtcgagattgaaatcacagattactttatgatatggtaactctcgaagacgttgaaatgaaaaatgcagacagtcctcgaggattagaagctggtgatacagagagagataccgacctacagagtgtaatagaaattcgtggacatgcaggacaggtagaaaaatcagtcacaatgtagaggagagcgtttcatcttacgagttttacgttgcttgcccaagac

SEQ ID NO: 5340 - DNA, 330 bp, Diabrotica virgifera
  unsure (1)..(330): unsure at all n locations
  Clone ID: LIB150-004-Q1-E1-G2
gggcggacgcttgggcggacgcgtgggcaatgatgagcctccaatactgtggattggtccttttggcaagtcttttgttggtttccgcccaccctggaaccgactctaaggctgaagccaaggtatcttcagtagccgagaagaaacaggaaaaacgtggtcttcttgatctaagctacggtgggggacacgactttggaggaggacttgaacttggagggcatggtttggatttgggtggacatggtggtttcgacngaggatatggtggagggttaagtggagggtatggtggattagacgaaggtcatgttaagcacattaccatca

SEQ ID NO: 5341 - DNA, 380 bp, Diabrotica virgifera
  unsure (1)..(380): unsure at all n locations
  Clone ID: LIB150-004-Q1-E1-G5
aacatttttgcaacaatgttctcgaaaaaatatctgacttttctgtcggtattgtgtatagctattgccgtgttcgcggacgacgaaatacctgaacctaagccaaaaagtgaatacaaaaaatctttgtcaagagattgtgcaactagttattcgacgacatgtttaaaattggacatagtgtcatgggtcgataagttaaacgaggaaaataattatagtgttctaccgggagtttcggtgataaaggaagagcaaagtgataaaagttcgacggcagatatggtgtctgaattagcacgagactttcncaatgatcccgacgcccgcctggacgcgttcctcttgaaaaaagtgacttcttatttaaacagtcattc

SEQ ID NO: 5342 - DNA, 367 bp, Diabrotica virgifera
  unsure (1)..(367): unsure at all n locations
  Clone ID: LIB150-004-Q1-E1-H4
aatttgtcgtgtctggcccttcatttgaaaacatggccaatctctttaacgttattgttgctcaagcgtccgaaaatttaacagaaaatgccaaaaatgctactcaaaagactcctagtacaccagaaggaacggccgttgcatatattagtttagttgtaatggccttacttccaatattctttggttcttttagatctgtgtcctaccataaggataataaagtagaanaaatgaccaaaagagatgcagcagtatttccaattgtagcttcatgttccctttttggactctacatagtatttaaattattttcaaaagaatatataaatcttttgttaacaggatatttccttttcttgggtgt

SEQ ID NO: 5343 - DNA, 53 bp, Diabrotica virgifera
  Clone ID: LIB150-004-Q1-E1-H8
tcatttgaaaacatggccaatctctttaacgttattgttgctcaagcgtccgg

SEQ ID NO: 5344 - DNA, 243 bp, Diabrotica virgifera
  unsure (1)..(243): unsure at all n locations
  Clone ID: LIB150-005-Q1-E1-A12
cttactcgtgaattcgacagacacaaggacaaatgcgcagatattgaaaagaaaatgaatgctaccatcgaggacctcgccaactgcattgaagatattaccattggatcaagtaccgtgtgcgctactgcccaacgtacaattganaaatgcgccaagccagtcattgaattagttagcggttgtttgccagaagaatccanagaacttcccgccttagctganggaattgttcttgctgtt

SEQ ID NO: 5345 - DNA, 211 bp, Diabrotica virgifera
  Clone ID: LIB150-005-Q1-E1-A6
gtgtcaaattacaattttttctgattgtaatttttgctccattaattaaagtagtgatattttaaattcgtgttcaacgcttcagagctaaaagaaaactaaaaatgacttatccacaaaacggtgatgatggttaccaggctcgttccaatgggttctccaatttcaaaagtggaggaaacagtggaggaagacgacgttacaacaacag

SEQ ID NO: 5346 - DNA, 367 bp, Diabrotica virgifera
  Clone ID: LIB150-005-Q1-E1-A7
cgcgtccgcacacgcgtccgcggacgcgtgggtttatctttgtgcagtacttgtagtgtgacataatgttgacgaaggtgacagtattaatagtattagtggcatcaacgcaagctggactcttaggcgctccagctgcatattcaacagtcacttcccacggggtcctaggtggccacgccctagcagccccagcagtttcatacgcatccccagcagtgtcatacgcagcgccagcagtctcatacgcgtctcccgccgtttcctacgcagccgcggctccagctttatcctacgctgcacctgcaatcgccgcaccagcgatagctcatacgtacgctgcgccgacaattgttaaagctgctcc

SEQ ID NO: 5347 - DNA, 247 bp, Diabrotica virgifera
  Clone ID: LIB150-005-Q1-E1-A8
gtccgcagaagtcacgtcaggttcaacgcgggacagaccactttctaatattcgcgacacatacactcgcacaaatgattctgaaaagcgtaattctgggcagcgttttgtgtatatccggagtgatctcacagctccaggatgtttttgaatgggaagagttgacattcgcgtgggctaaacaaaatgcgaaaaacgcaaccttgacgaaaggggagtaagttgccaaaaaaaaactggctctggg

SEQ ID NO: 5348 - DNA, 156 bp, Diabrotica virgifera
  Clone ID: LIB150-005-Q1-E1-B2
atattttttagtaaaagttaagaaaaattttatttaatgatagttaattagtattgtgagagaatattttaattttataaaagaaaaatttattttttgtaccttgtgtatcacggagtattaattcataattatatatttaatagtttccaagtt

SEQ ID NO: 5349 - DNA, 219 bp, Diabrotica virgifera
  Clone ID: LIB150-005-Q1-E1-B5
cgtccgcaaacgtccgcaattgggacgaatctgtcgttggtgttaattttgtgaaaaaagtgaaaatacaaaaattacgaaaaatggcaatgttccgtcgactaacacctacaaaattatcagaaacaccaaaactaaaatctcaagttgcaatcgtcctcaaacagctaagtgatagttcaacgggcctcaaagctgtactcccagctaaaataccaa

SEQ ID NO: 5350 - DNA, 341 bp, Diabrotica virgifera
  Clone ID: LIB150-005-Q1-E1-B7
cgtccggcatttgcttaactctagctgccgaatccgagaaaaaggaagtaacgcaggagagtaaaaaacaagagaaacgcggtctttacggccttggtgatcatggtggaggattcggcctaggcggccacgattttggaggcggccatgattttggaggcggtgattacggaggtcatcaagaacaccacgaacacgtaaaaacggtcgtagttgaaaagaaaattccaactccttacgaagtagtcaagcatgtgccttacaccgtcgaaaagaaagtaccctacgaggtcaaagtaccagtaccacaagcttacgaagtgtacaaaaaagttacatat

SEQ ID NO: 5351 - DNA, 167 bp, Diabrotica virgifera
  Clone ID: LIB150-005-Q1-E1-C12
tatcacaaaaatgtgatctctcaacaagttgagcaattcattcaacaaggacaacgtcttccccaagacttgctttcccaacaagtattagtctaccaacaagttcgccaattgattaaagttttgagcacccaacaacttaacatgatcaacttcatccaatacct

SEQ ID NO: 5352 - DNA, 277 bp, Diabrotica virgifera
  unsure (1)..(277): unsure at all n locations
  Clone ID: LIB150-005-Q1-E1-C9
ttgactgagcttattaactgtcataactaaaagatcaggataaagctctatattacagcagacatattatgaaaatatttatttaccttagtccttattaaagtaaatcattcacttttagctttactttgttantagaaaaaatgtcttgtagcaaattcatcttagaaatgactttgttgtattacaaagaacaactttgagtccaactgttatgactggtttctaataagaactttttcaaaatattgtaaattatgaattaaaaatactattg

SEQ ID NO: 5353 - DNA, 187 bp, Diabrotica virgifera
  Clone ID: LIB150-005-Q1-E1-D10
atttaattttaaaaaagaaaaatttaatttttggaccctgggtatcaaggaataataattaataaataaataattaataatttccaatttaaaagagctaaaaaattaaaatttttaatggtaaataaataatttaaataatttttttggaatgaaatggtaatccgttttaaatataaccaaattt

SEQ ID NO: 5354 - DNA, 248 bp, Diabrotica virgifera
  Clone ID: LIB150-005-Q1-E1-D4
ttaataacaatataattataaataaataattttatattaataatattaaatatttttaaggatgagctctaaaaataaaattttattaaaatttaatttttaaaaaaaattaggattaaaaattttcatgagttttaaaatatgttattaattatttttatatattaatatttttagtttttataaattttttattaaaatataaatttaaattatttaaatttagtaatgatgataataatagtatt

SEQ ID NO: 5355 - DNA, 205 bp, Diabrotica virgifera
  Clone ID: LIB150-005-Q1-E1-E12
gactacaggtgactacagggtataatatggtgattcaaaaggaagcccttttgggcttaatgttgtgtatttcaatagtaacttgtttcccacaagtaagtcaatcagacagtctgggtacatcaattgcaagtgaatctgttgaaaacaatggagacaattcacacaaaggaaatgtccctgttctttccaaaatatacgaaat

SEQ ID NO: 5356 - DNA, 260 bp, Diabrotica virgifera
  Clone ID: LIB150-005-Q1-E1-E2
atcaacaaggcaattatgttgatagaaagtggtgcagtggtgctgttattacaagaatgtcaaataaaaagattgggattattgggagtgggctcattggccgatcatgggccatgatctttgccgccgctgggtacaaggtctctctctacgacatagattcccaacaaattgaagtagcccctgcagatatcaatcaacaattgcaaactttggaaaaagaaaaagtcctccggggaacacttataggaaaacaacaa

SEQ ID NO: 5357 - DNA, 343 bp, Diabrotica virgifera
  Clone ID: LIB150-005-Q1-E1-E7
cgtccgaatttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattaatatttttattttttataaattttttattaaaatataaatttaaattatttaaatttagtaatgatgataatattagtattaaaaaattgtatatttagtaaaaatatatacgtttaataaaggaattcggcaacatttttttca

SEQ ID NO: 5358 - DNA, 347 bp, Diabrotica virgifera
  unsure (1)..(347): unsure at all n locations
  Clone ID: LIB150-005-Q1-E1-F1
ttaataatttccaaatttaaaagagctaaaaaattaaaattttaattgtaaaataaatattttaaaaaatttttttgtaatgaaatggtatccgtttttaaatatatctaattttttaagagataaattaattttattattaacaataaaattataattaaatatttttatattattaatattagataattttaaggatgagcttannaataaaattttattaaaatttaaattttaaataaaaaatacggatagaaattttcatattttaacatatgttattagttatttttatatattagtatttttattttttataattttttattaaaataaaaatttaaaat

SEQ ID NO: 5359 - DNA, 311 bp, Diabrotica virgifera
  unsure (1)..(311): unsure at all n locations
  Clone ID: LIB150-005-Q1-E1-F5
tccttccttaatcgcattcaacgctgctctaacaacaactcttgggaaaaaccgctctgggcaaaagaagatggaactgttactctcaacgactctagaggatacaaactggtaatcctcaagagtgttnacgattccagacaagtcgaagttattctcaagagtcnanacacaagaacccagatgttccaagttggggaaacacttagaactagagaaactatcgaccgtactctcgttggagtttcagcttaccaaaactataaccaagctgatattcgtactgatattttccgtcagtatgaaggtac

SEQ ID NO: 5360 - DNA, 274 bp, Diabrotica virgifera
  Clone ID: LIB150-005-Q1-E1-F9
cttggccacagttaaaaagtttaaaatttgggtccggttttgttgaaaaatgtaaaataggaccaaataaccaatattactaacttccttggggtgcagtttaaggcaaaagtactttcctaaccctaagtgaaccaaagtcattgcgacaaaatgagtgtgtggcaaataaaacattctactactactgatattcatccaaagatccatcctttcttcacttgctgtagtggcactgtgagtcctacagggaatttaaagcctacaagtatgt

SEQ ID NO: 5361 - DNA, 320 bp, Diabrotica virgifera
  unsure (1)..(320): unsure at all n locations
  Clone ID: LIB150-005-Q1-E1-G3
aattaagaatgaaacctttgataacgctctggttcttagtccttgtagcagtggcgataaacgccgatgccaaggagaagaaaagcgcagaagccgatgacaagaaacagaagaaacgtggtctcctcagcttatgatacggatatggtggagattttgataatggttaacacttatgacaaagtggatacngtattgacggtggttacacactatgattaggccagctagacttatgacacactacttctattgagaagaacattactttggttaaaggaggtacagtaccatacccagtagagagacacatcccttac

SEQ ID NO: 5362 - DNA, 87 bp, Diabrotica virgifera
  Clone ID: LIB150-005-Q1-E1-G6
ataaaccaagttaggtggaatggttaagcacttggggttaaacactaatttaaaacgttttttttttttggtatttaatgaaaaatg

SEQ ID NO: 5363 - DNA, 397 bp, Diabrotica virgifera
  unsure (1)..(397): unsure at all n locations
  Clone ID: LIB150-005-Q1-E1-G7
cggggccaccacgcgtccggatctattcaataaatgtaaatataagaaattgtacttacaaattattctgcttgttttcttgactcactttctgtacaatttcactttgtcagtttatggtttctttggcgctttaaaagctttttaattatagctgtaataatcacaaaacttgataaaagttacgagcactcataaacacgtcttaccaattcaattagagatgggacatgatgtgataattaaaattaanaacattaattataaaaaatattagttggtcaaagctgtggtatatatttttaccttaaatatacttttttactgttccgtaatatgtaattataaattattctaataatcttagcgccatctacacgataattgtgaaagtatc

SEQ ID NO: 5364 - DNA, 447 bp, Diabrotica virgifera
  unsure (1)..(447): unsure at all n locations
  Clone ID: LIB150-005-Q1-E1-H11
gccgaaccagaagagaaacctctagctctgccaactctagttgctgaagaaaaaccagctgagcaagctccaaaattggtcgccactgaaataaaagaagacaaaatcttactcagtgaacaaaaagtagaagctagtcctgtagccgaagaaaaactgcccgaattgaagaaagccgaagaacctgctccacaacttgaaggtaaatcagtgctcgaactacctgaagaaaaaccacaacctgcacagcctgaaggtaaattggaaccagtacaacctgtccttgcggcagtttcagctgtagaattagaagtaaagccagaagaaaaaccagaaggtganaagaaagccaaatcagaagagcccaaacccgaagagcagaaggtacanaaagttgaagaagccaaagcaagcgaaagaaaatctttagagcaacaaacagctgaa

SEQ ID NO: 5365 - DNA, 256 bp, Diabrotica virgifera
  Clone ID: LIB150-005-Q1-E1-H3
catcatagctatgttaattttatttactaccatcctaaatatcttgcttgtatcaataccataccaatttcacaagttcttcaaccatgcagttcttcttcgtcctggactgcgtttgccggtcaatttcccttgcataatattttgtagcaacctatatttgggaccttttactacatgtccgaaatactctagctttcttttgtaacgacataatatacggtatatttaactatattgagaagaatattttttt

SEQ ID NO: 5366 - DNA, 267 bp, Diabrotica virgifera
  Clone ID: LIB150-005-Q1-E1-H6
atttgtgattgcctctttcctctaagatcttcctcgttttaatatcacctttttagtgttttatatgagtttatttgtgaaacaatggaaaaaaatgatggtttgttttaatttttgaagtttcgcctgcatctgggcgtcttctcaaattgagtacttcgttcttcggtttctaaactatttgtaaaatatttgttgctcaaaaaatattaattctgtattattttaactataagtaatcctataagtcttactggacaatgctct

SEQ ID NO: 5367 - DNA, 392 bp, Diabrotica virgifera
  unsure (1)..(392): unsure at all n locations
  Clone ID: LIB150-005-Q1-E2-A10
aggaaagatgcgttgcagtgtattagtcgttttaataattgcatccatttttggatgtaatgctgacaacttgaacagcgttgttcaaggcaatgatgaatttacagcgaacacttacaaggaactcgtgaaaacagtaggcaaggaaaacattattcttagtggactgtctgcacaaatcgtcttatctttgcttgcaaatggggccaaaggagaaacgcaaaaacagctgttgataggtttgggcttacccaataacataacaaatgttaataagggattcactgaaataacatctcgcctaaaggtcaacacacccgatttaaaattgttatcagcanacaaaatttatccagcgaaaggttttccaattganaaagcattccaagatg

SEQ ID NO: 5368 - DNA, 349 bp, Diabrotica virgifera
  Clone ID: LIB150-005-Q1-E2-A11
aggtggtcaacgatattgcataacaatgtgtataagtatttcatcaatttatgaatctcatagcaaatgacttagagatagagttgcatcatgtgcactgcataattgttacaggctaatcgatacaaagtcctcactgagccaataagcaaggctgttcttaatcatctagagctgtcagcaattttcatcgtcactatttatgcagttcatttctattagggacctgactatcagatgtacatatgttagagattagttccaatgttaactgatctaattaatgaagtcactgtaacctaacatctcctataagtttttcaaccctcgttaaaattattcccatttt

SEQ ID NO: 5369 - DNA, 292 bp, Diabrotica virgifera
  Clone ID: LIB150-005-Q1-E2-A4
tggatggcattggggcgtcctcttcatttgtcgattgatactaagaatgggccgtgcactgatttatccatcgcgccaaatcatactagctttctgagctcatctccatgaaaaaggaaactttgtcattgctcttagtggcaacgttttacgaaactgcgttacttggccattggtgatattggtcacaccatatttgggatggcattggggacattacctactgaatttggtaactgtacttttctgtgcagtattcttcctagtggtcacagatacacctgaagctcac

SEQ ID NO: 5370 - DNA, 418 bp, Diabrotica virgifera
  Clone ID: LIB150-005-Q1-E2-A5
agtaattttcacggaaataggcatggtattcgtagggtgcagcaaaatagtgctaaaatttgttgattgacgaaggaccgacgtgttttttacacacttgtttaaccaaaaactcaagattccaccgaaaacctttatcgaacccagagggtggctaccgaagggtcgtaacttggacgaagctagcccagatactagcagccttcttttaccctacaactggaaaattttcctaaacggcgaaccgccttggcagtgctgacaaaaatctaggagatactaagtcacacctaccttaataaacctgtgtgaatctgagcacaggctgcctccttgcttatttcatcgaaaatattcaactgtatttgacaaagacaccttataaccaaccaaaaacaaaatgaaaattccaagtgtt

SEQ ID NO: 5371 - DNA, 398 bp, Diabrotica virgifera
  Clone ID: LIB150-005-Q1-E2-A7
agcgctgttcttgcaatttttagaaatttgttaagtattattgttgctgtttggagaaataacgggaaaattctgtgaatagttcgtattacagaaatgtccatatttggacctttgatgggagatatggaagacgatcctttctttgggtgtcatatgcgacacatgcgtcaaatgagcaacatgatgaattcactattttctgataccttcacaatgttgagaccagcaatgttgggatatgatgattatgaaaaccgggctctgactacaccccacaacatgcacaattcactaatgtccccattttctatgccaactatgcgaaattttaacagactgctcattggatccttagactctatggccaatactggacactaccacagctccaatac

SEQ ID NO: 5372 - DNA, 413 bp, Diabrotica virgifera
  Clone ID: LIB150-005-Q1-E2-A9
aaaaatatggctacaatcttaggaaacgaatggcatatatcttccaaaggaaacgaaattttaacgggaaatgtatcgacgggggataaacaacagatttataactttgctttaaatacagatctaaaagaaatatgtagcccaattgttaactcttttccaattgatgcgacatcgaatgtagtgctccagattcacaagatccgaaacatttctgcacccaaagctaatgaagattcccaagcagctcctcggatgctcaagataactctaacagatggagaaaactatattcaagctttagaacttacaacaattagcacaataaattataaaacaactccacctggaacgaagctgttagttcaaggagctaaacttacatctggtttcctgttactaaatccacaaaa

SEQ ID NO: 5373 - DNA, 433 bp, Diabrotica virgifera
  Clone ID: LIB150-005-Q1-E2-B1
agtaaggtctagggggccgagccacgcgtccggagcagttaaaaaagtgtctttatttttataggaaagattaataatactaccatattcacacatggaatcggcagatagtactgaagaagacttactaaaaatgcacagacaagagaaaacagacttacaatctaaaatacaggcactaaagaaaacagttcctaaacgtgataaatcagaataagacagaaatagctgaggaaatcgcaaaactagaattacaactagacgaaaaacacagaacagaacttggtgaaagtaatatatgctcagaacagctcaatattagtacggaaaatggtgaagatgaaagtgaaatgactgaagatcaaacagtagagaatggaattaatagtacacgtatatctcgagcgcagaaacgacgaaataaaggggaact

SEQ ID NO: 5374 - DNA, 406 bp, Diabrotica virgifera
  Clone ID: LIB150-005-Q1-E2-B12
aggtggtcagctgtgaacaatttagctttggtaatttcaaagagatttttcagcgctgcctctcgatctataagaacatactttcttgacgtgacatgtgactgcaaaattatactgggttataactgacatcaaatgtaatagttgatgtcgaataattcgttttgagcttatttatacatcaatacagctgacattcttccttttgaacttaaaagtacctcaaacaagtaactgcttgttaattcttacaccttttaatattgtaaattttataaaagtcacgtcaagccacaacgttgacgttcctctcaaggtaagaatctgacaatgacttcatctctagcgcacgtcaaaggtggtggaagcttccaatctgaaaatattgtagatattagaaaaacat

SEQ ID NO: 5375 - DNA, 370 bp, Diabrotica virgifera
  Clone ID: LIB150-005-Q1-E2-B2
tcctcaatctgaatcggtggattcatcaaggtatcactctcaacccttggaaacaggtggttgtacagaagaagacttactaaaaccgcacagccaagtgaccacagactttccatctaaactacatgcactaatgataacaattcctaaacgtgacaagtcgaatgtgacggatatagatcagtacatcgcacaactgaaatacaaccataggagtaacacagatcacaacttggaggatgtaatatatgctcagaacagctcaattataggacggacaatggtgctaatcaaagtgagatgacggaaaatcaaacagtacagaatggaattaatagtagacgtatatctccagcgcagaaaccacgaa

SEQ ID NO: 5376 - DNA, 399 bp, Diabrotica virgifera
  Clone ID: LIB150-005-Q1-E2-B3
gggccgggccacgcgtccggaggaggtatgggtggaggtagagggatgggtatgggtagaggaagaggtggtcccggtggaccaggtagaggtggaccaggaggtccaggaggtccaggtggccgaggaggattcaggggacgaggtggacctggaggaccaggaggacgtggtggtccaatgatgagaggacgtggaggtccaaggggagctccaagaggacgattcccaggaggtggcccaggagaaggtggtattggaggtagaggaggtggccgcggaatgggaggaagaggtggtccaggtggttttaggggacgtggaggcccatgaggtggcaggggaggacctggtggtccaggaggtcgtggaatgggtagaggaggtccaggtggtttc

SEQ ID NO: 5377 - DNA, 390 bp, Diabrotica virgifera
  unsure (1)..(390): unsure at all n locations
  Clone ID: LIB150-005-Q1-E2-B4
gcgtccagntgagtatgtgtggacgttaaaggatgggtataggttgaggaagcagtggtccctgtggtccatgtataggtggtaccatgatgtccaggatgtcgcactggccgaagatgattcaggggacgatgtggacctggaggaccatgaggacgtggtggtccaatgatgagaggacgtggaagtccaaggggagctccaagaggactattcccacgatgtggcccatgagaacgtggtattggaggtatatgatgtggtcgcctgatgggatgaacaggtggtccacgtggttttatgggacgttgaggcccatgatgtggcatgggatgacctggtggtccaggaggtcgtggaatgggtagaggacgtccatgtggtttcaga

SEQ ID NO: 5378 - DNA, 390 bp, Diabrotica virgifera
  Clone ID: LIB150-005-Q1-E2-B8
agaaaaataataagaagaaaaaataagattcaggttatgttatgaaaacgtcaacaattgtatgtagtaaataaaattagttattaaaatgcagtactgcaagtaaaataaaattaattaaattaacttttatataataattgcatatcatatcaatattgtggagcaatatataatttttctgcttcattgacagaaggtatgaaatatacgtcaatttgacaatttcaattgacaatatgaattacttaagatagttgcaatatttcgccgcgactcgcgcatggtcgtttctcgtttccccttccaagtacttgcacacctcgaatactgtaatttgtaaaaatagccatgttttaagccaaattatacttaataacgtttaccgtc

SEQ ID NO: 5379 - DNA, 375 bp, Diabrotica virgifera
  Clone ID: LIB150-005-Q1-E2-C1
cacgcgtcaggatgacacattgatcgtctatcacgtcgctcaggacccccatgggccaaaagctagtcaggagtcacgggacctccaagaatttccgggctaaccgggaacatcacttcaaggacctctaagtcgtccagggtcaacaggagacagttgagataagtgagactcaagatgatactgggcctgcaggacttataggacctccaactattgccggagacctcactggtatatctctgacactagaatgggatatgaaaggcgtacacaagagactcgaagtacaatatacggacatcgcgacagggaaacggtatgggacatttttctaccggagaattgcatatgggacctccatcagcacctgat

SEQ ID NO: 5380 - DNA, 391 bp, Diabrotica virgifera
  Clone ID: LIB150-005-Q1-E2-C11
agctctgttagcgatgacctgccttccgattgcgagtccgacatttacgaagacatggaacatatgaacgaaaactagatttcgtcttcaactataaatgactcaacagaggaattagtcgatccataagatcggagaataacttttacgaagagtcattggtgtgaaattcctgaagtagtgaaatcgaccgttttaagtacttaaagctctcaacagatttaagctgcaagaagctaagttcgaaagcaatacgtcagaagcatcatacatacattcactcaatgtattagccgatcatttcgacaagaagttcatacactcgataatagtatatgaaattgagttcgaaattatatgtgggagcattaaatcagtgagagcttgctcc

SEQ ID NO: 5381 - DNA, 307 bp, Diabrotica virgifera
  Clone ID: LIB150-005-Q1-E2-C12
agcagaaccaaccaatttctcaagaaatatatgtccaacagtatggtttgaacaaacaagtagatcagcttatccaatcattggtatatcaccaaaatgtgatctctcaacaagttgagcaattcattcaacaaggacaacgtcttccccaagacttgctttcccaacaagtattagtctaccaacaagttcgccaattgattaaagttttgagcacccaacaacttaacatgatcaacttcatccaatacctcgttgaacaaggtaatcaagttgatcaacaattgtacgctgttcaaagaaattt

SEQ ID NO: 5382 - DNA, 413 bp, Diabrotica virgifera
  Clone ID: LIB150-005-Q1-E2-C2
agtaaatttagatagacaccttataagtaaaaaaaactcatacacacgcattaagctttaagttactagactataattacttgtttttatagaaaacgctcttgtggcacttagaattacaaagaacgcataattttttgcgtttgcagcgtatttaattgcattcgccactacaattgcagtggcggaatccttgactgcctatattcgaatctttgcgaacgcattcaatgagacttatgtgagtatcatgcgcttcattgactgaaataagtgttatagctttttatctataacagacataataatgtcaataatgtttaagctatcggccttagctctatcaacttctggaatttgcactctaacactttgacctactttttcaacagggaatctatcattggaatgct

SEQ ID NO: 5383 - DNA, 277 bp, Diabrotica virgifera
  Clone ID: LIB150-005-Q1-E2-C3
gcgtccgttttaataataattttttaattagtggtactttaattacagtttccgcttatgcctgattaaacaatgtgaatcggtttatgaattaatttaatgagatctagccccctaatgaaatctcataataatatttttcccggcgaatgcactcttaaaaattttattactcaagctttatgctctgccagtgtactggattgaattcatttaactttaaattcatcaaattttagtttaagaaattgatatttagcatatcatttaatcctaa

SEQ ID NO: 5384 - DNA, 415 bp, Diabrotica virgifera
  unsure (1)..(415): unsure at all n locations
  Clone ID: LIB150-005-Q1-E2-C4
agtaaacaccgccttcaagatgtaccgcctactatcccacaggatacaccacgatatcagtggagacaacgacatataagacatacgaatatgaaacaactttctctgtcctcggagacatcganactagatcatttcgttttaccccctagaactacgatcttagcattgtctcagagcggcggagataaggaagaagacaaaaagtatgtcgtcaccaatcacggaaaagctgatctttttgttgaggtagtacacctcaataaccaagatgatgctccacaatggtttgtggtccagccagaccaaaccactgagatagctattgaggacagtcttgaacaaagcgtgttgaaagtgagcaacaacagttacgaacaggaagtatcattttctgctgaaggtggtaacgtta

SEQ ID NO: 5385 - DNA, 377 bp, Diabrotica virgifera
  unsure (1)..(377): unsure at all n locations
  Clone ID: LIB150-005-Q1-E2-C6
atgagattcatttngcttaagccattgttcacaccttgaccgtcgatggcccaatgcagataaaggccaaggacaaacgtttggcaatggatcccaacaccggataccatcaaggtgccactgcgtactcccatcaatcttctcaaccacaatacgtctcatcccaaccacatcagcaccactactaccaacctgaggccgttcaacatcaagccatttcatatactcaacctattagcaagtacgcatctgctggtgcacctccagtacaaaagtacactttcgcaccacaacccgctaaacagcaagtacaatactcctcagcagctgatgtgtctagcttcagttacagcagccctatcgtagcatacaacaac

SEQ ID NO: 5386 - DNA, 409 bp, Diabrotica virgifera
  Clone ID: LIB150-005-Q1-E2-C9
agaataaattcactggttataccttgactgagcttattaactgtcataactaaaagatcaggataaagctctatatagcagcagacatattatgaaaatatttatttaccttattcttattaaaagtaaatcattcacttttagctttattttgttattagaaaaatgtcttgtagcaaattcatcttagaaatgactttgttgtattacaaagaaaaactttgagtccaactgtaatgactggtttctaataagaactttttccaaatattgtatatttaggaattaaaaatactattgtaattatttgtttaactcaaataatttattttcaattaactgaaattttagtttgtagacttttaaaagtattgtgtaataataatatatttacgcctaaaaacattat

SEQ ID NO: 5387 - DNA, 402 bp, Diabrotica virgifera
  Clone ID: LIB150-005-Q1-E2-D6
cccacgcgtccggaataacattgtaagtatcccattgttcgtttttgagaagttgaagaaagggttttaaaattgtgataatggtgagtttatacattttaagggtgagtacaacctttgaatgtataagtttgccattgttataattttaacactttttttctatttcttaaaaacaagtgattaggcacttgcattgttcggtggacccgtcaaattaattttaactataaaactgaaaagttgacttgtctgcttgtgtcccctaaccacacagttatctatgtgatctgtttttattaaatagttaattttcccgtaaatttacttgaaaatatcaccaaatcattgactcagtaaacatacaaacatctgccagacagattaaatgaatattatgac

SEQ ID NO: 5388 - DNA, 412 bp, Diabrotica virgifera
  unsure (1)..(412): unsure at all n locations
  Clone ID: LIB150-005-Q1-E2-D7
aacccacgcgtccggaataacattgtaagtatcccattgttcgtttttgagaagttgaagaaagggttttaaaattgtgataatggtgagtttagacattttaagggtgagtacaacctttgaatgtataagtttgccattgttataattttaacactttttttctatttcttaaaaacaagtgattaggcacttgcattgttcggtggacccgtcaaattaattttaactataaaactgaaaagttgacttgtctgcttgtgtcncctaaccacacagttatctatgtgatctgtttttattaaatagttaattttcccgtaaatttacttgaaaatatcaacaaatcattgactcagtaaacatacaaacatctgccagacagattaaatgaatattatgacaagtcctt

SEQ ID NO: 5389 - DNA, 407 bp, Diabrotica virgifera
  Clone ID: LIB150-005-Q1-E2-D8
aggtccacacatcaatagctatgaagtatctatattatgtatatttcttttgcacactttcctgttatgtatcagcagaagacgtcctactaggaactgatctttgtgaatgtaatgaatgcctgaaaccaatccttgaccaacttgggggcagcaacgttacaatccagaagatcgaagctctcatacaaagattaagaaaagatgtcgtaactattacagtaatactcaacggaacctgtgaaaaaatcgaaggtattcaagaagacatcaagaatttagacgctgtcctcgacgttaacgttgaactggtcaaccaagagaatctaatcatccacgatatcgatgtcagagttagggagctcggtcttgaaggacaagaactggacgatatgatcgactctaac

SEQ ID NO: 5390 - DNA, 411 bp, Diabrotica virgifera
  Clone ID: LIB150-005-Q1-E2-E1
acaaaaaccgtcttcaagatgaaacgatcccaacaggttacggtcactaaaaccactacgacatatgaagaatacgaatatgaaaccactttctcggtttcgaagttatcgaaacttgagaatttcgttttacctcctagaactactatcttagcagtgtctcagagcggaggagacaaggaagaagacaaaaagtatgtcgtcacgaatcacggaaaagctgatctttttgttgaggtgatacatctcaataaccaagatgatgctccacaatggtttgtagtccaaccagaccaaaccactgagatagatattgaggacaatcttgaacaaagcgtgttgaaagtgagcaacaacagttacgaacaggaagtgtcattttctgctaaaggtggtcacgttattgacgac

SEQ ID NO: 5391 - DNA, 381 bp, Diabrotica virgifera
  Clone ID: LIB150-005-Q1-E2-E10
aggcagtatccatcatgaagtgttttgtactgttcgcttgctgtgttgcatatatttcagcttcggcccttaattttcagcctttccaatcagtatacgtagacccatgtgcgtgcagaaaatgtttagaggaaatatggaacagaacactacagcttaatcaaaatttgaattcagtcaaccgcactctaaacaatttaacagtgatactcgaaaaaaatgtaacaactgaggtgacgtatcaacttgacgaactctgcaaagtggaagaaaacctcgacaacttagtagccacagaaaaaaatatcacagttgttcttcaagcacaaatttgtaacctgacagatgtggtaggtgacttggaaaaatgttgcagagata

SEQ ID NO: 5392 - DNA, 285 bp, Diabrotica virgifera
  Clone ID: LIB150-005-Q1-E2-E12
acggacgcgtgggttaacatcgaagccgactacaggtgactacagggtatagtatggtgattcaaaaggaagcccttttgggcttattgttgtgtatttcaatagtaacttgtttcccacaagtaagtcaatcagacagtctggttacatcaattgcaagtgattctgttgaaaacaatggagacaattcaaacaaggaaaatgtccctgttcttcctaaaatatacgaaatgagagtcgacgctaatgtttccaatagatttgccaaatgtcaaattactaaca

SEQ ID NO: 5393 - DNA, 395 bp, Diabrotica virgifera
  Clone ID: LIB150-005-Q1-E2-E4
tttttatcataaagtaacaaagcacaaagaacttgctaaatgtttgaaaaaagtaaactgtttacttaattggtgaaagaaaaattattttgaaacattgaaaaactggaaaattataaactgaacacaattaacagaacagatcaatattaaaaccaatcctaacctataaatgccatcggtataaaatttataaattagctattttgaagctgttttccagtaatttaagaatatattttcaatatgattcaagaaattgatggttcgttattggaaggtggtgggcaaattctgaggattgccctaactttaagcgcctaaaaaaagataccaattcgaataaccaaaattagaggaggcagaagtaagccgggattaatggaacagcattt

SEQ ID NO: 5394 - DNA, 395 bp, Diabrotica virgifera
  Clone ID: LIB150-005-Q1-E2-E5
gtcttcatgatgaaacgataccaacaagttaccgtcactaagaccactacgacatatgaggaatacgaatatgattccactttctccgtttcgaagttaacgatacttgagaatttcgttttacctcctacaactactatcgtagcagtgtcacagaggggatgagacacggaagaagacaaggagtatgtcgtcacgagtcatgggtaagctgatcattttgttgaggtgatacagctcagtaagcaagatgatgctccacaatggtttgtagtcgaaccagaccaatccactgagatagagattggggacagtcgtgaacaaagcgtgttgaaagtgagcatcaagagttaggaacaggaagtgtcagtttctgctaaaggtgggcacgttat

SEQ ID NO: 5395 - DNA, 414 bp, Diabrotica virgifera
  Clone ID: LIB150-005-Q1-E2-E6
agagaatatgtaaggacttaaaggcttaaaagtacaaataattataacaaaatggcatactttcactatcggtgtggtgaaagaattacattaataaacgaaaattgtactgccattcgaaatgaaagtgaatttgatcatggcttggtcatttctgcagaacccctacaaaatgatgttctttttgaaataaaaattgataaaaaggtcaatacatggtctggaagtttagaaataggtgtagttgactgtgatcctttagattttgattttccaccatgtgcatcaaaaatacaatctggttcctggattatgtctggaacaacagtttttaaaaatggtgcctgtctcgtggagggctatggaatggatctagatagacttaaccaagatgatagaattggattaatgaga

SEQ ID NO: 5396 - DNA, 400 bp, Diabrotica virgifera
  Clone ID: LIB150-005-Q1-E2-E7
aggttcttctttccctagtaacccttagtgtagctgcctactacccaagtactggtaagcatgtgacagtatgagtagctggaaatgtgaaactagtcggctctcaaggttccaagattgacattcgtaaaattccttacagcccaggaactgtcaacgtaaccctcagaattcaaaatgctcaaacaagaactctgcaatttgatgaacccagaaacggcaaaaaacttggttattcaaacctcaaaggtgtcatcatccaaggtgtcaaccaggctgatgtccttgctgatcttttcagtcaatatgagggtattgtagatgaccagaccttctacagtttgttgaacaaacttcaacatttggtacaagctggagtcatcaacagagtagtcttgga

SEQ ID NO: 5397 - DNA, 384 bp, Diabrotica virgifera
  Clone ID: LIB150-005-Q1-E2-E9
agaaaacaccgccttcaagatgctccgcgtacaatctcaggaagttagcacccaagaatattcagtggagacgacgacatatgaaacatacgaatatgaaaccactttctctgtctcggagacatcgaaactagatcatttcgttttacctcctagaactacgatcttagcattgtctcagagcggcggagataaggaagaagacaaaaagtatgtcgtcaccaatcacggaaaagctgatctttttgttgaggtagtacacctcaataaccaagatgatgctccacaatggtttgtggtccagccagaccaaaccagtgagattgctattgaggacaatcttgaacaaagtgtgttgaaagtgagcaacaacagttacgacca

SEQ ID NO: 5398 - DNA, 332 bp, Diabrotica virgifera
  Clone ID: LIB150-005-Q1-E2-F1
acgcgtcaacgtaaagtaatcaagccttacttcttaaaacaccagggtgaaatcgacggagttgttaacaaagtgaagaatacagttaaagacactgttaacaaagtgtcgggaaaagcaaagttgaaattaccaacaaccaaagggccgattctttttccaatggaggaatggtttaattaaagaaaccgggtaatatccaaaatccaagatatattatataagccaagtaccttaatgggaatgttgtgagtatatataatctcacatgtaagggattaaattttaaatatatcccaaatattgtaagcgtcacattttaaaagattttg

SEQ ID NO: 5399 - DNA, 412 bp, Diabrotica virgifera
  Clone ID: LIB150-005-Q1-E2-F12
agcggtattgcaccttcaaaggtttacaattatggaccaattccgaagggttgcgttcgagtaaaaatgtggattgataagagtatatccttctcagatccattgcatattctgaggcaactgtcacagcaaaattcatgtctaaggacgaaaagttggacggttttagatgttaagaacaatccaaagacgggctctatattcctcctacagttaagacaggagcatctcactgttttacggagcttcaacatggcaccctgtattcagaagaaaaaaactttatttaaagttctacaacctggagaggaattaaactatttttagaggaattgatgtccaacttcttcaaatagatgtctcgacttcaagataaaataatgatttttctttataagaattttattgtacg

SEQ ID NO: 5400 - DNA, 413 bp, Diabrotica virgifera
  unsure (1)..(413): unsure at all n locations
  Clone ID: LIB150-005-Q1-E2-F2
gtgataatagtgaaaaacctgacgtaagaatcttacacattgttacagttttttaagtttcattacatgtgtgaaatanaaaggcattctcagtaaactgtacaaatatctacagaaaaaataggtgcaatggcagaacaatcgctcatgagttttatggatgaattactagaaagcatgtgcctcttctgtgcagtttgtaaagatattttaaaacctcctattatgttagtggagaatgtaggaaacgtctgtacaaaatgttatgaagaaaagcaggaagtaatgaactggaagagtatgaaaaactcagctttggaaaatatattgaatttattaaaactgccttgcaaatataaagccaaaggttgtgctgtaagggtatcgtacgaagatttagattttcaccaaag

SEQ ID NO: 5401 - DNA, 411 bp, Diabrotica virgifera
  Clone ID: LIB150-005-Q1-E2-F3
acttaaaaatgttaaatttgtaaaaattattgtaaaaatagataaaacacattataaataatgataattatcatagaaaacgaagtcccaccagaggagtcccataggaaacgttttgcaatcatttcttgaattttttgagaaattttcgtatgtccgaaaaacaacatgtaatagtaactgaattagtaagaagaggagcccaaatttcgagacagatgaacgaaaaaaactttatttgattcctttttgtaaattttaaaattaattagtgttgtttaagacaatcaaaattgaaccctcacgcacaagttgtaggtacgtacaacttcagtgaggaactgagtttagtattgtataatttatttactacgaataaactccattattattaaatttacattttcacca

SEQ ID NO: 5402 - DNA, 415 bp, Diabrotica virgifera
  Clone ID: LIB150-005-Q1-E2-F4
acccacacgtccgcccacgcgtccgtttatttattatggtgccgaggtagttctgactctttatatatgggtttgcttgaagtatacttgaccttctggtctctttttttgctaattatcatgagctttgtcttctttgcgtttatattgagtccattttgttgactgtaatacgtggttttacaagttttaccaagatcacaatactatggattcatcatctgcatatctggtgctatttagccggtacctgtttagtagattgccttttttggttgcgtgtaaaccttctgattctcacatattcgatgtgttcacggttggggaaaatttgactttcacacagactacagattttcttacggattttctttaggaacaattttagaacatgactcatgatggcttattgtac

SEQ ID NO: 5403 - DNA, 338 bp, Diabrotica virgifera
  Clone ID: LIB150-005-Q1-E2-F6
aaatgtacaaaattgttatcttcaatgatcagttaattagttaatcgatgatcacgaatattcttagttatttcatcattgaaagatttattttttgtaccctgtgtatcagggattattacttaataggtatacatttatgactttcgagtttaaaacatctacaagattacaatttttactgtaaaccattcatttcaactaatttttgatgaacgaaatgttaatgcctttttaatagatatcgaaattcttaagaaatacattagtatttaattattaacactctatctatcaatcaatatttttacaggatcaacatccaatatttttaggga

SEQ ID NO: 5404 - DNA, 379 bp, Diabrotica virgifera
  Clone ID: LIB150-005-Q1-E2-F7
ccgggcagacccacacgtccactttatcttccgataataaattattttttagtatcagtaaagacaaattttatctaatgatagttaattagtagtgtgagagaatattttattttcataaagtgacagatttagtttttgtaacctgtgtatcagggatgattacttagtgggtatacatatatgactttcgagtttaaaacatctacagcattacgatgtttactgtaaaccatacatttcagctaattattgatgacgcattggttattcgtctgtaatggattcgaaattcttaagaaatacattatatttaattattaaccctctatctatatataaatatttttacagtatcaacatcaaatttgtttaggga

SEQ ID NO: 5405 - DNA, 400 bp, Diabrotica virgifera
  Clone ID: LIB150-005-Q1-E2-F9
attattcgccttcagactatatttaagatcaatctactacacgtggccacagttaaaaagtttaaaatttgtgtctctgtttttgttgtaaaaaatgtcaaaaataggagcctaaaaataaactcaaatattatcttaactttctttggggttgcagtttaaggcaaaagtactttcctaaccttaggtgaaccaaagtcattgcgacaaaatgagtgtgtggcaataaaaacattctactactactgatattcatccaaagatccatcctttcttcacttgctgtagtggcactgtgagtcctacagggaattttaagcctacaagtatgtactcttcttctttagcagcatcttagtaggcctccccttgtgttttccatatttgtctgtcttgagct

SEQ ID NO: 5406 - DNA, 417 bp, Diabrotica virgifera
  unsure (1)..(417): unsure at all n locations
  Clone ID: LIB150-005-Q1-E2-G1
agttcatctttccctagtaacccttagtgtagctgcctactacccaagtactggtaggcaggtgacagtangagtagctggaaatgtgaaactagtcggctctcaaggttcccagattgacattcgtagaagtccttacaacccaagaactgtcgacgtcaccctcagaagtccaaatgctccaaccagaactctgcaaattgatgaagccaggaacggccaacaacttggttattccaacctccaaggtgtcaacaaccaaggtgtcaaccaggctgatgttcttgctgatcttttcagtcaatatgagggtattgtagatgaccagaccttctacagtttgttgaacaaacttcaacatttggtacaagctggagtcatcaacagagtagtcttggatgttgtaagaaactggga

SEQ ID NO: 5407 - DNA, 411 bp, Diabrotica virgifera
  Clone ID: LIB150-005-Q1-E2-G10
agctccaatactgtggattggtccttttggcaggtcttttgttggtttccgcccaccctggaaccgactctaaggctgaagccaaggtatcttcagtagccgagaagaaacaggaaaaacgtggtcttcttgatctaggctacggtgggggacacgactttggaggaggacttgaacttggagggcatggtttggatttgggtggacatggtggtttcgacggaggatatggtggagggttaggtggagggtatggtggattagacgaaggtcatgttaagcacattaccatcaccaaagaagttaaagtacctgttcctgcaccataccccgtacacatcgaaaagaaaataccagttccagtgccagtcaaagtacctgtaccagtagatcgtccatatccagtacatg

SEQ ID NO: 5408 - DNA, 420 bp, Diabrotica virgifera
  unsure (1)..(420): unsure at all n locations
  Clone ID: LIB150-005-Q1-E2-G2
gagaaatgagagaaaatagtagagatcctagagtggttagagatacaagggagagagattcanaagatgtcaaagatattagagatcctagactgaatagagagggatcagttaacagagaaaatactgttacaaaacaaaccttggatgcagctgaaaagattaatagggatccaagactaaatagaggaagatcatcaagtcgtgaagattccaaatttgatcgactgtattcaagaacaaataggaatcgatcacgttcaagatcgagatcatcaactagaacggaagtgattgaaggtgacacattttcatctccattagatagtttgtataacagtagagaagaacagaaatctggtaaaggatatggagttcagagttttagaatacctanaaagaanaaagatgaaaaagaaa

SEQ ID NO: 5409 - DNA, 401 bp, Diabrotica virgifera
  Clone ID: LIB150-005-Q1-E2-G9
agtcattgtgtaaaacataattttgattgttttactgaaattaactacctaatttttttatgaatatgaatagtgtaactttagtttttgttctactgcaattgtttagttatatgtacataattacaagtgatattaatgttgaattaagtagagtgtggggtcctggtttaactcctgaaaaaattgtaatgcctgcaagatatttttttgttgaattggtggatgttaataacaggaggataatatcagacgatattgaattaaatgccattgtggatggaggcactaaaacaaataagccctgtcgtatatggaccaacctgctcaataggaaggatggcagttacattgttagatacaaactgtatgaaacttgttcatatgtgaaaatttctgtc

SEQ ID NO: 5410 - DNA, 387 bp, Diabrotica virgifera
  Clone ID: LIB150-005-Q1-E2-H11
acccacgcgtccggccgaaccagaagagaaacctctagctctgccaactctagttgctgaagaaaaaccagctgagcaagctccaaaattggtcgccactgaaataaaagaagacaaaatcttactcagtgaacaaaaagtagaagctagtcctgtagccgaagaaaaactgcccgaattgaagaaagccgaagaacctgctccacaacttgaaggtaaatcagtgctcgaactacctgaagaaaaaccacaacctgcacagcctgaaggtaaattggaaccagtacaacctgtccttgcggcagttccagctgtagaattagaagtaaagccagaagaaaaaccagaaggtgaaaagaaagccaaatcagaagagcccaaaaccga

SEQ ID NO: 5411 - DNA, 431 bp, Diabrotica virgifera
  unsure (1)..(431): unsure at all n locations
  Clone ID: LIB150-005-Q1-E2-H2
gcacgcgtccacctaaatgtgctgtctatatttttaattttacaatcttcatatggtgatgattataccaaagaataccctaatgataccgaagatgtccaaggccctccagaagtcaccttgactacgcctaagcgggtactagtccatctangccagaatctgaatatcaactgcagcgccactggcgctcaacctatggaaatcggatggaaagcttggaaacgtgacatgcctagttcagtttacaccaataaaggatacattaagttcaacaatatccaatccgaacatgccggtatatattggtgcatggctaccaatccagctggtaccggaggtgctatagctgaggtcatcatagaaaataactaattgtcctcaaaaagtaaatgtgtataatatacaataaaatataaatttacctacat

SEQ ID NO: 5412 - DNA, 398 bp, Diabrotica virgifera
  unsure (1)..(398): unsure at all n locations
  Clone ID: LIB150-005-Q1-E2-H4
aaaaaccaagggggcctgttcaacaaaccataagtaaatttcaagttttggaataaaaaaaagcaattggtaacatcatggaaggggaagcaacggccgagactaaagttggatccaccaacgaaaattcacaagaaaaaccaaattatttcaatcgggggcaacgcccttgaaggggtcatcaaagaaggtggagattcggacgaggtggccagaaccatggtggaaaccagcattttgaaaatagacgaggtanaagcaattatggaggtgttaataganaccacgcanacaaagatgaaaacaatggtaatgacaatcgccaagaaggcgacggaaatcgccctggtggaagggatcgtgagggccgtgatgatcaaagaggagataatatggga

SEQ ID NO: 5413 - DNA, 414 bp, Diabrotica virgifera
  Clone ID: LIB150-005-Q1-E2-H5
aggcctgagtcatgatattttgaggttattttcgttgttaaatgtgtgttaagtaaattaaagcttataaaagtttcgcagttactagtattgagttcctagtgaatgataaatcatgagcatgtcagatcgcaccaaaaaattacttgatctcgctttggacaatgtaaataaacccgatgaagaaataacaactgctccgttttatagactacgacctcgtgcagagtcaagaaaaaatacaacacataatcttcctgaagacaatgaatcattcgtgttctcttccgatgactcgattattgatccagacattaccatgcaagatcttgttggaacttacagctatgaagactacgattttccagaatcaaatcaaagtcaactaatatggagacattctctggaaataaa

SEQ ID NO: 5414 - DNA, 400 bp, Diabrotica virgifera
  Clone ID: LIB150-005-Q1-E2-H6
gacccacgcgtcagcaaatatcagccaatatcactcacagacacttgacgaaaattatgtcttagtttattggagtgcaacgtagtgggacacaacaatgctccagtgaatttgcacacatatccttaaatcctgatgtgtattacagacattcagttgatggcccttcgtcgtcaactcctagtaaggatgaggttccctgtgcagacagaactacaattactacacgtcgcgatctacttgaaagttcctgagttttcatgtttgaagaatatccccttaaagcaaggctctacgtgtacaagttcataccttatcacatcaacgcatcatagacagtttacgcttatgacattacaagagattatccggtgtggaatattatcagagcatagatgac

SEQ ID NO: 5415 - DNA, 56 bp, Diabrotica virgifera
  Clone ID: LIB150-005-Q1-E2-H7
aagacatctgcagacgtaatagatggcttcattatctaccataaaggtacttgctt

SEQ ID NO: 5416 - DNA, 190 bp, Diabrotica virgifera
  Clone ID: LIB150-006-Q1-E1-A10
tcttagcttgcttcatccctctcttatattatcatactctgtagtgcttctaacaaggttggtcgttcgcggatgacgagtgtacacgtctccgtcgttaattactgctcacgggggtcgatcagtgacctttcctggctacagattatgttcgactttaactgctcgaggttaacgtgcgattacattt

SEQ ID NO: 5417 - DNA, 156 bp, Diabrotica virgifera
  Clone ID: LIB150-006-Q1-E1-A12
gttctttttttttttaaaagataagttgataaatttatttcaaataaatttatgtgatcaactcttctaaagcacacattgcatggggggccggtagcgagagtagctgagggcgcgctggtggaggagggaattggggagcggttcaagggggcg

SEQ ID NO: 5418 - DNA, 402 bp, Diabrotica virgifera
  Clone ID: LIB150-006-Q1-E1-A3
ttaagtttactaatggtatattttttatccgaaattggttcatttcttccaaaaattaattaaaatgagtttaaaaattactttttaataaaaatttattatattaaaatttaaataattaataaaaaacaactatcactgagaaattgatagtttttggccttttatatgttgcgatgatacatatatttaacaatttgaaatactaggatcttggagcttccacaattcgaacattttaacgttatttttggacctgtgaatctatggtgttgtaaagtctagaactaacattataccacgcataacaatttatgtactttatattaatttaccgaaatcacccctatgttaccaaaacatatttgcttattaaataaaaattgtaggttaacgaaaaat

SEQ ID NO: 5419 - DNA, 369 bp, Diabrotica virgifera
  Clone ID: LIB150-006-Q1-E1-A5
aaatttatttaaatgtgcaattaacaattcttccaccgtccgatttccatctaattcatattttctatcattgcaaaagtccataaacgctttccatacaaattttttactgtaaacagtattctttggtatatttgattcgataatttcattaatattctcatcagtattacaaccaaatcgtgacattttgaaatattgaatatttgaaatgtcaaaatcgaaatgaaacgaaatgtaggtatccatagctacatgattgagtgaaaacagcccatgggatctgttttcagtataatgttggttttattggttgtattcaatcagatgaccacaaattaattgatttcattggatttctaattgagc

SEQ ID NO: 5420 - DNA, 393 bp, Diabrotica virgifera
  Clone ID: LIB150-006-Q1-E1-A7
acggacgcgtggggaactgttttttctttgattgttgaatgataacaagtgtttttgaagttttgcaagtgcccgtgtaggggtgtgaatgaccgatttggatttttgattttttataatgaagattattcttcttatcctgctagcgatatgtacgatacttagcgcagcggaataccccagatacaaaggcaggcctccacctccacgacaacgtagggtaccaaccaaccaacagttctccaagaaatggcaccaaggaggtcccttaatacaaaatttgccacaaggtattccacaaggatttccgcaaggcgtacaaggagttcctccaggacacggccagttcggcatacgtgggccgcctccaagacagagacccgtcaaacacat

SEQ ID NO: 5421 - DNA, 680 bp, Diabrotica virgifera
  unsure (1)..(680): unsure at all n locations
  Clone ID: LIB150-006-Q1-E1-A9
agcccaagcgtccgcccacgcgtccgcgcgagtgaagtgaatgtgacctggacctcgactttgataccgcgccgtagctatgaaggtccaactatggtttctgcttataattcatgtgagctgcttgttaggaattaccaatgctgtacgctcatctatatatgcccctttgcatttgatcagtttgaaggacataacagccgacgaaagaagacagattgcactcctggagcagaaactagatagagcaaaaagatcaggacacccaggatcaggatcaggatcatccgggtcaggatcaggagatatcttaaacgctataaaaaacgctattggtaatagcatcaagaaaaaagtaggacaattggcaatggcgtcagcatctgcttccggagccttcagcaaaactagtagcggtggtggcgatcatcattctcatcatgagtattacgaacatcatccgcatccaccgccacatcattatgagagtcacagctcccacagctcccacagctcatttgatttctgggatctcaagaaatcagtcctcaacacactacttcaggcggtcaaagctatcaaaggtggcgtaatagctgtcaaaggacagctaatcaaaggtggaggcaagctggtgtcagcctctggtcatctagtaagttcacanggagacgctatca

SEQ ID NO: 5422 - DNA, 572 bp, Diabrotica virgifera
  Clone ID: LIB150-006-Q1-E1-B10
cccaagcgtccgctaatatttatttgggttttgaatgtaattattttatatttggagctcaacaggccctaaaggcccaaggcttgaaatttctccacgcttttcctccattttctcctgtccatggccgcagttctccaatttgttatcccgatgtccaggtctttcttacacgcttctagccactttcttcttggtcttcctcttctccctctaaattatatcttatacgtacacggctttaagaccaacgtcaaggtccacccctcggagacctgatttttctcagtgttatggaaatttatcggattctaaattttaaaactttttaaattcaataatattttggaacgttaggtccaacctcaatcttttaaaagacctattatcatttccattttttatgattttcactgtacaggttaaccatatgatattgtaaggataataattacagtatataaatatctactccttaattttttacactctccatgcactacggccactctttttttcagtagacacgactgtttgtagttgatacattgcttgtgattggtcaaaaattg

SEQ ID NO: 5423 - DNA, 513 bp, Diabrotica virgifera
  unsure (1)..(513): unsure at all n locations
  Clone ID: LIB150-006-Q1-E1-B12
ccaaacgtccgttcaacgacttgaacaagtttccaacatgaactctttggtaattcttgctttcgcctgcatggcagccaccgcctctgcctccgtcgtcggcttgggctggggagcaggattaggaggtttgggatggggccatggtgccggtatcatcaacccccacgctcttagcccaattggaccctctggaatcgtcactggagctggagctgccggtccatccggagtagtaactggagctggagccgttggaccctctggagtagtcaacggacacggagctgtaggaccaactggacccaatggtgttggtgtttggggagctcccgctttagctttgggacatgccggtttaggtgttggcggatggggacatggatggggtgccggacactggtaaacgaaaataattacaaaaaagaagttgttttgttgtgttttgtataaatagaactgaaaaatacaaaaatttaaataaacgttgtacatacattaanaaangaaaaa

SEQ ID NO: 5424 - DNA, 410 bp, Diabrotica virgifera
  unsure (1)..(410): unsure at all n locations
  Clone ID: LIB150-006-Q1-E1-B2
accacgcgtacgcccacgcgtccgacccagcanacaccgccttcaagatgaaacgatcccagcaagttaccgtcactaaaaccactacgacatatgaagaatacgaatatgaaaccactttctccgtttcgaagttatcgaaacttgagaatttcgttttacctcctagaactactatcttagcattgtctcagagcggaggagacaaggaagaagacaaaaagtatgtcgtcaccaatcacggaaaagctgatctttttgttgaggtaattcatctcaaaaaccaagatgatgctccacaatggtttgtagtccagccagaccaaaccactgagatagatattgaggacaatcttgaacaaagcgtattgaaagtgagcaacaacagttacgaacaggaagtgtcattt

SEQ ID NO: 5425 - DNA, 387 bp, Diabrotica virgifera
  Clone ID: LIB150-006-Q1-E1-B3
atttgttttgacatttccgttttatttaacctaacctatgttttgtgttttattgtgttgtattgttgtatacaaggagttgtatattgaaattgaattgattcttgtttcattgaatatagaggagttgttctgttgcaagttgttctagttttgttgttttaaaatctgcgaaaaactatttatagataatggtgaacttaaacaagaaatggacatgcagtttgctgattacttaattgtgtactcacaacacataggtacaggcattatgcaaatacataccatttagaggatacttcattcaaattggaggactctgcgatattgggcttccttaatagtttaccagacgtagacactgtctttttcttggtagaaaatgac

SEQ ID NO: 5426 - DNA, 359 bp, Diabrotica virgifera
  Clone ID: LIB150-006-Q1-E1-B4
accacgcgtacgctttagtgagtcagacatttcttctacatgtctagcattgattcatccatgaaacgcacagtagatgttgctttttgccgtatttttacggacaatttcgcagtttcttcggatactatcacggactcttgtgatgaccccaaggctcactacggctgtgaatcaccctgtatagcaacatgcaacgatcggcaaattgcaaaatgtgcatcacactgcatcaatggttggttttgtaactaacattatagtctaagttgatgacaatgaaaatgtgttttggtaaaacaatgttatcctcactaagagctattttatgagacacagtactgggaatctttttttcg

SEQ ID NO: 5427 - DNA, 377 bp, Diabrotica virgifera
  Clone ID: LIB150-006-Q1-E1-B7
acccacgcgtccggagaaagtggaaaaaatccaacaaattataaacacacaactccctgaatttatcacaaaacaagaggtgtacgaaaagatcacacaaatagaacaagattttcatggaaagctcagagatttagccatgaatgtaaccatgcttattatggaaggtggtggcggcggctctggtggtgtgagaggagggccaaaagcaaaagaagaacttgaaggacttgttcttgagaaactaaaaactttcaaacttgatgaacttgaatcaaaaattgacaggctttcagaaaagattcaattagaattaaaccaatacagacatgaatcgtatagtaactcaactctcttagaggaaagaattttgaaga

SEQ ID NO: 5428 - DNA, 650 bp, Diabrotica virgifera
  unsure (1)..(650): unsure at all n locations
  Clone ID: LIB150-006-Q1-E1-C11
cttatttcccattgaaaatagttgattagaaacatgccacaaggaaataacttcagaacaacattaatcctaatagttttgaaattaaacgttgacttaagaaaatttgttgcatatgcggaaaattttcgtctggtcatcaggcggggagttattgtacagtaaaattgtggcttatttaccatttaaaatagttgattataaaaatgccacaaggaaatagcttcagaacaacattaatcctaatatatagtcttgaaattatgtgttactcgagaaaatttgttgcatatgaggtaaatattcgtctggtcatcaggcggngagttatgtaataggatttcanatttatgtacaatgttggtccagtgtgactttaatgtgacccatttagggagcattatctcgatcacaaagaacaaatacaatgcccttacaacagtgctcatctcatatgaagaaaggtatttaatacgcatctggtaaagtgcaaaaaggctaatccaaatattaaattggtaaaatgtgacccattttgtagaagatacatgctctcagcatcatcacgaaaattgtcctgatcgaaagaaaattgagacgcatttttgaagttcaagtgtatcacatcttcgttagaataaacaaatagt

SEQ ID NO: 5429 - DNA, 425 bp, Diabrotica virgifera
  unsure (1)..(425): unsure at all n locations
  Clone ID: LIB150-006-Q1-E1-C12
cccacgcgtccgattttcatttagtttacaatcataccatattttttagtcaacgtaacgacaaatttcatttaatgatagttaattagtattgtgagagaatattttatttcttataacagaaaaatttattctttgcaccttgtgtatcatggattcacacttaataagtacatatttactattttcgaatttaanagagctaagagattacaatttttattgtacaaccaatattttacctaatttttttgctatgaaatgttactcgctcttaaatatatctaactttttaagaaataaatcaactttacttcttaacaatatatttataattagatatctttatattattaatagtaaatccttttagggatgagcttaaccctaaaattttactaaaactcaatttttaaatacaaatt

SEQ ID NO: 5430 - DNA, 352 bp, Diabrotica virgifera
  Clone ID: LIB150-006-Q1-E1-C2
accacgcgtacgtccaaccgttcaatctatgcttgagactgtgctcctgaattatttcttccactaaaaatggcgcaattgatggcattgttggcaattttggcggtatgtattgccgtaattacagctgtatgcgcaacttactgcgacaattgcagcgacgaagcctgcaaagaaaatgtaaaagttatgtatggtgttacctctgagaaacctgctgaatcagtttggcaaaccgtttgacaaaaaagtaaagtaggcagcgaagatagcaaagaacacagtgactaagcatgtagctatggtcacgatcactgtcacgcacactgtctcacatctaaagtcactgctg

SEQ ID NO: 5431 - DNA, 312 bp, Diabrotica virgifera
  Clone ID: LIB150-006-Q1-E1-C3
accagaagtcgccttctacatggtaggacccattgaagaggttgtccaaaaggcagaaaaattagctgaatctacataaatgctaggataactttgtatatttatttgtatgtgattccatcaatctgcagagagaaagatgtttctttttattaagatcatgtaaagaacttttcattacactaccagattttttttatatcgaaaatttttgtttattagccctaatttcatctgtcatgggtattgttgtatttttaattaatccatagctaagataaatctaaaaaaaaatgtggcaacggtcagaaa

SEQ ID NO: 5432 - DNA, 197 bp, Diabrotica virgifera
  Clone ID: LIB150-006-Q1-E1-C4
acaaagagagaggccaggacgcagactcccctttagtcgatcagtactgcacgctgcggaggatatcgcgtccgcgaaacacatgagcacccctctggcgtaacaaatccggtgcgagtgatcatcataatgatggcagcttatataagttacgccatggacataaactccttaagcgctgctcccagggggccgca

SEQ ID NO: 5433 - DNA, 365 bp, Diabrotica virgifera
  Clone ID: LIB150-006-Q1-E1-C7
aggcaagattaaaaaacggcaacgaaggaagaggaaattgctggaaattttagtaattctcacattgtttccgaaaactcaggaaattatctgaaaaactgcaaccgatatttcataatgttgccagatttctgcaaatgattgtattttaccttccagtattcgcgtagattttcaggagaagcatagttgcatcgagagaccaatattaattaaacgttagtttttgaaaaaaaaaagccccaacaacttgggcttttaggatgaataatacgtacatattcttcaagaaacagaaattttaatcagataaactaaatccagtattactgttaatgcagagaaggttcctatcttcaatgaga

SEQ ID NO: 5434 - DNA, 393 bp, Diabrotica virgifera
  Clone ID: LIB150-006-Q1-E1-C8
atattactgttttgtagtaccaagtatcaaaacaaaatcatttgtttaaattgtgtttttgtgttgaataatttccaaaacagaaagcgaaacatccaaataaaaatattttaagctgaaatgacacaagaaaggggtttcagaacaaaattatgataatcaatagtcttgtatcttcagcaaagggttgaagagattaacagaatcacatatttttatcagaatttagccaaaacgataaaatctctaggaacttgtctgaaaataaaaattataattattttttaagaaatactgctgatctatacataataatttaattttcctttgttcgcctacatatccttgtgaaggataatgtaatattaaatttaaaggtgtaaggtgtaaaaa

SEQ ID NO: 5435 - DNA, 642 bp, Diabrotica virgifera
  Clone ID: LIB150-006-Q1-E1-C9
gtaacatacaaagtcatagttcctcaaccctatccagtagaaaaggaagttccatatccagtgaaggtgccagtacatattcccaagccctacccagtagaaaagatcgtaccatatccagtgaaagtacatattgacaggccttacccagtacatgtacccaagccagtacccgttccagtagaaaagaaaattccatacccagttttcaagcccgtcccagtcccagtgaaagtacctgtagaaaggcccattccatatccagttgagaaaccccaaccttaccctgttaaagtaccagttccagcaccttacccagtagaaaagaacattccttaccctgttgaaaaaccagtcccatacccagtcaaaattcccatcttcaatccagtaccatataccgttataaagaaagtgccacacattgttgaaaaaccagttccagtaccagtaaaggttgccattccagttccagttaaagaacaccatcacgaagaaagcagtgggggacacgatttcggaggtcaagattacggtggacaggattttggaggacatgactttggaggtggacaagatttgggaggacatgatttgggaggacacgattttggaggtggagacatcggagggggagaccac

SEQ ID NO: 5436 - DNA, 666 bp, Diabrotica virgifera
  Clone ID: LIB150-006-Q1-E1-D10
cccaagcgtccgagcaagcaagatgaaaaagtaaaagtaaaaagttaagatgtgtttcacgccaaatatggtttttttgtactttttcaagtggcctgataaataattattgttccatatatatatgccagtataaggatataatcgaatataaatattaatttcttcaatcggacgtaaatacctacccgtattggaattcaagttttaaattgtaattataaaacttcaaacacaactggtgctgcaaattacttcaaaatgagtgaaattacactttatctttggaagccgaagctgccatgttccgttggccatattgcaatgcagcttccagatggcgaatatatcagcttttggccaagcacttgtaaatcatttacagctaaaggcaaaggctgttctatgtcatacaaagaggacataaaaaaggagaaacgggaagctgataaaacattgaagcttcccagcagcataattagtcaaaaagatgcaatcaattggtggaaccggtatttgtgctcttcttctactaattacaacctggtcgccgtcaactgcgctacctctgtgttcaattgcctcgttcagggtggtattttatcgaactgtgcctaatctttatcgtccgaattactttcagaagataacacctaatggggtatt

SEQ ID NO: 5437 - DNA, 283 bp, Diabrotica virgifera
  unsure (1)..(283): unsure at all n locations
  Clone ID: LIB150-006-Q1-E1-D11
agcccacacgtccggaaaaatacagagagttcaagttgaaaaatcttcaaaattgattttttgcattttgcatcaaatttgatttttgaacatgttccactaattctaaataaaaataaacttcatattcggattcagcgacttcgaaaccaaaaaaataccaaaatttgccattcacctatcatggtggctctttcgaattcctaagcctcaaattaggggtgtgcctctcgcctacacatttcaaaagcttcaacgccatacaanaaaatttaaaatacat

SEQ ID NO: 5438 - DNA, 376 bp, Diabrotica virgifera
  Clone ID: LIB150-006-Q1-E1-D2
aaggacgcgtgggcggacgcgtgggatttatgccgtactgcatatatgcactaaaaaaaataaatggcaatttaaaacaaatatgctgaactgaaaaattgtgcatactgcagccgatctacagatacgtcaccaatataatcttttgcaacatttttttgcaataaaccgtcagcaaacttaataattaatataaaaaatattttttctattgaatgaactgaaattaattctaaaaaaggctgacgtgactaatagttttgatctccaaatgacgtgaaatgataacaattatttgatactctttatgttttaataaaagttttaccaacattttgggcttaactaaaaaggtctagcctctttataattatag

SEQ ID NO: 5439 - DNA, 432 bp, Diabrotica virgifera
  Clone ID: LIB150-006-Q1-E1-D3
aatcagttaatctacagttagttaataaaaagtttttgtttgttgtgactcttaaggtatttttttgtttttaactgtataaaagtgttacgaaattttaaagaaagtataaatgtgtagaatagataaatcggccgtttaagaaatattcacagtgtgcttcttgtattttcttatataggcaactagttcactactgttttttaacctattcaataaagtaagttctttctgtttcgtttgttttatcttagataataatagaagatttttgtcatttcctacactagtagtcacagaattgggaagaagacttattgaaatatttatgctgaattttcgataggtaggattattaagacatgaatttaacttgtagatatttttgacgtttaaacgttggtaaaaaacgtcagtccgtctttctttttg

SEQ ID NO: 5440 - DNA, 420 bp, Diabrotica virgifera
  Clone ID: LIB150-006-Q1-E1-D8
aacttattctccactcagacatttccaaactctgctcggacaaatccaacagcaacgtgtacttcaacaaggtttattgacccaacaacaatatttacctcaacaatatctatctggggaataccttcttgaagatcaaatgaacactaaccaaatcttgaaccaaatttatagacaacaacttggacaatctccattgaaccgttatttggttaacatgagacttgtaaacggagagcaagtatacgaagttcctgaagaattcgttaacgttcaacttctcgaacaactcttcgccaagcaagaattgatcaaccaagaattgactgaaatcaccgaaagaagacaaccaatcactgaagacgttcactaccagcaacaactgattaaccaacagattcaaaaacttattgaacaatt

SEQ ID NO: 5441 - DNA, 441 bp, Diabrotica virgifera
  Clone ID: LIB150-006-Q1-E1-E2
aaacaacttaacatgatcaacttcatccaatacctcgttgaacaaggtaatcaagttgatcaacaattgtacgctgttcaaagaaatttttaccaacaagtccaaagacttgttcaacaggtagttcttcaacaatctcaaatcaaagaacaaatccaggtacttatccaacaagaacaaactgttccacaagaactagttttattccaacaattggcctaccaacaagttgaacaattcatccaagtattgatcaagcaattcatctaccaacaagctagccttagacaattagttcaagtttttgttcaacaaggtcgtgttgttccccaacaacttgtttccagctacttcctgatctacaaacaattggtccaattggttcagcaaagagatcttgttcctcaagaattaatcgctcaacaacaactgatccatcag

SEQ ID NO: 5442 - DNA, 402 bp, Diabrotica virgifera
  Clone ID: LIB150-006-Q1-E1-E6
gcgctactcttctatcatctatattctgtattattctagccactcaaacttttctaacaattctatttttcatcttgtttaattttcttagctttagattatggctttggacttttatctttctttctcttgagcttaaccttaaatattcacttttgtacttcattcttaccctgtagaaaacctaatgttactagtctaggaataacataattttcttcatcgaaaaatttaaatatctagtcaattctatttattgttaaatcttccttagacatttaaatatatttttaagtgttttcattgtcagcttcgataactacaacttacacatactgttcctcccaaatgttgtacattctttcttgaaaactttatacacatctttcaaaacgttaaatt

SEQ ID NO: 5443 - DNA, 430 bp, Diabrotica virgifera
  Clone ID: LIB150-006-Q1-E1-E8
agcaaaaacagaatttgtaagaagtgttgacaaaagtacagttctaatgcgtagatgaactttctagaacaaatcttgaactgaaagttgagttcttgtcaactaagcatccctaaggatcaaaatcgctcggtacttccgtcgtattttccccgatctgtggcttcagaccgaagcgcagatcagtccggtttgatttcttcaagcgtgaagatcgcttgccgactcaccccaaaagggcgtggtgccttttgttacccgccggtaaagggtatagtatgtcgttctggaagatctagtgtgagggcacgatgtttttttttaccccgtagtgaagttgggtgctcttacactgtgtttgagttgtgacgcagtactatacgccggcgtggtatgaagtccctgtatcttgtccaagttcctgtttaaa

SEQ ID NO: 5444 - DNA, 527 bp, Diabrotica virgifera
  unsure (1)..(527): unsure at all n locations
  Clone ID: LIB150-006-Q1-E1-E9
ggcaagattaaaaaacggcaacgaaggaagaggaaattgctggaaattttagtaattctcacattgttcgaanaatcaggaaataacctgaaaactggcaaccgatatttcaaaatggtgccaaaattccgcaaatgaatgtaatttaccttccagtattcgcgtagattttcaggagaagcatagttgcatcgaaagaacaatattaattaaacgttaatttttgaaaaaaaaaagccccaacaacttgggcttttaagatgaataatacgtacatattcttcaagaaacacaaattttaatcagataaactaaatccagtattactgtgttagcgcagaaagtgtccatatccacagtgatattagggagaacattgagacatctcatactatacacatcactctcgcgcatacacaaacttgccctgtataaacaactgtgtgaaaattataaatctcaattttatattgaaatggtgtataagacgatgcttaaaaattttgagaaatttgtcattacttaaa

SEQ ID NO: 5445 - DNA, 655 bp, Diabrotica virgifera
  unsure (1)..(655): unsure at all n locations
  Clone ID: LIB150-006-Q1-E1-F10
gaaagtgctgaagtgacaagtgtcttcacatgtgcgacaacaaatgtgctaaattctgaagattttggattacaaaaaaaaaaatatctccttaaggtccaccatgtactcgaagataaacaatggcgataaaagtaacatatttacaagaactaacagtatttgtcctcctcccgaagaagtacttctggatcgtgttctaacaaacgaaacagaccaattggagacgatagtcaacgagaaacttctaaaatatctatatcccgaccacagtaaacccatcctgttgatagcatgtacagcgaaggaagtggaggcaagaacagtcaagttgttaatagacttaggagcagatgtacggtaccaagacgaaaatcaatgggaggctcttcattatgccgctgaaagagctgactactttgtccttaaagttattatagacaaattaaaagagagaaaattccatttgaatgaagttttagcacaaggtagtaatgctttacatatacttattagacatggtaataaaaactccaaagattttgtcaaatgtgctaagcttttaatagatgaaggaataaatgtaaatttggcagataacaaaatgattactcctatcctttgggcagctaagaaagacttanacgatatcatc

SEQ ID NO: 5446 - DNA, 314 bp, Diabrotica virgifera
  unsure (1)..(314): unsure at all n locations
  Clone ID: LIB150-006-Q1-E1-F12
cgcgtaaggtcaactgttttgtctggcgtctccgcgttcgttttgcccgttcctgccttnctcgtcgtctgtggtggttctcncgctggtctgtcgctggctgtgctggcgttcctgctccgtccgtctgtggctgccttcttcnctgtcgccgtggacatgcgatgcgaggtctagtatcacctcatgaacgtcaacatggatcaattcggttttggcgctactggtggaagttattaaaggggttttgcctcgaagatcctcattaacaatgttgggctcgaactcatccagggtgccatctccaatgctgg

SEQ ID NO: 5447 - DNA, 432 bp, Diabrotica virgifera
  Clone ID: LIB150-006-Q1-E1-F3
ctgctccaaaatgaaggtactcattcttctttccgttgttgccttgagcagctgcttaccagcatccagaaatcaacaatacgttgatgtagactacaacagctacaacgctcatcccgtctacaacttctggaggacttggaatcagcaacactatggacaagaaccatggaaccaatgggtacaatatggtgtccagaaccaacccggtaactactggaggcagtacgtgcaacgcagcaaccaagctgaaaatgtcgatttaccttggatgtatcactcttgggatgtccaggatgtgcaaaacttaactcccgttcaacgtgttcagttgctactcaactacgtcagacttcaccaacaatggaaccaatggactcatgatgtaactgccaatgaacgtcttcagaatatgttgtatcaacaccttcc

SEQ ID NO: 5448 - DNA, 675 bp, Diabrotica virgifera
  unsure (1)..(675): unsure at all n locations
  Clone ID: LIB150-006-Q1-E1-G12
gcaaaaacagaatttgtaagaagtgttgacaaaagtacagttctaatgcgtagatgaactttctagaacaaatcttgaactgaaagttgagttcttgtcaactaagcatccctaaggatcaaaatcgctcggtacttccgtcgtattttccccgatctgtggcttcagaccgaagcgcagatcagtccggtttgatttcttcaagcgtgaagatcgcttgccgactcaccccaaaagggcgtggtgccttttgttacccgccggtaaagggtatagtatgtcgttctggaagatctagtgtgagggcacgatgtttttttttaccccgtagtgaagttgggtgctcttacactgtgtttgagttgtgacgcagtactatacgccggcgtggtatgaagtccctgtatcttgtccaagttcctgtttaaatgaagtcttccgagtcccgattgatgtcctgatgtagacattttgagttccagtcccgtgatgtttatccagttgattgccccgaaataaaaaggaagccatgaagcccacctcaagtcgatgaccctgtttgtttgtagatgaaccccctttccgtgtantttgtgacgtgtgataaaggattttgtttaaatatggtatgatatatttttttaaattttgcaaggattccaaatggataaatat

SEQ ID NO: 5449 - DNA, 334 bp, Diabrotica virgifera
  Clone ID: LIB150-006-Q1-E1-G3
agacatgttatggataatcctgaggatttgattaggtggattgatgagaatgaataagctggtgttactcaaattctaacatatttacagagcgtgcatgtgaactcatgtgcagccgtcgctgctcttgatgtacgatcctaatgatgatactagttccgtgacatcttaacttcactgttagcaatcacagcccatctgatatagaaattgaggttgcatacactgacagtgatcagcgtgctaatgatcagtataaggtaatcctaccaaatgagactgtcaaacttgatcatgataccaatactggtgtaactactgttaatatattgag

SEQ ID NO: 5450 - DNA, 433 bp, Diabrotica virgifera
  Clone ID: LIB150-006-Q1-E1-G6
acgatgactacatataagcaaattattgataaaaagttctttttaatcaaataatgacaaatagttttgtaacagaattgattgtgaaacagaatatattgtatatagaaaaaaaattgaattgtgcttccccaaaagttgtggatgagcactcgtttaacaatatgtacattttgattactactcacgaaattttgaactacagagtgcaccctatagtttataataattatctttaagcattttgaataacaaaaatagaaataagagttctaatcctagtttacgccatttttctaaaagatttatttactttcctggtgcaccctgtatagtatttttgcttaattttaatatttctctggctgttttataagagaatgtttttgtgaaataatttaagtggtgtgtccatttgtaccattttgaaagt

SEQ ID NO: 5451 - DNA, 433 bp, Diabrotica virgifera
  Clone ID: LIB150-006-Q1-E1-G8
acccacgcgtccgcccacgcgtccgaaactgtatcatgttgtctaaaatacagtttgttaccttaagatcacggagctattttacccatgatactataaataacaagataatatattgcacatcctgaagtcgtgacgtaactggagaccggcaagttcgtaatagttcgtaatcattcgtaatgtccgattagtaacataacattaaacttcaatgtatacaaatcccatgatactataaataacaagataatatattgcacatcctgaagtcgtgacgtaactggagaccggcaagttcgtaatagttcgtaatcattcgtaatgtccgattagtttgaattgttcgcggttgtaagctaagtgtattttatattttatttttgacgaaattttgacaggaatctcgacaatatatttttttcgaatacat

SEQ ID NO: 5452 - DNA, 513 bp, Diabrotica virgifera
  Clone ID: LIB150-006-Q1-E1-H11
cccaagcgtccgaccgccttcaacatgaaacgatcccagcaagttacggtcactgaaaccaccccaggatattcagtggaaaagatgtattataaagaatacaaatatgaaaccgctttctccatttcgcagttatcgaaactggagaatttcgttttacctcctagaactactatcttagcattatctcagaacggaggagacaaggaagaagacaaaaagtatgtcgtcaagaatcacggaaaagctgatctttttgttgaggtaatacatctcaataaccaagatgatgctccacaatggtttgtagtccagccagaccaaaccactgagatagatattgaggacaatcttgaacaaagcgtgttgaaagtaagcaccaccagttacgaccaggaagtaccatttccggctaaaggtggtcacgttattgacgacttggaaaacaacatggaagaacttcttgactcagacgaaccagaaactgaaatggtcgttctggaaaacttttct

SEQ ID NO: 5453 - DNA, 431 bp, Diabrotica virgifera
  unsure (1)..(431): unsure at all n locations
  Clone ID: LIB150-006-Q1-E1-H3
accacgcgtccgggttgccaacttggnaaatggaaaccgatgaatctcatttaaaaattgattatgtgaaggtgtgggcgctgtgaaaaaaacattttcttggaatattttgtttttaaatattccacaaaacttcactatatcgttatggtaggggagcaaagtacgctaaatttgcagtcactcaaacgttatgggaaacaaatagggttgtaataataggtcctaaaatcaaaaacagttaagtaaaattttcgtaattttagggggcgctttccattttttaatttaactttccatttctaacaatcgttttttccaattatagcgccatctatccataattcgaaaaaatatctcgaataaaagtggcttatttttacgtcccatttaagattttaaagtaaccccccaacccaactccgtggggg

SEQ ID NO: 5454 - DNA, 424 bp, Diabrotica virgifera
  Clone ID: LIB150-006-Q1-E1-H5
aaattgtcaattcatagagtcggacttcgtaacctgtgatggagccccaggcactcacaggagatattcttacattcaatataaaggaggtagaacactgggccaaagaggcagctgtgctagacggaccgtggatagttggtggagatggttcgttcactgctcatactgcttatgttattgcgatgaaccaggtcttaactcggatagatactttagtttacgaccttctatagccgatgtaaacaataactgggtggtaactgggatgcgatttgtcaaacgaaatcgcatgattcatattcaaattcagcagggcgtgttattgccctacggatatattaaccaagacagcgtacattggaagccggtagatgacttttcgatacagtcttggggtgctgttgaaggtgaagattaccat

SEQ ID NO: 5455 - DNA, 409 bp, Diabrotica virgifera
  Clone ID: LIB150-007-Q1-E1-A12
acgcgtccagtctgcaagagcttggttcctttggtgtctcctagctttggcttcagtttttggagttaatggcggaggacatggtggccaccatcacgtagtattcaaaatcccagaacacattcacaccgtcaaacacacacataccgtctataaaaccatccatcatcatacaaaaggtcacgaagagcctcacagccatgggggaaaaccattccattggcactgaagaaatttcacagttgaaatttagataagataattttttgcaagctttaattatggggtaacattccagtatgatttttttttcaaaacctatagattttctatatataagtaatatggaaaactgctgaggtcgccaaactaaaagcaaaacgcttcgggatacaccacaggtgcctct

SEQ ID NO: 5456 - DNA, 391 bp, Diabrotica virgifera
  Clone ID: LIB150-007-Q1-E1-A9
acatgagattcatttgcttagccattgtcacccttgccgtcgtggcccaagcagaaaaggccaaggacaaacgtttggcagtggatcccaacaccggataccatcaaggtgcctctgcgtactcccatcaatcttctcaaccacaatacgtctcagcccaaccacaacagcagcactactaccaacctgaggccgttcaacaacaagccatttcatatactcaacctattagcaagtacgcttctgctggtgcagctccagtacaaaagtacactttcgcaccacaacccgctaaacagcaagtacaatactcctcagcagctgatgtgtccagcttcagttacagcagccctatcgtatcttacaacaacttaggccttttgaaacagat

SEQ ID NO: 5457 - DNA, 403 bp, Diabrotica virgifera
  Clone ID: LIB150-007-Q1-E1-C10
accacgagtccgggcgaagcgggtgtgctaacgtggtgtacaattttacaattgtatttcctacactttctcaagttagttcttttgcagttgcttactgcataatttcaagtaatttattgtgtttgtgcttataaagttcaaataaacatggcaaatagaagaatgggtggcggacctggcggtggccttcggggcaatcgttcttttaatcaaccaccatttcaaggaggtagtggtgttagcccctggcaggggtctaatagttccggtcagggattgatctcccaaattacttccaatccccaacaacttgctcttgctctcacgagcttactacaacctcaacaacagaatccaccatcgttgctttctttgaatacatctcctggttataatcggg

SEQ ID NO: 5458 - DNA, 391 bp, Diabrotica virgifera
  Clone ID: LIB150-007-Q1-E1-C12
accacgcgtccgcccacgcgtccgatttagtccttaccaagaataacatctaaaatgaaatacatctactttttgttcatttatttcttggttgccttagcaaaggcagaagaaactgttagcttagaaggaaaactcccaaaatgtgagtgtagggatataatcgatgagatcttgtgcaagctaacagaaaactcagaaaaggtcctcaaaattcaagccaaactagccaaagtagtgaaagaaaccaatgaaattctaacagaagctaaagaaaactcagcccaagtgaaagaaatcgtctctgttagcaccttgcttaaatctcaagtcaactctacggtcacagtcgttactgccaataccgcagctatcattcaaattaaaaatc

SEQ ID NO: 5459 - DNA, 146 bp, Diabrotica virgifera
  Clone ID: LIB150-007-Q1-E1-C9
gaccgacgcgtccaaggacgcatgggaagagcatgtgttgtaatatgttcaaatgacaatttctctcattccttatttacaaaaataaggaatgagagaaattgtcatttgaacatattacaacacatgctcttcccacgcgtccg

SEQ ID NO: 5460 - DNA, 384 bp, Diabrotica virgifera
  Clone ID: LIB150-007-Q1-E1-D10
aagatgaagtgtctagttcttctttccctagtaacccttagtgtagctgcctactacccaagtactggtaggcaggtgacagtaggagtagctggaaatgtgaaactagtcggctctcaaggttcccagattgacattcgtagaagtccttacaacccaagaactgtcgacgtcaccctcagaagtccaaatgctccaaccagaactctgcaaattgatgaagccaggaacggccaacaacttggttattccaacctccaaggtgtcaacaaccaaggtgtacaaggtgttagtgacattgtctctctgcaaggactctctggttatggcaacttccaaggacaatcaagagtatattccccactcaaagagatcttaaagaat

SEQ ID NO: 5461 - DNA, 422 bp, Diabrotica virgifera
  unsure (1)..(422): unsure at all n locations
  Clone ID: LIB150-007-Q1-E1-E10
atttagaaaagaaagaaaataataacaaacaagaatctgttaccacaagatcaatatcagcttttanaaaagatagaaaagtaaaattcgtccaagaggtcgataattctttgaacgaatctcaagaatctcacaaccaaacattgcattctactaaagtagtaaaaaatgttaattctgaatcaataacgaagcctgaacctaatttgcatcacctcaagatagaagatctgaatgtaatcgaaaagatcaatcctattataagtacagctaaagatgttaaaaattcggttaatgacactaaaaaacttatagaaaacaatgaactaaacacgagcttcaagtgtccaaaaaacgctgtacaattttatacgagttggaaaaacttcagaactaccgaagagaaatatacatacctcaag

SEQ ID NO: 5462 - DNA, 387 bp, Diabrotica virgifera
  Clone ID: LIB150-007-Q1-E1-E12
acacgataatcatgaaggccttgattgtccttagcgtttgcttttgcttaactctagctgccgaatccgagaaaaaggaagtaacgcaagagagtaaaaaacaagagaaacgcggtctttacggccttggtgatcatggtggaggattcggcctaagcggccacgattttggaggcggccatgattttggaggcggtgattacggaggtcatcaagaacaccacgaacacgtaaaaacggtcgtagttgaaaagaaaattccaactccttacgaagtagtcaagcatgtgccttacaccgtagaaaagaaagtaccatacgaggtcaaagtaccagtaccacaaccttacgaagtgtacaaaaaagtaccatatccagtaaaggaaa

SEQ ID NO: 5463 - DNA, 379 bp, Diabrotica virgifera
  Clone ID: LIB150-007-Q1-E1-F10
agaacctcgtatgtgtgcaatgatgagcctccaatactgtggattggtccttttggcaagtcttttgttggtttccgcccaacctggaaccgactctaaggctgaagccaaggtatcttcagtagccgagaagaaacaggaaaaacgtggtcttcttgatctaagctacggtgggggacacgactttggaggaggacttgaacttggagggcatggtttggatttgggtggacatggtggtttcgacggaggatatggtggagggttaggtggagggtatggtggattagacgaaggtcatgttaagcacattaccatcaccaaagaagttaaagtacctgttcctgcaccatatcccgtacacatcgaaaagaaaata

SEQ ID NO: 5464 - DNA, 441 bp, Diabrotica virgifera
  Clone ID: LIB150-007-Q1-E1-G10
attctagggtcgacgacgcgtccatcttcaaatcctatacaattgggacaatactctgtcgatgttgagggaggaattgttcagcgccgttaccaatctctacgagtacaatccggacagcattcataaaattgtcattgagaggtctttggtgaccaaggcaatgaactgtcatttgcgaccgcagaaaaaacgagaaaaatcgacgaagaagtgtccggtttgtgtctctaataattgtttgaagaggtatgagttaaaattgtttaatatgacacaaaggacggagacgttcgaagagatgtcgttgaaaggtgactggaagccgacgtacccagaaatcgtcatgcaatcattacacaacatcctaaaactacaaaatgcaaatcaagaattcattaaagatggctggacacaaattaatatgaataacaccatgaa

SEQ ID NO: 5465 - DNA, 256 bp, Diabrotica virgifera
  Clone ID: LIB150-007-Q1-E1-G9
acgcgtccgggacaaagctcagtgctattgacttacgcatcagattggcaagctgaaaaagctatcaaaaatcttgataaagctagaattgatggaaggatgatcgacgccagattgtacttctaaattagaacattaagatctttttttactattattttaaattatgtttagttttgaggtgccttggtgcaaatattattgtgtaactcattcagttatgtgtgtttgacattcagaataaaggaatagtttt

SEQ ID NO: 5466 - DNA, 346 bp, Diabrotica virgifera
  Clone ID: LIB150-007-Q1-E1-H10
acgatcaaatgtcgagatcttcgatcgctagtaatgcttactgtcactgcatgctaaccaattactgctatgcaggtcacagtaagagtacctgggcaatgtgaaactagtctactctcagggttcccggactgccattcgttgagatctgtaaattccaagaactgtctaagtcacactcatgagtcaaaatgctccagtcataactctgcaaattgatgaagccaccttcaggtattaccttggcatattccaaactccatagtagtactaaccaacgtgtcaatcaggctgatgttcgagctgatcatttcagtcaatataatggtaatgcaaatgaccaaat

SEQ ID NO: 5467 - DNA, 234 bp, Diabrotica virgifera
  Clone ID: LIB150-008-Q1-E1-A4
cgcccacgcgtccggttagtccatgcagtagctgcagtaatgaataccgttagcgtatttgcagctggatggcattgggggcgtcctcctccttttgtccgattactaactaggaaatgggcggggccactggtttaaccaacggtccaaatcctaataaccttccggggtccctcttcagaaaaaaggaaattttgtaattgccctaagggccacctttttaggaacttcctt

SEQ ID NO: 5468 - DNA, 375 bp, Diabrotica virgifera
  unsure (1)..(375): unsure at all n locations
  Clone ID: LIB150-008-Q1-E1-A5
aaattttcacggaaataggcatggtattcgtagggtgcagcaaaatagtgctaaaatttgttgattgacgaaggaccgacgtgttttttacacacttgtttaaccaaaaactcaagattccaccgaaaacctttatcgaacccagagggtggctaccgaagggtcgtaacttggacgaagctagcccagatactagcagccttcttttaccctacaactggaaaattttcctaaacggcgaaccgccttggcagtgctgacaaaaatctaagagatactaagtcacacctaccttaatagacctgtgtgaatctgagcacaagctgcctccttgcttatttcatcganaatattcaactgtatttgacaaagaca

SEQ ID NO: 5469 - DNA, 301 bp, Diabrotica virgifera
  unsure (1)..(301): unsure at all n locations
  Clone ID: LIB150-008-Q1-E1-A7
cactgttcttgcaatttttagaaatttgttaagtattattgttgctgtttggagaaataacgggaaaattctgtgaatagttcgtattaaagaaatgtccatatttggacctttgatgggagatatggaagacgatcctttctttgggtgtcatatgcgacacatgcgtcaaatgagcaacatgatgaattcactattttctgatcccttctcaatgttgagaccaccaatgttgggatatgatgattatganaaccgggctctgactagtcgccacaacatgcacaattcactaatgtcc

SEQ ID NO: 5470 - DNA, 279 bp, Diabrotica virgifera
  Clone ID: LIB150-008-Q1-E1-B1
aaaaataccaaattcaaaaatggaaacggcaaatataactgaagaagacttactaaaaaagcacagacaagagaaaaaagacttcaatcctaaatacaagcactaaagaaaacagttcctaaaaggtgataaaaagaaaagaaagaaataactgaagaaatcgcaaaactagaattagaactagacgaaaaacacagaaaagaacttggtgaaagtaatatatgctcagaacagctcaatattagtacggaaaatggtgaaaatgaaagtgaaatgact

SEQ ID NO: 5471 - DNA, 301 bp, Diabrotica virgifera
  Clone ID: LIB150-008-Q1-E1-B11
tattcaagaagacatcaagaatttagacgctgtcctcgacgttaacgttgaactggtcaaccaagagaatctaatcatccacgatatcgatgtcagagttagggagctcggtcttgaaggacaagaactggacgatatgatcgactctaacaacggcactattaacgatatcgaaacaattgtggacgaattacaaacttgcgcatgtgcagttacaacaccggtgggcagtgggactcctactactaccccatattatttcaatcatacgtactacgtaaaaattaaagcacgttaaaat

SEQ ID NO: 5472 - DNA, 442 bp, Diabrotica virgifera
  unsure (1)..(442): unsure at all n locations
  Clone ID: LIB150-008-Q1-E1-B8
aaaaataataagaagaaaaaataagattcaggttatgttatgaaaacgtcaacaattgtatgtagtaaataaaattagttattaaaatgcagtactgcaagtaaaataaaattaattaaattaacttttatataataattgcatatcatatcaatattgtggagcaatatataatttttctgcttcattgacagaaggtatgaaatatacgtcaatttgacaatttcaattgacaatatgaattatttaagatagttgcaatatttctccgcgactcgcgcaaggtcgtttctcgtttcccctttcaagtacttgcacacctcgaatactgtaatttgtaaaaatagccatgttttaagccanattatacttaataacgtttaccgtctggcctatcattgaatatgtagcattcgactgatatattatccattcacaatga

SEQ ID NO: 5473 - DNA, 200 bp, Diabrotica virgifera
  Clone ID: LIB150-008-Q1-E1-C10
taagttaatgataaatatattttatgtagagtaaaacacaaatttcaccatgcaagtggcccccgtaattaacgataagtccctggaagaccaggcccaagaactcaaggtgtaattaaaaagtcttggggctgaaatttctgaagaaaagttccccaaaggtataaaacacgatttacattaaattaatggggtaggtg

SEQ ID NO: 5474 - DNA, 134 bp, Diabrotica virgifera
  unsure (1)..(134): unsure at all n locations
  Clone ID: LIB150-008-Q1-E1-C4
gccttcangatgtaccgcctactatcccagcaggatagcacccaggaatattcagtggagacgacgacatatgacacatacgaatatgagaccactttctctgtctcggagacatcgagactagatcatttcgt

SEQ ID NO: 5475 - DNA, 396 bp, Diabrotica virgifera
  Clone ID: LIB150-008-Q1-E1-C6
aagagattcatttgcttagccattgtcacccttgccgtcgtggcccaagcagaaaaggccaaggacaaacgtttggcagtggatcccaacaccggataccatcaaggtgcctctgcgtactcccatcaatcttctcaaccacaatacgtctcagcccaaccacaacagcagcactactaccaacctgaggccgttcaacaacaagccatttcatatactcaacctattagcaagtacgcttctgctggtgcagctccagtacaaaagtacactttcgcaccacaacccgctaaacagcaagtacaatactcctcagcagctgatgtgtccagcttcagttacagcagccctatcgtatcttacaacaacttaagccttttgaaacagattgctggt

SEQ ID NO: 5476 - DNA, 141 bp, Diabrotica virgifera
  Clone ID: LIB150-008-Q1-E1-D1
cggttcaaaataattttgcctgtgcgcctcccctaagtctgttaaacacaagcgaatcccaaagggggttgccactaagaccaaaaaaggaactccccggaaaggcaaagcaaattccaagtttccctttttggaacaact

SEQ ID NO: 5477 - DNA, 363 bp, Diabrotica virgifera
  Clone ID: LIB150-008-Q1-E1-D6
cacacgcgtccggaataacattgtaagtatcccattgttcgtttttgagaagttgaagaaagggttttaaaattgtgataatggtgagtttatacattttaagggtgagtacaagctttgaatgtacaagtttgccactgttataattttaacaccttttttctatttcctaaatacaagtgattaggcacttgcattgttcggtggacccgtcaaattaattttagctcataaactgaaaaattgacttgtctgcttgtgtcccctaaccacagagttatctatgttattcggttttattaaaaagttaaatttcccgtaaagtttacttagaatatcatcagatcattgactcagtaaaca

SEQ ID NO: 5478 - DNA, 340 bp, Diabrotica virgifera
  unsure (1)..(340): unsure at all n locations
  Clone ID: LIB150-008-Q1-E1-D8
gaccacacatcaatagctatgaagtatctatattatgtatatttcttttgcacactttcctgttatgtatcagcagaagacgtcctactaggaactgatctttgtgaatgtaatgaatgcctgaaaccaatccttgaccaacttgggggcagcaacgttacaatccagaagatcgaagctctcatacaaagattaagaaaagatgtcgtaactattacagtaatactcaacggaacctgtgaaaaaatcaaagtattcangaagacatcaagaatttagacgctgtcctccacgttaacgttgacctggtcaaccaggagaatctaatcatccacgatat

SEQ ID NO: 5479 - DNA, 146 bp, Diabrotica virgifera
  Clone ID: LIB150-008-Q1-E1-E10
ccaaacgtccgaatgttgcgccttaagtgaatgtgaagttaaagtgccaccaagaaagtattttaaataggtacctacaaattaacgagtgttcaataaaattgaaaaaatgccaacggtttaacgtgactacagttacgaagaac

SEQ ID NO: 5480 - DNA, 290 bp, Diabrotica virgifera
  Clone ID: LIB150-008-Q1-E1-E6
aaaatatgtaaggacttacaggcttaaaagtacaaataattataacaaaatggcatactttcactatcggtgtggtgaaagaattacattaataaacgaaaattgtactgccattcgaaatgaaagtgaatttgatcatggcttggtcatttctgcagaacccctacaaaatgatgttccttttgaaataaaaattgataaaaaggtcaatacatggtctggaagtttagaaataggtgtagttgactgtgatcctttagattttgattttccaacatgtgcatcaaaaa

SEQ ID NO: 5481 - DNA, 415 bp, Diabrotica virgifera
  unsure (1)..(415): unsure at all n locations
  Clone ID: LIB150-008-Q1-E1-E7
gatcttctttccctagtaacccttagtgtagctgcctactacccaagtactggtaggcaggtgacagtangagtagctggaaatgtgaaactagtcggctctcaaggttcccagattgacattcgtagaagtccttacaacccaagaactgtcgacgtcaccctcagaagtccaaatgctccaaccagaactctgcaaattgatgaagccaggaacggccaacaacttggttattccaacctccaaggtgtcaacaaccaaggtgtcaaccaagctgatgttcttgctgatcttttcagtcaatatganggtattgtagatgaccagaccttctacagtttgttgaacaaacttcaacatttggtacaagctggagtcatcaacagaatagtcttggatgttgttagaaactggg

SEQ ID NO: 5482 - DNA, 197 bp, Diabrotica virgifera
  Clone ID: LIB150-008-Q1-E1-F10
tgggttcagccagttctcattttcttggctggtgccacgttgatgtgtgaatattttcaatttagttacacatatcaattgtatgtttaacatgaaaattcgtcaatatgttccggaccggttttctgctggtaatctttttgaatgctgtttttgccgctgaagatatcaaaacctaagatggagttttggtcctc

SEQ ID NO: 5483 - DNA, 147 bp, Diabrotica virgifera
  Clone ID: LIB150-008-Q1-E1-F11
atgatacaacaggatctactgaattcatttactatgacattatgccaaaaaaattggctgacttagaatacttcacatccaaagaagctgtcaaacagccactgtttctactacctcacaacttttgtcgatacgatataacacacc

SEQ ID NO: 5484 - DNA, 331 bp, Diabrotica virgifera
  unsure (1)..(331): unsure at all n locations
  Clone ID: LIB150-008-Q1-E1-F3
taaaggttaaatttgtaaaatttatggtaaaattagataaaccacattaaaattaatgataattatcatagaaaacgaagtccaacaaaaggagtcccataggaaacgttttgcaatcatttcttgaattttttgagaaattttcgtaggtccgaaaaacaacatgtaatagtaactgaattagtaagaagaggagcccaaatttcgagacagatgaacgaaaaaaactttatttgattcctttttgtaaattttaaaattaattagtgttgtttaagacaatcaanattgaaccctcacgcacaagttgtaagtacgtacaacttcagtg

SEQ ID NO: 5485 - DNA, 227 bp, Diabrotica virgifera
  Clone ID: LIB150-008-Q1-E1-G10
ttaaaataatagaatattttttagtaaaagtaaagaaaaattttatttaatgatagttaattagtattgtgagagaatattttatttttataaaagaaaaatttattttttgtaccttgtgtatcacggattattaattaataattatatatttattaatttcgaatttaaaagagctcaaaaattaaaatttttagtggtaaataaatattttaaataaatttttt

SEQ ID NO: 5486 - DNA, 285 bp, Diabrotica virgifera
  Clone ID: LIB150-008-Q1-E1-G11
aattttagggatgagcttaaaaataaaattttattaaaatttaaattttaaataaaaattaagagtaaaaattttcatagtttaaaatatggtattaattaattttatagaataataattttaagttttataaattttttagtaaaatataaatttaaattatttaaatttagtaatgatgataataatagtattaaaaaattgtataattagtaaaaatatatagggttaataaaggaattcggcaacatttttttcacctggttattaaaaacaagtcctttt

SEQ ID NO: 5487 - DNA, 277 bp, Diabrotica virgifera
  Clone ID: LIB150-008-Q1-E1-G12
aaacattgatttttttttatatagaactaacactttcgatagcgagtggatctaaaactattaattttatcaaaaaagtgtatagagcgttttttgctttgggtgaatgtttttaccaacttttgctgtcaaggtgtaatggggggtttccgcccccgaggtggggtggcaaccacccccatggtgggggcgcctttcggcgtcgtatggattttgatccttggactgtccactgcttgttctcggattttcgagcaaatcgattcattctggtaaa

SEQ ID NO: 5488 - DNA, 271 bp, Diabrotica virgifera
  Clone ID: LIB150-008-Q1-E1-G5
gcatttgaacggtgcgtccggcacaaggcttttgaagttctgcactcggcgcgagtgattgtggtgattgtttttggttttagtgtgttttcgaaaaggatttaagtaacaatggtcaaaggaaaagtaatacaacttaccgacaacatgtcgaccaaagacagagtaacaatatgcgccgcagaaattggaggaacagccatgctcgtttttttgggttgcatgggctgtgttagctccttggcttccggaggtgtaattccccacgaac

SEQ ID NO: 5489 - DNA, 259 bp, Diabrotica virgifera
  Clone ID: LIB150-008-Q1-E1-G7
acacgcgtccgggagaaactaacatcgttgacaaccatggcggctaaagaaaagaatgtcaagaagaataataaggaagaaggcgaagcacctgctgccgctcctgcccccgccgaaaccaggtcctcctcaaagagttcctccaagaaagccaaaaggtctggttccaatgtcttctccatgttttcgcaatctcaagtagctgaattcaaagaagctttccaacttatggaccacgacaaagatggcatcatctcta

SEQ ID NO: 5490 - DNA, 189 bp, Diabrotica virgifera
  Clone ID: LIB150-008-Q1-E1-H11
atcagatatcgaattttatcaattttataggaggtatgtcaaaaatatgaatttcgctaaagagtaaagtacctttatatttcagaatataaaaaattgttattatgaaaagttgtttcgaattaaaaactatgttttaatatgcaactaaatcctcccgaagcacccaattctggagtaaaacttttt

SEQ ID NO: 5491 - DNA, 390 bp, Diabrotica virgifera
  Clone ID: LIB150-008-Q1-E1-H5
gcctgagtcatgatattttgaggttattttcgttgttaaatgtgtgttaagtaaattaaagcttataaaagtttcgcagttactagtagtgagttcctagtgaatgataaatcatgagcatgtcagatcgcaccaaaaaattacttgatctcgctttggacaatgtaaataaacccgatgaagaaataacaactgctccgttttatagactacgacctcgtgcagagtcaagaaaaaatacaacacataatcttcctgaagacaatgaatcattcgggttctcttccgatgactcgattattgatccagacattaccatgcaagatcttgtgggaacttacagctatgaagactacaattttccagaatcaaatcaaagtcaactaatat

SEQ ID NO: 5492 - DNA, 210 bp, Diabrotica virgifera
  Clone ID: LIB150-008-Q1-E1-H6
aaaatatcagctaatatcactcacagacatttgactattattatgtcatagattatgtgtgcaagtgtgggacataaaatgttccatagatttgccactttaccctaaaatcctgatgatgaatacagacgttcagttgatggaccttcgtcgtcaattcctggtaatgatgaggttcactgtgcagtcagaacttcaattactgcacgt

SEQ ID NO: 5493 - DNA, 160 bp, Diabrotica virgifera
  Clone ID: LIB150-008-Q1-E1-H7
cggggccacccacgcgtccggacatctgcagacgtaatagatggcttcattatctaccataaaggcactttattaaaggtaaagggcttagcattgcgacacacatatcttctcttatattcgaaggagttctatttggtgccttgtctctcatggatta

SEQ ID NO: 5494 - DNA, 373 bp, Diabrotica virgifera
  unsure (1)..(373): unsure at all n locations
  Clone ID: LIB150-008-Q1-E1-H9
acacgcgtccgatcaaaagaagctttcaatttttcaatttcatactttatattataatttgttaatttgtattgtgttcgtccttcgtgaaagatgaataataatatgggatataataataaagcatgggggagaactaacaactcctccaacttaatgaatcagaatcaattacaatcacaacaacccggtggtctaagaaacatggtcncctttccgggaaatcaacaaatttttcaaaacccattgggacttcaacagcagaacctggggctaaggttacaacanataaacaatgcaattgacggtgcanctgcactcagctcccaaattgctagcaacccaattttccaaacaggtatcgtacccgaat

SEQ ID NO: 5495 - DNA, 423 bp, Diabrotica virgifera
  Clone ID: LIB150-009-Q1-E1-A1
caacaaacaccgccttcaagatgaaacgatccaagcaagttaccgtcactaaaaccactacgacatatgaagaatacgaatatgaaaccactttctccgtttcgaagttatcgaaacttgagaatttcgttttacctcctagaactactatcttagcattgtctcagagcggaggagacaaggaagaagacaaaaagtatgtcgtcaccaatcacggaaaagctgatctttttgttgaggtaattcatctcaaaaaccaagatgatgctccacaatggtttgtagtccagccagaccaaaccactgagatagatattgaggacaatcttgaacaaagcgtattgaaagtgagcaacaacagttacgaacaggaagtgtcattttctgctaaaggtggcacgttattgacgatttgggaaacaa

SEQ ID NO: 5496 - DNA, 370 bp, Diabrotica virgifera
  Clone ID: LIB150-009-Q1-E1-A10
aggatccgcaccagtacacaactcaccacaagctggaggcggttttaatttcccgccacctgcctatagtccagcaggccatccaggttatagctcaggtggatatcatgcaccacctgcttacagtgcaaatcccagtggaggtcatgtaacgattatcaacaataataatcatcattattcttatccagcttatgtaccaacttatcattatactacagcagatacaggaagcagccatcttggtttctttttgggatattcattatgaagactaacctctccaagctaccactatcacagctccgttttatatgataatacaccaagatacgaccactacgaagtccatcactactatcacaacagc

SEQ ID NO: 5497 - DNA, 328 bp, Diabrotica virgifera
  Clone ID: LIB150-009-Q1-E1-A11
gtccgaaaaatagaatttgacctgtagagggagatccagtgatcaccctctttacataaattaaattaaaacaaaaagtttagttatcacagattatttgaatcttcttgctaggtccactactttgaatctcttcaggcgtcgtacatcattgtgatcatcagtgaggttgctggctaactcgtttggatgagattctagtctcttggaatattttttgtaatattccgttattactgtttttatggatggcacattgaggtctttctctatcacatagtttggcacgtaccaaggggcattcagcattgttctgaaatctctgcag

SEQ ID NO: 5498 - DNA, 242 bp, Diabrotica virgifera
  Clone ID: LIB150-009-Q1-E1-A2
actatattatcgttcaacggtgccgtgaattttgcttatgatattcaaccggcatactgcagatctctcgatttcacatgctaacttatgcagccacttgaaatgtttcaacaaactccaagctgtaatagctacatacagccagaggtgtgccgatgcagcgatcctcactctgttgaggtcgtcagaaattgctacaaagtacatatctgcggtaacgtatgtcgcagatcgcacaattt

SEQ ID NO: 5499 - DNA, 268 bp, Diabrotica virgifera
  Clone ID: LIB150-009-Q1-E1-A5
ccacgcgaacaaaatatcgtcatcttgtgcgaaattgcctacaaaatcatccgttccagttatcaacccacaagggaaaaaacccccaatttgggggaaaagtctaaattttcagaatgttgcattgaacattgtgaatgactgtttccatcctaatgacaacaatcatccaaatgtttcaaactttgaaaattatttgaaagacatgattaagatttatggcacaacatgcaaacttggtgctggcaacagtggtcaacaatcagtt

SEQ ID NO: 5500 - DNA, 181 bp, Diabrotica virgifera
  Clone ID: LIB150-009-Q1-E1-B10
cgcgtccgaacacgagtccgctgagttgtgtggtgctcctggacctctttgtcatcaactagtttttttttaaatctccttaaccatgtctgacgaagaagaagtttactccgaagaagaggaggaggaagaagtcgttgaaaccaaaacgactaccaacactaacaacaaagtccaagga

SEQ ID NO: 5501 - DNA, 355 bp, Diabrotica virgifera
  Clone ID: LIB150-009-Q1-E1-B11
cgtccgagctgaagtcagaactatctgctagaaacgattccttgcatcatctacaaaccatggtggtacagttctcatgaaatcaatctgatacagctaaattactggctactatggaaagtgacagagtcactgctgctcgagctgtccagcacaatatggaaatcaaagagcagttagagactatggcataagtatttgccaaaatgcacaatgacaaggtgtcacttatagataagctaagcattcagcagtctgcaagtaaggacctacttgataaattgcaaaaaactgaattgcacttacagatgttaactgatgctatcgacatcaaagatcgagagctttcgcatct

SEQ ID NO: 5502 - DNA, 400 bp, Diabrotica virgifera
  Clone ID: LIB150-009-Q1-E1-B2
ggattacatccagtacagctccagcgccggtttcaggaggctatcaaatagaaaaccagaactcacaagactctcaggctagttcccaaccatttacaacgctacctccaattttgaatatcaacgagatattccaaaatctagtagcttctggattagtaaagtcatcaccaccaagtaagccagtagaagagccacctaaagtggtagaatcgcctaagaaggaaatgagaattgagcctgaagtacctgccgctactagtactccaaacgtagcgccctcaaaacttaagaaaaccgtattgagcctgaaaccagtcacttttaacaggccagaaacgctgagagtacgccaaaacagcctatatgcaatgttatattctggtatgcaatgcagtac

SEQ ID NO: 5503 - DNA, 446 bp, Diabrotica virgifera
  Clone ID: LIB150-009-Q1-E1-B3
attcatctttactgttgtacttgttcgatagcttatggctgagttaaattaatgatatgggtagctactgtaagtgggcctttttatactgaaatattttataatgtaactactattcacttttttgaatggttgattttctttaaatacttttcataaatctttgacattattacattttgctggccccttttaaacaaaaaagtcaaagagtgtggattaaatgtgggaaccattgtatcattatacaagaaagacagtttttaatataataaaacgatttgcaagtaatgctaaaatactgattaagcgaattactcatttttggttaatagatatgaatgctttggttcattaattttattatagcatattaataaaccaaaattacattatatgatacatatggaatattttgatattggatatataaaaatatgaaatat

SEQ ID NO: 5504 - DNA, 333 bp, Diabrotica virgifera
  Clone ID: LIB150-009-Q1-E1-B4
acaagacttcggtttaatttaaaataaatatattatttttagtaaaaattaattataattttagttaatgaaagattattgtgaaaggggaaaaaaaatttaattttaaaaaattaaaatttaagttctggtgcctcagggaccaggaattattaattataacatttacattaacaatttccgaattaacaaaacctaaaaatttataatgttaaagggaaattaaaaatttaaaataagtttttggtagtgaaacgttatccgttataactaaatcccaatttttaagaaaacaattaaattttattaataaccatatcattaagaattaat

SEQ ID NO: 5505 - DNA, 370 bp, Diabrotica virgifera
  unsure (1)..(370): unsure at all n locations
  Clone ID: LIB150-009-Q1-E1-B5
cccggtcgaccacgcatccatatgaatctagtccgaagaagaatccaagggagcanagccatctcgacctcctccaaaactcctgatagaaaccgctataggacaatggaccatattatcagttgtcttangtgctgttgcagttctaacagttattgccataactgcagatgagtgtangaaatgcttcgataaagcatcaaacttgcaaccgctagagaaaatacaaaaggcgtattgggcatatggaaaagatgtcgacggaaggcatttgaaagaagttttcacgatactagatcgattangatacaagaaagacgataattactcagagtgggatctgctttgggcccacgattatccctttacg

SEQ ID NO: 5506 - DNA, 345 bp, Diabrotica virgifera
  Clone ID: LIB150-009-Q1-E1-B6
aagcacttcggctcatattttggtttttggtgcggtaatactaagtgttttcaaattgcttgtttattgattgttattcatgactacgctgacgagatgccagggatcatcaatgctttcatcgtgccatcgatcttttgcgtcaccgcattggactcgcagtacagctgttatcatgactcatttaccgcaagtgatccagctgctgcaaggagtgttgactgattgaataagtgttatgcagtattcggtggtagatattcagcacaatccgatcatcaaaaattcttcaatcatatcttcaccagatcctttgtatacctgcttcaggctaccaggatcgac

SEQ ID NO: 5507 - DNA, 376 bp, Diabrotica virgifera
  Clone ID: LIB150-009-Q1-E1-B7
aaccagtcgcggcgagatcgtgagagtgttttgcaacaaagaaatcgtcgttttcgacgaggggagtctcctgctcccgatcatttcggcctattcgttccaacaaatcctttttgtcattcaaatttgagaaattactgttattttacggttttttcttgtttgggattttataaacatggctttttaaaatgtctgccttcaaattgtgcatagccactccttgtggaggagcttcaaactccaataaattatcatctacttatactggaggacgtcgggatggagaagaaaggaaatcgcaatttgcctcttgcaaaaggctccactactgattccaaaaaagatggcattagtagtaaaccgtggccccgcg

SEQ ID NO: 5508 - DNA, 364 bp, Diabrotica virgifera
  Clone ID: LIB150-009-Q1-E1-C10
actacgcgtccgcccacgcgaccgcatgtttttagaagcatgtcacgtcaggtatctcttcgacagcgtgtacatagatcattcgctcaagaagaatctgggatagattatgaagaagattcagaacatggcagttcagatgggtaaaaacatgggtacccagaatggtccaactaataatccgttgaagggacaagcgctgaaagctccgcaatgacatgaattgtcggtggaacagggttttctagattcttcagtacacagccaatagcactttctggtaccaacaagaagcctttaacacaccctcacaataaatttgttctacaacaatattcgacacagtctctgggcataaattttc

SEQ ID NO: 5509 - DNA, 340 bp, Diabrotica virgifera
  Clone ID: LIB150-009-Q1-E1-C11
accacacgtccgaaggtagttaaaccaaatgaaactgtagaaattgagcataagaaagacgctggagtagctctgttacatatattgaacagagattacacagaagtagctattatcaccgccaagggtggaagagtagtacgagacattgagagaaaaatcaaacaacttatatctgatgaaaaatcagtaatgttggtaaacaattaccatctagcacctgcatcatccgtagttgtcatgcatcaagttggtagatatagccgaagacccatgtacccagctggacatcgcaaactccaacatgttgtagtgcgtagacttaaacaccatcctggac

SEQ ID NO: 5510 - DNA, 464 bp, Diabrotica virgifera
  Clone ID: LIB150-009-Q1-E1-C12
ggtcgacgcccgcgtccgaccacacgtccgccgaaggaaaactattgactgccaaacagaaggctgatagggctagggctcaagcattaatagatagtttgaaagcacaaggtgtacaattacctgatgtaggcgagaagaaaccaactagactgggaacgaggataaggccgaataagcagaagaaagagcaaactccagttcccaaacctgaagaacaagaagaaaaaatagaaaaagaagaatctcccaaagaagaagttgttgtaccaccagtagaaacaaaagaaccagaaccagaagatgatgtcaaagacgcttgggatgcatcgtccgaagaggatgaggaatctcaagaaactgatgttaaaccacaggaatcaagaaaaacaatctgagtccaaaggaagcacatgacgaataggaaagcagctctgacgatgaagacgaatcagacagtgacg

SEQ ID NO: 5511 - DNA, 395 bp, Diabrotica virgifera
  Clone ID: LIB150-009-Q1-E1-C4
caaaatgaaggtactcattcttctttccgttgttgccttgagcagctgcttaccagcatccagaaatcaacaatacgttgatgtagactacaacagctacaacgctcatcccgtctacaacttctggaggacttggaatcagcaacactatggacaagaaccatggaaccaatgggtacaatatggtgtccagaaccaacccgataactactggaggcagtacgtgcaacgcagcaaccaagctgaaaatgtcgatttaccttggatgtatcactcttgggatgtccaggatgtgcaaaacttaactcccgttcaacgtgttcagttgctactcaactacgtcagacttcaccaacaatggaaccaatggactcatgatgtaactgccaatgaac

SEQ ID NO: 5512 - DNA, 229 bp, Diabrotica virgifera
  Clone ID: LIB150-009-Q1-E1-C6
cgcacgcgtaggagtgtctacggtttgacgtatcggagaaggtcctaacagttgaggataatgaagtatcttgcagtttttgtgatttttgcgtacttatacacagctcatgttagtgtgtatttagaagagaagttcaggtgatgattcgtgggaaatgaattgggtatacagcatggacccagatgggcatgttggcaggtttgttaggacagcgtggaagttcttt

SEQ ID NO: 5513 - DNA, 391 bp, Diabrotica virgifera
  Clone ID: LIB150-009-Q1-E1-C8
accgaccacgcgtccgcccacgcgtccgcttaagtctgttcttaatctacgtacaggttcttatttttttcgaagtcatgagatagtgaattggtggtatagtttattaagagtactacaaggttgttatttaaaaattaaaaaggaacatggactactatttaggatacatcttaacagtattattaaccatatttagaacattaaagaattatatgagaactgtgattttggcttggaagttgccaggacccacagctttacccatattgggcaacgttcttattttaaaaaatcacacagaactaatatatctgggcaaccatgcccccaacatgtatggtaaatttttcagggtttggtgttccattttacctgccaacttcatcac

SEQ ID NO: 5514 - DNA, 281 bp, Diabrotica virgifera
  unsure (1)..(281): unsure at all n locations
  Clone ID: LIB150-009-Q1-E1-D11
cgcgtccgaatgaaactagtcgaagaagaatccaatggagcaaagccatctcgacctcctccaaaacccctgatagaaaccgctataggacaatggaccatattatcagttgtcttangtgctgttgcagttctaacagttattgccataactgcagatgagtgtatgaaatgcttcgataaagcatcaaacttgcaaccgctagagaaaatacaaaaggcgtattgggcatatggaaaagatgtcgacggagggcatttgaaagaagttttcacgatact

SEQ ID NO: 5515 - DNA, 386 bp, Diabrotica virgifera
  Clone ID: LIB150-009-Q1-E1-D2
aggacgcgtggcggacgcgtgggttgtggtcgtctgagcaacattaaaacatgttcttgaaagttttaattgccttccacgcggcggcagcactggtatcgatgtcgcaggcggtgccctccgacattcccgaaagccctttagcgtctccttgcccggaaacgtttacttatggaacgattgataaaccaggttattggacaggaaacctcatcttaagaccagatcatgacattagcggagtctgggtcaggctgatatttgataaggaagtggagaaagtgacactaaacagcgaagaattcataatcaaactctcggaggacagtaaaatggtcaaacttcaaagccccgatatgttattgaaagccgataatccaaaactt

SEQ ID NO: 5516 - DNA, 210 bp, Diabrotica virgifera
  Clone ID: LIB150-009-Q1-E1-E11
agaaaaaagaagtttgtcaaagtgtcttgaatgcatcgtgtagcggtcaaattgttggctttttcaagttgttttgaagatattaaaaatgagtttcctgaaccaaggtcctccagtgcgccaattaacagatgaataatataacctctgcaagcgtccgtaattttgtccaaaataacataaaagtaattatcacgtgttactccccgt

SEQ ID NO: 5517 - DNA, 418 bp, Diabrotica virgifera
  unsure (1)..(418): unsure at all n locations
  Clone ID: LIB150-009-Q1-E1-E3
accacgcgtccgggaacaaataatccgtcagttcaagaaaatttattaaattcttaaaatttaacgcttgaaacagcaatagagatatgcagaaactctgaaataacaaaaaggcaattcgaatctgtaagaaacaatgaaagtttggaagtaaatgcagtaaaaaataaacaaagtgagttgaaatttctgtgtaaaaattgcaaacgtaaacatgtagctgcccagtgcccagcgtctggaaaaaatttctttgtatatggtggagcaaatcactttagtaatgcttgttttgctgaaatgtccaatcagcanagatataaaaggcaaagtgttaaaaaaagttcaagaaattagaagacatgacaagaatattgatggagatggctattcaacagatgatgacgtacctgtgcat

SEQ ID NO: 5518 - DNA, 383 bp, Diabrotica virgifera
  unsure (1)..(383): unsure at all n locations
  Clone ID: LIB150-009-Q1-E1-E4
ccgttttggggactggggacaacgaacgacgacaaccatcccttttttccaattttttaggttaaattggggtaaataaacataaataaaaatacaaaaaaaatggaagtaaaaagacaagttcctgagaaaagctgtaaggtagaaacagataataatgaggtgaatctattagatacctttaaagttgaggataaagaagaaccaaaaacagaaattatatacatgtatgatacatttgattatttagacaaggaaatcctcataaaggctgaaatagaaaaagatgaccttagcttttctccatttgaggaaaaacaaagtcaaaaagaacttcaagaatacaattgctgtacaggaacgtcncaacaatacattggtga

SEQ ID NO: 5519 - DNA, 379 bp, Diabrotica virgifera
  Clone ID: LIB150-009-Q1-E1-E6
acgggtctgttgaccatgttataaatcgtcgcgaaaaaacataatcgaacgtattcgcattcgcgaaaacgtatcgagagtaaattaataaacaaactgcagtggagtatcagtggctactactctaccataaataacatcagatcatgaaagtaatacctgaaaatttagttacgtagtcccgagtccagagacattagtagctggaatatcgttatatctgttttcattacgtcttttgacaatttctagtcgatatgaagtgctacattgtgtacgcttcggcagtattattcagctatatcagcgctgagaccgtacaatctggggggggggggagtgagtgtcaaggggagctgttggacacagtgcaatccgc

SEQ ID NO: 5520 - DNA, 168 bp, Diabrotica virgifera
  Clone ID: LIB150-009-Q1-E1-E9
gtgaaagcaataagaaatcgcattccatcacaattaaactttgtgaaaaagtcacaatgcggttacgacacggcacctttgggttgctgtggttctgctaaccaattttcaactactagaaatccaccttcagattcaatgggaaattccaatccaatgggaaaagta

SEQ ID NO: 5521 - DNA, 366 bp, Diabrotica virgifera
  Clone ID: LIB150-009-Q1-E1-F11
attttgaaagttatcaacacatgccagactgaagatgcagtttttagagctgaaggaggagatgttattgaagatcttgaggatttgattagaaatattgatgagaaagaagaaactggtgttacgcatattcgaacaaatttagagagcttgcatttgaactcacgttcatccgtccctgctttgatgtatgatcctaaggatgataccatttccgaacatcataacttcactgttaccaaccacggaaaatctgatatagaagttgaggttacatacactgacagcgatgaccgtgccaatgatcaatataaggtagtcaaaccaaatgaaactgtaaaacttgaacataagaaagaagccgga

SEQ ID NO: 5522 - DNA, 336 bp, Diabrotica virgifera
  unsure (1)..(336): unsure at all n locations
  Clone ID: LIB150-009-Q1-E1-F6
acgtgacaatgcagggcttattaatccaccgtccaataatccttcttctaattcagtttttagtttagttcaatcagaccctatgcctagttttgctggactagggacagctccactatcaaggatatctccaggaaaaccttggccatctatgcctgtcaattatgcaaacttttcttcagttactactacagataatcaaattgttaatattagacctgaaattccagggcgtattaatccatcgttcattacaccttcttctaattcagttcctagttgagcacaatcagaccctaggcctagttttgctggaataaggacaactccnacacc

SEQ ID NO: 5523 - DNA, 424 bp, Diabrotica virgifera
  unsure (1)..(424): unsure at all n locations
  Clone ID: LIB150-009-Q1-E1-F7
acaaggtcgacgaggagattgaagttagtgctagttaaaatggttcagcaatatattattgcgggttttgcgttgttttttgtgtttgtttgttgtgtgcatgcagattacagaattgactgtatatccccaaataaagaaaacacaaaatgtgagtcaatatataagtgcaaaacatttacagatgctcttaaaggcactgtaacgcaatctcaaaaagatttcatgaaagaatccttatgtggatattatgataatatacctatagtgtgttgcggaactaagtctgactatacttcaaaacgaactagaaggagcacagagtccaaaacaaattccgtaattgcggacactcaatgtggagtactggtgaatgatcatcttacaagtggacaaccccaangatatccatgggctgtaaaac

SEQ ID NO: 5524 - DNA, 375 bp, Diabrotica virgifera
  Clone ID: LIB150-009-Q1-E1-G11
tcgtcgtcattagagcttcaaattaccgtacacttctcgaagactctgccgataaggtagaatcgtgttacggaaaagtcgcgcgcccacatatttcgccctacatgcgccatctatcgccattatattttgttcaatgaaaacagttgcagtttgcattggtagtaaacaggtttatccgtgctcttgaaccgttttaccacattactatttttagtattctgtaaaaacaaatagtaagaaacgggtttaagtgcgcttgaaccattttaccacaaaactatttttagtattttgtaatgtgtaaacacatgttaatacaggatattttaagtaaataaatattaaatttgtgaccaattttgaagactaatt

SEQ ID NO: 5525 - DNA, 306 bp, Diabrotica virgifera
  unsure (1)..(306): unsure at all n locations
  Clone ID: LIB150-009-Q1-E1-G2
cgcgtccgagttaatgttcttgtgtaattgagactggagtgtcagttcagtaatgaactatgtactgaacttaattaatttatgaaactagtgaaatacattctacataatccattaataagaagtgttatcgcaactcacattacctcaactacatcaatgttgagacgtacagccatggcgactccacaatttgtaatactaccctcaccgattcanggcgagagtgatgagaaagaatatacgggtaatatactattgaacaatttggtaacgtgtttaacatccgggatggcacctatcccc

SEQ ID NO: 5526 - DNA, 415 bp, Diabrotica virgifera
  Clone ID: LIB150-009-Q1-E1-G3
atttaatattaagataatatacatacaaacaaaataaaagaactgtgccagatataaaatttactttttttcgtcaaataaatagaaatgtgtgacttttaacacaatttgttctatagtcttttcagccttttcaagtcgtgttctttgcacgttaaatatttccttctagatcaattttaaaaggaattaaagtttattcaacgtgagttctgaatagtataaaatcataaaactactaaaagccacagttacaatgcagtgcaggtagcatagagcaatgtatttcttacgggagaacggccgaccacgttgccgatttgtcctgagcggcgcatcaggacaggtgatttctcagtctaccgccaaactaccacgcacctaccattgctgcgcgtcgtaagaacaacattgc

SEQ ID NO: 5527 - DNA, 422 bp, Diabrotica virgifera
  Clone ID: LIB150-009-Q1-E1-G7
caagatgaaggtactcattcttctttccgttgttgccttgagcagctgcttaccagcatccagaaatcaacaatacgttgatgtagactacaacagctacaacgctcatcccgtctacaacttctggaggacttggaatcagcaacactatggacaagaaccatggaaccaatgggtacaatatggtgtccagaaccaacccggtaactactggaggcagtacgtgcaacgcagcaaccaagctgaaaatgtcgatttaccttggatgtatcactcttgggatgtccaggatgtgcaaaacttaactcccgttcaacgtgttcagttgctactcaactacgtcagacttcaccaacaatggaaccaatggactcatgatgtaactgccaatgaacgtcttcagaatatgttgtatcaaacac

SEQ ID NO: 5528 - DNA, 430 bp, Diabrotica virgifera
  Clone ID: LIB150-009-Q1-E1-H1
atcaaaaacagtcaaggtgatagtttttgagatttaatgtccctaagtaatgcagaacgaaagccacaaaagaatatcaaagactatcaccttgactgtttactacatataatcgaaaaagttattatggaattttgaaagaactgcgtcgtagaatttaaaataaaaataatggaaggaaagctaaaagtttgtaaaaccatttttgatccaacgttgattgaaaaatcttgccgctatttttattttattagtaaagagaaatttttattgtattgttttataggtgttttacatcatttattaatatatagaagaaaaatgatagatgtaatccagtgtgattaaaagaaaattgagatattaactttttgaaaaatgtaaacgtaacagtatgcctcaatttccttgataccaacgtatcactatg

SEQ ID NO: 5529 - DNA, 244 bp, Diabrotica virgifera
  Clone ID: LIB150-009-Q1-E1-H11
ggtccacgacgcgtccgaaaaacactctccacgttgaatgggttcactttcttgaatatatgtagtaaatatatgtagttaagcgattcaaaatcacgactgaatattgttaaattttggttgtacataatcattagatataaatagtgagcaacgattgacatgggttaagggaaaagtttttttgaagcagttaacgcgaataaaaaatctacagggtgttcacaatacgggctgtagtttt

SEQ ID NO: 5530 - DNA, 374 bp, Diabrotica virgifera
  Clone ID: LIB150-009-Q1-E1-H5
atttcttttaccgtgagtactagtgagagagttaagaacggtttagtgacatcttcaatttaaatttcgaaaaaatgtacagagaagcagtaggttgggcttttaccgcccttttggtctccagttctctagtaggaacattctcttatccaaatgtccaaattaactccaggccagtatcttcagacgcagctgaatcaccgtcagaaccacgtaacttctatccagtgaaaggccccagagacgtgccacaattccagagagcggaaagaaaattcgcagaaaaaccaaatgcaattaaaaaggtggctttggatcgactggatgatgtcgagagtaattccattgcagagagcagcgataacggtcttgcc

SEQ ID NO: 5531 - DNA, 388 bp, Diabrotica virgifera
  Clone ID: LIB150-010-Q1-E1-B11
agttctttgttactattcgtggaaatcgtggattatcatttttaaaaagttggatttacatattaatacatggcaatgaaaatccacaagaattcgaaaggcagtctacttaaatttgtatagaaatatcatatatatgccttcaatttcgggatatagatataagcctaacaagaagaaaactaaaatgaacgtacacccgaatgttccattgggagtacgatttttacagaagttgacagatacttgtacttgttgtccaaggtttcattttaacagggaactatgttatcgtatgagcgtgatatttctaacatatatatcgtatatgtgttatcatctatcaagaaaacccatttcagtagtgaaagcagtgttacatagaaac

SEQ ID NO: 5532 - DNA, 64 bp, Diabrotica virgifera
  Clone ID: LIB150-010-Q1-E1-B12
aagaagttatcgacacttgagaaattccgtttaactccgaaaaccacgaacctaacaatgtccc

SEQ ID NO: 5533 - DNA, 358 bp, Diabrotica virgifera
  Clone ID: LIB150-010-Q1-E1-B9
aggacgcgtgggcttggcgatgaccgcgtaagactactcctgaaaaattaaagcgaaatggatagtaaatcttctacagtaaccaaagttaccgtcgttaaatctacctaccgtgtctctccggcagacagtacctcgccgtcgcgaactggttttgctgaagatggagagcaggtagatcaaaaacgtaccgtgcaagcagtacatgcggccgtagtgccttcgaaaccgggtgttgcgaaccacggcgcggctgcgggaaaaccgccgggaccacctgccgggcggggtggtcctccggcgaaaccacacggtccacctgccggacgaagtggacctccggtttcgggtaaacaaa

SEQ ID NO: 5534 - DNA, 346 bp, Diabrotica virgifera
  unsure (1)..(346): unsure at all n locations
  Clone ID: LIB150-010-Q1-E1-C10
agccattttagtatttagctctgaagattgagtttttacttccgtgaaaaatttttacgagtttttattgtcatcgttataatattttcgacaactgcagttctgtatatagtcggtttgaaaatcttaaagaaaataatgagggtatgaatttaaacgtgctccaatattagcgcttagcgtgtatttgccggtgtattgtgttcaacgtcaccatcaaccatgatgcaagcaaacaatcgagtcncacctataaagttggaaaacgatatagatctttacgccgatgatatcgaggatttcgcacaagatgactttggtggtgaaaatgttgatctatatgacg

SEQ ID NO: 5535 - DNA, 306 bp, Diabrotica virgifera
  Clone ID: LIB150-010-Q1-E1-C11
aagccattttagtatttagctctgaagattgagtttttacttccgtgaaaaatttttacgagtttttattgtcatcgttataatattttcgacaactgcagttctgtatatagtcggtttgaaaatcttaaagaaaataatgagggtatgaatttaaacgtgctccaatattaacgcttagcgtgtatttgccggtgtattgtgttcaacgtcaccatcaaccatgatgcaagcaaacaatcgagtcccacctataaagttgggaaacgatatagatctttacgccgatgatatcgacgatttcgc

SEQ ID NO: 5536 - DNA, 233 bp, Diabrotica virgifera
  Clone ID: LIB150-010-Q1-E1-C12
aatccaaggacgcgtgggcggaagcgtgggttattttttattttttttttttatatatttgtattattttttattttcattttaattttattttttttatttttattttttttatattattttatgtaaacatatattttttaattatggtattttttaaacttatttcataaatatagtcaaaaatgtaataaccagaatagaaaattcaacataaagatcaaccaaaatgc

SEQ ID NO: 5537 - DNA, 403 bp, Diabrotica virgifera
  Clone ID: LIB150-010-Q1-E1-C9
accacgcgtccgttaatttaaaaataataaaatattttttagtaaaagtaaagaaaaattttatttactgatagttaattagtattgtgagagaatattttatttttataaacgaaaaatttatttttggtaccttgggtaccagggattattaattaataattataaatttattattttcgaatttaaaagagctacaacattaaaatttttattgtaaaataagtattttaaataatttttttgtaatgaaatgtcatccgtttttaactataccaaattttttaggaattaaattaaatttatttattaccagtatatttacaattaaatatttttacattattaacattaagcatttttagggatgagcttaaaaataaaattttaataaaatttaatt

SEQ ID NO: 5538 - DNA, 429 bp, Diabrotica virgifera
  unsure (1)..(429): unsure at all n locations
  Clone ID: LIB150-010-Q1-E1-D10
cacgtcttcaactatgacaccatttattgaagaaaaaaacattaaaaaactgagggagtttgaaaagattgccaaaggttggtacattggttaatatctacttgttttggtgtattgtgatagagattaaaacaccgacttatgtttttttagaaaataaagtgaacagattagatgaaggattcttaaaacggtttttggttggaagacagtatgataccatcgcagctttaagagcaattcaaaatttcgaaagtttcgtccaccgacaccgcaacaaatggctcaagctaaaaaaatctcgaattgaactaatcataaatagccaaattgtcgaaatattagaaaacacaggtcttcaaggccaacatatantgtggattccaatgtgaaaactggaattcccaaataattacagctgatgaaatt

SEQ ID NO: 5539 - DNA, 367 bp, Diabrotica virgifera
  Clone ID: LIB150-010-Q1-E1-D9
acccacgcgtccgggagaatatcgtcttgaagatcaaatgaacactaaccaaatcttgaaccaaatctacagacaacaacttggacaatctccattgaaccgttatttggtaaacatgagacttgtaaatggacaacaagtatacgaagttcctgaagaattcgttaacattcaacttctcgaacaacttaccgctcaacaagaaatgatcaaccaaagatgggctcaaatgatggaaagaagacaaccaatcactgaagacgttcactctcagcaacatctgattaaccaacagatcgaaaaacttattgaacaattagcttaccatcaaaatctcattacacgtgaagttgaacaatacattgtt

SEQ ID NO: 5540 - DNA, 352 bp, Diabrotica virgifera
  Clone ID: LIB150-010-Q1-E1-E11
aaacgctcaaactcaaatattaataattaatgaaattacgaattattcgtaatttcaatccttaatttcagtacaggttcagtaattattaatgacaagatgaatttattattaaagcagataaaaaatattcgactagatcttaatagtaacataaaaaactttagtatatttcctgctctaaggttaaaagaaatacaagaaattcagaatgataaggaattaattatctctgcaaagcatgtaccttctggaagagaatcgtatttactgaaaaatgatcatccaactgcctgttcagtttgtgcttctggattagacataaagcatacagacgttttaatcctaagtc

SEQ ID NO: 5541 - DNA, 344 bp, Diabrotica virgifera
  Clone ID: LIB150-010-Q1-E1-E12
aaggattattaattaataattatatatttattattttcgaatttaaaagagctaaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttacttttatatattattatttttatttttta

SEQ ID NO: 5542 - DNA, 376 bp, Diabrotica virgifera
  Clone ID: LIB150-010-Q1-E1-E9
ctcgtgtttttggtgtgactttttttatcacgggttattttttcgtgtgttgcgctcatcgacaaaccacaagaatgaaacttatcgtaggattattattaatagccacagctctggcatacccagtagcggaaaatgaagaaaaactagcccaaccagtaattgcacaagacgcgaagccagcagagcaagaactaccactaccagaccaacttcttcccacatcagaaaaacttcttccccaaaaacaagaaccattacctgccagcagcgattcctcatcagaatcttcctctgagagcagcgatgagtctggagaaaagaaatcatcctccgagtcctcctcgagcgagaaagaatccagcgaagtaaaaat

SEQ ID NO: 5543 - DNA, 359 bp, Diabrotica virgifera
  Clone ID: LIB150-010-Q1-E1-F12
cggacgcgtgggcggacgcgtgggcgcgttatcaatatcaacgtggttccaccatattgttagaaaaacctatctcgcgcaaaagaaaattaatttcgggatccagttctgatgctgtgccgttcccatgaccattgtcagttatgttagcatgaagttcagctatcactatacttggaacagggagattgtgttcaattcacaaaaacttgttaaaagacgctgaaaaccattggggaatacctccaaagccacccttcaagacgactgctcgattttttacacctagaactaataacttttttgtgtttgtttgttggtgaaccctagccctacgctgaatgatgtctatctgttac

SEQ ID NO: 5544 - DNA, 379 bp, Diabrotica virgifera
  Clone ID: LIB150-010-Q1-E1-G11
agccgcttcacatataccacattaaaattatcgaatttagtagtagtaggtaacaaacgtattcctaacttctgaatttaaattagaaacaaccaactcagttagaggaagtcgttagatcgagttgtatgatagttgctatcaattgctggttaatcaagcactatccacttattattttaaacctcgtgtagcggcttttttataaagagtaataatgtccgaaaacaaacctgatacagttcctggactaggatttaaggataaagataaggcattggatacattaaaaaatttagaaggaagagatcctgattaccaaagactttctattaaaggattgataggaagagcaaaaagaactctgacattaacaaag

SEQ ID NO: 5545 - DNA, 342 bp, Diabrotica virgifera
  Clone ID: LIB150-010-Q1-E1-G9
aaacactttgtcaaaactaggaatgaaaattctacaatcggtacacccacttgatgcgtagcaaaattactggaaattaccgtattataagaataaaagaagtaaactcgacctgtaaacttcattttaaaaatcaagtagtctagacacgacgttcatctaactctttctttctgaatactttccctgtctgtgcactgcgcagatgtgcaaaatttcgaaagacatttctggtgttcacgagtaatatgacatatattattttatatttgatgtatggatggaatccatacatggaatctagccaatacaatggtatctgatggaatttattcattaatg

SEQ ID NO: 5546 - DNA, 339 bp, Diabrotica virgifera
  Clone ID: LIB150-010-Q1-E1-H11
agcgaacaaagtgaatcttttggcggcaaatttgaataatccttctgtggcacttgggggtagtggtatatttggatcaaatggtaccgcctaccaatcctacatttcaggaacaactgcttcaaaaattttaatagctaccgttgtccatactgtcattaatgcttcagctactagacactttacaaataaattccttaagggtggtcctggaaactttgattttgatgatgataaaccagaaattctaaagtaccaaagtaatagattatttgaaaataaaaaatatacaatcaaaacactagatctttcccaacataatatcaaagaaaagatatg

SEQ ID NO: 5547 - DNA, 367 bp, Diabrotica virgifera
  Clone ID: LIB150-010-Q1-E1-H9
ttagtaatagcacttgtttcatattttggaataatgtttttccaacaagtgacagttgttgtactcctcgtcctcaaaacgactcttgccagcttcgacgagcacggcctcggcgattttggaaaaagtcacggatggggtgccccagccgagccttcattcgaacacaaatatgattacaccccaactaacacgatagaacacaccaaaccagtccatatcccagtggtcaagaaaacgggagtacctcaaccgcacccagtgggtgtacccgtgccgcaagttgtcaaagtacctgtaccacagccttatcctgtacaggtgtcggtaccaacacctgtagcagtacccatctataagttggtac

SEQ ID NO: 5548 - DNA, 415 bp, Diabrotica virgifera
  unsure (1)..(415): unsure at all n locations
  Clone ID: LIB150-010-Q1-E2-A1
cacacgcgtccgcccacgcgtccggtctagttcttctttccctagtaacccttagtgtagctgcctactacccaagtactggtaggcaggtgacagtangagtagctggaaatgtgaaactagtcggctctcaaggttcccaaattgacattcgtagaagtccttacaacccaagaactgtcgacgtcaccctcagaagtccaaatgctccaaccagaactctgcaaattgatgaagccaggaacggccaacaacttggttattccaacctccaaggtgtcaacaaccaaggtgtcaaccaggctgatgttcttgctgatcttttcagtcaatatgagggtattgtagatgaccagaccttctacagtttgttgaacaaacttcaacatttggtacaagctggagtcatcaacag

SEQ ID NO: 5549 - DNA, 464 bp, Diabrotica virgifera
  Clone ID: LIB150-010-Q1-E2-B12
cgaagttatcgaaacttgagaatttcgttttacctcctagaactactatcttagcagtgtcacatagcggaggagacaaggaagaatgacaacaagtatgtcgtcacgaatcactgaaaagctgatctttttgttgaggtgatacatctcaataaccatgatgatgctccacaatggtttgtagtccaaccagactataccactgagatagatattgaggacaatcttgaacatagcgtgttgaaagtgagcaccaacacttacgaccaggaagtgtcattttctgctaaaggtggtcacgttattgacgacttggaaaacaacatggaagaacttcttgactcagatgaaacagaaactgaaatgaccgttttggaaaacttttctttaagcccaagaactgctgtcactgttttgagtcaaaatgttgaaggaagcaatgaacatcctggaaagtacactgt

SEQ ID NO: 5550 - DNA, 388 bp, Diabrotica virgifera
  Clone ID: LIB150-010-Q1-E2-B4
tccaggtgcccccacgcgtccgggaagcatatatcaccgacttaaggtcaaaactaaaggatcatatcgaaaatgtcgaaaagactcgtttatctctggaagttcaaacagaagaagtcagatcagctattgaagataaactgaagacagcttctcaacaacgcgatgataacatcaaaaagatgttggaacgcctaaaagagcacgaagaacaagtagctaaggtgagagagcaaaataccataaaattgcaacagttggaccttgcgatcacagaaaaactagagcaggctcaatcacgaaaagaacagctcgaacaagagcagaaagagaaactcaagagttacgagaagcgagctgagctcgttcgccagaacaaggccaatct

SEQ ID NO: 5551 - DNA, 399 bp, Diabrotica virgifera
  Clone ID: LIB150-010-Q1-E2-B5
gagcaatgatgagcctccaatactgtggattggtccttttggcaggtcttttgttggtttccgcccaccctggaaccgactctaaggctgaagccaaggtatcttcagtagccgagaagaaacaggaaaaacgtggtcttcttgatctaggctacggtgggggacacgactttggaggaggacttgaacttggagggcatggtttggatttgggtggacatggtggtttcgacggaggatatggtggagggttaggtggagggtatggtggattagacgaaggtcatgttaagcacattaccatcaccaaagaagttaaagtacctgttcctgcaccataccccgtacacatcgaaaagaaaataccagttccagtgccagtcaaagtacctgtaccag

SEQ ID NO: 5552 - DNA, 413 bp, Diabrotica virgifera
  Clone ID: LIB150-010-Q1-E2-B8
gagattattaattaataattatatatttattattttcgaatttaaaagagctaaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattaattaaatttaataatggagataataataataataaaaa

SEQ ID NO: 5553 - DNA, 462 bp, Diabrotica virgifera
  Clone ID: LIB150-010-Q1-E2-B9
caaacgcgtgggcttggcgatgaccgcgtaagactactcctgaaaaattaaagcgaaatggatagtaaatcttctacagtaaccaaagttaccgtcgttaaatctacctaccgtgtctctccggcagacagtacctcgccgtcgcgaactggttttgctgaagatggagagcaggtagatcaaaaacgtaccgtgcaagcagtacatgcggccgtagtgccttcgaaaccgggtgttgcgaaccacggcgcggctgcgggaaaaccgccgggaccacctgccgggcggggtggtcctccggcgaaaccacacggtccacctgccggacgaggtggacctccggtttcgggtaaacaaacggagaagactgtgaagagcgtgcctgacactgatagtaggaaattaacatctgcagttcttaaaatggtttataagttcggtgaaaaaggatctggtacacga

SEQ ID NO: 5554 - DNA, 492 bp, Diabrotica virgifera
  Clone ID: LIB150-010-Q1-E2-C10
taccggatcgtaccttccgggtgcgccccacgcgtccgcgacattttagtatttagctctgaagattgagtttttacttccgtgaaaaatttttacgagtttttattgtcatcgttataatattttcgacaactgcagttctgtatatagtcggtttgaaaatcttaaagaaaataatgagggtatgaatttaaacgtgctccaatattagcgcttagcgtgtatttgccggtgtattgtgttcaacgtcaccatcaaccaagatgcaagcaaacaatcgagtccaactataaagttggaaaacgatatagatctttacgccgatgatatcgaggatttcgcacaagatgactttggtggtgaaaatgttgatctatatgacgatgttatatccgctcctcctggaaataatgacaacccaagtgaatcaaatcaacaaggctcccccggtggctggtgaaaatggtggaggtaattttgttgggtcaggag

SEQ ID NO: 5555 - DNA, 125 bp, Diabrotica virgifera
  Clone ID: LIB150-010-Q1-E2-C11
cacgcgtccgcgacattttagtatttatctctgacgattgcgtttttaattccgtgaaagatttgtacgactttttagtgtcatcgttttcctcgttcctgagactggacttctgtctaggggcg

SEQ ID NO: 5556 - DNA, 112 bp, Diabrotica virgifera
  Clone ID: LIB150-010-Q1-E2-C12
cacgcgtccgcgaccgcgtgggcggacgcgtgggtttttttttttttttttgttttctttattgttctttttctttttttcttttcattgttttttttcatttttttatttc

SEQ ID NO: 5557 - DNA, 376 bp, Diabrotica virgifera
  Clone ID: LIB150-010-Q1-E2-C2
cccacgcgtacgcccacgcgtccgcggacgcgtggggtttttggtgtgactttttttatcacgggttattttttcgtgtgttgcgctcatcgacaaaccacaagaatgaaacttatcgtaggattattattaatagccacagctctggcatacccagtagcggaaaatgaagaaaaactagcccaaccagtaattgcacaagacgcgaagccagcagagcaagaactaccactaccagaccaacttcttcccacatcagaaaaacttcttccccaaaaacaagaaccattacctgccagcagcgattcctcatcagaatcttcctctgagagcagcgatgagtctggagaaaagaaatcaccctccgagtcctcct

SEQ ID NO: 5558 - DNA, 434 bp, Diabrotica virgifera
  Clone ID: LIB150-010-Q1-E2-C3
ttccagggccacccacgcgtccgaacatctaataatgcctcccggcactcaagcgcgtttggtctgcgaatggccgcacctcaacctgggggacttagtcacaatcatccgctacgacccaacccaaggatattttgtccgaaccagctctagcctggaagagttttggattcctgctcacgttctagccaattacagtaggaaactatggtcttttaggttaaagaaaccaagaaaatctctggaaggaatcctctcggagaactcggaccgttgtgtaccagaatttcgtgatagactgaaagatattaccgttcagagtggatccaaggtggtgtttaagtgtagagtgaagaattggaataggaacacgaggcaaacttggaagaagatggaaccaaatgtcgtagtcctacataacggcaagtttgtgc

SEQ ID NO: 5559 - DNA, 386 bp, Diabrotica virgifera
  Clone ID: LIB150-010-Q1-E2-C4
ggaagaagtgactaaaaacacagctaggaatataacaaatggcattttactaacaagtttgtgatttggcaaaaagttggagaagtgcgaacaatccaaagaaaaagaaaaagacgcttcaactgaaaaaatgggcaaaaaaggtaacaaaagggcaacaaatggcgttaacaagttcccctccggattcaatggcaacggtcctccgaagtttataaggctcatgggctgtgttcctgaaattgataatcctgcagcagttcatcacatggcatcgttaacattcggattagtaatcctgcttatcattcagacatttggtcacatctcaagggctcacttaaaccctgcagtcacatttgcagcagttttcatgaagctcgtgt

SEQ ID NO: 5560 - DNA, 367 bp, Diabrotica virgifera
  Clone ID: LIB150-010-Q1-E2-C6
gaatttttgtagtaaaaatactatattatattattattaatcttgtgtttttaagatatgaaaatattgtggaaactgccgatccaatttttcgaataatagtcacgacacttctgccatctgacggccagacataaactagctttattctttactttattacacaaaaaaatatagaatattttaaatcagttcactaacatagtacattttttactttttttgtattttttgagatacatattggtcttcctcgaaggtagcgatatgtttttcagttgtatctgaatttagtcatttcataaaataatagaggtgggaagtaaatatctgacataactgttaaaaggtacatacattacaaaag

SEQ ID NO: 5561 - DNA, 458 bp, Diabrotica virgifera
  Clone ID: LIB150-010-Q1-E2-C9
ccaacgcgtcggtttattttaaaataataaaatattttttagtaaaagtaaagaaaaattttatttaatgatagttaattagtattgtgagagaatattttatttttataaaagaaaaatttatttttggtaccttgtgtaccagggattattaattaataattatatatttattattttcgaatttaaaagagctaaaaaattaaaatttttattgtaaaataaatattttaaataatttttttgtaatgaaatgttatccgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattattta

SEQ ID NO: 5562 - DNA, 417 bp, Diabrotica virgifera
  Clone ID: LIB150-010-Q1-E2-D1
caagtggctcatataatcccagagtcacagagtgactcaaatctaataattgatctggaacaaaggaacgcagagttgacttcatttttagagcaggagaaaattcaatcacagcaacaacagcttcaaataaatgaactgcaagcaagaatataccacttagaacttgaaaatgcaacaaaagataataattcagtaataaataaattagaagaagatttaaaatgtcatagtcagaccatcaggcttttagtagctgaaaaaagcgaactttctaatgctgtagctcaacaggaggttacttttaaaaataaaaattctgagtgtgaagaactgcaagcgagactaaaggcttctagatctagagcttttgaattagagcaagaacttaacactttaaaatcagaacgaatacac

SEQ ID NO: 5563 - DNA, 460 bp, Diabrotica virgifera
  unsure (1)..(460): unsure at all n locations
  Clone ID: LIB150-010-Q1-E2-D10
caagtcttcaactatgacaccatttattgaagaaaaaaacattaaaaaactgagggagtttgaaaagattgccaaaggttggtacattggttaatatctacttgttttggtgtattgtgatagagattaaaacaccgacttatgtttttttagaaaataaagtgaacagattagatgaaggattcttaaaacggtttttggttggaagacagtatgataccatcgcagctttaagagcaattcaaaatttcgaaagtttcgtccaccgacaccgcaacaaatggctcaagctaaaaaaatctcgaattgaactaatcataaatagccaaattgtcganatattagaaaacacaggtcttcaaggccaacatatagtgtggattcgattggaaaactgggatccccaaataattacagctgatgaaattttagaagtttcaggtctgttatgcgagttgct

SEQ ID NO: 5564 - DNA, 376 bp, Diabrotica virgifera
  unsure (1)..(376): unsure at all n locations
  Clone ID: LIB150-010-Q1-E2-D2
caaacgcgtccgcggacgcgtggggcaacgcagctcgcggttccagcctccacgaggcgcaggcgagcaacgagcagtctggcagacgagccaagcgagtaccacagctggacctcgcggtaccagccaagtcgtaacccaagaattcaggagccaagcttcttccagttacgtcggtcgtagtcagcctcctaaaggctggttcggtgataacgacagcgaagctagctataaataaatcgaatacctacaaaggcagcttgtgcttgcctgtaagtctaactaaaagcagttacactgcctaaagtactcagatattcctaattatgtgctaatattaatagaaaagctgcccttttttanttagaaagaattt

SEQ ID NO: 5565 - DNA, 415 bp, Diabrotica virgifera
  Clone ID: LIB150-010-Q1-E2-D3
tccggagagatacattttggtgatataccaatgattggataagctgatctacttgtttgttcaaaccatactgttggacaattgattaaagttttgagcacccaacaacttaacatgatcaacttcatccaatacctcgttgaacaaggtaatcaagttgatcaacaattgtacgctgttcaaagaaatttttaccaacaagtccaaagacttgttcaacaggtagttcttcaacaatctcaaatcaaagaacaaatccaggtacttatccaacaagaacaaactgttccacaagaactagttttattccaacaattggcctaccaacaagttgaacaattcatccaagtattgatcaagcaattcatctaccaacaagctagccttagacaattagttcaagtttttgttcaac

SEQ ID NO: 5566 - DNA, 422 bp, Diabrotica virgifera
  Clone ID: LIB150-010-Q1-E2-D5
cattcaagtaaatcaaaccacaaaatcagtttagttttttcagttcggttaatcaaacaaaatcgttttcgtacggatatcgctaaaatgtccaatgttaaataacggattaagtgtgtactagtttttaaataattttgtattacacatgatgagatttaaaaagcaaccatggcaacaacagagaactggtttcaaaattggcatccgccaactacgttatttacagaacagcaacctttccaaccgattcactttcaaaattccagtcctgcatttgaatacggctatcaattatctcaaaattctcccaatgttggaccaaattcctttcttacatatttagtttctctaagtatggtgaaaccgccgggttctgaatatatagataatagagcatctagacactcaacacgtggata

SEQ ID NO: 5567 - DNA, 376 bp, Diabrotica virgifera
  Clone ID: LIB150-010-Q1-E2-D6
gattgcggttttacaatatggctagaaaaggcaataaattactacatgtggcgtttttaaatttaagaacctttctgtagttttaagaaacgtcttcgaatgcatttccaaagtgcgttattgacataaggtctgataaggtaattaatttatggggaattcagtttgttaaactgaacacaccaaaaacatattatggttagggacacatttcgttttgtaaaacttcttagcatctggtttgtatattaaatgtgaattttaaatgaccgttttaagaaaagttattaaaaaataaaattagctaaaagagtaattaaagcgtgtctccacaattgcaacgaatgaactccattcttgcattttttgagaaaag

SEQ ID NO: 5568 - DNA, 464 bp, Diabrotica virgifera
  Clone ID: LIB150-010-Q1-E2-D9
ccaacgcgtccgggagaatatcgtcttgaagatcaaatgaacactaaccaaatcttgaaccaaatctacagacaacaacttggacaatctccattgaaccgttatttggtaaacatgagacttgtaaatggacaacaagtatacgaagttcctgaagaattcgttaacattcaacttctcgaacaacttaccgctcaacaagaaatgatcaaccaaagatgggctcaaatgatggaaagaagacaaccaatcactgaagacgttcactctcagcaacatctgattaaccaacagatcgaaaaacttattgaacaattagcttaccatcaaaatctcattacacgtgaagttgaacaatacattgttaaaggacaagtagttccccagcaacttgtttaccaacagagattggtttaccaacaagttcatgaagtaattgaacgtttatactaccaacagctctt

SEQ ID NO: 5569 - DNA, 409 bp, Diabrotica virgifera
  Clone ID: LIB150-010-Q1-E2-E1
cacacgcgaccgcaaatatgaaatgaattgtgttgtgattactgaaatactttctcatgaatatcaagaattaccaacagtgatgccatctgtgggtgcgattaactgctggatccatgaagatccgctggctgaacccgattccaatgaagagtctggggaagaatacacgttttatactccgtttaattttgaaccacatccacgcggtcttggaaattatttgtttaatagaatgcatcaccatacacatcacatagcacaatatattgctgatactgacgaagaacaaacctatgcggaacgtttacaacgttgtgtacgcacagcctgccacctatcaaccagaggtttaaccaatgaccatgtcgctgagcattgttcttacaaccatatggcaagttcagtg

SEQ ID NO: 5570 - DNA, 455 bp, Diabrotica virgifera
  Clone ID: LIB150-010-Q1-E2-E11
aaacgctcaaactcaaatattaataattaatgaaattacgaattattcgtaatttcaatccttaatttcagtacaggttcagtaattattaatgacaagatgaatttattattaaagcagataaaaaatattcgactagatcttaatagtaacataaaaaactttagtatatttcctgctctaaggttaaaagaaatacaagaaattcagaatgataaggaattaattatctctgcaaagcatgtaccttctggaagagaatcgtatttactgaaaaatgatcatccaactgcctgttcagtttgtgcttctggattagacataaagcatacagacgttttaatcctaagtcaatttgtaagaacagatgggtgcatgttgccaaaaaggattacagggttatgttcaagatcacagaaacgcattgcaacattagttgcgatggctcaaaaatc

SEQ ID NO: 5571 - DNA, 384 bp, Diabrotica virgifera
  Clone ID: LIB150-010-Q1-E2-E2
cacacgcgtccggtgcattgttcatgattgttcatgataaaataataaattacgtttggaaaaaaagcaaattaaattatcgggtgaaatttaacgttttataaaagttattgagcatggattgcgctatgtgtatgaggggctattcccgttacatgttaatactttttaatttcatatttgtgatcactggtattgtaataatttctgtgggtctgagctctaaagcttacttcaatgaattcgatcaacttatggataacaaatatttctacatttccgattttctgatagtcattggagtggtaatatttttcatcgctttctttggctgctgtggagcgatgaaagaaaatgcatgcatgactaccacatactcaactt

SEQ ID NO: 5572 - DNA, 123 bp, Diabrotica virgifera
  Clone ID: LIB150-010-Q1-E2-E4
agcgtccgaaaacaaaagaaaatttaaatttaagaaaaaaaaaaacagtcaacttaggaaaagaaatgcttggttacattagttaaggaacctacggcagcaattccaatgttcaaagggggg

SEQ ID NO: 5573 - DNA, 388 bp, Diabrotica virgifera
  Clone ID: LIB150-010-Q1-E2-E7
tacgaccagcccatctttcaggtcaaggtggtcaacatccagcgcaacaagagcaccacctagctcaacaacagcaccaccaagctcaacaacagcaccaacaaggtcctcaagctcgacaatgcagaccagcgcgcagaccaagaattgttatgcgccccgctgcccaacgtaaatccgttgctcatgatagatacacagttgctaatcatggaactcatgcttttaccgctcagatcgttcacgttaaaggaggaaagcaggagatagtacgcagtcaagttgtccaacccaacgaaaccaaagagcttcttcttaaagacgtaaatggatcgtctttgaaaatcgtcaacgaaaacgagactgattacgcaatcttctcagctga

SEQ ID NO: 5574 - DNA, 464 bp, Diabrotica virgifera
  Clone ID: LIB150-010-Q1-E2-E9
ctagtgtttttggtgtgactttttttatcacgggttattttttcgtgtgttgcgctcatcgacaaaccacaagaatgaaacttatcgtaggattattattaatagccacagctctggcatacccagtagcggaaaatgaagaaaaactagcccaaccagtaattgcacaagacgcgaagccagcagagcaagaactaccactaccagaccaacttcttcccacatcagaaaaacttcttccccaaaaacaagaaccattacctgccagcagcgattcctcatcagaatcttcctctgagagcagcgatgagtctggagaaaagaaatcatcctccgagtcctcctcgagcgagaaagaatccagcgaagtaaaaatccaagaaaagaaacttgccgaacctctcgcagctatcaaagagccaattaaggaagaagtgaggccaatcgatccacttcctgttttg

SEQ ID NO: 5575 - DNA, 442 bp, Diabrotica virgifera
  Clone ID: LIB150-010-Q1-E2-F12
tccgggtggccccacgcgtccgcaaacgcgtgggcggacgcgtgggcgcgttatcaatatcaacgtggttccaccatattgttagaaaaacctatctcgcgcaaaagaaaattaatttcgggatccagttctgatgctgtgccgttcccatgaccattgtcagttatgttagcatgaagttcagctatcactatacttggaacagggagattgtgttcaattcacaaaaacttgttaaaagacgctgaaaaccattggggaatacctccaaagccacccttcaagacgactgctcgattttttacacctagaactaataacttttttgtgtttgtttgttggtgaaccctagccctacgctgaatgatgtctatctgttacgaacccttccttctcgatgagaagatactaccagtcctggacgaagtggaacctccgcgtg

SEQ ID NO: 5576 - DNA, 414 bp, Diabrotica virgifera
  Clone ID: LIB150-010-Q1-E2-F2
ttccagggccccccacgcgtccggatttaatgattgttgtaatatcatgatagagatcccgtcaaattagtgcgttcccaaatgacgagatctttatcataattatgagagtaggttggtttaggacaactatctccaactaactaggtacatagtaaatttagtaattatttttttgtaatgttggtaaaattgtgatatcgactagatatgttggaagtttggtacaaccaggggcgggtattcatagccaatactaattgtaacttagaagtaaaaaattatccataagcagttttttaacattaactgaatcgattaaaacactaaaacaaaggtttaaatggttattttcaaaatgttatagttttttctacaatttttgtattctgagaacaattttcaaagtgaaaa

SEQ ID NO: 5577 - DNA, 438 bp, Diabrotica virgifera
  Clone ID: LIB150-010-Q1-E2-F3
ccacgcgtccgaaaacttcaagcatgtctgcaagagcttggttcctttggtgtctcctagctttggcttcagtttttggagttaatggcggaggacatggtggccaccatcacgtagtattcaaaatcccagaacacattcacaccgtcaaacacacacataccgtctataaaaccatccatcatcatacaaaaggtcacgaagagcctcacagccatgggggaaaaccattccattggcactgaagaaatttcacagttgaaatttagataggataattttttgcaagctttaattatggggtaacattccagtataattttttttcaaaacctatagattttctatatataagtaatatggaaaactgctgaggtcgccaaactaaaagcaaaaagcttcgggatacaccacaggtgcctctgaagacgccaaaaa

SEQ ID NO: 5578 - DNA, 409 bp, Diabrotica virgifera
  Clone ID: LIB150-010-Q1-E2-F5
gagagctcaatttatatttttctgacagcagattttccaaaacttactttttagaatgtgatcgacttatgtgagaaacttttaacacgtagaataatagctagaagaaacaaaacgatagataactaatgtgagatattatcgaatatagatgtatttttcgtgaaagccgttgtgaattcaaattttaactgttcatcttattcattaaatacattttagtatagctcattaacgggatgtttatttcggtttttttagaaagtttatccatttaaaacagaatggaaaattcttttaaaaaaatatcttaattgtatagcaatgtattagatggttaacgccaatagtgttaatagtaacattatagcaaatattttagaatttgtttcaaatccaaaaaaaataa

SEQ ID NO: 5579 - DNA, 396 bp, Diabrotica virgifera
  Clone ID: LIB150-010-Q1-E2-F7
aattatacactctcagtttaggtttctttcttgtaaaacaaatctaaactgagagtgtataaatatacgccttgtatgtttatctgtatgagttgtttgccaaaactagttttttacaagaaagaaaccttttgaaatttcaagggttgcagtttagaaaattttcattttttaatattcgaactgcgaatgaggtaatttgtggccctaaatttttacctatttaattgttagacataatttaaatatgtgggtcccaaaagctcgttctttatttaaatttgctccagtgtgggacagggatgattggaaaatcagaaatcatttaattcacctctattcatcccgccaattttttgcgtacacttgacgtatgacgttattgatatatcccaa

SEQ ID NO: 5580 - DNA, 461 bp, Diabrotica virgifera
  Clone ID: LIB150-010-Q1-E2-G11
tgacgcttcacatataccacaataaaattatcgaatttagtagtagtaggtaacaaacgtattcctaacttctgaatttaaattagaaacaaccaactcagttagaggaagtcgttagatcgagttgtatgatagttgctatcaattgctggttaatcaagcactatccacttattattttaaacctcgtgtagcggcttttttataaagagtaataatgtccgaaaacaaacctgatacagttcctggactaggatttaaggataaagataaggcattggatacattaaaaaatttagaaggaagagatcctgattaccaaagactttctattaaaggattgataggaagagcaaaaagaactctgacattaacaaaggacaaagagaagatccaaaacataaatgatgccgtcaaagtatttgaggacttcctaagggacttcgaaatcaacaatatgt

SEQ ID NO: 5581 - DNA, 417 bp, Diabrotica virgifera
  Clone ID: LIB150-010-Q1-E2-G4
tcccccacgcgtccgtgatcagctggtctgttgtctgcaaacaattctaggaagcatcttttcctaatttgcttttgcttttgtattgtggatatctcttcctgtgtctcttatgtggcttcatgtgcagtttcttgttctcttttctccagctgctcctccaaaaagtctctattgttcatccattgcattagtccatgctattttgtctttgctctagctgtttgtgccgttgtggataatagtgtatgttaaaaaaaatatgaagttattattttgaaacaacattcgtactttagggctagaatattttatttttcaattaaactaatgtccttaccaattttagcttttacttgtaagaaaaccttgtcccaaataccacgttgagaagaagaaagtttttgaatccaaaga

SEQ ID NO: 5582 - DNA, 378 bp, Diabrotica virgifera
  Clone ID: LIB150-010-Q1-E2-G5
caaaaaaccagtttaatggcgattgctataatagccctatctatacctataacccatctgcacactaatggaacgcagattcagatagagcgcgttaaacagtcttgctacctgggaactattataaataatgagcagtagagcaaaaaagttgaaaatggtggaggtatttagcatcaacggttctcctttaaaatcaatatgacggctaacccttcagcggaattcctattgacctcccctaaaggttagaattataaaatttggggcagctcggaaacaagattcaattcaatatttatgctcccccacccctttttaatatattcccgctaactcggaaaatatcaaccgcacgaaaaaaattgtcacaaaaga

SEQ ID NO: 5583 - DNA, 371 bp, Diabrotica virgifera
  Clone ID: LIB150-010-Q1-E2-G6
gactcccaattgatacaacaataaaatttactgtggatctaacgtaaatagccagtttcccaagcttctgataattacacacatagctaataaacgattactttagttactgctaatatatatgcctattaactgtcatacatttttgtgtgatattcgtatttattcactattcatacaatactatgataattgtagaatacttaaataaattcaaaagaatacatgacaattaactgacagttaggtcgatatattaaagatattatactagctttaaaagttactgtctcttggttaggtgcgaaattaacggatgtttgtggaagtggccatactactattgtaacgcccttaagtatttattgaaa

SEQ ID NO: 5584 - DNA, 400 bp, Diabrotica virgifera
  Clone ID: LIB150-010-Q1-E2-G7
cattgacataatcctagccgttattcttttagaaaatatttcaaaacgtgattaaaagtaattaaaagtgatcatcaattaattacacttgttcttaaatggagcccatgacgttaggaagcgccccttcaagtcctgcatctcctgctgctaaccgcaattttttacctggttttttaataggaggtgataatcaaattccatcaggtaacccaagtatttcacctggaaggaataaaacccctgggacaggcggcaaaacaccagcaaacgaaccaaatggcttccgtcaaaagttgttcaatcaccagcttaatgaaagtgcaggatacacaccagcacctgaaaaagggggacctcccaagttaagactccttggtaatttaaaacacaaagaaaa

SEQ ID NO: 5585 - DNA, 347 bp, Diabrotica virgifera
  Clone ID: LIB150-010-Q1-E2-G8
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccccccaaaaggttcaaattttaattacccttaaatgaaacttaaaagcttttcaaaagtgtcacctaatttaatttaatgggccttttttttaaaatttcttaatgggaaaaaccctggttttacccaatttaacccctttgaaaaaaatccccttttcccaaattgggttattaacaaaaaggccccaaccttttgcctttccaaaaattttc

SEQ ID NO: 5586 - DNA, 454 bp, Diabrotica virgifera
  Clone ID: LIB150-010-Q1-E2-G9
taaactttgtcaaaactaggaatgaaaattctacaatcggtacaaccgagatgatgcgtagcaaaattactggaaattaccgtattataagaataaaagaagtaaactcgacctgtaaacttcattttaagtatcaagtaatctagacacgacgttcatctaactctttctttctgaatactttccctgtctgtgcactgcgcagatgtgcagaatttcgaaagacatttctggtgttcacgagtaatatgacatatattaatttatgtttgatgtatggatggaatccatacatggaatccatccaatacaatggtatttgatggaatttattcattaatgtactagttctcattcgttttattggaactctgatgttgcagaagatgcagaacgcacaaaatacctttattataaatagccgtactagatatcaaggttgtatatatataaa

SEQ ID NO: 5587 - DNA, 430 bp, Diabrotica virgifera
  Clone ID: LIB150-010-Q1-E2-H1
caagtggcacatataatcccagagtcacagagtgactcaaatctaataattgatctggaacaaaggaacgcagagttgacttcatttttagagcaggagaaaattcaatcacagcaacaacagcttcaaataaatgaactgcaagcaagaatataccacttagaacttgaaaatgcaacaaaagataataattcagtaataaataaattagaagaagatttaaaatgtcatagtcagaccatcaggcttttagtagctgaaaaaagcgaactttctaatgctgtagctcaacaggaggttacttttaaaaataaaaattctgagtgtgaagaactgcaagcgagactaaaggcttctagatctagagcttttgaattagagcaagaacttaacaccttaaaatccggaccgattccccaaggaacccacc

SEQ ID NO: 5588 - DNA, 459 bp, Diabrotica virgifera
  Clone ID: LIB150-010-Q1-E2-H11
ggcgaacaaagtgaatcttttggcggcaaatttgaataatccttctgtggcacttgggggtagtggtatatttggatcaaatggtaccgcctaccaatcctacatttcaggaacaactgcttcaaaaattttaatagctaccgttgtcgatactgtcattaatgcttcagctactagacactttacaaataaattctttaagggtggtcttggaagctttgattttgatgatgataaaccagaaattctaaagtaccaaagtaatagattatttgaaaataaaaaatatacaatcaaaacactagatctttcccaacataatatcaaagaaaagatatgccatagatctttctgctgtcaatttaataccaatgtaacaacaaattccagcacggatgtatacaaattggttgcgtacagtggttcagtagatattttcggaacccaaaagaaaaccca

SEQ ID NO: 5589 - DNA, 375 bp, Diabrotica virgifera
  Clone ID: LIB150-010-Q1-E2-H4
tcccggatccatccagcagatgtatacggtagttgttaggaatgtttcaatattaattctttaattttatctaaataagaagtgcattaacaaattactgccatttttaaagttttccgaacatgaagatgagttcttgtgaataaccactaataaagaaatattgatcgtacatggaaatttggtgccaggtgtaaggacgtattttaatggaaattacctatacattaaatgattaataatgaatgaaagtgatttcaaaagtattttggctacaactgcgtcaatttgtacaattctacagtttttaacaggaacgctaacctgccaaaaaattgttcaaaataagagtaccggagatatatcttcctttcc

SEQ ID NO: 5590 - DNA, 464 bp, Diabrotica virgifera
  Clone ID: LIB150-010-Q1-E2-H9
ttagtaatagcacttgtttcatattttggaataatgtttttccaacaagtgacagttgttgtactcctcgtcctcaaaacgactcttgccagcttcgacgagcacggcctcggcgattttggagaaagtcacggatggggtgccccagccgagccttcagtcgaacacaaatatgattacaccccaactaacacgatagaacacaccaaaccagtccatatcccagtggtcaagaaaacgggagtacctcaaccgcacccagtgggtgtacccgtgccgcaagttgtcaaagtacctgtaccacagccttatcctgtacaggtgtcggtaccaacacctgtagcagtacccatctataagttggtaccgcaggaaatagagaagaagattccaattcatgtaaacaagctagtaccggtatacatcaagaaaccttacaccgttgttctagaaaaacactatcc

SEQ ID NO: 5591 - DNA, 448 bp, Diabrotica virgifera
  Clone ID: LIB150-011-Q1-E1-A10
ggccaacgcgtcggaaaagctaaaaaattaaaatttttatggtaaaataaatattttaaataatttttttggtaaggaaaggttattcgttttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataatattagtattaaaaaattgtatatttagtaaaaatatataggtttaataaaggaattcggcaacatttttttcacctgt

SEQ ID NO: 5592 - DNA, 453 bp, Diabrotica virgifera
  Clone ID: LIB150-011-Q1-E1-A5
cacacgtccggtgcaatgatgagcttcgagtactgtggattggtccttttggcaggtcttttgttggtttccgcccaccctggaaccgactctaaggctgaagccaaggtatcttcagtagccgagaagaaacaggaaaaacgtggtcttcttgatctaggctacggtgggggacacgactttggaggaggacttgaacttggagggcatggtttggatttgggtggacatggtggtttcgacggaggatatggtggagggttaggtggagggtatggtggattagacgaaggtcatgttaagcacattaccatcaccaaagaagttaaagtacctgttcctgcaccataccccgtacacatcgaaaagaaaataccagttccagtgccagtcaaagtacctgtaccagtagatcgtccatatccagtacatgtacctaaagcatacccggtt

SEQ ID NO: 5593 - DNA, 446 bp, Diabrotica virgifera
  Clone ID: LIB150-011-Q1-E1-B10
cacacgcgtccgcccacgcgtccgggtggctatgccgtacaatgagcagcgggagtagccaaatatggcgtcgtcgcagtggtacagcatggatccgcgctggcctagtaatcttcatcttggtattcatatggatccagatgacgttcctgagcttcgctggttcatcccctcaatactcagaactaaacgatagtaacgcggctattctgagtatggttccagctgttttgcacaagtttctatcacccagaccaaaaaatctttctactattactttcgctaacggcagtttctcaaaatttatttctacagacgttctaaatatatctgaaattaaacgaaatatagcacaatacaacagacaacaaatcgtttacaatgaaaatatatttgaaccgcttcaaaacgactcaattgtcatactagttcaaattcacgacaga

SEQ ID NO: 5594 - DNA, 329 bp, Diabrotica virgifera
  Clone ID: LIB150-011-Q1-E1-B12
aatcatttcatcagctaaattttctgcgtattcgccaactagcgcccatttatcctttccggagtactcaagtttgagtacgtttttttcagtagtttggtgtttgtattattgtgctagttggtgttaaaaatataaatgttaaatagagaatttcaaataaatatttttattataagcccgattaggactgatttagttttaagttttattaaacacgagtttctttttttataataaaaaaatgtatcagaatatccgtaatggttttgtgtaactgtgcacctgtaaatgttctgtaactgtatgagtatgtgcagatttttatt

SEQ ID NO: 5595 - DNA, 444 bp, Diabrotica virgifera
  Clone ID: LIB150-011-Q1-E1-C12
cccacgcgtccggaacctcgtatgtgtgcaatgatgagcctccaatactgtggattggtccttttggcaggtcttttgttggtttccgcccaccctggaaccgactctaaggctgaagccaaggtatcttcagtagccgagaagaaacaggaaaaacgtggtcttcttgatctaagctacggtgggggacacgactttggaggaggacttgaacttggagggcatggtttggatttgggtggacatggtggtttcgacggaggatatggtggagggttaggtggagggtatggtggattagacgaaggtcatgttaagcacattaccatcaccaaagaagttaaagtacctgttcctgcaccatatcccgtacacatcgaaaagaaaataccagttccagtgccagtcaaagtacctgtaccagtagatcgtccatatccagta

SEQ ID NO: 5596 - DNA, 433 bp, Diabrotica virgifera
  Clone ID: LIB150-011-Q1-E1-D10
cccacgcatccggtgcattgttcatgattgttcatgataaaataataaattacgtttggaaaaaaagcaaattaaattatcgggtgaaatttaacgttttataaaagttattgagcatggattgcgctatgtgtatgaggggctattcccgttacatgttaatactttttaatttcatatttgtgatcactggtattgtaataatttctgtgggtctgagctctaaagcttacttcaatgaattcgatcaacttatggataacaaatatttctacatttccgattttctgatagtcattggagtggtaatatttttcatcgctttctttggctgctgtggagcgatgaaagaaaatgcatgcatgactaccacatactcaactttattggttattatatttattctcgagttggctgttggaattactgctgt

SEQ ID NO: 5597 - DNA, 63 bp, Diabrotica virgifera
  Clone ID: LIB150-011-Q1-E1-D9
cccacgcgtccggcagtaacgaagccgttgaatacctttggtgtacaatttgatagttgggta

SEQ ID NO: 5598 - DNA, 60 bp, Diabrotica virgifera
  Clone ID: LIB150-011-Q1-E1-E12
cagacgcatgggaaaaaaaaaaaaaacacaagaagacaaagaggaacaaaagaaaaatag

SEQ ID NO: 5599 - DNA, 392 bp, Diabrotica virgifera
  Clone ID: LIB150-011-Q1-E1-F10
atttcctcaaagcggttctcacttttgactgttaattggcaagaactcatctagaagtgtgttaataatgaagtttacggtttcttcgtggtttatttgtttgtttttagtttatttccggtgtggatttgcgagatttatgcttccccccgtgcccgatgttatctatccaccggtgcctgatattgttgccaagatgaatgaaacacttctagaagaggaacatatggacccggaattatcaccaggacttttccaaggagatatggcactcaccaacgagttctataactactggagggttggactgaaatttgaaatatttcctgataaattgtggaggaatggaaattgttcttatacaattagtccgttatatgagccatctgaac

SEQ ID NO: 5600 - DNA, 442 bp, Diabrotica virgifera
  Clone ID: LIB150-011-Q1-E1-F11
tggtactaaaggtgagatatttgaactgtgctgtctgtacgtcggtccgtccgaccgcgaatataactcctccgtcattataccaagtagaatgacaaaatgtgtcaaataaaagcatataatccaaggatggtactaaaggtgagatatttgacctaggctgtctgtccgtccgaccgcgaatacaactatcctccgtcattataccaggtataatgacaaatgaggtgtcaaatgaaagcttataatgcaaggatggtactaaatgtgagaaatttgacctaagctatctgtccgtaagactgctaatataactctgcctccgtcactataccaggtagaataacaataattgaggtgtcgaatgaaagcttataattcaaggatggtactaaatttgcgaaatttgaccttggacttccggttttagaaatgtaaccag

SEQ ID NO: 5601 - DNA, 443 bp, Diabrotica virgifera
  Clone ID: LIB150-011-Q1-E1-G11
caatgctccaagatgaaggtactcagtcttctttccgttgttgccttgagcagctgcttaccagcatccagaaatcaacaatacgttgatgtagactacaacagctacaacgctcatcccgtctacaacttctggaggacttggaatcagcaacactatggacaagaaccatggaaccaatgggtacaatatggtgtccagaaccaacccggtaactactggaggcagtacgtgcaacgcagcaaccaagctgaaaatgtcgatttaccttggatgtatcactcttgggatgtccaggatgtgcaaaacttaactcccgttcaacgtgttcagttgctactcaactacgtcagacttcaccaacaatggaaccaatggactcatgatgtaactgccacttaacgtcttcagaatatgttgtatcaacaccttcctgaacactt

SEQ ID NO: 5602 - DNA, 439 bp, Diabrotica virgifera
  unsure (1)..(439): unsure at all n locations
  Clone ID: LIB150-011-Q1-E1-G12
gtccgcaaattcatcaagtgcaagtacctatacagtttagtagtgaaaaatattgttcagcggcaattttaataggtaaatctaacattaaatttgactttttgtggttttgtattgttttagcgttatggagacagatactcctcaaactgcagcacccgctgtgacacagatacctgcagagattgaggctataattaaagcaacagttgaacaaactgttgctactttaatggaaaaacggcttggtaaacgtaaacaccgcaggtccaggtctagatctaagagcagaagccgttccagatctcgtagccgtggtggccgttctagatcaagaagcaagggtagacatgacagatccaaaagtagaggtaaacatgacagatcaagaagcagaggtangcatgacagattaaaaagtagaggaagacgtgacaag

SEQ ID NO: 5603 - DNA, 341 bp, Diabrotica virgifera
  Clone ID: LIB150-011-Q1-E1-H10
gattttacatcatgagaccgtttgtgttattatccaccttgatggctcttgccagtgccagacctgatgcaggttacagttacagcccaccctccggctcctacggagctccatccggtggcggtggaggctttggacgcggaatcgggggtggccacggaggcggtggcattggcggaggtagcggattcggcggtggtggattcggtggcggcggtcacggaggcggtggaattggaggaggcggtatcggaggaggcggtattggatgcggaattggaggcggaagcggaattggaggcggctttggcggtggatccggacgtggatttggaggtgga

SEQ ID NO: 5604 - DNA, 433 bp, Diabrotica virgifera
  Clone ID: LIB150-011-Q1-E1-H11
agccagccgatttcgatttagccataaacagcaaaaggagtttatttgtatgattgaactattttttataatttattcagtttatattttatgttaaccatggaatttaaagctgaagttaaggaagagtttgtttttgttgaatgtaaccaaatagatatagagagccagcctgagccatccacatcaatatcaatagaacaggaacacaaaaatgaaccagaagaatggaactcaggattattgtataaagccatatactgtgactcagcaatggaagtaaaacctgaaattaagaaagaatttgatcaaaacgaccaaggatatgtagaacctctgctcttaacatccatagaacttagagagttgaagaaagaaatagatgaagataaaccagggttttctcataacggaatggaaatcatgaacagtg

SEQ ID NO: 5605 - DNA, 429 bp, Diabrotica virgifera
  Clone ID: LIB150-011-Q1-E1-H9
aattactaaggcttttggagcctcactactgtgcaatttgtcaatatttgtgcctgttttgtccatcagctattaaaaactacttctttttaatagtctgcaagaacaaaccagggaatttttgttttactagttactagtcgttttacattgtgcagtgaacatttgtctttaaaaaagcgaagcaatggttaacacaaatccaaggcactaagtatctcatttcttctgatcattgcttataatttaatctcgagtatttaaattcaaatgtattgtcagatacatatttaatgacgagacttacattattcaaaaccatgtatagaaataataccataaaaccccatgactataaccatgtcaccatccccacatatgactgacatgattttgaggaatgtaagccttcacggctggtgttctgta

SEQ ID NO: 5606 - DNA, 329 bp, Diabrotica virgifera
  Clone ID: LIB150-012-Q1-E1-A1
aaaaaaaaaaaaaaaaaaaaaaaaaaaaagagaaaaaaaataaacaaaaaaaaaaaaaaaaaacagaaaaaagaaagaaataataaaaaaaaaaaacataagaaccaaaaaagataaaaaaagaaaaaaaacattaaaaaaaaaaaaaaaagaaaaaaaagggggggccccccaaagggttcaaagtttattaacccttgaatgcaagtccaagacccctccaagggtgtccccaaattcaatttcaggggccttctttttaaaactcttgatggggaaaaacctggggataccccaagttaccccctttaaaaaaattccccttttcc

SEQ ID NO: 5607 - DNA, 243 bp, Diabrotica virgifera
  unsure (1)..(243): unsure at all n locations
  Clone ID: LIB150-012-Q1-E1-A11
ccacccacgcgtgggaatttaaaataataaaatattttttagtaaaagtaaagaaaaattttatttaatgatagttaattagtattgtgagagaatattttatttttataaaagaaaaatttattttttgtaccttgtgtatcagggattattaattantaattaaatatttataatttccgaatttaaaagagctaaaaaattaaaattttaatggtaaaataaatattttaaataattttt

SEQ ID NO: 5608 - DNA, 409 bp, Diabrotica virgifera
  unsure (1)..(409): unsure at all n locations
  Clone ID: LIB150-012-Q1-E1-A2
ggcatcacttgcgtactgctggcatattactgcgtagtattaattctaagcggtagtgttttttcgttcatacattgttaataattacattattaatactaatttactataaatatgtcttatagtacgcgaagaagtactggatataataccccacaaacccagaacgtgggaaatgtcggccaacggagaccggtggttacaaataattttgtccaaggacaacaaaaaccaccacagcagcagcagcagcagcaggtacaacanaatagaccaacaacaccagctactgcaagaggacaggctacaactccacagggcagaattcagttcagggctcagcaacagacaccacaagcaaatcaacaggctgcgaacacacangcagcagcaaatgctgcaagactac

SEQ ID NO: 5609 - DNA, 414 bp, Diabrotica virgifera
  Clone ID: LIB150-012-Q1-E1-A4
cccacgcatccgatcaaacacaagagtctgaggaacattcagctagtggtagcagctctgaagacgagcaagaggagaatatggaacatttgcgtagattctttgcagagaagcttaatttttcaaaagccgaagacaaggaaaaagtaaaggtgctaaatgatgtgtccattgatggcatagttaactacattaatgaaaagaactgtaaaaatatcattactatggcaggtgctggaatatcaacttctgctggaatcccgaattccgctcagcaggtacaggcttataccacagtctcaagaagtataatttgccaaatccccaagcaaatttcgagttagacttctttccaaataatccgaaccaatccttgagttggcaaaagaactttacccaagtacattcaaaccg

SEQ ID NO: 5610 - DNA, 434 bp, Diabrotica virgifera
  Clone ID: LIB150-012-Q1-E1-A5
cgccttcaacatgaaacgatcccagcaagttacggtcactgaaaccaccccaggatattcagtggaaaagatgtattataaagaatacaaatatgaaaccgctttctccatttcgcagttatcgaaactggagaatttcgttttacctcctagaactactatcttagcattatctcagaacggaggagacaaggaagaagacaaaaagtatgtcgtcaagaatcacggaaaagctgatctttttgttgaggtaatacatctcaataaccaagatgatgctccacaatggtttgtagtccagccagaccaaaccactgagatagatattgaggacaatcttgaacaaagcgtgttgaaagtaagcaacaacagttacgaacaggaaatatcattttctgctaaaggtggtcacgttattgacgacttgggaaaca

SEQ ID NO: 5611 - DNA, 190 bp, Diabrotica virgifera
  Clone ID: LIB150-012-Q1-E1-A6
acgcgtcagcgaagaagtcacgccggcttcaggatgaaacgatcccagcaggttacggtcactgaacccaggccaggagattcactggaaaagatgtattatggcgatgagagatatgggacctctttctagagttcgcagttgtcgaaactggagaagttcattggaccgccgagaactgggatcgtag

SEQ ID NO: 5612 - DNA, 87 bp, Diabrotica virgifera
  Clone ID: LIB150-012-Q1-E1-A8
acgcgtcagacaaaatacagatcatttagcactgtatcgtactttgtttaatttcaattgtttttcccgtgcattcagtaaatcatg

SEQ ID NO: 5613 - DNA, 264 bp, Diabrotica virgifera
  Clone ID: LIB150-012-Q1-E1-A9
cgcgtccgcccacgcgtccgtacgaaatgggaaaacctaatggaccatgcctcccaattcagcaaggcggtggtatttttgacgtaaacgctacaacacttgtcgtggaatgtcttaaaggcactgatagactgtcattattcaatttgcccaaattctgcatgcctggaagtaaaagagacagtaacggcaattgcagagtcatttacaactaatagaaacacatgttttttggtttaccggagtatttttagttgtattgat

SEQ ID NO: 5614 - DNA, 305 bp, Diabrotica virgifera
  Clone ID: LIB150-012-Q1-E1-B7
agccaagcgtccgaaataaacaaaaatttaattccagcttcagatattgatatttttaagtttttgtctgctaaaagtatcaatatctggcaattgcattacagagaatgtaatactggctcaaattttgctcattgtaaccctgggatattctcaaaaagatggttttacacagaatataacagacattttatcaagaccattaatcggctgagagccaatcatgctcttacgccatattacatgcatagaatcggcttgtcagacactcccaattggtagtgtggcaaaattcgagatctatc

SEQ ID NO: 5615 - DNA, 232 bp, Diabrotica virgifera
  Clone ID: LIB150-012-Q1-E1-C1
cgaagttcaagtagcaatcggtcgcgttgaacttctcgacagacacttcaccaaacaagagttgatcaatagggaggtgacagaactcaccgcgagaagacacccagtcacggtagaggtccatgagcaacagggagtggttgccgagcagttcgcacagctgattgtccagttagcgtagcagcacagactcactatacgtgaggttgcacaagagattgccacaggacag

SEQ ID NO: 5616 - DNA, 329 bp, Diabrotica virgifera
  Clone ID: LIB150-012-Q1-E1-C10
cacgcatccgaatttgacaatgatttccgaaatgcacatttaaccgtcaaataaacttattttacagtaaaattgtggttcattcccaacaaagatactaaaaagtaaattaggaatgtgatttccataatgtcatacaagttatgttagatttcctgattattgacttcatatcacccttactagccaaaattacttttgggttccgaattttcaaattcatttccgactagacatcgtcgaagttacgaaccgtatcactgtcatcggcatcatagcctgtgacagcacatgatacgaacaccaagtagttatgcggtacgtgtgtt

SEQ ID NO: 5617 - DNA, 424 bp, Diabrotica virgifera
  Clone ID: LIB150-012-Q1-E1-C12
cagggttatctgatgtttcagattcatcgtgtcctcgtaaggcgagctcaaaagccccacagaattttatacagtcaattatttttgacaaaacatacctgtttttcgtcacctcttcattgtgtttttgtatatttatccaataagcagagtcaagttgggcctgtatattaagtttcccaaataatgcaaatcgcatttcattgttcatatgagtttgcgtgttttcatgcttctttattttttcacttaaatgcactagatcccgcactcctgtctcgcgccacaatttttcctctttatctgcgccgaataatgcacacggaaaacagaaaaaagcatttttttcggaacatccacaaatccactgatttcgtagatacatgtctttattaaatttacgcgtatatgtttttccacggct

SEQ ID NO: 5618 - DNA, 446 bp, Diabrotica virgifera
  unsure (1)..(446): unsure at all n locations
  Clone ID: LIB150-012-Q1-E1-C2
cttttgctgtaaccctttttttaactgaagctaaagaaagcggtggaatggttactggtctctactaattaaagaagaatcaacagccatggacaaaacggtcaaaagcaggggatggcctttaacaggtgctaagtgtaacatcaaaccattactatttgatctcgaggaagcactttctgtagagaacacctacaggcccagtgtattagcaattcaatataacgttaaaccaggagaagttactctcaagtccagggatggtattgtacatcttcttcgtttcctgaagtcttggtttgataccccagaacaagtcttttttgtagccgtcngctatctggatgcatttatagcacgtataaacgtaccagaaaagtacttgatgtgtcttgcatttgcttgtttcttcatagctgcccgtgaagagcaacttgacattcctt

SEQ ID NO: 5619 - DNA, 351 bp, Diabrotica virgifera
  Clone ID: LIB150-012-Q1-E1-C3
aaaatgagcatggaaaacataaaaaactccacatccctgtaatagaatactcagaatggactgataatgtatgcgaaatgcattttgaagtagaaactaccaaggcttccaaaaatgcgtgtatatacattaaaaaatgacttggtatatatattggattttaaaaagagttgctgacatgaccaaactaatttataagtacttgtgaaatatggatttggtaaaagtcaagacaaggtgtttaggattattataaatgtcattaaatgacaaatgtgaaacattatcaaatatagggcgtttcattcacagtcatttctttcgaccttctgtcatatgtcgtacaatccc

SEQ ID NO: 5620 - DNA, 325 bp, Diabrotica virgifera
  Clone ID: LIB150-012-Q1-E1-C9
attttgagaatgatttccgaagtgcaaatttaaacgtcaaataaacttattttaaagtaaaattgtggttcattcccaacaaaaatagtaaaaagtaatttaaaaatgtgatttccataatgtcatacaaaatatgttagatttcctgattatttaattcttataacccttaccagccaaaattatttttgggtttcgaagtttcacattcatttctgactatacttcgtcgaatttactaaccgtttcacgtcatccgcgtcatagcctgtgacctcgcatgataccaacacgaaatatttaagcagtaagtgtgttcgttttt

SEQ ID NO: 5621 - DNA, 76 bp, Diabrotica virgifera
  Clone ID: LIB150-012-Q1-E1-D2
gtcgaccgacccttcggccaagccatcgggcgttttgattgccggaaaacagaagccaccatgagagaacattggt

SEQ ID NO: 5622 - DNA, 330 bp, Diabrotica virgifera
  Clone ID: LIB150-012-Q1-E1-D4
attgatagtattggttatccttgttggttttggtacaaattcgaatggactaaaattacctgtctactacaaagcgctgtgcccagacagtgttagatttagtggtcgtcagctctaccccaaatgggaccaaattaacgactatatcgacgagttggaatttgtaccctttggcaaagctatatacgtgcaccacgatgctgatattgtaaagcaaacatctgagcgttactcattcagttgccaacatggtcgtagagaatgccaaggagacaagtaccaggcttgtgcactatcgcagaataaaggcgaagatgtagaactgccttt

SEQ ID NO: 5623 - DNA, 447 bp, Diabrotica virgifera
  Clone ID: LIB150-012-Q1-E1-D5
gtcacgtcttctacgctttcgctatgatggttgaaaagacggcattgtattttttgttcttcgtattgcattttctaaaatgtttctagatatgtgcattattattcttttacttcttggagatctttcgacctgtttaattctgaagctgcctctggttaatttgcgaggtagcgaggtagattgttgcgaggtagattgccaactacccctccatcttttaggtggtcttccggggggtcttgaacagggcgggttgttttctagggcaatttttgggagtctattatcatccattcgtcttacatagttgtaccacatcctcttgcgctgccttccccatcttacaaaatcttgaattttgcattgctctctaatgcttgtatttctcaaccggtctcttcttggtttcacactattgtccttagggtttcatttcggaaacct

SEQ ID NO: 5624 - DNA, 293 bp, Diabrotica virgifera
  Clone ID: LIB150-012-Q1-E1-D6
gtaacgtcttcgacgctttcgctatgatggttgaaaagacggcattgtattttttgttcttcgtattgcattttctaaaatgtttctagatatgtgcattattattcttttacttcttggagatctttcgacctgtttaattctgaagctgcctctggttaatttgcgaggtagcgaggtagattgttgcgaggtagattgccaactacccctccatcttttaggtggtcttccggggggtcttgagcagggcgggttgttttcaagggcaatttttgggagtctattatcat

SEQ ID NO: 5625 - DNA, 143 bp, Diabrotica virgifera
  Clone ID: LIB150-012-Q1-E1-E1
attatgcacatctcgtttgagttacatcggtatcagttcattcacaattggaattcgttcacagattggtcagaagcgctctagtgcagttagaaggatgtgattaatgaatgcaagcatcgaaatgggttcaagttcagata

SEQ ID NO: 5626 - DNA, 412 bp, Diabrotica virgifera
  Clone ID: LIB150-012-Q1-E1-E10
gaatgcaggtagcgatataggaaatatgttgaagtctcattttcaaaagagccagtttatcatcgttttttaaggatggtatgttctctggtatgccatctcttcaaaggtgtccagaatttccttttcatcctgcattactactctatttcgtcgtattgaataaatattttatcaaagcttttcgctagagttttgttacaagttacaagtaactgtcaagcaacttaaaacttataactagttgtcaaaattatttattttatacacggtaagtacagcagacccccctctataacgagaactgaaatggcatactaattacctcgttataagctgatctcgttatatcagacaacaataatattgagcatacatattaatatgtagttttccaaaacactaacttcct

SEQ ID NO: 5627 - DNA, 403 bp, Diabrotica virgifera
  Clone ID: LIB150-012-Q1-E1-E2
cgtcaagttagaacaaaaaattagttttacattttcaaaattaagatgattattcctttttaacattacatcatagaagaatattaaaaacagttcaagtaattcacaaaaatggcagacactgccttcacaaagaacgaagtaataggcttggtggtgaggttaacccttgtctctgcagttacatttttaagtataaaatggattatgaaccaggttgaccccaccaataaaagcaagaaaaaggcaagacgacaagcagaagagcagttgaaaagattatctgctacaggacatgcacctgtacttattgagaaattaaatgattatgagatgatgatagcagctcacttggttcatccccaagatattaaagtaacttggagtagtattgctggtctgg

SEQ ID NO: 5628 - DNA, 358 bp, Diabrotica virgifera
  Clone ID: LIB150-012-Q1-E1-E4
atcttcaccactatggcattttttaagctagctggtttgtttttgtgtatagtcgcgtctatcagtgcgttacccacggcacacgatgaaacgcgcggtaattcagttcaaaccgaacacgatcttttggatgccgtttacaacgactgccttaaaaaagactctatgtcgtgtctgaagtataaagtttttaatttcgtggacaagatgatcggcaacagggaaacaattacagtgatggatggtgttcagttcgtcaaaactcgcggtggtgaacatgatggtgctccacgcgctattagcagtgacgacactatcgaatctgtcagtttcaacaggattacatcgttcttggggt

SEQ ID NO: 5629 - DNA, 89 bp, Diabrotica virgifera
  Clone ID: LIB150-012-Q1-E1-E7
aaaaagacttttatttaatgatagttaattagtactgtgagagaatattttattttgatacaacacacatttattttgggtaccctgtg

SEQ ID NO: 5630 - DNA, 454 bp, Diabrotica virgifera
  Clone ID: LIB150-012-Q1-E1-E8
atacttcttgattaattttaaagctctttatttgttgtcaattttttaacaaaatataagctggtattgacacgggtcttgctattcaatcaaaagatgtgtttgacttttccctttgatattgttgtttatgaacttgaaattatgttaccaacctacgcatagacatatataatacttgtatgtttatgcacgtaggtgatcaaactctaaccaactaaataatttcaaatattggatatattatattgggacatgctgtatataaaatggtcaatgactggtctatttgaatgttaattaaaagccaaacaatcaatttattttatttgtaattatattcttatttagcttgtatttagattagatacatatcttatattaaattaaggaaagaggaaagtcatgtacttgctcggtgaaatttttgtaaatgtattagctgttaaaaatg

SEQ ID NO: 5631 - DNA, 373 bp, Diabrotica virgifera
  Clone ID: LIB150-012-Q1-E1-E9
gcgagcgccgccctttttttttttttttggtaagatttacatttattgtacaaacgttaagatcatttacattgtgatttttccgactttagacaacatttatgccactttgcaatgtgaaattacatttactatggatggtgatactgctctcttcatactagcgtaagactttatgtacattacttttaaccgaatcgtgctgttgaatcagattattacatgtatattagatttgggacttagacctgactccctcgccagtcttttatcaacttcgattggagcattcaactaatctataagtgtcagaatttacatcagccaatattgcaagaacatataatcacgcacgacattggatccacattca

SEQ ID NO: 5632 - DNA, 217 bp, Diabrotica virgifera
  Clone ID: LIB150-012-Q1-E1-F1
tacagccgacggacttgctgaagatcatgatgaaggataagttaacccacgtgaagacttcaaagtccgtgcccgttagcttacagagagataggactatgatatagactgaagcccgtaagatccggtgctttggacgtatgagtactggacccattcatccttgtagattgtacgaagggagtgcagcagcttaatgaaatcatatactctgtgg

SEQ ID NO: 5633 - DNA, 260 bp, Diabrotica virgifera
  Clone ID: LIB150-012-Q1-E1-F10
gatcttccctcagccatgtgtcataagtccatgtttgatacaatgatatacttcataattagactatgttgtagatttgtcgcccatgtgaatccaattatgctccaggggcattatactgtcagcattcaatatacatataattgatatcgggacctcttgttctcagcgtctaatcgtatcaaaccttatgtatctgaaggctctcattcgggaatctctacgtacattcattggataccagtgattaatctggtgta

SEQ ID NO: 5634 - DNA, 125 bp, Diabrotica virgifera
  Clone ID: LIB150-012-Q1-E1-F11
agcttctttagttagagcagccatagacaatttaatgctaggagacagatcttctgtacaggattttactgtttttttggaccagatggcatacaaccacggaaaggaaaggtttttccttctgg

SEQ ID NO: 5635 - DNA, 385 bp, Diabrotica virgifera
  unsure (1)..(385): unsure at all n locations
  Clone ID: LIB150-012-Q1-E1-F2
gttttgtccacttttgcatgtaaaagttaaatcattcaatacttctttatcaattacagttcgctgacattattctatcactcgttcttggaccaagggatgtgtcacttttctaatcaacctaaagctgagtanggaaagaattaatcccaggggacgagttttgcaaggaccttgcacatccttaaacggtcccaagactgctgggtactcccaactaatgacaagtggccctattgaaacaacccaatggatatatgctggaggtattccataaacaatccccatgccaagccgtgagacactgtggtgaaggcaacaaggcactanggtgagagtgtctcgaacagttcctttggggcaccaagtctcactccatcgtatt

SEQ ID NO: 5636 - DNA, 312 bp, Diabrotica virgifera
  Clone ID: LIB150-012-Q1-E1-F3
cttcggctaagtccaacgttgcgcataagtttgttgacattcaacaaatctttatcacttacagatcgcagacattaatcaatcactccttcttggatcaagggatgtgtcacttttctaatcagcctaaaactgactatggaaaggattaatcccagaggactaattctgcaaggaccctgcacatccgtaaacagtcccaaaactgctaggtacacccaactagtgacaggtggccctattgacacaacccagtggatctaagctggatgtaatcgatacacaatccccatgccaagccgttagacactg

SEQ ID NO: 5637 - DNA, 378 bp, Diabrotica virgifera
  Clone ID: LIB150-012-Q1-E1-F5
gtatatggtgaggtctattggatcatgggtttttcacacttgtcgcatcttcttatcgaactagttaaagttagattcataatataaggttatcattaagatatattactctgctttctacggtagcagttctttcaggacaagtctcacaatctctagttgcacattgcttaaaagctacagacacttcgatacgacaatacacaaatagctcaacactgatgagagacctgtcgaagtaacttttgccagacatgcaatacaagaaccaatacctgtacacatgggattcattccagaagagtggattcaggttatctacaatcaacctggtattacacgaccatacactttcacactcaccatgtctacatacct

SEQ ID NO: 5638 - DNA, 237 bp, Diabrotica virgifera
  Clone ID: LIB150-012-Q1-E1-F6
ataaacagagtaaacgtggtctcctcagcttatgataccgatatggtggagattttgataatggttaccacttatgacaaggtggatactgtattgacggtggttacacactaagactaggccagctatacttacgagacactacttctattcactaataccattactttggttaaaggattaccagtaccatacccagtagagagatacatcccttacccagttaccactcacgta

SEQ ID NO: 5639 - DNA, 450 bp, Diabrotica virgifera
  Clone ID: LIB150-012-Q1-E1-F8
cttagtctcagcatccgttatggcttgcaaattgtagaagcctcgtaggtgttaccagaataggttcccattgttttcagtctggtaggatgtagagtaacatttttggatgttgttttatgtgctattagattgaaaacttagttttttttaagtaaacaattgatcaacttgctcaagtttattactatttacatacacagacgattttatattgtcttgtttacttattacgagtattttggttttccgtatgttcagatccagacttgcttctttataactctcaacgacactgtcaagtaatgtttgcttatcttcttgagtagaagctccgcatatcgcagattattgatgacttcaccgttcataataattatttcttcttgtttttcagaaagtgcatgtgtgaaaattcttgggagtaaacttttgataacaggggtgaca

SEQ ID NO: 5640 - DNA, 383 bp, Diabrotica virgifera
  Clone ID: LIB150-012-Q1-E1-G1
ccgacgcgtccggaataactggagtggaaggaggacgaatgtatcaaataggaagctattagtagtattagatcgtaatatatcactagtaaatttagattttggcagactatcctttaaactgcaagattagtgcatataccagctcccatcctaaaatgtcagtgctgtcaagaatatccaatatttattccaagtctggttcaaggcagtatccagatgaattggatatgatacaaactaatctctacctcaatggtgaggcaaaagccagaaatgttgaaactcttaaaatatacaagattactcacatactcactatcaatgatttcccttaaactggtactgtaaaaaatgccctaagatatcttcaagtaagtaca

SEQ ID NO: 5641 - DNA, 250 bp, Diabrotica virgifera
  Clone ID: LIB150-012-Q1-E1-G11
caacgcgtccgagaaaaaaaaaaaaaataaataaaaaaaaaaaaaaatcaaaaattaaaaaagctaaaaaaaataaaaattgttagtgtcacaataggattttaacttatttggttgtcatgaaatgtcattcgtcttcaaatatgtcaccttttttcagatcaatggtcgttttatttagtcgcagtatctgtaaaaaccctgtacttttatcatattaatcactttgtatttttacggattttctcaa

SEQ ID NO: 5642 - DNA, 461 bp, Diabrotica virgifera
  Clone ID: LIB150-012-Q1-E1-G2
ccgatttctccatttcgcagttatcgaaactggagaatttcgttttacctcctagaactactatcttagcattatctcagaacggaggagacaaggaagaagacaaaaagtatgtcgtcaagaatcacggaaaagctgatctttttgttgaggtaatacatctcaataaccaagatgatgctccacaatggtttgtagtccagccagaccaaaccactgagatagatattgaggacaatcttgaacaaagcgtgttgaaagtaagcaacaacagttacgaacaggaagtatcattttctgctaaaggtggtcacgttattgacgacttggaaaacaacatggaagaacttcttgactcagacgaaacagaaactgaaatggtcgttctggaaaacttttctttaagcccaagaactgctgtcactgttttgagtccaaatgttgaaggaagcaatgaacat

SEQ ID NO: 5643 - DNA, 125 bp, Diabrotica virgifera
  Clone ID: LIB150-012-Q1-E1-G5
ttacaatacaatctaaactgaccttctggctcttacttgtgttattgatgcagctgatgtaatgatccttcattactaacgcgagagcgtatctcatttccaatcgccaatccttgactcctggt

SEQ ID NO: 5644 - DNA, 347 bp, Diabrotica virgifera
  Clone ID: LIB150-012-Q1-E1-G8
ccaacgcgtccgctttggcatcacaaagaatttgacgaggtaactaggaggttaaaatgtaaacgtttggtgcactctttgaaagtgaaaatgtagtgactggaagttgaacacggatggtgatggtaaccacgaacattcgataagtgagactggggatttgctacctctgatggatttcagccagagacctatggagtgtagcagaggcaacaggagcgattccaaaagctgtcagacttccctggctatcagctgatctattactagaaggtagtacaagttacgagaagagtaactagacatattatgtcagaggcactcaagaccgcagaagagttgagctc

SEQ ID NO: 5645 - DNA, 411 bp, Diabrotica virgifera
  Clone ID: LIB150-012-Q1-E1-H11
gtttactcacgtagggtagatgtgtagccagacattcattatttttatatcatttaaatgtcagttaatatcattgtgtgtattcaagtatgagtgtaggcgtgtttcgacaacatatctctctttcaacaggtgtcccgtttggggtgtaacgatgagagcatatgaactgtacgatgttcaatcattgtggctttgtatatgagaatcgagggcatatacggctgtatcagtatttttatgcaacattgtgacatttgatgcaccaaatcatcatcatttccctagcctgcctatatgaaccctcaacacgtcggagcttaccagcatgagtccagaatctcctcagcagagtcagggcctacatattcagtaacctcgtgtttcgatgcagcacattagtagttttta

SEQ ID NO: 5646 - DNA, 364 bp, Diabrotica virgifera
  Clone ID: LIB150-012-Q1-E1-H4
gggggggggggggggggggggggtgtgggggggggggtggggtgggggggggggggggtggggggggtgggggggggggtggggggtggtggtcgtggggggttgggggggggtgtgtggtgtggggggggcgagggggggggtggtggggggtggggggggggggggggtggggtgcgggtgggggggggggggttggggggggggggggcgggggggtgggggtggggggggggggggggcggtgggcgtggggggcgggggtgggtgggggggaggggggggggcggcggggggggggggtgcggggtgggggggggggtgaggcgggggggcggtgggggggtggtggggggggggtggg

SEQ ID NO: 5647 - DNA, 259 bp, Diabrotica virgifera
  Clone ID: LIB150-012-Q1-E1-H7
cccatgcgtccggcaagatgtgacataatgttaacatacgtgatagaaacaggcgtattcgtgataacagcttccacggtaattgtactgtccacgtgacactttgccaggagatccatcacggttgaacagcggtcagtttcggacaggtaagcttatgctgatgggtctgagatatacacgggacggaaaggagttgcagtggtacaggtaccgccatcaaatgcgaaatgtgtagcacatggcagaccatggtggg

SEQ ID NO: 5648 - DNA, 431 bp, Diabrotica virgifera
  Clone ID: LIB150-013-Q1-E1-A12
agcagtatccatcatgaagtgttttgtactgttcgcttgctgtgttgcatatatttcagcttcggcccttaattttcagcctttccaatcagtatacgtagacccatgtgcgtgcagaaaatgtttagaggaaatatggaacagaacactacagcttaatcaaaatttgaattcagtcaaccgcactctaaacaatttaacagtgatactcgaaaaaaatgtaacaactgaggtgacgtatcaacttgacgaactctgcaaagtggaagaaaacctcgacaacttagtagccacagaaaaaaatatcacagttgttcttcaagcacaaatttgtaacctgacagatgtggtaggtgacttggaaaaatgttgcagagatatggagtgtttgggacagaaggtcgacgaacagacatgcatcttagctaacg

SEQ ID NO: 5649 - DNA, 456 bp, Diabrotica virgifera
  unsure (1)..(456): unsure at all n locations
  Clone ID: LIB150-013-Q1-E1-A3
ccaaaccttcgccgacccctggggggtttggaaacaatccggaacaactcaaacaaaaggtttaacaagagaaaccaaaccaataaattccggaatggccccaaatggcggcaaagccattccaagcggaccaagagaaaaaaccccaactccggcaaatccaagtggctgagaaaaaacaagctgaccaagctccaaaatgggccgcaacggaaataaaagaggacaaaacctaactcagtgaacaaaaggtagaagctagtcctgtagccgaagaaaaactgcccgaattgaagaaagccgaagaacctgctccacaacttgaaggtanatcagtgctcgaactacctgaagaaaaaccacaacctgcacagcctgaaggtaaattggaaccagtacaacctgtccttgcggcagttccagctgtagaattagaagtaaagccagaagaaaaac

SEQ ID NO: 5650 - DNA, 423 bp, Diabrotica virgifera
  Clone ID: LIB150-013-Q1-E1-A4
ttacataaatcaacaaatcaaccatgtctgaagacgcagcaacgacaacctcaaagcgaagacgcaaagcctatgcaaagaaagcttaaaaagttaaaaaagcaaaaaaaggttattccaaaaaaaaggggaaagaaaaatgcaaattatgaaagttcaacacctgcaaaaaggggtagaggcaggccacaggggaaccaacgaaaaagaagagcgcagtcaaaccagaagccaaatctgcccgagcatcacgaagccgtggcagaccagagaagaaagaggaacccaaagactccggagatgaagataatgacgacaatgatgccggagaagaggaagaagatgatgattaaatgttcagtcttaaaaaagttttgaatttttggcgcacccatgtatttgggcgccaatcctacaaatatg

SEQ ID NO: 5651 - DNA, 449 bp, Diabrotica virgifera
  Clone ID: LIB150-013-Q1-E1-A5
cccacgcgtccgactttttcttatatctgtaatgcaaagcaaaatatcggtaatttaccgtgtttttggattcgcagtaggccacttttagaattaaaaaaaattcagttgagtatcttaaaaaatgtgaaccttcaacctctatggactgcaaaagttaaaatctgtatttattttgatatgcatatctacttacagagatagatttgttaacaaataaacgacacaaactttggtaacacacttttacaatttgactaactacttttaaaatgatatgatattatgaattatgatgatattataaaatgtaaataaaaaatggtcaaaaaaatggggacttaaattagattttttcggcggatttttttttgctagtgcaaatttgtctagatattttacagttaggtatagcctcccctggtaaaaatcacgagtcgccactgatg

SEQ ID NO: 5652 - DNA, 292 bp, Diabrotica virgifera
  Clone ID: LIB150-013-Q1-E1-A8
agcggtaacgatactccggctgacccacgcgtccgcgaaaacgtctgccatttgcgtattcgtccaatggtgtgtgcgctatctcagctcaaacgagagttcggtgtctcacggtgacatattacgttgtgtagaataactcaatatcagatcacatactttgggcacagctgaacacgttgcacaatgggcatccacgtccttcagtactaggatacgcgattttacgccatccgacggaggttattttgtgcatgggctcccaacaggaagcacacctctgggaatgttg

SEQ ID NO: 5653 - DNA, 236 bp, Diabrotica virgifera
  Clone ID: LIB150-013-Q1-E1-B11
cacgataatcatgaaggccttgattgtccttagcgtttgcttttgcttaactctagctgccgaatccgagaaaaaggaagtaacgcaggagagtagaaaacaagagaaacgcggtcattacggccttggtgatcatggtggaggattcggcctaggcggccacgattttggatgcggccatgattttggacgcggtgattacggacgtcatcaagaacaccacgaacacgtaaaaa

SEQ ID NO: 5654 - DNA, 277 bp, Diabrotica virgifera
  Clone ID: LIB150-013-Q1-E1-B5
gggtcgccgcacgcgtccgcaaagtttatgcagagacgaactcactcaaatctacaatcaactcgtcgaagctaatgtcgaattgaaggaggccaacgatgaaatgattcagctggactcccatatggaatacatggacaatagggtcgaaggccagaacgaagatttggaagaactcgaagttgcacttaccatgctgcgttacagccagcttcaaagtctgtaggaggtttgcagtcaagagcagattctgaattgcattgtcgtcactgttcaa

SEQ ID NO: 5655 - DNA, 470 bp, Diabrotica virgifera
  Clone ID: LIB150-013-Q1-E1-B6
catcgattgttcagtcaaccgtatcgtgttttgagttctttggaattactatttttttacatttccaaaatgaaattcttggtacttgtagtagctgctttcgcagtatgcgctgctgttgaggataaaaaagaaaagagaggtctcttaggcttaggcgattcacttttggacggtcacggaggacttgaattggctccagcacctattttggctaaagctccaatctacagcagctactccgcaccaatcatcagcaaaaccatcgctgaaccaatcatctctgcacctttgatctccaaagcagtcctcccagctccaatctcgtactccgctcccctctcctacgctgcacctgtctcctattcttctcctctctcctactctgctcctctctcctactctgctcctctctcctactctgctccagtcatcagcaaatcctatgccgcagctaacctttccgctcc

SEQ ID NO: 5656 - DNA, 428 bp, Diabrotica virgifera
  unsure (1)..(428): unsure at all n locations
  Clone ID: LIB150-013-Q1-E1-B9
acgcgtccgccacgcgtccgcgccgaaaacctcgacgccgtccctgtgcgtacatatcaccaganagaggataaggaataacacgatattgattagtgagtaggtaaccttttaacagcggcacagtgtgcgatgtttgagaaacaataattgacaacatgaacaacaatcggtcgaagctgctcccacaacaatcgtcgaaataaggtgaagcaatatttcggtgaaatatgcgaaaatacagcagtggggaggaaaagttgtacataaacagtttgtgtgttagtggaagcagtataaaacttttgaacccgacaaacaagtgttacatcaacaaaacgatcaagataacgttggatgccgacgtcgtggaccaggaagccaccgccgatagcanaaataaaatcgtggattttaaaaaaagtgac

SEQ ID NO: 5657 - DNA, 427 bp, Diabrotica virgifera
  Clone ID: LIB150-013-Q1-E1-C10
cggtcgcgtgagctgctccaagatgaatgttttcaagcatcagtccgtagttgccttaagcagcggcagatcagcagcaatgtgtcagaataatgtagatgtagactacaacagcttaattgctgaacccggcgtcacatgcaggaggacttggtatcatacatacttatggactttcgacatggaaccagcgggtacattatggtgtctagagtcaacccgatatctacaggaggtattatgtgctgcgctgtaacccgtctgaaaatgtcgctatatcttggatatatcactcatgggaagtctaggatgtgcatatctaaactcccgtacatcgagatcagtatgcaacacatctatttcaggattcacttacaatggaacctttagactcatgaagtttctgcctatgaacgtcgacaaaata

SEQ ID NO: 5658 - DNA, 433 bp, Diabrotica virgifera
  Clone ID: LIB150-013-Q1-E1-C12
cacacgcgtccgcccacgcgtccggtctagttcttctttccctagtaacccttagtgtagctgcctactacccaagtactggtaggcaggtgacagtaggagtagctggaaatgtgaaactagtcggctctcaaggttcccagattgacattcgtagaagtccttacaacccaagaactgtcgacgtcaccctcagaagtccaaatgctccaaccagaactctgcaaattgatgaagccaggaacggccaacaacttggttattccaacctccaaggtgtcaacaaccaaggtgtcaaccaggctgatgttcttgctgatcttttcagtcaatatgagggtattgtagatgaccagaccttctacagtttgttgaacaaacttcaacatttggtacaagctggagtcatcaacagagtagtcttggatgttgt

SEQ ID NO: 5659 - DNA, 273 bp, Diabrotica virgifera
  Clone ID: LIB150-013-Q1-E1-C4
cgaagttcctgaagaattcgataacgtacaacttctcgagaaactcttcgccaaacgagaattgatcaaccatgagttgactgaaatcaccgatagaagacaaccagtcactgaagaggttcacgagcagcaaggaatgattaacgatcagatcgaaaaactgattgaccaattagcttaccatcagaacctcattacacgtaaggttgaacaatacattgttaaaggacaagtggttcgccatgagctcgtttaccaacagagattggttta

SEQ ID NO: 5660 - DNA, 443 bp, Diabrotica virgifera
  Clone ID: LIB150-013-Q1-E1-C5
caaacaccgccttcaacatgaaacgatcccagcaagttacggtcactgaaaccaccccaggatattcagtggaaaagatgtattataaagaatacaaatatgaaaccgctttctccatttcgcagttatcgaaactggagaatttcgttttacctcctagaactactatcttagcattatctcagaacggaggagacaaggaagaagacaaaaagtatgtcgtcaagaatcacggaaaagctgatctttttgttgaggtaatacatctcaataaccaagatgatgctccacaatggtttgtagtccagccagaccaaaccactgagatagatattgaggacaatcttgaacaaagcgtgttgaaagtaagcaacaacagttacgaacaggaagtatcattttctgctaaacgtggtcacgttattgacgacttggaaaacaac

SEQ ID NO: 5661 - DNA, 333 bp, Diabrotica virgifera
  Clone ID: LIB150-013-Q1-E1-C6
cggacacgtgggctttagcggcgaatcgattgagggtaaaattgtacatcaaccacgcgcctgcgcacactgacagtatgtagttctgacagtacatatgtagttcactgctaatctttcaagataggtatgtatgtatctgtaaccgtgcaaataagtcattaaaagaatatattagtggttttaggaaatgtattatgtattataattcttgtgtttttggatttgtaattccctgtagtaaaataatgaaatatgtacgcataacatttttacagtttgtccccgtgttgtgtaagtatatccgaaacttacacgtcaattcaagtggct

SEQ ID NO: 5662 - DNA, 404 bp, Diabrotica virgifera
  Clone ID: LIB150-013-Q1-E1-C7
acagttttgggcacccaacaacttaacatgatcaacttcatccaatacctcgttgaacaacgtaatcaagttgatcaacacatgtacgctgttcaaagaaatgtttaccaacaagtcgaaagacttgttcaacaggtagttcttcaacaatctcaaatcaaacaacatatccaggtacttatccatcaagaacaaacggttccacaagaactagttttattccaacaattggcctaccaacaagttgaacaattcatcgacgtagtgatcaagcaattcatctaccaacatagctatccttacacaattactccaagtttttgttcaacaaggtcctgtagttccccaacaacttgtttccagctaccatcgtgatcgacagacaagtgggccaattggttcag

SEQ ID NO: 5663 - DNA, 67 bp, Diabrotica virgifera; identical to SEQ ID NO: 3929
  Clone ID: LIB150-013-Q1-E1-C8

SEQ ID NO: 5664 - DNA, 461 bp, Diabrotica virgifera
  Clone ID: LIB150-013-Q1-E1-D1
gacggaagactgcaagaggcattttaggctaaaaattcgtgacattttggatagactagtcagaaaatacggttgtgaatctcttactccttttgtaccaaataccgacacagtaatgtacaagaggcttagaaacttacgaaaactaaacgccagaaagaagaggaggaaagacgaagatagagaagatgagagtgatgatgaagaatttactgtaaaggctaaaccaaaaagcgtcgaagaaattttggcagattcagattcagaattcgaagatatggaaacagatgaacccaaagttaaaaataagaagcaagctaaaacatggattgaagaagatcctgacaacattgttgattttattgatccaagcgtcattagtaaaatcactgctaccaaacctggactcgtccaaccaacccttgaaaagaaaaagcccgagaaagaccgaggattcaaaa

SEQ ID NO: 5665 - DNA, 463 bp, Diabrotica virgifera
  Clone ID: LIB150-013-Q1-E1-D2
gcgatgaacatcctggaaagtacactgtaactaaccttggtaaagctgctttcgatattgagttgaagcgtacttcaccagttcaaactctagaactccaccgcaaaaccgttgagcctaatacatctgagtcttttgaactcacagctcaattccaatctaccgttttggaagttatcaacacaagccacactgaagatgcagtttttagagctgaaggaggagatgttattgaagatcttgaggatttagttagaaatattgatgagcaaaaagaaactgttgttactcatattctaacaactttggagagcttccatttagtctcacgttcgtccgtcactgctttgatgtatgatcctaatgatgttaccctttccgaacatcataacttcactgttaccaacaatgggacatctgaaatagaagttgaggttacatacactgacagcgatgaccgttc

SEQ ID NO: 5666 - DNA, 439 bp, Diabrotica virgifera
  Clone ID: LIB150-013-Q1-E1-E1
actaagcttccgatataattttattttttagtataagttttagtaaattttaagtaatgattgatttatagtaatgtgagtagataatgtgagatataaaattatttttattatttattgaaccatgtgttgcaccgagtataacatggattataaattaataataatttcgatattagtttcgcttttaaattagcttttttattgtaatttatatagtttaaaaaattttttagttaagttatgtgaaacgatatgaaatacatctaaatttatatcaaatttattaagtttaattattaacataataattatcattatatatatatatatgaatattaatattaatattaatggataatcttaaggatgagcttatattaaaatttatattataattaaatttttagattaaaattttgcatattttatttcatgt

SEQ ID NO: 5667 - DNA, 452 bp, Diabrotica virgifera
  unsure (1)..(452): unsure at all n locations
  Clone ID: LIB150-013-Q1-E1-E2
cggacgcgtgggccagtactgacttcggcacgatggatattctcctgtcgtatactctccgctgtcggcagggattgtattacgcccatagttgccatattttatataatttatcaaaagaaatacacacaaaaaaaaagttaacaggaattaaaaagttttgaagataaaaaatatgtttctgcatagttagcaaggtagtgccatggctctatggcactacctcacgggccgccactgcagtacctgtaaacaactcatagttttagtactattactactacaaaaggctattttgtcacaaaacgctttgatactagttattaaaactttttttaacgagatttttatccttaaatgtttatgttttataattgctaaatgttctgtcatttggaaccgtctgtggacagtcggangaattttacaatatttgtaaaatatatacattt

SEQ ID NO: 5668 - DNA, 448 bp, Diabrotica virgifera
  unsure (1)..(448): unsure at all n locations
  Clone ID: LIB150-013-Q1-E1-E4
anatgcagatcccttttaatttcccccggtttaattcaattaacaaataaaatccttccaatttggccaaaaaccccccgggacaaataccaaaatggtaataatttaaaaaatcaaggaatgggttcaagttctgaaatataacataactcagtgaaaattgacgttaaaatttagcttaagtaacaatgtttgtactattgtcgttgtgttttctttcaattacgcagaactaaaaaatgctctgaaaaaactgtgttaaaaataacaattttgttaaaaagggtgaaggacagcgatatgattcagatacctctcaaaaagggtttaatactataatatattcgatattaatgacatctagtatcgatttaaaacatctaatactcctgaaatacttgaaacaataaaaaataatccttgtggcatgttttgtcctaacacaatg

SEQ ID NO: 5669 - DNA, 474 bp, Diabrotica virgifera
  Clone ID: LIB150-013-Q1-E1-F1
ggctgacaaaagactatggctgtgttgttttttattattgacaattgcttacgctcaagatgaagatgatgacgattcaggggaaccacagatcgaccagctgtgtgaaaacaggcctgctgatgaatattttaggttaagcactgatggagactgcagagaagttgtaaggtgtgatctcaattcagatcttaagggcggtactcgattggcagcggtaaaatgtccgacaggacttgcttttgatcttttccgacaaacttgcgattggaaagtcaatgtcaaaaattgtgatatcgtagaaaaaccaagaaaagtccttccaattttgaaaaccgacgaaccaagatgtccagaaggaaagctgatgtgtggtaatgaagaatgtatcgacaaagatcttttctgtaatggaaagccagactgtaaagatgaatcagacgagaatgcatgcgatgttgatagtgatcccaa

SEQ ID NO: 5670 - DNA, 458 bp, Diabrotica virgifera
  unsure (1)..(458): unsure at all n locations
  Clone ID: LIB150-013-Q1-E1-F2
agctgtgatagtgaccagtaccaaaactgcattacgatgaagtggatagtgttaaccgttgttgtacttcttggtttagccagtgcagaagaagtttctgaaaagagagcagtcctcagaagaaccaccagacaagccctaggatccatgggaggttcatttttagcacaaactgaaaggaatattataaacaactgtaagaaaaatggactatcagatcaaggcgctgacgatctacaggctacatacgctaaaatgaagtcgtgcatgtccggcacaaaaatttttgaaactcctagaaatgaatttattagcaaaatggaagattgcagtcgtgacgcaattaaagaaactaaatcttgtttggctaacaaccaaaaatatttcccagaattcgtcttggatcntgcaaaatcgatggttaaatatatgtacgatgacaaagatctatttagaga

SEQ ID NO: 5671 - DNA, 416 bp, Diabrotica virgifera
  Clone ID: LIB150-013-Q1-E1-F4
agcagacataagtgagaacgcgacgcttatacataaaatcagcgcggatttgttgtccagcactggtactatgtcgcaatttatcactctgaagaaatctttggtggacgatgatctgaagagtgaaatccacatggatagtgaatcgacttggttggatatgttacaagagtaatgacagtttctgaagcgaggtcttatgacgaaactacaattccacctccaatgaagtgtcttcggacagactacgattcagaaccttcttctcagcatcctaacgatgaggcaaacacaatggccgatagagacttatgggtcacatttaagcttccacacactcatctgtaaaaaccagataggcgaagcgatatttcaggattcgaatcgctttagcataatccacacaacaaattttg

SEQ ID NO: 5672 - DNA, 430 bp, Diabrotica virgifera
  Clone ID: LIB150-013-Q1-E1-F5
ccaaatttgccaaaagaattgaacggttacaacctgtccgactaccccttttacgagagggttccagaaaatattacatttaagtgcgatggactgcacgacggattttatgccagcgtgatacacaaatgtcaggtgtaccaccactgtctgttcggaataagatacgattttctatgtgccaattatacagcgtttgatcaaacattatttaattgtaactttgtttctaatgtcgactgtcaaaattccaaaaagttttggaataggaatgatgaactgtataaaacaaaaagcaccactccaccgccgatcgtgtatagcttctacactcagtctcctcgcgtttatcctcctcctggctcaatacgaagagtaccgcaacgacgagggccagtcattccagacgtagcctctagtccagaagctc

SEQ ID NO: 5673 - DNA, 462 bp, Diabrotica virgifera
  Clone ID: LIB150-013-Q1-E1-F6
acaaaactttatagtaatattgttttcaaaggaataatacgacgacatttcacatctgccacaccatctttcttgtctcttttaactgtgaaagtggtgtactcgttttcattgtcatatttccaattttattctagtttattatgttggtttttcgttcgatacatttaggatgatttatatttatgattgaagtcttcacatagagtttaagtattcacattcatagtgtggtattattaaagactataatctgacaagtcttgttaagttgatttacttctgctctgaaaatggatacgatacatgaaagtacaaatcaatttttctcgaaaatggtgcgccgtaggaacttaaaaaatgtcatgtcaaatggataaaatttttaaagacaataaagttatgaataaaaatgtcaaattacaatcctaaaagaaccgtttaaggcttcaattaaaacat

SEQ ID NO: 5674 - DNA, 301 bp, Diabrotica virgifera
  Clone ID: LIB150-013-Q1-E1-F7
gacatttcataaatgcaatggcacgctcgtcttgtcacgtttagacggggaagtggtgtacgcgatttcactgtcacatttccaagtatattcgactttaataagttggcttttcattcaagagatttaagatgatgtatatttaagattgaagtcttcacatgaagtttaagtagtcagattcatagtgtggtattattaacgactacaatctgacaagtcttgttaagttggtttagttctgcactgaaaatgggtacgaagcatgaaagtacaagtcagtttttcgcgagtatggtgc

SEQ ID NO: 5675 - DNA, 458 bp, Diabrotica virgifera
  Clone ID: LIB150-013-Q1-E1-G1
gtaaatttagtatagttgttctgaacatattataagaaaatcagacattagatgtaaaggcaatatttggtacaaacatttcttattggtattttataatttttttgtctatttcaatggacatttggtctgaaagggtacggatattgaaatactttttatagaaatgtataaaacaattggtttattaagagaaaaatccaaacaaaaactttgtatccttacacgaagttatcaaaaataatatgaattgtttctatatacgtattcgtcatataggtactgaagtctattatacataggtaggtacatttaaaagaaaggtaaaatgattctaaaatcaatagaattacatttaaaaaaaatactgttgggatgatattgtaagaataaaatagagttgtacatgttttttttagtaagtattgtaaaagtcaaaagatgttttgatttcactt

SEQ ID NO: 5676 - DNA, 435 bp, Diabrotica virgifera
  Clone ID: LIB150-013-Q1-E1-G10
ggacgaaggaaaactagaactacaaaaggtgaaagaagaattgcctagtgaggaatatgataaacttacaaattttgaagaagttatgttaactgaggaatgtaatcttccaagtaaatctgaggctgacttagaagaaaaaatctccagtaattatcaccctcgagctgtatcaaatcaaaagcaagagaagtttttttatgcttcaataaaagagtatattaccaaaaccaagaatgatagaaggaagaaacttaaaaatgcaaagtccattatcacatgtccatattgtggcaaatggtattataggaaaaattagttactgaaacactttctaagtgatcgtgtaaagacaagtgtgtttgttaaaagatttatgcacagcaatgacaatattttaaccaaatatgaaagatggagacctccaacaacagg

SEQ ID NO: 5677 - DNA, 427 bp, Diabrotica virgifera
  Clone ID: LIB150-013-Q1-E1-G11
ataatttagtggactgcaaagcttaatataaacccatttcaaacagtccagaaatgcatggcgagatttttaagaaatgggcatatattgtattatttcactctcaggtgatacatttgtcaaaactattgtgatgcctatagccaaataaaccaaggcagtaataagtatgtttttatttttcgataactgcagaagagtaaaacaattatttttatatcagtataggtacatgaaaactgttcttaatatagaacgtttccaaatgcgtttttctaggaacagtttacacgatatgatgaaaatcaataaaatattatctattatgcccttctaggaaaagtttaaataagacgataacttttgataccattttatatcctaccagattaaaacaatggaaaaccttctctggttacaccatccg

SEQ ID NO: 5678 - DNA, 405 bp, Diabrotica virgifera
  unsure (1)..(405): unsure at all n locations
  Clone ID: LIB150-013-Q1-E1-G2
tacattcattctttttgtctcaattaatttaattaaaaaaaattgggcaccctgtaaataattagaatttatattaatgagtggagagttgaataacttttcagatgagctgtcacacgacccatattcttatttanaaaaattatcgattgcgtcattacgcccagatggaagacgtcactagtatgatatatatgcaaaaaaattataatttaaaaacaaaaatcgacctgattcgtaatttatctccagagtcacccgttctcgagaaaacgaatttattcaactcaaacgtcctcactgtacctataacttcagaggcttatattttaaaaccatgattttttggagctatgcgcccattgagtcttttgttctacacatcaaggactaccagaacccaaa

SEQ ID NO: 5679 - DNA, 332 bp, Diabrotica virgifera
  Clone ID: LIB150-013-Q1-E1-G3
cggacgcgtgggtttttttaacaggtaaatttttaattcagcaacgacacgttttaaataaatattatataaatatgtttacaacggacgcaataatatatcaaaatacaatcctaatgaatataaaacatatccagggggtaacttcaagtttcaagtttcacaatattaaagacatactaagttggacctaaacgtaatgagaaactttatttcattgataaatactgatcatgtcacattaaacacaacctcgcacgctaccctactacaacgaaaatgttctgcttattacgtacaaatagtactaaaatcatcacacgaacatctat

SEQ ID NO: 5680 - DNA, 468 bp, Diabrotica virgifera
  Clone ID: LIB150-013-Q1-E1-G6
atgagtttcattcctttaagccttgtagaacttataatttttgaaatagcgaactctcaaaataatcttttattatttgactgcataccgagacgtagtaaaatccctgggatttacccagcctggattaaattttgaaacctattataaagtatagtaatccatattaacagtatgacactacagtcataaattacatctatttgtggcaaataagtctaagttgtgtttattttgtcttatctaaaacagagtgacgatcttgtcatcgattataaatacgtatttacagtaaatatttgattagctaaagtaaatgtattatgttttattgcaatttatttaaataattattttttattcgtgtttaatattatactgaacttgtgtaaaaaaagcattctattggaatcactaaagatttttagtttaattaaataatatgattgataaaattaataaaaattt

SEQ ID NO: 5681 - DNA, 428 bp, Diabrotica virgifera
  Clone ID: LIB150-013-Q1-E1-G8
acaaattaccaacatgaaatacttggttgttcctgcatgtgttgttgttgcggctgtggctagtaacctgcccaacctacccgaaggcgaaagacttaaactagctcaagtccacagagactgccaagccgatccacaaacgcacgtcgacgaagacgaacttaggaaactcacaaactttgttgaagataaacaagttggtgttcatatgcgatgcatggtagtagaagcaagattaacgaagcaaaaccgaaaattggacgttcccagtattagcgaaaaattccgtttggtgactaatgatgcttccaaggttaacgcaatagtctaacagtgtgctgttgattctgaaactcccgagaagacatctattcagttcagcctttgctgtgtccaaaatgacattcagtagtaccacaaattgtgga

SEQ ID NO: 5682 - DNA, 369 bp, Diabrotica virgifera
  Clone ID: LIB150-013-Q1-E1-G9
gcaaaatccccataatttttttgtggggtggccaaatttcactataattttattttaagatgttcctgccgtaagaatgatacatgtctattctgaataaaaaatctctaatagttttcgatgtattgaaagagatcgattttcattttgtaacttcaaagggctgtaactttttttacgagcacatttgtactaaggtagttaggttcaatcgaactattttgaccccagaatgtgtggtgtgatttgtgaccaatcttttcgggacaccctgtattattcgatgtaatttaacagcgtatatttcctgttttgcatttataagacgtattttagtgacccttttcagagtgctattgttataaattt

SEQ ID NO: 5683 - DNA, 345 bp, Diabrotica virgifera
  Clone ID: LIB150-013-Q1-E1-H10
cggacgcgtgggcggacgcgtgggccagcatgagacaagcagtcctggttctagccttaataggcatttcagcatgcgcccgcctcgactacctacctccaggacgcggtaatgcaggtggtggtggaccaggtggttacccaggggccgtagcgcctggaactggcggcggtagaggcggcggttatcaaggtggacccggaggtggatatcaaggtggttccggaggaggataccaaggtggttccggaggtggatatcaaggaggccaaggaggcgcaggcggtggttatcaaggcgggtcaggaggtggaggctatcaaggtggttctggaggtgggtatc

SEQ ID NO: 5684 - DNA, 425 bp, Diabrotica virgifera
  Clone ID: LIB150-013-Q1-E1-H11
taaggttatgagttagctaatcaaactccaactataataaaaatcaaggttataatttttactagaataggaagacaaataaaaataggagtagaaaatactaatcacgaaaataagcttccttttttaataaaaattataacgttgatttttattatagttggagtttgattaggttatgagttagctaaagttaaaattgcgtataatttattaaggttaaataatatttctagagtattatttctcagaataatatgaaatataccttttttatctactttaggaattaattattatccaatttattttggtatattttagaaaaaattttttgatataggatgatttgaatattatggaagttcaggtgtaataaaacaattaaataatagaatatttttacagttattttctcctaatca

SEQ ID NO: 5685 - DNA, 199 bp, Diabrotica virgifera
  Clone ID: LIB150-013-Q1-E1-H12
agaaaattgagtaaaacacttgctgataaggttggaggtgccgatggcaatgatattgttgaagttgaggaagaaacaaatgatttggcattggagccaattctagatgagccattggaaatggaagctgagaatccaattcttgaaattactgaaaatatcaatttctcatttatgaatcttatgcctgcatacaaac

SEQ ID NO: 5686 - DNA, 431 bp, Diabrotica virgifera
  unsure (1)..(431): unsure at all n locations
  Clone ID: LIB150-013-Q1-E1-H4
aggcaacagcgataattactaggaagataaattgagatggtaagaaaaacaaaaacaagattttttcgtaaaatgtgaacgtgttagtcagtcaaaatagcatcanaatgccggtcattgatggttataaagtactttacattttattacacagtttatatacaatttttgaaaatatttggaggactcttttatttatttatcaaaattgtataagggttataaaccctgaatctacattcgatgatgctgaccagttaaagaaaagactgtctagactaacanaaaagcctcaacatttaactatcattattggtgtggaagaatattcattggtagatttggctaacctcgtatattgggtgttaggtcctaatattccgtacgttagtttctatgattataaagggtaattaaaaaagcatgaagag

SEQ ID NO: 5687 - DNA, 329 bp, Diabrotica virgifera
  Clone ID: LIB150-013-Q1-E1-H6
gaaaaatttaggatttagcaggttttgattttgacgggctcaactgataagttctacctctaaatcaaacaccccatttgtaatatttcatcttagcaactgttcactacactggcttgcttgacagccattctttaagtagacagctacttatgggaatgaaaccatttctttgtgacatttctgtttattaatttaatcgttattaaccataattttcattgagaataaacgtatttccaattaaaagcgtggttaattcacattaaatatattaaatcatatcatcacggtgctatagcccttaaagggactcgaccttctcaagc

SEQ ID NO: 5688 - DNA, 310 bp, Diabrotica virgifera
  Clone ID: LIB150-014-Q1-E1-A1
aaaagagctaaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaatttttt

SEQ ID NO: 5689 - DNA, 440 bp, Diabrotica virgifera
  Clone ID: LIB150-014-Q1-E1-A12
cccacgcgtccggcgaaggtaggacgtgttaggtgttagtagctcttaggctaagtataatattagttttttaatttatcggcacacaggcagttctaatggagaacggtgaagatttttcaaaagatgtctcagcagagcatcaaaatggatcaggtgatgctccagccgatagtggaagtgcagaaacgcccggccgtgacgatgataggtaagtgtttttcttttttatattctaaaatatacatgaattttagttatttcgtagctatttgtcgtatattttgttttattaaatttccgatgtattgatatttatatttaataaagtttggcacctcgtttttctcgttattaatctgtaaacatcttactaataacaattactttgtaatattaaatcgttaaatttgtatgtttagatcgtaagaaatttgaat

SEQ ID NO: 5690 - DNA, 432 bp, Diabrotica virgifera
  Clone ID: LIB150-014-Q1-E1-A2
cacacgcgtccgctccgattaaaagacctcgccaaatcgtccacagcaacacgcggtacgctacacaaatctctcgtttttttttattaaccgaaagaaaatcaaccccaaacatgacggataaggtagaacaacccagtgttgaagtcactgaagaagaaccaaaaatcaaggatgacaaagcctccccagtgaaacccgcagaaaaggtagaaaatggggatgccaaagcaaatgaagatgaggagaaagaaaaatcatccgagaatggtgctgaaaaaacagaagaaaatggaagttcagaatctgaagaaaaacctgccgtaaagaggaaatctacaggcggtggagatgcaacagacagtgtggacgttgagagcgccacaccagagaaaaaagccaagctggatgaaaaagaatcagcggaagcga

SEQ ID NO: 5691 - DNA, 384 bp, Diabrotica virgifera
  unsure (1)..(384): unsure at all n locations
  Clone ID: LIB150-014-Q1-E1-A3
catcagctctcgatgatttacgacgcgaattgtgtttgttcttcgatgtgaataaaatattttttcttgaggtggttcttaattatagtgtgtgagattttggaaacacaaccataaaaagataaggagtttcctgttgtcagcggtgattcccaatgtttcgtttaaagcannaaatacattanagtggagatggctcaattaattatcaaaaaatgtataccagtgcgagctataatatggatactgtgcttcacctgcacattattcctttacatgttaagaatanatttgtccattataattctggctatggtacagcccaatgacaaaggcaacactactttttgtacggaatgtanactacttangcaatctacacac

SEQ ID NO: 5692 - DNA, 183 bp, Diabrotica virgifera
  Clone ID: LIB150-014-Q1-E1-A5
gaatctgtcaggtgcgcagtaaatgtgccttcgttatgtataaacgttaggccataacaatcatgtgtacgggtatctcgatacgatgttccaatatcagcatgtctcatagatattgcgaagccagatgacgatcagtgcgtgatagaaaattaccaatcatcatggttggagtcacaaatt

SEQ ID NO: 5693 - DNA, 310 bp, Diabrotica virgifera
  Clone ID: LIB150-014-Q1-E1-A6
catatgcatcatcagttcgtgtgttaacatacatgttcacaatgcagtttctcgttctttgagccttattacattacagctcttcagaagttttacgtaatggtagatgaccacattgtacaggtaaatcatgatgaaatacaactttgcccacatggtatatatacctgacgtatcctgaacctaaaaatactgcgtgctgtcccaattgcgatcttcatataccatgtgaacgtacaaaatgcggtctaatatagtgcccatcagtatcaaattgacgactacggcctggataattgttgtcctacct

SEQ ID NO: 5694 - DNA, 392 bp, Diabrotica virgifera
  unsure (1)..(392): unsure at all n locations
  Clone ID: LIB150-014-Q1-E1-A7
aataatctcagtggaaagagttttcttatgactattatagttcacgttcatacttttctgtgaagagtatactttaataattataacgatcattcacgatcatcgtatagggcttttcattcacagttatttgtttcgagcttctgtcatatgtcgtataatccgtgtatattaatattacacacagattatacaacttatgacagaggctcgaaacaaatgacaatcgatgaaaagccctattggagtgagatagtttgaattaaaatatttttcttctttgtaacgttatcgctacgtttaaaaggatattaaaatatttgtaggcgttttaatcgatatgttaaaatatttatagtaaaaattgagatanatatttaataagtgaaaaa

SEQ ID NO: 5695 - DNA, 415 bp, Diabrotica virgifera
  Clone ID: LIB150-014-Q1-E1-A8
cccacgcgtccgtgtaattctaattcgttcataacgatctacctcctcttttcatttttttttgtgtagttatttaggcatttttaagtctacgactgtcaaaatagtgtcaactgacaagttggaagtgtcatacttaaattatcaccattttatcctgactccctttgtcttcaattttgatttcataataatttttatttcagtgcccacttgaacctttttttataatttacatatctcatagtcatttttaggcgtttaacttacaacattgtttccacacacattttccagcttcgatatcagttattgatttacaataatttaaatttgctcctttatacaaatgtaacaacccaattccaacccttttattaattttctttttgttttgataagatttatttgcaac

SEQ ID NO: 5696 - DNA, 372 bp, Diabrotica virgifera
  Clone ID: LIB150-014-Q1-E1-A9
ccttttaggtactagacagaaaccatgagcagatgaagaaaaactacaatatggaactgacttggaagacttgaatatctatttagtttcagacgataattggcagatattctttgatcggtcgttcgatgtagagcagctaaaaacccacttcagcactttacaagagaacgatagaatagactgtctcaaattcggaatatcttgtatccttaattttgttcagtgtaacttcactggtcctgacttatccaaagaaataaaggattatttaagtaaagatacctacgatacacttaactttgcgaaactgttgtcggttaataatgaagatattaatatcaatatcagatacccggcattgctagtgac

SEQ ID NO: 5697 - DNA, 267 bp, Diabrotica virgifera
  Clone ID: LIB150-014-Q1-E1-B12
caaatgcgtacgtgtgaagttagttagtttatcgtgtcaaggatcttattgagacatattcaagcattttgcatccaggtcctcccagcatcatattgcggtccatacgccgggtttcgaagattctaatcttgagtctacatgctgctaactggtgtacctctcgatcagcatgagttctccgtgcatgtcactcacaatgtatgtcagattctagttggcactactcctaaatgttcaacatgtctagcatgtctcgcgtcaaag

SEQ ID NO: 5698 - DNA, 410 bp, Diabrotica virgifera
  Clone ID: LIB150-014-Q1-E1-B4
attatacggtttaacagtgttaaagtgaaatttgttaattcgcttttaaagttttcaaaaaaaaccttttgctttaagttataagacattttttttgttaacaatgagacagtgtaagtgaacttttagttgattgcagtttactaagctttttctgtagaaagtcaaatggaaaaacctactaacattgtgatattttttctcttatagtaattgtccaactatggtgtttttactacaaaaattaacttacatcattcaagttttctgacgtcagaaccacaaaattttgtatttccccacattcacagagagcgtcgttatctgtcttgatgccacatttaatgaggttctgttttagagggacaaaaccggtgcgtatgcggttaagtgtccgccagtttctccag

SEQ ID NO: 5699 - DNA, 406 bp, Diabrotica virgifera
  Clone ID: LIB150-014-Q1-E1-B7
cccacgcgtccgggggctgtatacgctgaaccatctatcgtttaacgatttggaaccatggaatgagaggtataaatttggtagcagcattaccactattatgagattgaagtgtttgcgatttgcgttgatcaatttgctaaacatagtgcagcattacatattttcatttatttttaccacatgtttgcacaaattcgaacttgaatttgaatctgcgaatgatttgtcatccagtatatcgtcccatgctgagtttaataataacgcacaaattttgattggccaacttagagaacatgtgagcacaggatacgtcatttgataacgttgcgaagtgtataacagtattgatatacatgtgggagcacgtgtcctatgctacacctgaaagattacttgacat

SEQ ID NO: 5700 - DNA, 423 bp, Diabrotica virgifera
  Clone ID: LIB150-014-Q1-E1-B8
aacatcaataatagcgattgacagttggtctcatttctctttgtgcgtagtgagtaaccgttgttaaaagcaaaaatgaggaagttcatcgtacagtgtttgctggtggcactagtcgcggtgggagttgctgatacttggactacgatagataagagagattgcgaatcgaattgcatgagaaactgtaataaagccaattatcaaagctcagaatgcattagccatggaggacacttccccagatttgctgattgccactgctggcacaaaacctacgactacgataaatatgacaagatgagcaagtataataatctactaggttactatgagtaaagttttttgtgtgtagacaatgaactgtgcataatttcattaactgtgtgtaaacaagctgatctattataagttgtgtgatta

SEQ ID NO: 5701 - DNA, 357 bp, Diabrotica virgifera
  Clone ID: LIB150-014-Q1-E1-C1
gcagtggttgccttccagtaactgctgcactacagtttgctgcaaacgacttcatccgctatttgtattttacccaacatagtattgtagattttaggacctaaactgagatgcgttcattggaatgatccgaggtaatcgttgtcgaaagctgaccatccaccccccaaaaaatatggcaattggttacgaggtgacacctaaaggcgcgcaaagtttggaaaaaagacgaaatacagtccagtggataatttgtattgtagcaatctgtaactatttactccaaaaagtaaatggtgatgctgggatgtccgctgtttgatacaaaaacaaaactcgtatgacaagttgcctttt

SEQ ID NO: 5702 - DNA, 443 bp, Diabrotica virgifera
  Clone ID: LIB150-014-Q1-E1-C10
gtctagttcttctttccctagtaacccttagtgtagctgcctactacccaagtactggtaggcaggtgacagtaggagtagctggaaatgtgaaactagtcggctctcaaggttcccagattgacattcgtagaagtccttacaacccaagaactgtcgacgtcaccctcagaagtccaaatgctccaaccagaactctgcaaattgatgaagccaggaacggccaacaacttggttattccaacctccaaggtgtcaacaaccaaggtgtcaaccaggctgatgttcttgctgatcttttcagtcaatatgagggtattgtagatgaccagaccttctacagtttgttgaacaaacttcaacatttggtacaagctggagtcatcaacagagtagtcttggatgttgtaagaaactgggatcagcaaggtgtacaaggtgtt

SEQ ID NO: 5703 - DNA, 428 bp, Diabrotica virgifera
  Clone ID: LIB150-014-Q1-E1-C2
ggtatgcctctatgctagtatagccaccgcagttttagttgcagccctctgttgtctagcgcgaagaatatctccttgtttttaaagaaaaatgtcgaagccaaagggatctgtatcttcagtaagtaaagcaggccagttgtctgttagtggaatcagtcgaaccagtagaataggtgctagagctccagcgccaccacccaaagtaggattggagaaaccaccaaaaggcttagaatggacattgcccccttttagcgtttgtccaagaccgaaaacaggaatcgattgggatgaactaaagaaacgaatgattagacgtcaagctccagaaggagaggatatcaagggaatacgattgattttgaaggagctccaaggcaagaatattccagtgcaagattttgtgaacttaatatctgcttata

SEQ ID NO: 5704 - DNA, 181 bp, Diabrotica virgifera
  Clone ID: LIB150-014-Q1-E1-C7
tcccggggtcatacacgcctctaaaatgacgtcgtattattcaatagttctctgcacaattgcctccaccagttcatcaaaatcatgtcttggttcattaattcgactatctctacggccttctgatactataggccgatctctatctattgattactgcccagttgcagaatcagcattt

SEQ ID NO: 5705 - DNA, 428 bp, Diabrotica virgifera
  Clone ID: LIB150-014-Q1-E1-D1
gaaaaacacctgaggaatacttaaccgctttgcgcaacttttacttacctcttttaagtagtataccgagtgatttcgaaaagttcttgcgtcatggagaaggaaccgcaaccagaatccatggcgacggttaccatcaagccggagtacaccccttcggagtattcggcctccgaaccaccaccggcatacatgaaaatgcgtagtacttcagtccaaatagccaagattatagcaataaccgtcgtagcttgttctgtaattttgggaggattcttgctagcttctgcctacgtctcagctaatgcttcatgcaggcagttggagcatgaacttgagctcctcagcgaagctgcagacaggtttcagtccccattgcaacccgaagcgcttatccaagacccaccatcatccgtcaacgccaaacg

SEQ ID NO: 5706 - DNA, 352 bp, Diabrotica virgifera
  Clone ID: LIB150-014-Q1-E1-D10
atagtgagtcgtattatcagcatcgccatcacgtacggtgattctagacagcgatatcgatacttcctggatgtttcagatttattggagggacaccagcgatattttttcatccgcatactcagggatagacgtcgcattctttggttctaatatagatcagtagaacatcctagaatcttgtaagatgatactcttgccgacaatgtcatccttctgggtgttactacgatctacttttcagtactattaaatggtctctgtatcgactgtcatttcattttccacgggaacgtttgtcaaactgcagcctctgagcacttcataagtcagcagctccacatctcttgtg

SEQ ID NO: 5707 - DNA, 438 bp, Diabrotica virgifera
  Clone ID: LIB150-014-Q1-E1-D11
cacacgcgtccgcccacgcgtccgcccacgcgtcagaaccttgtaaaaacattttcacattaagacattttaaattacactcagtaattttaaattttagacgtaaccaactaacatcagcttagtctacagtggctttagcattaattttgagaaattcgacaagaattcatgcatccccaaatattttcaagactgccatcgctataatgtcaaggaagtcattcacacaacttactagtggtgccatgataaacttgaatattttaccacgaattaatttggctagctatgtgattaggaatatgtctgctgatcacagcatgctaaggtcaatagaaagggctgtatcaattgcccttgtgggaatcaccccactagtttttatatcacctaatactgctctgaatgacatgtttgctatcgccactgtagctc

SEQ ID NO: 5708 - DNA, 419 bp, Diabrotica virgifera
  Clone ID: LIB150-014-Q1-E1-D6
caactgactatagaatttttgcgatataaagtatgaaaatattatattggtgaaactttttgtgaaattaaaggaaaaatggatatagaagaagttcagtcagttagtgtcaggaaacttatttcagcctttgaaaaccaaactaattctcctgaagccacatactttagaccaaggactagatcattgggcaacatactagcaaaaaatgttactgttagagaaaaccaatttgcaacattggatgaaataagtgacgcattggaagtaatacaacaacaactgcaggtttacgacatatacaataaagaaagacatgttgcattccaagaagaactattcaacattctgaccagcattattaatatcgataatgatgatccaatcagagcccgtaatcttatctccactactaaaca

SEQ ID NO: 5709 - DNA, 195 bp, Diabrotica virgifera
  Clone ID: LIB150-014-Q1-E1-E11
cccacgcgtccgggaaaagattcccgaatgtgatcaagctatcttaactcccagtttctgcatagctggtccgttcatcatgttcagaacttttcttatgccggccattagagtgctcacgtcatactcatcttctgcagaccttactatggcttcaatgttgaaatagtcgtccgacatccaagatcggaaggt

SEQ ID NO: 5710 - DNA, 440 bp, Diabrotica virgifera
  Clone ID: LIB150-014-Q1-E1-E12
cccacgcgtccgaaaagattcgattagattcaattacattgaatattaatttgttttgttgtaaatccacttaataattatgtgatatgtttgatttaacatgaattctataatttttttgtaatttggcaccaatgtcaacttagatctctgacgtagataatgacatgcaacggtatttataatctaccgactgtagatctattgagaaattcacaccgagaatgcagtacggctaagatagggcaatacatttctaatggggaataaacgcacagggttgtcagtcttcaccagttgttgattgctctctcaagagcgtcgcacaggaactgtggcaacactgaatgcacattgctatcttaaccatactgaatttcacgttagtctagctttaatgtcactgttaataaaaactggtttctatatttgtgtacaga

SEQ ID NO: 5711 - DNA, 391 bp, Diabrotica virgifera
  Clone ID: LIB150-014-Q1-E1-E3
aacccagcaaacaccgccttcaacatgaaacgatcccagcaagttacggtcactgaaaccaccccaggatattcagtggaaaagatgtattataaagaatacaaatatgaaaccgctttctccatttcgcagttatcgaaactggagaatttcgttttacctcctagaactactatcttagcattatctcagaacggaggagacaaggaagaagacaaaaagtatgtcgtcaagaatcacggaaaagctgatctttttgttgaggtaatacatctcaataaccaagatgatgctccacaatggtttgtagtccagccagaccaaaccactgagatagatattgaggacaatcttgaacaaagcgtgttgaaagtaagcaacaacagttacg

SEQ ID NO: 5712 - DNA, 196 bp, Diabrotica virgifera
  Clone ID: LIB150-014-Q1-E1-E6
cagacgcgtctgtgaggatgacaggacatgcgattacactgtggagacgatgacttagtgcgaaacagacggatgtgatacgacgtttctctgggacgtgagacatcgatctaagattatttcgttgtacggcacaaatgtctgatctgatcactgtcggagagcggaagatacaaggatgattacaatctgtagg

SEQ ID NO: 5713 - DNA, 344 bp, Diabrotica virgifera
  Clone ID: LIB150-014-Q1-E1-E8
caagactctaaagtgagtcgtattatggacacatgctctgatatcaggtcttccagcatgtatataacgataagaacggaggaattactgacgatcattgagcggagtcctgctctgacttcgtttagatcagtatacacgtcatctagcatagatcgaaatgaactgtcatataaatatgattgtaaaatttccgaatattgtgaacgcatagtaattttgagtttgtgtactagaccttcatgctaaactttgtcgatggccttagcgacgtggaaggagattgttcaacagactttcttgtcatctattgatttagcagttacggtcatcattctgggtac

SEQ ID NO: 5714 - DNA, 424 bp, Diabrotica virgifera
  Clone ID: LIB150-014-Q1-E1-F12
acaaattaacaaaatgaaatacttggttgttcttgcttgtgttgttgttgcggctgtggctagtaacctgcccaacctacccgaaggcgaaagacttaaactagctcaagtccacagagactgccaagccgacccaaaaacgcacgtcgacgaagacagacttaggaaactcccaaactttgttgaagataaacaagttggtgttcatatgcgatgcatggtagtaaaagcaggattaatgaagcaaaacggaaaattggacgttcccagtattaccgaaaaattccgtttggtgatcaaggatgcttccaaggttaacgcattagtccaacagtgtgctgttgattctgaaactcccgaaaagacatctattctgttcaccctttgctgtgtcaaaaatgacattcagtattaccacatattg

SEQ ID NO: 5715 - DNA, 421 bp, Diabrotica virgifera
  Clone ID: LIB150-014-Q1-E1-F5
gcggggcgacacacgcgtccgaaatgagtccatggaagaaatacgtggttgttcttgcttgtgttgttgttgcggctgtggctagtaacctgcccaacctacccgaaggcgaaagacttaaactaactcaagtccacagagactgccaagccgacccaaaaacgcacgtcgacgaagacaaacttaggaaactcccaaactttgttgaagatagacaagttggtgttcatatgcaatgcatggtagtaaaagcaggattaatgaagcaaaacggaaaattggacgttcccagtattaccgaaaaattccgtttggtgatcaaggatgcttccaaggttaacgcattagtccaacagtgtgctgttgattctgagactcccgaaaagacatctattctgtgcagcctttgctgtgtcaaaaa

SEQ ID NO: 5716 - DNA, 284 bp, Diabrotica virgifera
  Clone ID: LIB150-014-Q1-E1-F7
acgactccaaagtgagtcgtaatatattttagcataacaccatactttttagtaaaagtaaccagacgttttatttaaggatagctacttcgtattgtgagagaatattttatctttataacagacgaaatttattttttgtaccttgtgtggcacggattattacttaataattacatatttattattttcgaatttaaaagagctaacggccttcaaatttttactgtgaaatacatattttaaataatttttttgtaatgaaatgttactcgtttttacat

SEQ ID NO: 5717 - DNA, 428 bp, Diabrotica virgifera
  Clone ID: LIB150-014-Q1-E1-G4
ccacaatgcatctctgctaacagaatcgtaatcttgtttaaattccacgaagatttggtgtacatcgcggttgaattggttgatgtactcaaagtgaaatacttttcatcatctaaaataatcatttttttattggcaaagtttactcgcctcagttgacgatactatcttggtatacgaatggtatacgaatgacaatactacttggtatttggggcagttacgtctctttcgatattttaagaccattcctccccaaatccaaccatatcgtactcttagaagatctgcattgacgagggaatctcctagatgacattccaacctggtttcttgctcttctcaacaatctctatgacttctgtgcagtaaatgcacatggtcttcctctttttggttgatttagacacggtattcccagatcgcac

SEQ ID NO: 5718 - DNA, 201 bp, Diabrotica virgifera
  Clone ID: LIB150-014-Q1-E1-G5
cagacgcgtcagcggacgcgtcgcggagagactaacatcggtgtcaaccagtggcggttattgattacaaggtcaataagatgaatattgaggagggctaagcatcatctgctgatcgtgcccccgccgagaccatgtcttcgtcaatgatttcatcaaagaaggctatgcaggtctggttccaatgtcttcgccatgttt

SEQ ID NO: 5719 - DNA, 443 bp, Diabrotica virgifera
  Clone ID: LIB150-014-Q1-E1-H11
gaatttagttagaaatattgatgaaaaacaagaaactgctcttcctcttattccaacaaatttggagagcttcaatttagcctcacgttcatccgtcactgctttgatgtatgatcctaatgatgttaccctttccaaatctcttaaattcactgttaccaacaacggaaaatctgacatagaagttgaggtgatatacactgacagcgatgaccgtgccaatgatcaatacaaggtagttaaaccaaatgaaactgtagaaattgagcataagaaagacgctggggtaactctgttaaatgtattgaacagagattacacagaagtcgctattatcaccgccaagggtggaagagtagttagagacattgaaagaaaaatcaaacaacttatatctgatgaaaaatcaataatgttggtaaacaatttacatctagcacctg

SEQ ID NO: 5720 - DNA, 366 bp, Diabrotica virgifera
  Clone ID: LIB150-014-Q1-E1-H4
cctttggtaccggcaagcaagtcaccatcaacgacgatggcactctcaccatcttgggagaaaatggtaagaaaatcgtcatctcaaacgccattggaggcactggaccaaaagacattgaaatctcaatcaatggaccatacggagcagtcaagaagatctcagtaaatggcgaaaccaacgaaagaaccatcagcctagtcgaaccaagcttgtctgagcaatacaacactgacgaagaagacagagccaagagaagcagctccaccaaagacaatagagacagcaaaaactccaaagacaccatagagtacaaaggaaacgaaggaaaatcgaaaactcaagctcaattacttcaagaaatct

SEQ ID NO: 5721 - DNA, 81 bp, Diabrotica virgifera
  Clone ID: LIB150-014-Q1-E1-H5
acacgcgtccgaaaaaaaataataaaaatatgttttagtaccaagtagataaaaactttagttaaagaatattaagggagg

SEQ ID NO: 5722 - DNA, 212 bp, Diabrotica virgifera
  Clone ID: LIB150-014-Q1-E1-H6
gaagaagaaggaactaaacaatggcggacgcagctccagccggtggacgtggtggattccgaggaggttttggaggtggtggccgtggaggcggtagaagtggtcccagaggccgaagtaaaagtcctggcaaaagacctggtcctggaaaggaagatcaaaaagaatgggtatcaattacccaacctaggactttaatccaaggatggaaa

SEQ ID NO: 5723 - DNA, 432 bp, Diabrotica virgifera
  Clone ID: LIB150-014-Q1-E1-H9
gttataataaaaacgtaagtcttctttggccacgggaatggaacaggttagtctgtaacaacagagaaaaagtttcgttaaatatttgtataattttcggcatatctcatttcttctgatcattgcttataatttaatctcgagtatttaaattcaaatgtattgtcagatacatatttaatgacgagacttacattattcaaaaccatgtatagaaataataccataaaaccccatgactataaccatgtcaccatccccacatatgactgacatgattttgaggaatgtaagccttcacggctggtgttctgtaatggtaaattctttttgggctttataattggtcgtgatgtggatctatttctttcttgtgcctttcaactgtgacagacatcgaagactatgcaacataggtcataactgtcgggt

SEQ ID NO: 5724 - DNA, 441 bp, Diabrotica virgifera
  unsure (1)..(441): unsure at all n locations
  Clone ID: LIB150-015-Q1-E1-A10
cacgcgtccggaactcgaaatgcaatgttctatttactaacanagaaaaaagcaattatccgtataaatatgcaatctattcgataatttcacgaaaagcaggttgcaaataatttattttatattgatctttttgtatgtcattgataaagctcgaccgtcattttacatgacaatggctgcagatacgtgagcattcataaccttcttaatagaaggaagggattttttacactgtaaaacagtgccttctttattctgcttggccgagctcctggccacgctgctatagcagcctactgttataaatatatnaaaaaaaagtatcggatgtaaaattttattaataaaaaatgtggaaatttaaaagcacgattttttttaaaaatggttcccttcaaaatgcactcccccaatggtacaatttttaataagcaaaat

SEQ ID NO: 5725 - DNA, 358 bp, Diabrotica virgifera
  Clone ID: LIB150-015-Q1-E1-A11
aggaaaaaccgcaggcaaccgtaaaaaatttggacaatggctcaacttaacgggggttaatgaaaataaaatggaaatcaaacccggtttgaaaacccaaggggcggctcccaatttaaaccaaccccccccttttggaaacaaatttaaaatttcgtattaaaaaggcaactttgggaataacacaattcaaagtgcacaagggatcaccatggtcggataaacgttttgtgtatactttgttcgataaatggacaaagtgaagatctagactctctaagtaactccgtgttctccagaccatcacaggattaaccgacaactgaaacgacaaagccagtaacttcatcaccaggaa

SEQ ID NO: 5726 - DNA, 422 bp, Diabrotica virgifera
  unsure (1)..(422): unsure at all n locations
  Clone ID: LIB150-015-Q1-E1-A3
caaacatcaatagctatgaaatatccaaaataagtataattcctttgcacaatttcctgttatgtatcaacagaagacgtcctactagggactgatctttgtgaatggtatgaatgcctgaaaacaatccttgaccaacttgggggcagcaacgttacaatccagaagatcgaagctctcatacaaagattaagaaaagatgtcgtaactattacagtaatactcaacggaacctgtgaaaaaatcgaaggtattcaagaagacatcaagaatttagacgctgtcctcgacgttaacgttgaactggtcaaccaagagaatctaatcatccacgatatcgatgtcagagttanggagctcggtcttgaaggacaagaactggacgatatgatcgactctaacaacngcactattaacgatat

SEQ ID NO: 5727 - DNA, 411 bp, Diabrotica virgifera
  Clone ID: LIB150-015-Q1-E1-A4
cagacgcatgggctctcacgtcgttctctagccgcgcacagtgccaaactcatcctcatctcgcagcagcatgttcggaggtcttgaccccactgggctatattgagagattttgtgccatttttaacaagttctttctgatttttcgtaaatttaaacacgacattttcgcaatcatggacggagacaagttagatcctaccggacagtactagtgtgtgacagttaacgaaaaaaagacttttaacgatgcagaaaacgggaggcaagggcctagaccccacaggactatactaaaattaaggatgtggccccaccgaggcaacggtggacgacaaacttccagttgccgccgttaaagactatgatcctgtttcgacaaatacacagattaacatctcactggcacac

SEQ ID NO: 5728 - DNA, 454 bp, Diabrotica virgifera
  Clone ID: LIB150-015-Q1-E1-A7
gatcaaatgaacactaaccaaatcttgaaccaaatttatagacaacaacttggacaatctccattgaaccgttatttggttaacatgagacttgtaaacggagagcaagtatacgaagttcctgaagaattcgttaacgttcaacttctcgaacaactcttcgccaagcaagaattgatcaaccaagaattgactgaaatcaccgaaagaagacaaccaatcactgaagacgttcactaccagcaacaactgattaaccaacagatccaaaaacttattgaacaattagcttaccatcaaaacctcattacacgtgaagttgaacaatacattgttaaaggacaagtagttcctcaggagcttgtctctcaacagagattggtttaccaacaagttcatgaagtaattgaacgtttgacctcccaacaaatattcttgaatcatctagccgaaa

SEQ ID NO: 5729 - DNA, 461 bp, Diabrotica virgifera
  Clone ID: LIB150-015-Q1-E1-A8
ttccggggccacccacgcgtccgcatttttttgcgaataggcttgaagtgcaaagttaaatgagtctttgaaacgtcctgctgtaaaggtctttatatgagtaccgttttacctgtatgttcagtaagtattaaattttttaaccacaattttgaggagcaagtccaattttgagtcaagaccataaccaactaatttttacgctattgcttatgatctgtcggtaaaaatgttcacttaccccgtcgtacctacaaattttattttatttttttgaatatgtttaacttttaaagtttttgacaatttagttatgtatctatcgttaatttcttatttagtttattgtcagaggtctattaatttagaatgcttatttatttgtatttttttacatttcaagactactactactaatttttaaatcgcttctagcttttgaattttcgatgtatcacata

SEQ ID NO: 5730 - DNA, 169 bp, Diabrotica virgifera
  Clone ID: LIB150-015-Q1-E1-B10
cccaggtcgacgtacgcgatccgcaaacgcgtccgcggacgcttgggcggacgcattggcacagttttagtcacaggtttcaaatccctgagaggcaatttctgcgattacgacaaagtatcgtcactatccggagacaatgatggtgacattaggcctcatgcttgta

SEQ ID NO: 5731 - DNA, 443 bp, Diabrotica virgifera
  Clone ID: LIB150-015-Q1-E1-B12
gatatctcgtgtttttggtgtgactttttttatcacgggttattttttcgtgtgttgcgctcatcgacaaaccacaagaatgaaacttatcgtaggattattattaatagccacagctctggcatacccagtagcggaaaatgaagaaaaactagcccaaccagtaattgcacaagacgcgaagccagcagagcaagaactaccactaccagaccaacttcttcccacatcagaaaaacttcttccccaaaaacaagaaccattacctgccagcagcgattcctcatcagaatcttcctctgagagcagcgatgagtctggagaaaagaaatcatcctccgagtcctcctcgagcgagaaagaatccagcgaagtaaaaatccaagaaaagaaacttgccgaacctctcccagctatcaaagagccaattaaggaagaagtga

SEQ ID NO: 5732 - DNA, 444 bp, Diabrotica virgifera
  unsure (1)..(444): unsure at all n locations
  Clone ID: LIB150-015-Q1-E1-B4
ccgtccggcaaagcatccgccgaaacgttagtccgaaagttaaccctcaaagaagtcctttcaaaccaaaaacgaatcctccaaaccaaggaagaagttccccggagcaataagggaactccaataaacaacaacaaaagaatcaatttcgtttcgaaaccagagaagtaggtttgcttaaccctcaaagaagtccttttatacgagaaaggagtcctctaaacagtgaaagaaattctctagagcaatatggaagcaattctggtaacaatattgagatactagattttaaaccaccacaagataattctggtaacggtattgcaccttcaaagggtaacaatttcggaccaattccgangggttgcgttcgagtaaaaatgtggattggtaagggaatatccttctcagattcaacgcgtattgtgaggcanctgtcacagc

SEQ ID NO: 5733 - DNA, 435 bp, Diabrotica virgifera
  Clone ID: LIB150-015-Q1-E1-B5
cggggccacccacgcatccgaattgactatgtgattccaaattaacctatgtattgtttgttttgaaaatctgccttatggaataataatcctcaacaaacgacattgataatgtttcactatatgaaaagggaacgggaactttggtgtcctgcgaagatgtagatacaaaagaaacaaatgatacacaagtgaaaatgtccatcaatgggaaagaaaaacccggatctaagcaacctctattgggtaacgataaacaaacgtcttttaaattaagaccaagaataaataccacaagcttgccatacatacgaacagttgcaaaagatggagactgcaatatttatccttcaaatgtacaaaaaaggcgatttttgagggacatttttacaacacttatagacatgaaatggagatataccttcacagtatttt

SEQ ID NO: 5734 - DNA, 70 bp, Diabrotica virgifera
  Clone ID: LIB150-015-Q1-E1-B6
acgcaaccgcagtgactacgtgtctccaatcttacctatgtatcgtttggtctggtaatctggcttatgc

SEQ ID NO: 5735 - DNA, 443 bp, Diabrotica virgifera
  unsure (1)..(443): unsure at all n locations
  Clone ID: LIB150-015-Q1-E1-C1
gtccggaaanngaatgttgggacaacaaatgatgaatcaaaaaatgatgggccctaacatgagggatgggaagagaaatgatgtccgaacacgaagttccacaaatgaggaccacaaattgatggaacctgatatgatgatgaatgggaaaatggtgggaactgaaatgatgaatcaacaaatgatgggcccaaacatgacgatgagaagacaaatgatgaccgaacaaggagttccacaaacaatgaacgaaaaaatggtgggcctcaaaatgatgattaataataacataatgaaagaaaaaatgatgaaacgtgaaatgatgaacaagaaaatgttggaagaccaaatgataaaccaacaattaatgatgacaagaaaaatgatggctcaaaaacaagtacccctaatgatgaaagaaattgaccagcaaatgatgaatg

SEQ ID NO: 5736 - DNA, 398 bp, Diabrotica virgifera
  Clone ID: LIB150-015-Q1-E1-C2
aaaaacccggtaaaccaatgggaaaacgccctcggaagtggtgaaaaacaactaatagtgccaaagaatattttttttgtatacctcgaaggctcaaaacgtaatcaaaacctttgtataaaaaagttataagcataaatacttcttctttacaagtatttaagaatattgtctttttttaaaattgtttacaatttagaaaatttcaaaaaattgtcacgtggtctatcaaaaaagtcataatttaaatgtcaatgtcaaaaaataacaaataacctttcaaaaaaaactttagtgtttgatgcagtttgatgatgttatttttggggttattaaaaggattttataaattgatctattaataaaccatgagtactcaaaaaggaaataatggccgt

SEQ ID NO: 5737 - DNA, 449 bp, Diabrotica virgifera
  Clone ID: LIB150-015-Q1-E1-C4
cacgggtcccaccaacccttcggcatcccaaaacttgggtaataccaagattaaccaggattccaaaataacttggaattttggctttggtgcaacgggcaataattgaggaaaacaacacattaccaaaatccaattccccaagataaaagtaatgatatagataatggtgccgataaaggtggtccagatacaaagggttccgataatggtaaagatggtcccgataatgatagcaaaaagggtggtccagataatggtaccgataaaggtggaccagacagcaagggaaacggcggcaaagatagtggagaaaaaggaaatggcggcaacggtagtggagaaaaaggaaacggcggcaaaggtagtggtgaaaaaggaaatggcggaaaaggtaatggcaactcaagtgaaggtaatggcaatggagatgataatgattgtgacga

SEQ ID NO: 5738 - DNA, 297 bp, Diabrotica virgifera
  Clone ID: LIB150-015-Q1-E1-C6
gaaaactagcaacatcgcggcttaaacttggagtcagttcagacttaaggtctgtatattcacctagtccaatggcgaaatgtcggaagactccaaccccatcgccaagaagagcatctactccattggttaacataaaaaataaaaaggctgcagaagtttctaccgacgatttgttgaaaattgaagttcccaagaggattcttaaaaggaaaacggcagcagactttttttgaagatataaatgagttttatttatttattgtacagataagataataaagtattttttaattt

SEQ ID NO: 5739 - DNA, 268 bp, Diabrotica virgifera
  Clone ID: LIB150-015-Q1-E1-C7
acgcgtccgaaaaactagcaacatcgcggcttaaacttggagtcagttcagacttaaggtctgtatattcacctagtccaatggcgaaatggtcggagattcaaaccccatcgccaaaaaaggaacttaacccatgggttgacagagagatttcaaaggggtcagaattttctaccgacgaattgttgagaattgaagttccccaaagggttcttaaagggaaaacggcagaagactttttttgaaaatataaatgagtttaattaat

SEQ ID NO: 5740 - DNA, 458 bp, Diabrotica virgifera
  unsure (1)..(458): unsure at all n locations
  Clone ID: LIB150-015-Q1-E1-C8
aaaacctccgccttctacacatacgtcatccagaactgtaagtgtccgtacccgctatcaacacatcttggagaatatgcccgattccaatacatgtggtgtaatttgaatccactgtgttttgtattttcactaaagttttctatccatttattgcattgcacactataatctatctccgtattatttcggtttagatttgttcgtccgcacacgttaagatcagcattatcagaacatgattcaatctctaatacatattcatcgtgcagttttaaatattttcttaaatataattcagatattctttctacgtatttagatgaaacgatgaccaacaacanactgacgaccacactcaagattactgcnatatagtttgttaaaaggttcaaatgacaacatctgttctggaatcgagtatattttgtaggatgtgttgatggcggatacgtata

SEQ ID NO: 5741 - DNA, 333 bp, Diabrotica virgifera
  Clone ID: LIB150-015-Q1-E1-C9
caatagcccagcaacgatgccaacattaggggagtcaagcttcagtaacggcaaggataacttttgtggagttcaaaatgccgctccgaaagcaacaacacagccacccaagatatgtcttcagagaaattggatagcacagggaatctaatagaataataccagagactgatacccacacatatttagttagaacagatactcaaaatgcatctggtgataattccaaatacgcgaagtatcctgtagaggatgatactctcaaaaaccatactcttctccaagaagaaatgaatcatggcagcgacaacgacggaaatggaagacaagata

SEQ ID NO: 5742 - DNA, 121 bp, Diabrotica virgifera
  Clone ID: LIB150-015-Q1-E1-D11
gagtaacaaaacaacatccaaacccggttccgtttgggagaaaaacttttccgggttaaggcaacaacaaaaccccggtaaggagaatttaattaaaggtactcacaatttcaagtttttc

SEQ ID NO: 5743 - DNA, 446 bp, Diabrotica virgifera
  Clone ID: LIB150-015-Q1-E1-D2
ggcaaacgaatccgcaaaggggaaaggcgcaaaatgtcgcctgtcaaaactttcaattaagtctagaagtacatacagaaggtaaaaaattacaaataagcatgtatccaagtactcaaaaactgaaaatgtgtggagctgtagcagttagccaaaaggttactggtctctcagagaaatatagacctgaacctttaagatcacataagaaaattgataacaaccaccttccagtatataaagatacccatctggtacaaagggcatcgatagctgaaagtcctagtaaagaagtggctccacctctacaaccaagacaaatgagggttaaccaatcgatgagagcacgaatttcgagtgatcataaatctggttcaaccaaagttcgagaagcgagatcgtcgtcaataagccagtcgaaggcatcttatttaactaaccgccac

SEQ ID NO: 5744 - DNA, 460 bp, Diabrotica virgifera
  Clone ID: LIB150-015-Q1-E1-D6
aattagtttgtatggaatcaacaggcaaatttagcacatcacaatgagtcttaaaaacaacaaagaaaatggactaaaaataaataaaaacaacacaagacgaaagccaaattgaagaacagatgcaaccagcttgcttaggcatttgtgactgtaatttaagatgttgcgaatgttacaacactggacttgcaatgatagaatttgagaggaaggataaaaggagaaaaggtatgaaaaaagcagatgaagttgataattttaagatccaactagacaaaagtccttatgttgtatcacgagactactatataaaaacctgtgaagttccctcatataaagacgccaaaaggactcttggtaatctagctacctttgtgtacaattattgtgaaccgggactgaaaccttacattccttctgaaccgcaaatgccttacggagacctgtggatatctcc

SEQ ID NO: 5745 - DNA, 472 bp, Diabrotica virgifera
  Clone ID: LIB150-015-Q1-E1-D7
ttccggggccacccacgcgtccgaacaggttggcctgtaccccctggagcaccatggcccattccaccagctttattttcaggaggtgctttggcggctatagatgaagcagctgttatgtcaaaaattgatccggaaatcatagctaaagcttctgagtggacagaacacaagggtccagatggaagattttattactacaacgccaaaaaaggagaatctgtttgggaaaaaccccaaccacttaaagatttagaaactgcaaagcttgctgctgcccagggaatttctacaaagccagctggagagactgcaggagaaacaggtaagacactaagtacaccaaatggtgcgttgactaaagaagaacaggataaagggaacgaggagaagatcaagaaactacaggaggagatcaaaaggaagaaagaggaggatgagaaagccaaagagctaaagctgctgataaatc

SEQ ID NO: 5746 - DNA, 339 bp, Diabrotica virgifera
  Clone ID: LIB150-015-Q1-E1-D8
aaatattttgtttaattaattttggtcaattatgtatttcacggagttaggcaattttcttttttaatactgttgttgttttttggacatggcaagttccacagtgttttgtctctcctgtaaaattttcgatttgtgacttaagcaatttgcctattagaccgacgttatgtataaatattgcaccagagatgtcacgacgtaatctgagaggaagtagtgagagatgggattcaacagttgagtaatcatggctaactatagctagataagatttgaatgcgcagtaacgtaaaactttatgttggatcatctcgaccgtatcgatatggctttgat

SEQ ID NO: 5747 - DNA, 274 bp, Diabrotica virgifera
  Clone ID: LIB150-015-Q1-E1-D9
gagtttttggtgtgactttttttatcacgggttattttttcgtgtgttgcgctcatcgacaaaccacaagaatgaaacttatcgtaggattattattaatagccacagctctggcatacccagtagcggaaaatgaagaaaaactagcccaaccagtaattgcacaagacgcgaagccagcagagcaagaactaccactaccagaccaacttcttcccacatcagaaaaacttcttccccaaaaacaagaaccattacctgccagcagcgattc

SEQ ID NO: 5748 - DNA, 165 bp, Diabrotica virgifera
  Clone ID: LIB150-015-Q1-E1-E1
aaggaacttacaggatggacattttggcagaaatctaccggccagtggtatgaaatgcaggatctgcacgtgacggatattttaacggcagatgattacgttaacggaagcctatatacaaatttatgaattaagaacacagtaataaataaatatttttaagta

SEQ ID NO: 5749 - DNA, 421 bp, Diabrotica virgifera
  Clone ID: LIB150-015-Q1-E1-E11
cagaaaggtcagatcaaaaactttcgttacccaacgttgtcagattaatcaaagtttaaaggttttccggttttaatttgtaaccggtttcacagtaaaattgataacaattcaataacgccttttgcattttttattataaatcgaaatattagacgtgataagttacagtgtatattggtgaaattccttttgtcaattatttcagttaaatacaaataaggagtcttaactgtttattaatgactgtgtgacaggtacttcttttaagacaacagactcagtaaaacaggttaaaaataaactaaatgtattgacgaatattaaatatttcaatattaaaaatacaatataaaaagcttcccaaaaaacaatttccggtaaaactccctaacccggacgtttggaaaattaaaattaa

SEQ ID NO: 5750 - DNA, 443 bp, Diabrotica virgifera
  Clone ID: LIB150-015-Q1-E1-E12
gtatcgccgtgcgggaaattatgttcaatgttataaattattaaagtacgttataaccgtcagatataccaactacattagattcggacgtccatatttagtgtaattaaagttcaacgatttttgtgggtgccgtaagaggttatgcgatagtacacatgggagaagccagaattgcagaaagtggtatttgcacagcagtcgcacttagatattactttatgtaccaaaatgtaggcgctggagaagctgaactacgctttgtgcaacatcccttaatcgaattggaagttgatataccaaatgaggacactgaggaagaactaactccagaatccgtggactatgaagacgatgttgactacatgagacgtttacagcctaaagaatggaactcccacgaccattacaaagtcccaggtatcccaaacataggatacaca

SEQ ID NO: 5751 - DNA, 317 bp, Diabrotica virgifera
  Clone ID: LIB150-015-Q1-E1-E2
ttttaaaaaataccaaattttttaagaaataatttaaatttattaattaccattacatttacaattaaatatttttacattactaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttacatttagtaatgatgataatattagtactaaaaaaatgtatatttagtacaaatata

SEQ ID NO: 5752 - DNA, 314 bp, Diabrotica virgifera
  Clone ID: LIB150-015-Q1-E1-E3
gtccgcaaacgcatccgcccacgcgtccgcggacgcgtggggtaacattttcaagatttttgtcacataaaaaattgaacacgtttgttcgaagattacatacattttcaaacgcagtcaattttataactgtgaagatagcagttataaccatacgaacaaaaacattaatgtgctgcataaaatacgtgcctttcagcatagataatccgtgggttcgtttctgggagaattttttattgggactaacattgtttccttttagcagctttcctactatagaaatcgtgatcaatgacgaatagtagcaacta

SEQ ID NO: 5753 - DNA, 424 bp, Diabrotica virgifera
  Clone ID: LIB150-015-Q1-E1-E5
gaaatttgttgtaaaataataactaaacatgaggatttccacttattatatcttagtattgtcaataattttggcattattctgtgccacaacatatgcaagtatatgaggctacattagccaagcagattagaacaaatttattcagattttgggaaaaacactcaaaatcgatggggatgatattggttctccatactatgcagccagaggatatcaaattcttacagttcctctggataagaagcacacaggggacaactgtgctcacttgaagaagaactttaagcatcaaagtactgaaagtactttttacgtgtacagtacctggaatatattgggatgccagggagctcttcattcaccagaagttgtaaagacaattcaagcagctctggaagataataagtcctacttagcagat

SEQ ID NO: 5754 - DNA, 456 bp, Diabrotica virgifera
  unsure (1)..(456): unsure at all n locations
  Clone ID: LIB150-015-Q1-E1-E6
gattatttttatatatctaagacttgtgacaaacttcacagtatgacgtcatcaccaatatggcgtgtagtatgaggttgctttccggggtcggtttgataatcgaaaaattatttattttagatttgttgtcattacattgtgattttgcattgccttttgagaaagaatactccataatgcattcaatggagtccgagttgtacataaaagcaaaaaaatgtccatctagttcaaaaatggcggcatgtagtgaaatgagttgctggacaacgtatatgtaaggccgtttttggataatttgtaattttatcgtttgattttgtcaaatcatacaattagtgattgatatgtancggatttcggtctaagaatctcaatttcttttcgataacatttttggtactaagtatagtttatgacaaaatgtagttttaaaatttataatgattcaca

SEQ ID NO: 5755 - DNA, 417 bp, Diabrotica virgifera
  Clone ID: LIB150-015-Q1-E1-E7
gactgacaaaagactatggctgtgttgttttttattattgacaattgcttacgctcaagatgaagatgatgacgattcaggggaaccacagatcgaccagctgtgtgaaaacaggcctgctgatgaatattttaggttaagcactgatggagactgcagagaagttgtaaggtgtacaaaatccggtctaaaacagatcacttgtcccagtggattggcgtttgacatcgataaacagacttgtgactggaaaggaaaagtcacagattgcgataaacttgagaaagcaagaaaagtccttccaattttgaaaaccgacgaaccaagatgtccagaaggaaagctgatgtgtggtaatgaagaatgtatcgacaaagatcttttctgtaatggaaagccagactgtaaagatgaatc

SEQ ID NO: 5756 - DNA, 441 bp, Diabrotica virgifera
  Clone ID: LIB150-015-Q1-E1-E9
aattttagaaaaaagaatgagactacttctagccatactggcactttctgtgttacatcatacaacagcagaagaagcctcatggtcttggggctcaaacgacaaagatgaaaccccacagaaatcgtccaatgagccacttcaagaaactgtgcccagatctttaaaaccttcgtttttacaagatgaggaaattctaattgctgaaccttccgaatattcagaagacatcagagcaaacagcactgaagcagaacttgtaatagacgaaatccttagctctacgaagaaaggtagagccatagatggtttcaatgaagtctacagcaaccctaacgtacaagaagctttgcaaaaggggaataattccaagccaaaaatgtttaccaaggaaaggtaagttgcttaaggacttagccattttaacgtgttgaaggaaaa

SEQ ID NO: 5757 - DNA, 451 bp, Diabrotica virgifera
  unsure (1)..(451): unsure at all n locations
  Clone ID: LIB150-015-Q1-E1-F1
tcagggtcaccacgcgtcgcaaaccaacanacacggcttcaagatganacgaatcaggcaagttaccgtcactaanaacactacgacatatgaagaatacgaatatgaaaccactttctccgtttcgaagttatcgaaacttgagaatttcgttttacctcctagaactactatcttagcattgtctcagagcggaggagacaaggaagaagacaaaaagtatgtcgtcaccaatcacggaaaagctgatctttttgttgaggtaattcatctcaaaaaccaagatgatgctccacaatggtttgtagtccagccagaccaaaccactgagatagatattgaggacaatcttgaacaaagcgtattgaaagtgagcaacaacagttacgaacaggaagtgtcattttctgctaaaggtggtcacgttattgacgatttggaaaacaacatg

SEQ ID NO: 5758 - DNA, 400 bp, Diabrotica virgifera
  Clone ID: LIB150-015-Q1-E1-F10
cagacgcgtgggttcagtagtccctttaagtgattaagttttgttagttagggatcgtccatgatgatacctacatgaaattggttctaatgcttgtggccgtccattccgctgtggtattaacgtcaccgccgtcgacaccatccacaccgtctgcgccaccgtcgcttccaaccaattcgacgacttgcattgaccactgcacgtgcagctttgagatgctgaccaatatgctgcatgtaaccatatgcgataggcctctagtacgtatcgacgccacttttaagtacattagcatgacctcatctaacgttatcactcttgactgtttgatcatcatccacatccaagttagtgcattcgctgggttcaagaatcatgaccatgtcatcattaccaa

SEQ ID NO: 5759 - DNA, 404 bp, Diabrotica virgifera
  Clone ID: LIB150-015-Q1-E1-F12
caaaatcatggggttcatattcgtcactttctgcgccctcgtcgctgtagccaaagccggtatctacggcgaaacctacgcagctccccttagttacgctgcaccagtagctaaagttgcctactcagaagctcctgctgtgtcatactccagtgtgtcagccctagtagcctacgccgccccaggcatcgctaaagtagctgctcgcatttcatactccgctccagctttctcctactccgctctacccgttatcgtagctgctccagtagcttacgctgccccagcatatatagtagccgctccagtcgcttatgccgccccaatcgacacagccgtctatgccgaaccatctgcaccagctcactacgatttcggatatgccgtacgcgacgcccacaccg

SEQ ID NO: 5760 - DNA, 458 bp, Diabrotica virgifera
  Clone ID: LIB150-015-Q1-E1-F3
tatcaaaatacttttaaaaaatatttttaagtttttcggttcagttattacttaacacgttaagtattattcttatattttctttttgatatgtattagagccctattggctcagttaagtggccttagaagttaactactttttgctttgttagattattttgctttttaaatatatttaactaatgttatacgaaaattgttttccattgtttttgtgataactaacaacaattttgggtcaatttgaaaatcggatcctcacattaaacacggatccgagctgaactgataaaaaaatatataacactccagatctgcaattagtccagataccgagtaaggtacactgaagatttgtagcagtttttcaaaatcttgcaactaacttctacaatttttcatcgaccttctttttcgtttccaactctggactaataatttttattccaaatttt

SEQ ID NO: 5761 - DNA, 412 bp, Diabrotica virgifera
  Clone ID: LIB150-015-Q1-E1-F5
gattaattaacgtcatagatttttgtgaagacgcttcggttttttcaatttcaagttccgaatgaggtaaaaataaaggaaattgggatactgtgtgataagaaatctaatgggagcacctgtacaacaagggaagccaaatagacgaggtcctggaaatatgagaggtcgtggtggaaatccaaaaatgcgaggacaagggcgtgcgtttaatggacaaccgccatttgggaatcctggaatgatgcgaggtggtttcagaggaaatatgaggcctccacaaggtcccccaatgcgcggtggaagaccccctatgagaggacgtccgcttccccctccgccaccgagaatgatggggccgagagggccatgatgccccaatgagacaacttcacaggcatgaggcacccca

SEQ ID NO: 5762 - DNA, 442 bp, Diabrotica virgifera
  unsure (1)..(442): unsure at all n locations
  Clone ID: LIB150-015-Q1-E1-F6
ggctgacaaaagactatggctgtgttgttttttattattgacaattgcttacgctcaagatgaagatgatgacgattcaggggaaccacagatcgaccagctgtgtgaaaacaggcctgctgatgaatattttaggttaagcactgatggagactgcagagaagttgtaaggtgtacaaaatccggtctaaaacagatcacttgtcccagtggattggcgtttgacatcgataaacagacttgtgactggaagggaaaagtcacaaattgcgataaacttgagaaaccaagaaaagtccttccaattttgaaaaccgacgaaccaagatgtccagaaggaaagctgatgtgtggtaatgaagaatgtatcgacaaagatcntttctgtaatggaaagccagactgtaaagatgaatcagacgagaatgcatgcgatgttgat

SEQ ID NO: 5763 - DNA, 295 bp, Diabrotica virgifera
  unsure (1)..(295): unsure at all n locations
  Clone ID: LIB150-015-Q1-E1-G1
taaaaatgtacgatttgttaatattacacgcccgaataatattaagaaaagcactcaacacaatggcgattgggtttagacagttgatcaaatttgccaacttttcaagcttggtagcttctagaagcagtgcttttaaattntgaaaaagcctcacaagttcaaattacacaaacaaatcatcagtatttaccaaagggtgtaaagaggtttaatcatgaagaaggtcntcaaagtcaggaagtagataatcgagaaagtgataatggactagttataaaagaacacgttttta

SEQ ID NO: 5764 - DNA, 202 bp, Diabrotica virgifera
  Clone ID: LIB150-015-Q1-E1-G11
aaattgctgaatttcttttagcgcttttactatattagggaaccaaggagatttttaccatggtttgtaaatatgtggacgacaaccaggtaaggtctgtcacatttagtatgcaccaatcaatgattttggtagatgcacaacaatttattttaaataggtaatttaacaggtaaaaagttgattccgcaatcctttaccc

SEQ ID NO: 5765 - DNA, 446 bp, Diabrotica virgifera
  Clone ID: LIB150-015-Q1-E1-G12
tcagcatctttgataattgttttcttcagtgtatttgtcagtctcctctgtttccgttttcctggaggttggaattaaaatgtgaaaattgttggtaaacatttattaattggaggtgattgatggatagttggctctctatgcgtgacaaggtaaatttttatgaaggctttaaaaatgtgagattatttagccgcgtccgtattataaatgtggccgttaataccaggtcataaataagggaatctacatataattgctttggagaatttttaaactggtcgttagtacaggtggctgttaacacaggttttactgtattatacatggcttacaaaatctactgatttctactaattttttgaaagcacaactactgaataaataaaaactgacctggcaaccctgctttaaaggcacgttcaaaatcaacaaaaaccatctat

SEQ ID NO: 5766 - DNA, 407 bp, Diabrotica virgifera
  Clone ID: LIB150-015-Q1-E1-G3
ccaagccttcgggaggaacaaaatttggcaaaaaaaccttaaaataaataacaacccaaaatgtggttggaaagaaatttaaaagccttggttgaaaaaatccggcaaggttaaaatgaattagaaaacctcccaataaggggattgaacaacaagatggagatgagaattatcagaagaaaataagagttaaggagttttcaaatcgattttcaaggaactatctttatccaatcgtcaagcagattgatgaattaagtaaatttaagcaaatccatcccactacaatcataaggtgttaaacgcttataatgttatatataacggactagtagcatatcagaatcatcttcctacctccataggtgcatgttcttcagataaactaaaactactgcttaaacacc

SEQ ID NO: 5767 - DNA, 455 bp, Diabrotica virgifera
  Clone ID: LIB150-015-Q1-E1-G5
gactcatttacttctacacctaattcttatacaactcaatcagtttcctttccctaagttgttatattttggtctggtgacaatccacaattatcatgcccatttaagcttatttataggtatttcataggaattgttacaaatacaaaagttatttttatagtaattatttgtattaaaatctaccaccacttatagatgaggatatgttttagaaatgtaatatcgacatggagttctggaacaggtggtgcacgagtaattggagctgctacgtatgcaattcttgcccaagtccatttagaaatgaggacaattttacagatacttcttgtagttcccgttgccatgggtttagcgttttggttgttgcttccacggccatcccaagaggacattgcacatgcattagaaattcagaatcttgtcaacagcgatgagctaaagaacccaaa

SEQ ID NO: 5768 - DNA, 168 bp, Diabrotica virgifera
  Clone ID: LIB150-015-Q1-E1-H1
ggggccacccacgcgtgcgcacacgcgtcagcgtgtttaaggaacccaggactcgactttccttcaataatcttttatttatttcgttttcgtcccttccagtattagggagagtcgctacgaagtgtgcgagaacagatacttctttaaaaagagaaacatatcttt

SEQ ID NO: 5769 - DNA, 382 bp, Diabrotica virgifera
  Clone ID: LIB150-015-Q1-E1-H11
aaaaacaacggccttcagaatgcccggcgtaaatccccaggaagttacaacccaggataatccattggaaacaacgacttatgaaccatacaattatgaaacaacttccccggccccgggaacatcgaaccaaattaatttcgtttaacctccaaaaactacgatctaagcattgtctcaaaccggcggagataaggaagaggacaaaagtatgtcgtcacaaatcacgggaaagctgatctttttgttgaggtagtacacctcaataaccaagatgatgctccacaatgggtttgtggtccaagccagacaaaccagtgagattgctattgaagacaatcttgaacaaagtgtgttgaaagttagcaacaacagttacgac

SEQ ID NO: 5770 - DNA, 379 bp, Diabrotica virgifera
  Clone ID: LIB150-015-Q1-E1-H3
atttaaattaaattgttcaggagaacctaacaaaaaaattaggtgaattaccgttcgtcaattctagtaaatgctgtgaggccgctcccatgatgagaacattttctttttttctgaaaagagaaacttcagtttttcttaagaaattgctcaaacaaattttgtccaaaaatatcctttcaatttgttgaaaggggacaattttaacaaaaatccgtaaagaaactgaatcagaaaatttttcacactagaccgccctcacaacatgaattatattctttattattcacatatcattattttttataataacaacatacaattttattgttaattggtatcaaatgatgcctctcatatgttgatacatttttattgt

SEQ ID NO: 5771 - DNA, 427 bp, Diabrotica virgifera
  Clone ID: LIB150-015-Q1-E1-H4
ggcgcaaataacaataacaacacaccaaaccataaccaagcaatttttccggtgaattaataacggaatggaccaaattaaaataaaaggggttaaaccccaaacagttaaattgaaatgcagccgtccgtttgaatattaacaaagttagtaagtagaacattttcaattttcagtatttgtcagattgagccagaaaaatgaaattttggttgatattagtttgttacacatggatatttgcagaatgccatacgacgaagaaccgtacggcactttttgaacaaatcaagaaaggtatagaagaaataaagactttcaataaagcgtcagccacctttgagactgctattaaagagtataacattccaaacatatttacatcatcaccagacaattttgataaagaagaggtatgttcgacatg

SEQ ID NO: 5772 - DNA, 455 bp, Diabrotica virgifera
  unsure (1)..(455): unsure at all n locations
  Clone ID: LIB150-015-Q1-E1-H5
cacacgcgtccgcgtgtttaaggaacccacaactcgactttccttcaataatcttttatttatttctttttcttcccttccagtattagttacagtcgctactaggtattcgaattctgatacttccttaaatttatattcatctccttctcctttaatttttatatagttatcctcttttttatatctcctttcattaccatgtattgtgtttttccttggttgattcttaatcaatacctttttgctttcgcttcgaacttttggaagattttttgggggtggtaaattaactaatanaataataatattaaaacaaactagaaactagtcgctaagcgacctgcacgtccagtcactaccgactgatcactgacgaattacagaccggttaataactactagcgctttgtgcgggatactattannatacatggacagtaactaatacgcag

SEQ ID NO: 5773 - DNA, 376 bp, Diabrotica virgifera
  Clone ID: LIB150-015-Q1-E1-H6
cgtccgcgtgtttaaggaacccacaactcgactttccttcaataatcttttatttatttctttttcttcccttccagtattagttacagtcgctactaggtattcgaattctgatacttccttaaatttatattcatctccttctcctttaatttttatatagttatcctcttttttatatctcctttcattaccatgtattgtgtttttccttggttgattcttaatcaatacctttttgctttcgcttcgaacttttgggagattttttggaggtggtaattttaagcagtagagtagtagtattaaaacatactagaaactagtcgctaagcgacctggcacgttcagtcactagcggactgatcactgacga

SEQ ID NO: 5774 - DNA, 169 bp, Diabrotica virgifera
  Clone ID: LIB150-015-Q1-E1-H7
ccacgcgatccgcaatagcgaaacagacccagaggtagtacttaattcgtctcgctaatacagtacctacttcaaattcagttctaaaccgagttttgcatataaattagaattgacgccgtggtacattgagaaatgagtcggacaagtgacacctattaccagttaa

SEQ ID NO: 5775 - DNA, 464 bp, Diabrotica virgifera
  unsure (1)..(464): unsure at all n locations
  Clone ID: LIB150-015-Q1-E1-H8
caagctaaagatagatttctttcacaattaattagtgaaaatccatttgtagatataaatatatttttgaaattcaataaaattagaaaattaaactgtactctggatgatttacgaaaagcaattagcaagtcggatatgatagaactatcagaatgcaaagaaagaataaagagaaagatgcctataaaaattaatgaaaatgtagacaattgtacaatatatgttgaaaatattaaagccgatgctaaccatgagtgggtttcacagatattttcagaatttggaaatgtggtttatgtttccataccanaatacagacataatanaacaaacaaaggttttgcttttgttgagttcgaagatgaagctggtgctaaaaatgctcttacatactttgagagtantgggtgtaaaatgccatcagaaacaaacccggagaaattaaagagtatcagacattc

SEQ ID NO: 5776 - DNA, 53 bp, Diabrotica virgifera
  Clone ID: LIB150-015-Q1-E1-H9
ccacgcgtccgaaaaacaaaaatgaaagtactcattcttctttccgttgttgc

SEQ ID NO: 5777 - DNA, 340 bp, Diabrotica virgifera
  Clone ID: LIB150-016-Q1-E1-A11
gatgtgaagcttgtatttctacgccttaaacagtgaagatggcagaggggcaggtttcaaacgcaaaccatgaacaactgataagaaaggtggatgatttggaaaaacgtctgcagaccaaagatgcagaaattcaagtctacaaaatgctcatgtctcaaatggaggaagaggcagcgacagcaaacaaatacaaggcccttcacgaaaagcaaacccaagacgtggacggcttaaggacagaatctgagaaaacgttaacgaaggcgaagagtatgatctttgagaagacaagaatcattaggaaccaagaattacagatagaagcgttcaccaacaa

SEQ ID NO: 5778 - DNA, 143 bp, Diabrotica virgifera
  Clone ID: LIB150-016-Q1-E1-A2
cacacgcgtacggcggttgaattaaaaagtaacttccaaacttccaataacctcggttttggcaattcctccaattttaaacaaagaaaaaataacaacaagagtaaattcggtggtttaatggcaagtttggcaattggtgg

SEQ ID NO: 5779 - DNA, 138 bp, Diabrotica virgifera
  Clone ID: LIB150-016-Q1-E1-A3
gttttaatggtaaataagaaatttaaaaaatttttttggaaaggaatggtaatccgttttaaataaaaccaaatttttaaggaaataattaaaattaattaaggaccattggattaataggaaataatttgaaaagaa

SEQ ID NO: 5780 - DNA, 438 bp, Diabrotica virgifera
  unsure (1)..(438): unsure at all n locations
  Clone ID: LIB150-016-Q1-E1-A5
cacacgcgtccgtttaatttttgaaagttgaaatatgaacgtctagaatgaaataggtacagaaagtattaaagataaattggtgcaatactggttagttgttcttgagaatagtttgaccaacagcacttttttatactggagatatagtccttttagatagaagtaattattccccgcctagatgattagttgagttttatcactatttttgtttgtttgctcctgtttggtactacgagcatttagggaatggaagaaggctcaccaagcctgggtgtcgcctggtacccggaattgagccgtttttaccttccactcgatcgtgtccatctcccagaagtagcatctgtgactgagcacgaggtgcgctctttcaccacgacangagttcacgatttttggcgaagatcagtcaaactaacccatatggtaaat

SEQ ID NO: 5781 - DNA, 436 bp, Diabrotica virgifera
  Clone ID: LIB150-016-Q1-E1-B10
gtacaatgatgagcctccaatactgtggattggtccttttggcaggtcttttgttggtttccgcccaccctggaaccgactctaaggctgaagccaaagtatcttcagtagccgagaagaaacaggaaaaacgtggtcttcttgatctaggctacggtgggggacacgactttggaggaggacttgaacttggagggcatggtttggatttgggtggacatggtggttttgacggaggatatggcggagggttaagtggagggtatggtggattagacgaaagtcatgttaagcacattaccatcaccaaagaagttaaagtacctgttcctgcaccatatcccgtacacatcgaaaagaaaataccagttccagtgccagtcaaagtacctgtaccagtagatcgtccataatcagtacatgttccctaaacata

SEQ ID NO: 5782 - DNA, 431 bp, Diabrotica virgifera
  unsure (1)..(431): unsure at all n locations
  Clone ID: LIB150-016-Q1-E1-B11
aaatgtactaatcaatgttgagaaaatgtaacgtgtattcaactactacttactacttaattcatcaactacatatcccacaaaaatgatcgaatcgcaccattttgtaacttactaataggaagagatatgtatttaggcctaagcaacccaatacaatgtatttttaccttttttaatcaaattcctttattatatataagataattataaactctacgtatgggccggcgtagttcagcggtacgatgtctgactcgcttgctggtagacctgggttcgagacccagcgccggcaagaacaactagacatttttaaataggccccagttcgattcagcctgaataaaatgagttccttggctaaaaccaggggtaataataggcggttgaagcgtancactggccctgttatctttcttgtataccgt

SEQ ID NO: 5783 - DNA, 361 bp, Diabrotica virgifera
  Clone ID: LIB150-016-Q1-E1-B2
aaaatgttgaaaatcaagaatagttaaattataaatacaaactaataagaagctggcctcctaatcattaaaatgagtaagggtgatctcaattcaataaccatatgtaacaaaataattaaagtgtttcttcagttcatcagtaatttgataattcctgattaagatgctcaagtatttcaatatttaagacagtattcagaaggaaaacaaatttttctcaaatttaaataccagtttaagtgggtttgtaagatgggacgcagagtatttcatgcataacgctaaatatggttacacctttgaaaacactttggcgttttttccagtataaccatacattataagaattggttcctgg

SEQ ID NO: 5784 - DNA, 232 bp, Diabrotica virgifera
  Clone ID: LIB150-016-Q1-E1-B3
ggcagaataaaacgtaatggacctttaagtcaactttgggcaaatcacaagatttttaaggggatttttatttaaattttcaacaaaaaaatggcctgtggcgattgtggctcgtacggacaatgttgcggttctccatgttctccaccaatgtatccccatgccgtacgttgtacgtcatgtcctccatcaggtatcctttccactaaacccagaccaatgaaacctttgc

SEQ ID NO: 5785 - DNA, 109 bp, Diabrotica virgifera
  Clone ID: LIB150-016-Q1-E1-B4
tcgaccacgcgtccgccaggaaactgggaatcaataagaagcacaataccaataaccaagggaatgaagttgatactaatatagattccaaactaatgccccgtggaaa

SEQ ID NO: 5786 - DNA, 448 bp, Diabrotica virgifera
  Clone ID: LIB150-016-Q1-E1-B6
gtgttactgcacataattattcgttattgcgcatgcgtctatcgagttggaacaaacctatggcctaaagcacttttttctacgatgttttagcagagacatgtaaagaggatagacttggctagggatatgccactcaatgcatcgaggtaacgccgacataggattgagtggtctagccatatttgtcagtcacatgtgaaaagtcgcttggttaaaagagatagatagaccaccgatcgactgtttacatgctgtttccgcgttacgcttttttggtgagtatgccgagtctaggcttaatatgtcaatgtgttttagtggtgtaatcattcaaaatggctggtgggtgccattttctaaagttagtttaaatgagatcatagagcaagtaaaaccatttaaaagctctggtatcactcacggaatctgtcacgaagtttcaaaa

SEQ ID NO: 5787 - DNA, 446 bp, Diabrotica virgifera
  Clone ID: LIB150-016-Q1-E1-B7
gaaagacagcggaaaacaccagcccctgaggctgtctccagcgccgaagaaagtgaggagtctgtaaattctcgtcaacagagtcaaaaaaagacatcccctaaaagtgccaccgcagcaactccaaggcgaccatctgatgctagccacaagaaatccgcaagatcagctagctctgaatctcatacatcttccgaatcctctacgtcctcaagcgcagttcgatctactggagctcctttcaccacagatgaggttaagaagaaaattctctctaaagtagaaccaactacaccaagtaaaaagaattcatcacctgtccaaaacaaacctttccaaagtcgattcttaaacaaaaatacaacagctccaactaaagaagaagaagaagatgaaacggaaactagctctgaagaagaaactgaatctgaagaagaatctgatga

SEQ ID NO: 5788 - DNA, 88 bp, Diabrotica virgifera
  Clone ID: LIB150-016-Q1-E1-B8
aaaaaaaaaaaaaaaaaaaaaaaaaaaaaaaaaaaaaaaaaaaaaaaaaaaaaaaaaaagaaacagaaaaaacaaaaaaaaaaaaaac

SEQ ID NO: 5789 - DNA, 385 bp, Diabrotica virgifera
  Clone ID: LIB150-016-Q1-E1-B9
cctttggtaccggcaagcaagtcaccatcaacgacgatggcactctcaccatcttgggagaaaatggtaagaaaatcgtcatctcaaacgccattggaggcactggaccaaaagacattgagatctcaatcaatggaccatacggagcagtcaagaagatctcagtaaatggcgaaaccaacgaaagaaccatcagcctagtcgaaccaagcttgtctgagcaatacaacactgacgaagaagacagagccaagagaagcagctccaccaaagacaaaggagacagcacaaactccaaagacaccaaagagtacaaaggaaaggaaggaaaatcgaaaactcaagctcaattacttcaggaaatcttcagcgaacaccaggaggc

SEQ ID NO: 5790 - DNA, 411 bp, Diabrotica virgifera
  Clone ID: LIB150-016-Q1-E1-C10
aataaattttgctacgtcgcagtaaccttggttttctcttagaagcccataaaaccacttagctcgacttttgtgtatactttgatcaactgttatctgattttttgtaacagcatttttaaacttttttagtttgtctttaaaatgcagacacgtggaatatagatcagcgcttaaagtaaaaaatcaactcattctcctttaggtgccatctccgccacgaaggttggcaatcatcattgcgattctaacttttgagactacagcccgaaagagttcagttgagctgcatccaaaccattctctgagattcctcagccaggacatttttcccctacctatgctgtgccatccttgaatctttctctgcataattaattttaggagtttaaaaaactgtcaacatgagtt

SEQ ID NO: 5791 - DNA, 352 bp, Diabrotica virgifera
  Clone ID: LIB150-016-Q1-E1-C11
ccggggccacccacgcatccgaataaattttgctacgtcgcagtaaccttggttttctcttagaagcccataaaaccacttagctcgacttttgtgtatactttgatcaactgttatctgattttttgtaacagcatttttaaacttttttagtttgtctttaaaatgcagacacgtggaatatagatcagcgcttaaagtaaaaaatcaactcattctcctttatgtgccatctccgccacgaatgttggcaatcatcattgcgattctaacttttgagactacagcccgaaagatttcatttgagctgcatccaaacaattctctgagattcctcagcaaggaaaatttt

SEQ ID NO: 5792 - DNA, 426 bp, Diabrotica virgifera
  unsure (1)..(426): unsure at all n locations
  Clone ID: LIB150-016-Q1-E1-C2
accttaataacaaccaaacaacctaataaaattaaataatagtaaaaccattgaatgtaacaaataatatggtaaatttgtaaacctttggccccagatcagtacacctatagaagaatcgagttctgtactgtaactgtatcagttaacaatattgttcagttatttgtagaacaatggttttatcaaagcctcttgtaaattttttaagtttctattttggccaactgttcgaacatcncctgagaacaaaagctaaaacatgttcaattatcgctaccgctggtaattacacatctcaaaagttatcaggagagaaagtaattaatcatcacagtctgcttgcctatggattaaatggattaaattttggcggaaccatcccccattacttctacagcttcctggaaagagcaatatccgaag

SEQ ID NO: 5793 - DNA, 330 bp, Diabrotica virgifera
  Clone ID: LIB150-016-Q1-E1-C4
acgcgtccgcaaaccctaccaaaaattgaggatttggtaaaaaattggaaaaataccgctaacaaattaaggataaacactgcaaaaaaaccccctaaaggttttgattgcggtcccgaataaggaggactaacggagaaaggtccgatggctgcaataagaaaaaaattgggattgttggtgacggagcatgttgaaaaaacatgtcctttaaaagtatttagtagagatcagttcccaaaaagtatacgtgcccactgtattcgaaaactatgtggcggatattgaagtatatggaaagcatgtagaactcgccttatgggataacgc

SEQ ID NO: 5794 - DNA, 448 bp, Diabrotica virgifera
  Clone ID: LIB150-016-Q1-E1-C8
cacacgcgtccgcccacgcgtccgcccacgcgtcggcccacgcgtccgtctttgcaaaaatatcttcaacgatctttacatggttcattgctaacataacagacatagatacctaatacatgaaaaatcttagtttctttcggtacgcgattctggtgcccagtttaaacgctatccccgtagatgtcatccagagaaatattccagtagaagtgaggtatgaccagatcctcccaggaattgtatccagggagcaagttcgaatgcacggaagaacgaacttagatgcaacggtgcaattatcttcatacgaactgcctcacgtagtgaaacatttaccgattccacttgaatctgatctcgttcctgaacttgttagcgatgacaaagttcaagtggcatcagaagtcggaaacaatgcagttaactctttacttcagcctgcaga

SEQ ID NO: 5795 - DNA, 159 bp, Diabrotica virgifera
  Clone ID: LIB150-016-Q1-E1-C9
gacttttgccggcaaagagcccgtgtttgtatttggcattcgctagctagtaccatagtaccattagtacggtgagttgtgaaaggttcgttcgactcaggaaaatgaagacggttttttgtgtggtggcgcttgcgctttttggttatgtcagcgctc

SEQ ID NO: 5796 - DNA, 331 bp, Diabrotica virgifera
  Clone ID: LIB150-016-Q1-E1-D12
cactttataatctgtcgagctgcttctgaccaaggatcaacatgtacagtacagatgtctaacattacctgagcaaaaaatgctatagaacacaccattttaatgtgactaaggatggcatgtgcccacgatcctatgatgggcgtctacgctggcatcctactaatgccggagaattggcggtgcggagctgctcatgggatatcttagagtccactcaacagggattggcaacatggcaatgtttataatatggatcctggttcgtaccccctgtagacatatttccattgtcgaatatttctcaatgtggaacgttttctaaaactac

SEQ ID NO: 5797 - DNA, 440 bp, Diabrotica virgifera
  unsure (1)..(440): unsure at all n locations
  Clone ID: LIB150-016-Q1-E1-D4
cgcgtccgggtgaagtttgttaatttttgagttcaaggatttaaaacaaatatattcaagcatggagaaacaaggaaatcccccaccatatactggcccatacaacggacctccaggaccccaagctggattccacatgcctccacctggaatgcctcaggatcaacaacaacaaacagtgattgttactcacaccgtagcccaggttcctgttggccctaatccaaacatcgacaacatgtccatcatgtcatgctcagatagttacttcggtggagactgaaacaacaaccaagacacacttgttcgccttattgctgtgccttttcggatgctgtctttgctcttgcattccgtactgcgtggattcgtgccaagccacaacacattactggcccaactgtanagcatacattggcagattccaaaattaaagaacg

SEQ ID NO: 5798 - DNA, 449 bp, Diabrotica virgifera
  Clone ID: LIB150-016-Q1-E1-D9
cacacgcgtccgcccacgcgtccggtccttaccaagaataacatctaaaatgaaatacatctactttttgttcatttatttcttggttgccttagcaaaggcagaagaaactgttagcttagaaggaaaactcccaaaatgtgagtgtagggatataatcgatgagatcttgtgcaagctaacagaaaactcagaaaaggtcctcaaaattcaagccaaactagccaaagtagtgaaagaaaccaatgaaattcctaacagaaacctaacgaaaactcagcccaaagtgaaaggaaatcgtctccgttagcaacttgcctaaatcccaaagtcaactctaagggtcaaaattcttaactgccaaataacggcagctatcaattcaaatttaaaaatcaagtccaacgacaatgtccttgacaatggtggcgacttggaacagaccttga

SEQ ID NO: 5799 - DNA, 401 bp, Diabrotica virgifera
  unsure (1)..(401): unsure at all n locations
  Clone ID: LIB150-016-Q1-E1-E1
cacacgcgtccggcttcgaccagtagttctatctgcagcgctgatgatagatcaacgaaagtagcgaaggtacgggcgangaagtccagtaggataatagtgctgcaaccgactgcttcatcangtaaaaatcctcggaagtcgcctagacagcacgcctctactttagctattcttagcgacttggtacaacaaagaaagcgccggtccaaacatagacagcccgtagaagatattaacaatcctttagcaacatcgatgatgacaagaaatattatcggctccggtgcaagaagaagttgcaccagaacctcctcctccagttcgatcagcatctcctcccccagtacaagaaaacgactgccctccaaatcctcaaaaccaatccactcgtgttaagt

SEQ ID NO: 5800 - DNA, 438 bp, Diabrotica virgifera
  Clone ID: LIB150-016-Q1-E1-E10
cccacgcgtccgcaaagatgaaactactgagaagaattacaagcaatacgctgagagatcgaaagaggaagatgaagtcattagaagaaaatgtaacatatatatgcaccgttcttaggcgtcaacggccttcggtagtgatctatggaggagtatcaccaagccacaagcccttatctcttgccgtaccgctcttccataggccgatcagacactagtttattcgagaccaagtcgtagactctattgagttttatactacggcattggccttttataaatttcatgacctagctgaggctcgaaccagcgatcgcaaatcgcaaatccactaaacttgtcgatcgactgcgcctcagctaactagaccatctagaccgacagaaaagaagatataacatacggtgtataaataaatgaatactaaaatagaataaa

SEQ ID NO: 5801 - DNA, 234 bp, Diabrotica virgifera
  Clone ID: LIB150-016-Q1-E1-E11
gttcgccatgcgggaaattatgtttaatgttataaattattacagtacgttataaccgtcaaataagccaactacattaaattcggacgtcgatatttagtgtagctacggttcaacgatttttgtgggtgccgtaataggctatgcgagagtatacatgggagaagccaccattgcacatgctggtatttgcacagcagtcgcacttagatactactttattttacgacaatg

SEQ ID NO: 5802 - DNA, 317 bp, Diabrotica virgifera
  Clone ID: LIB150-016-Q1-E1-E12
caaccgcgtgcggtcagttatgtctaatgttgcagattattaatgtacgttataagcgtcaaatatcacatctacattcgattcggacgtcgatatttactgttattgaagttcaacgacttctgtttgtgccgttaccggttaaacgaatgtaagcataggaatagccaaaactgcaattgctggtatttgcacatgaatcgcacttacacttaactataacttgaatcatgtaagtgttggcgaacctgaactacgctttgtgcaagatcacttactctaattggaagttgatgtaccaatagatgacaaggacg

SEQ ID NO: 5803 - DNA, 454 bp, Diabrotica virgifera
  Clone ID: LIB150-016-Q1-E1-E3
gtattagttgtgtggtaaaatttaattcactatttactaatgaattgtgcctataaatctaaatttcactaaatgaaatggcacaatttgccaaagtatgtttcctcctaatcgtgataatatcgtgtttctcgagagggactgctcaagacaccaacactacataaatagtttcatatcaaacaggccctgttgtatctaatgcattggtgtctaaggaaacatcatatgaaaaaacgaaagtaactacacaacctcctcctaatagtcataagagcacggagcatgtgacaagtgctacagagaaaacactagatgtaacctcaaataatacattacaaaatgtaacaagtgtgaacacaacaacttcagaagtacttgtatctaaaaatgtttctcagcccctagacattactggtaacaacgcgccataagttgtgaacaacacctcaaa

SEQ ID NO: 5804 - DNA, 329 bp, Diabrotica virgifera
  Clone ID: LIB150-016-Q1-E1-E5
taaatcgcgagcggctgccctttttttttttttttgacaattgccttttttatttataggtacattacagaaataatgtgaatagatacgaattctacaacataatacaattattattctaaaataaacaagacaaacttttgaaaccaactatcgtgaaatacgaacatccatttttgaaaaaataacaattccttctgtacaatcataaataacgtagaatattttagtgattccttattttatttttactaaataaatacttttacttgtaaaaaagaaaaaactaggataagtgaaaccaaattgtataaaagaagaaaccaaag

SEQ ID NO: 5805 - DNA, 109 bp, Diabrotica virgifera
  Clone ID: LIB150-016-Q1-E1-E6
aaaataacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaa

SEQ ID NO: 5806 - DNA, 438 bp, Diabrotica virgifera
  Clone ID: LIB150-016-Q1-E1-E8
atcgcaaaaccgttcagcctaatacatctgagtcttttgaactcacagctcaattccaatctaccgttttggaagttatcaacacaagcaagactgaagatgcagtttttaaagctgaaggaggagatgttattgaagatcttgaggatttagttagaaatattgatgaaaaacaagaaactgctcttcctcttattccaacaaatttggagagcttcaatttagcctcacgttcatccgtcactgctttgatgtatgatcctaatgatgttaccctttccaaatctcttaaattcactgttaccatcaacggaaaatctgacatagaagttgaggtgatatacactgagatcgatgaccgtgccaatgatcaatacaaggtagttaaaccaaatgaaactgtagaaattgagcataagaaagacgctggggtaactc

SEQ ID NO: 5807 - DNA, 442 bp, Diabrotica virgifera
  Clone ID: LIB150-016-Q1-E1-F1
caaacgcgtccgcccacgcgtccgttcaggtcggcgttacaagtagttaaatgctacaataagagaaaacttgtgttagaccagtgtctgattgaagagatgttaatagaaagccaaatttaaaaattttttataaaattttttgaaataaaggtttgcaactgttgacatttcagaatattggtatatacaaagtcaaacctatgagtaaaaatgctcataggcatgtatgtgcaaatgggtgcatacagtttgaatttgttgagaataaaaattttaaccattaaaaaacaaaaacaaaataaacaaaaactgacttaaatatgcttcaaaattcaaagtagtaataataaaagagatagtaataatgttccaatctacttacatgccgttacaaggattgcgttgcaacttagttgttgtcatattagtacgtccaaat

SEQ ID NO: 5808 - DNA, 449 bp, Diabrotica virgifera
  Clone ID: LIB150-016-Q1-E1-F6
cacacgcgtccgggagaatatcgtcttgaagatcaaatgaacactaaccaaatcttgaaccaaatctacagacaacaacttggacaatctccattgtaccgttatttggtaatcatgagacttgtcaatggacaacaagtatacgaagttcctgaagaattcgttaacattcaacttctcgaacaacttaccgctcaacaagatatgatcaaccaaagatgggctcaagtgatggaaagaagacaaccaatcactgaagacgttcactctcagcaacatctgattaaccaacagatcgaaaaacgtattgatcaattagcttaccatcaaaatctcattacacgtgaagttgaacaatacattgttaaacgacaagtagttccccagcaacttgtttaccaacagagattggcttaccaacaagttcatgaagtacttgaacgtctata

SEQ ID NO: 5809 - DNA, 412 bp, Diabrotica virgifera
  Clone ID: LIB150-016-Q1-E1-F7
aatcaagtaacgaaaaggtttgtactgtctgggcaggttcatgatgcgaataagaactggattaatgatataaccgatatgattaacgactatctgcatctaatttgaccttttagtgttaataatgttacttaagaccttctacaaggaaaattacaggctctgtacagtggagtgcttgctatagtccgttcgctaaactcaactggccagtgattttagtacgtaatctttttgtttttggccaattttgctaaaattggcaacattactaactatttagtaattatttttttgccaaattggcaaaattacatactaaaatcactatccaattgtgtctgagtttagcgaaccgactataagagtcgaaattttactgaaatttgtagtggtgcatttttcgtcaatg

SEQ ID NO: 5810 - DNA, 439 bp, Diabrotica virgifera
  Clone ID: LIB150-016-Q1-E1-F8
gaggcgatcgttttgttaatttgtgcgacgtttgctgaaaatgctatttaccttggcaggggttatgatggagctgaagatccattaaaccttagaatcacaaaactgttggatgttaatttggaaagcaaaccaagttcttggaaaagtgacctaagtacgtactatcaacctcatagagaagaaaataatgatattgacacaaaggatggttatgtccaggttcccatgaaattttcattcgcagtcgacgaacaacgcaatcataatattttggaagggtgtagaaatttagttggagtaagccagccatctttaagtattctaaagtcgtcatcggcagctgcagaaaagtacatcgcatatcccacaagttgtatagagattcaagaaattggtaataataaatctggaatatatgagattaagcccaggacta

SEQ ID NO: 5811 - DNA, 440 bp, Diabrotica virgifera
  unsure (1)..(440): unsure at all n locations
  Clone ID: LIB150-016-Q1-E1-G11
cacagaagtcgctattatcaccgccaagggtggaagagtagttagagacattgaaagaaaaatcaaacaacttatatctgatgaaaaatcaataatgttggtaaacaattaccatctagcacctgcatcatccgtagttgtcatgcatcaagttggtagatatagccgaagacccatgtacccagctggacatcgcaaactccaacatgttgtagttcgtagacttaaacaccaccctggacatacatcaaggagttctggaaggtaaaccagcagcaccccgtccttctaaacaatcaggtaccccagcaggttcaggacgtcgtcaattccgtcgtcaatcttgtaggccattgatacggccagcccatctttctagtcaaggtggtcaacatccagcacaacanactcaagaacagcaccgtccagctcaacaacag

SEQ ID NO: 5812 - DNA, 279 bp, Diabrotica virgifera
  Clone ID: LIB150-016-Q1-E1-G12
tcttccccgtaattaacacgtttcttcaactacatatctccatgaagagtccaattttactacacaaagtgcgtgtacacaattagtaattggtcgtaagtgactgtaagctagacctcaaattgtcagcgaggaacatttttaagtatgcattataagtgtgagatcatttagccccgcccgtattagtgacgtcgccgttgagccgacggcatagataacgtattctaaatcgtattgcattgtcaatattctaaactggtcattagcacatgtggc

SEQ ID NO: 5813 - DNA, 446 bp, Diabrotica virgifera
  Clone ID: LIB150-016-Q1-E1-G2
gtccgcacacgcgaccgcccacgcgtccgcaaatatatccaagaactagatccgaataaatccgggttctggaaagtatctaaaatattaagaaacgaaagaaaaccaataccagccctacacggagcaaatggaatagtatacacagaaaaagaaaaggcagaagtcatgaaagataccctagaactaggaagcacaaagaactttcatcaggaagaagacctagacttcacaatagaagtagaaaacaacgctagaaggttaagaagaagaaagggaagaatagctctagaacacacgtctcctgaagaaattaaagaactactaaaaatggcaaacgcaaaaaaagccccaggggcctgacaatattacaaacaaggcattaaaaaacctgccaacaaaaataatagtttacatcacgaacattgtatactaagactaagata

SEQ ID NO: 5814 - DNA, 459 bp, Diabrotica virgifera
  unsure (1)..(459): unsure at all n locations
  Clone ID: LIB150-016-Q1-E1-G5
ccgggtccacccacgcatccgcagacgcgtgggcagcgtcagcaatgaaatacttttacttgacatacgtcttgatcacttacttctactatataaatgccgaagagtctccaagtctagcagctcttgcaccaaaatgtgaatgcggggacatcattgacaagattctgtgccaattgacagaaaactctaaagaaattctcacactccaggtaaaactagtgtcaattagaaaagaatcaacagaacttcaaaacaacgtagctgagaacacgtgtctggttaactcgatcgaagcagacgtcacagtcattgaacaacancagaaccaaactgtgaccgttgtcaataaccatacagctatcatcgtcgacattgagacaaacctagaagtcatcatccaggaacagaatgtactcgagaccaatatcgaggcaaacagttgcacacttgccgata

SEQ ID NO: 5815 - DNA, 77 bp, Diabrotica virgifera
  Clone ID: LIB150-016-Q1-E1-G6
aaaacacatgggaagcgtacaagcaataaaatacatttacatgaaataaaatcatgatcacatacatcaacaaaaat

SEQ ID NO: 5816 - DNA, 447 bp, Diabrotica virgifera
  unsure (1)..(447): unsure at all n locations
  Clone ID: LIB150-016-Q1-E1-G7
caaacgcgtccgtggaaaacttttctttaagcccaagaactgctgtcactgttttgagtcaaaatgttgaaggaagcaatgaacatcctggaaagtatactgtaactaaccttggaaaagctgctttcgatattgagttgaagcgtacctcacccgttcaaactctagagctccatcgcaaaaccgttcagcctaatacatctgagtcttttgaactcacagctcaattccaatctaccgttttggaagttatcaacacaagccagactgaagatgcagtttttagagctgaatgacgagatgttattgaagatcttgaggatttgattagaaatattgatgagacagaagaaactggtgttactcatattctaacaaatttagagagcttgcatttgaactcacgttcatccgtcnctgctttgatgtatgattctaaggatgata

SEQ ID NO: 5817 - DNA, 251 bp, Diabrotica virgifera
  Clone ID: LIB150-016-Q1-E1-H1
tatgtttcgtccagatcctcattaaaatacatataaaaatggcttttggagatttaaaaacagaaaagggagttaaggagctcaactccttcctagaagacaaaagcaatgttggaggctaaacctaaagcaaagccgatgtaaaggctttcaacaagcttcaaaaagctcaacctgcaatttaacccaaggcttaacttgggaaaatccaaatcaatccttcccaactgagaaacctaaacaaggccgaa

SEQ ID NO: 5818 - DNA, 275 bp, Diabrotica virgifera
  Clone ID: LIB150-016-Q1-E1-H9
tcgtaattctcaggaagttagcaggcattaatatgcagtggttacgacgacatatgaggcatacgattatgaaaccacgttctctgtctcggatacatcgaggctagatgatttcgttttagctccgagaactacgatcttagcattgtcacagatcggctgtcatatggaatatggaaagaggtatgtcgtcaccaatcacggaaacagtgatctttatgttgaggtagtacatctcaatatccagggatggtgctccaacaatggtttgtggt

SEQ ID NO: 5819 - DNA, 447 bp, Diabrotica virgifera
  Clone ID: LIB150-017-Q1-E1-A11
gtccggaacgatacaagctcttcatctggccaggaatttctattcagcaggagcacgagtggtcgtttgtgaagtagaaggacatttcgctttagccaaatattccacagcagtcagtaagttctatacagttcctaaacctactagcgataagcaacagaactatgttagagccctttgtgagatagttgacaaagagcaagcagtgtatttcatcccggttgctgctacaactcctgcttactacgatgctgtggctaaacctcatttagaacttttgggttgttcttgcttttgtccaggtatcagagaagtttgggttcttgatgacactttggaagtattaaaacggtgtcaaaagaaccagattacaacaccaatatatcatgtagtgacctcacgagatgatgttttaaaattgtacgataccggcgctataagaagggg

SEQ ID NO: 5820 - DNA, 458 bp, Diabrotica virgifera
  unsure (1)..(458): unsure at all n locations
  Clone ID: LIB150-017-Q1-E1-A2
cggggccacgcacgcgtccggaacattatataattaataagaataacatcttcatttaagaataacttttattttcgtatttatgtaatcttttaatacaaatgtaacacccaggaaacgcaaagaatgtctatcaatagtcaatttgctagtagaagtttgagacagcatttaaacttgaacccaaacactcctaggaaaaacgaggattatgcagcgaagggtgaagataccatgcatggatgtaatgtacgggatgaggtgttggccaaatattgggaagatggcaagtattacaatgccacagtaatctcagttactcctcgaacatttgctgttcgggttacaggatatggaaatatcaaggagatattaaaactgattgtttacaagtaccgcanaacaatgcgagaccaagcagtaatcaagatcagcaatatgaatataatagacaatac

SEQ ID NO: 5821 - DNA, 442 bp, Diabrotica virgifera
  Clone ID: LIB150-017-Q1-E1-A6
tcaagatcgcgagccgccgccctttttttttttttttagtcgttttattctctttgcagaaatatcttcaactatctttacatggttcattgctaaaataacagacataaatacctaaaaaatgaaaaatcttattttctttctgtacgcgattctggtgcccagtttaaacgctatccccgtagatgtcatccagagaaatattccagtggaagtgaggtatgaccagatcctcccgggaattgtatccagggagcaagttctaatgcacggaagaaggaacttagatgcaaaggtgcaattatcttcagacgaactgcctcaggtattgaaacatttaccgattccacttgaatctgatctcgttcctgaaattgttagcgatgaaaaagttcaggtgtcatcagaagttgaaaacaatgcagttaaatctttaattcaa

SEQ ID NO: 5822 - DNA, 420 bp, Diabrotica virgifera
  Clone ID: LIB150-017-Q1-E1-A7
atctcaaattcaaaattaaaccaaatttgtaacttttattaagcctcattattatattttataattttaatgcaataatggacatttcaaagagatctagacagtggaaatgttttgatttcggtccaccaacaaaaaaagttgatttttcacctaaagaacaaattaaagaaaattacgagcccaaaataagtagcagtagaaaaaatatcccagtgactggaaagaaatgctttaattttcatgaacaacttgcaccacaagccattagtgagcttgctgtacatcctaaaaagatacaagaagtcgaagattggtttaatagatttgttttggacaaaaagaagaatgtttttactcctccactgttactcccaagacctaacggttcgggaaagacttcaacgattaatggtaaaa

SEQ ID NO: 5823 - DNA, 440 bp, Diabrotica virgifera
  unsure (1)..(440): unsure at all n locations
  Clone ID: LIB150-017-Q1-E1-A8
cacacgcgtccgatttttattgttaatttagaaattttttgcacctccaagatgcctattgcagcaaccatgttgtctgatatggacgagcttcccaccatcaaattaggtgactacactcttcagctagaattagatgagctcaagccagaagttcaagagattgccaagaaggaacttagggaaacccctgatgtgaaaaaggcagggatagtggctctaagggatctactaagagaggaaaaagaccttaaagtacctctagaaaacgacctttggcttacaaggtatttgaggccttgtaagtactacccagaaagtgcctgcgatctgatcaagagatattacantttcaaatttacaaactccggtgtatacgatggattgatgcccagtaaagaaaagaatatttttgaacaaaatattctaacagtacaacc

SEQ ID NO: 5824 - DNA, 444 bp, Diabrotica virgifera
  Clone ID: LIB150-017-Q1-E1-B1
aatttcttcattttcattgtgacttaaattcgaatgtgggatattttctccgcagtatttacgtagaagaactacacgccaaggacgaccatggcatcgtctactccaaccatcgtgggggaaataagtgcaactgatgaagtttctcaatacaaggtagaaaagatagttctcgatggtgatttgctttcttcaagccttcctcaattggaaatgtctgtcagtggtaatagtaatccagcaagcagctattcggctagaaaaacctcgtccgttttagcttctaaaaaagaagtcaccccacgaaaaaaatctgctgtaaagaaaccaacagtgtcatctagtattccgctgccggttattaagccagccaaggcaactccttcagccaaactatcaagtcagactgtcaaatctaacaccggtaaactttccaagccaaat

SEQ ID NO: 5825 - DNA, 458 bp, Diabrotica virgifera
  Clone ID: LIB150-017-Q1-E1-B10
gggcccccaacccttcggcaaaattggcccaattaccatggaatgggtcaaccaattaaccccaatttggggccggcgcaaccaagttgcggtcagccccaaccgaggaaaaaaaagatttcgcaacggttttgttggaaaaagcagctgcacttgccgaagcaatggccaagagaatcgaagagagcggagtcatcgacaaagcattagctggtgctcaagcagttggcaagaaaattgaagaaactggagttatcgacagagctctagctggagcagatgctcttgccaaaagagttgaacaaactggaatcatggacaaggccaagcaaacagccggacaactttacaagcaagttgaagacactggaatcatcggaaaagctcaagctgaagccggtaggttatataaatcaatcgacgataccggtgttctaaaccaggctaaagagcaagct

SEQ ID NO: 5826 - DNA, 424 bp, Diabrotica virgifera
  unsure (1)..(424): unsure at all n locations
  Clone ID: LIB150-017-Q1-E1-B12
acccttccgaaaatacatgccaacctaggtgatctaattaactataattgtgccaatggtggtgctgattttggctgttttgactttgcgtaccacctcaaataatgaaatgtaccaccagtggtacatgtaccagagattgagaaccgctgacctagaccttaagatatataaaattattgttaatttgtccgttaacattttgctatttaataagggccggcgtagctcaggctgtaggatatctgactcgcatgctggtaggccggggttcgaaacccgcgccggcgagaacatctagatatttttaaaaatgtctataggccccaggtcgactcagcctgaataaaattagtaatttgggtaaaaccaagggtaataataagcggttgaagcgtancactgaccctgttacctttcttgt

SEQ ID NO: 5827 - DNA, 267 bp, Diabrotica virgifera
  Clone ID: LIB150-017-Q1-E1-B4
ggtcacgttacaggaggaaaccagaaagtggtccgcagtcaagttgtccaacccaacgaaacccaagagcttcttcttcaaggcgtaaatggatcatctttgaaaattatcaacgaaaacgagactgattacgctatcttctcagctgaaggaggtgaagtaattgatggattcagatatatggtaagaccactacgtcgccgtcccggtgcaagaaaaatgttctatggattttaagtatttaaatagaatacacatgttctgaat

SEQ ID NO: 5828 - DNA, 209 bp, Diabrotica virgifera
  Clone ID: LIB150-017-Q1-E1-B5
acgcgatccgcagatacctgtcgacctaggtgatcgattttcctatatttgcgccattggtggtgcagatttgggctgttttggcattcctaacacctcttacacctgtttgtaccaccaatgtcactttgaccagagtttgagatccggtgtgctcaccgttaagattgattggacgcgggatattgtctctgctaacgtttcgctat

SEQ ID NO: 5829 - DNA, 440 bp, Diabrotica virgifera
  Clone ID: LIB150-017-Q1-E1-B6
cagctccaagatgaaggtactcattcttctttccgttgttgccttgagcagctgcttaccagcatccagaaatcaacaatacgttgatgtagactacaacagctacaacgctcatcccgtctacaacttctggaggacttggaatcagcaacactatggacaagaaccatggaaccaatgggtacaatatggtgtccagaaccaacccggtaactactggaggcagtacgtgcaacgcagcaaccaagctgaaaatgtcgatttaccttggatgtatcactcttgggatgtccaggatgtgcaaaacttaactcccgttcaacgtgttcagttgctactcaactacgtcagacttcaccaacaatggaaccaatggactcatgatgtaactgccaatgaacgtcttcagaatatgttgtatcaacaccttcctgaacact

SEQ ID NO: 5830 - DNA, 439 bp, Diabrotica virgifera
  Clone ID: LIB150-017-Q1-E1-B8
aacaaatcgtgaaaaacatatctctatgcagaatttaattgcggtgaatttttatttgggtgtttttgttgtaaagttaaaatcttcggagttatagagcaataattgaaaaaaatacgatttgtcggcgccattttgtttataaaaaaagtagcacactatctgcggactttgcatgcctatattattaatatataggatcttataattcgattccagcaatggagttgctggtgaataacttttccatgaattttgctaattagcccagagtatagatattctaccttttttgccttattgttattctagctgcgcctctctgtcaacgctgtgtatacgtttttcgtctgatgggttcgacagataataaattctttttttttgtttgtttctttcagtgctctttcgcattcttcgtctgaccattttggtattt

SEQ ID NO: 5831 - DNA, 436 bp, Diabrotica virgifera
  Clone ID: LIB150-017-Q1-E1-C10
gatttttgcacgaaaatcacttccggaaaattaagaatgaaacctttgataacgctctggttcttagtccttgtagcagtggcgataaacgccgaggccaaggagaagaaaagcgcagaagccgatgacaagaaacagaagaaacgtggtctcctcagcttaggatacggatatggtggagattttgataatggttaccacttaggacaaggtggatacggtattgacggtggttacacactaggattaggccagctagacttaggacacactacttctattgagaagaccattactttggttaaaggagtaccagtaccatacccagtagagagacacatcccttacccagttaccaaacacgtaccttacccagtaaaggttcttgtaccacaaccatacccagtagagaaaccagtagcctacccagttaaag

SEQ ID NO: 5832 - DNA, 441 bp, Diabrotica virgifera
  Clone ID: LIB150-017-Q1-E1-C5
cagacgcgtgggctttggacatgcttggtccttgaaactaaaaattttatttatcagatttgatttttcaaacatttgtttcaattaataccgtgaaaatgaactgtaaagtgatttgtgtggtgcttagcggattgtttctgtttgaagctgccctcgctagtcctgttgtcgatgattctacaaataatcatattaattcggttcatccagaaaaatcaacaattgaagaatcacttttcaagaaactcaacgtgaaatgttccaatcaagatatcagttcctgcatgatgctgaagttggtaaactatttcaacaagctactaaagaagtcgtatattgaactaagtgacattgaaatcacacagacctccactgaaaccgttaacgtaaagtcgtccagaggtttaaatgaagttgagaaaatgggagaagaagaac

SEQ ID NO: 5833 - DNA, 437 bp, Diabrotica virgifera
  Clone ID: LIB150-017-Q1-E1-D11
tatgtcgtcaagaatcacggaaaagctgatctttttgttgaggtaatacatctcaataaccaagatgatgctccacaatggtttgtagtccagccagaccaaaccactgagatagatattgaggacaatcttgaacaaagcgtgttgaaagtaagcaacaacagttacgaacaggaagtatcattttctgctaaaggtggtcacgttattgacgacttggaaaacaacatggaagaacttcttgactcagacgaaacagaaactgaaatggtcgttctggaaaacttttctttaagcccaagaactgctgtcactgttttgagtcaaaatgttgaaggaagcaatgaacatcctggaaagtatactgtaactaaccttggaaaagctgctttcgatattgagttgaagcgtacctcacccgttcaaactctagagct

SEQ ID NO: 5834 - DNA, 429 bp, Diabrotica virgifera
  unsure (1)..(429): unsure at all n locations
  Clone ID: LIB150-017-Q1-E1-D12
gggcccaccaaccctccggtataagttgagaattggttaaccgggaacaacaatacaatccaaccccaaataacaaccaagccaaattgggaaaggaaaaagcaaggttggaaacaatcctccggtttaatcctttaacaactggaataaaaacgggaagttggttaaattttgcccggtggccaagccggtgaatggtttggaaccaaaagccaaaagtcagcgaagaagaaacagggattctttgctctgaagattaantttgaggtaattttggctaaagtaatttgcctggtgcaagnntgctgttaaatttggaaaattgctagnnntgctttccgccaactaactcaacagnnaatgaagaacggggcgttcaaatcaaagttaagaaagaaaatggcaaagaaaagtcctacaaacgaatag

SEQ ID NO: 5835 - DNA, 451 bp, Diabrotica virgifera
  Clone ID: LIB150-017-Q1-E1-D2
aatcaatatgaagttcttcattctcctttcgctggttgctctttgcagctgttcaccagctcatcaaaagcaaaacaaatatgaacaatcaaagaacgctgttcaaggaaataatccttacaacaccttttggaagacatatagccaacagcgtcaaggagaagaaccatggaaccagtgggctcaatatggccaagacaatcaagctggtaattactggagacaatacgtacaaggcaaaaaccaagttggcggtgctactgtaccctggatctaccattactgggataaccaggattacgaaaacttgagccctgcacaacgtgtccaacttgttcttaattatatgcaagttcaccaacagtggaaccaattgaactctgatgtaaacaatgaagattatttgcaccagctgatgtaccaacatcttcctgaatacgtacaatataac

SEQ ID NO: 5836 - DNA, 431 bp, Diabrotica virgifera
  Clone ID: LIB150-017-Q1-E1-D3
ggtcgacgacgcgtccgcaaacgcatccgcccacgcgtccggctaatcttatatttcgaacgtaacatctcaaccggctcaatctcagtgtaaattagtcggtctggaaaacaataaatccaaacaacaaaagcggcaaaaatccgtgtcaagtattttatcaacaactgaacaatgtcactgcttgcaaacgctttcatctgtgctacagacattaacagcacaaattatgacgattcctatcaggaaatagttaaagacttagtgccagactgggtttgtgctctggaatatgttccctggtgctgggccatctttggatctctccttgttggacttagcggggttttgcctctccttgtcatacccattgatcattcggagaacttgaaacaaggagatggtgccaataaacttaagactctattgag

SEQ ID NO: 5837 - DNA, 393 bp, Diabrotica virgifera
  unsure (1)..(393): unsure at all n locations
  Clone ID: LIB150-017-Q1-E1-D4
agccatctcgacctcctcaaaaacccctgaatagaaaccgctatatgacagtggaccatattatcagttgtcttaagtgctgttgcagttctaacagttagtgccataactgcagatgagtgtaggaaatgcttcgataaagcatcaaacttgcaaccgctatagaaaatacaacaggcgtattgggcatatggaaaagatgtcgacggagggcatttgacagaagttttcacgatactagatcgactatgatacaagaaagacgataattactcagagtgcgatctgctttgggcccacgattatccctttacggaacttangtcgcaattagacaatctgaaacctcatcanaaagttaaccatttgccgggaatcggtcacataacatac

SEQ ID NO: 5838 - DNA, 449 bp, Diabrotica virgifera
  Clone ID: LIB150-017-Q1-E1-D6
gagaggataggctaccaaaaagagcactcaatgctagaatgcagggaaagagaccggttggaaagccaagaaagcgctgggaagacacagtaaacagcgacgcacaagcccttttaggagtccgtgtatggagaagagcagccacagacaagcaagggtggaggcaaaaaataaaggaggccaaggctcaatttggactaaagtgccgtagaagaagaagaagaaaaatacagagagttcaagttgaaaaatcttcaaaattgattttttgcattttgcatcaaatttgatttttgaacatgttccactaattctaaataaaaataaacttcatattccggattcagcgacttcgaaaccaaaaaaataccaaaatttgccattcacctatcatggtggctctttcgatttctaagcctcaaattaggggtgtgcctctcgcctacaca

SEQ ID NO: 5839 - DNA, 437 bp, Diabrotica virgifera
  Clone ID: LIB150-017-Q1-E1-D8
gacgtgtctggtccttcatttgaaaacatggccaatctctttaacgttattgttgctcaagcgtccgaaaatttaacagaaaatgccaaaaatgctactcaaaagactcctagtacaccagaatgaacggccgttgcatatattagtttaattgtaatggccttacttccaatattctttggatcttttagatctgtgtcctaccataaggataatgtagtagaaaagatgaccaaaagagatgcagcagtagttccaattgtagcttcatgttcgctttttggactctacatagtatgtacattattttcattgaatatataggtcttttgttagcaggaaagttctttttctaggatgtcttagctctaactcatttattaagcgctgttgtaagtaaattatggccagcagcaataccaaacattccatttcat

SEQ ID NO: 5840 - DNA, 336 bp, Diabrotica virgifera
  Clone ID: LIB150-017-Q1-E1-E1
gtccggattcgaaatcgttcacatatattcgtcataacagttcttatcacccatacaggtatccatcagacggatgcttttgtgctactggtctattattgtggagacagacactatccacattctagtcccgattatcaaagtattgatctacagaatggtgtcgttgtcggtggtccacatacacacggttccgataacggcaatgatgggcacgataatgagactacaataggtggaccagatgatggtaccgataaacgtggactatacatcaatgtaaacgggtgcatgtatactggacaaacacgtaatgcctgcaacagtattagtcat

SEQ ID NO: 5841 - DNA, 433 bp, Diabrotica virgifera
  Clone ID: LIB150-017-Q1-E1-E12
gggaagcacagtcttcttcaacaatgagttcggtgcgggtatggaaacaggagccggcctcgccgtcgtcagactatgacaaggccgctcttctcaacgccactatctatattgcgaccccatttgaattagacatcaaactcaacaatgaactcgacaatctggcagaattcgagtcgaaggcggaagtcgcttcccacatactcgagggtctggagaatcttatggatctagatgaactgatcaaagatgaacccttccttctcgatgaaaaaatactaccaatcctggacgaagtggaacctccgcgtgccattccagtacctgttcaaaacttgaagaatgagtttgtcaactccaatgacacccaatatttcctcaaggaattccagaacgtgtacgaagtcgtggaattctcccatggcacgctcac

SEQ ID NO: 5842 - DNA, 273 bp, Diabrotica virgifera
  Clone ID: LIB150-017-Q1-E1-E2
gaatatatgaaataaatagtcattaaaaatgtggtatatacctactcaaaatcatttaaaaaagtaaattgtattcaacccattattaatatacctagaatatttgaatgatttagtcccatatatacacatgaaagaatctccttctgctttaattaagtattagtaatgctattctactgcatatatttaattgcaattatattctatgatttttgtaactctacaggtatctaccacatttttaaagaatatatgaaataaatagtcatt

SEQ ID NO: 5843 - DNA, 443 bp, Diabrotica virgifera
  Clone ID: LIB150-017-Q1-E1-E3
ggtaatttaaattttttggaaaaaatggaggaataaaaaaaaaacaacaagtggattaaaaagttacggtaaaattttttggaaaatttggataaaaattaaggtaaataatttggaaaatggaaccaattaagaagtaaaacaagtagttgtattttttgcatgtattcctatagatcaacagtttttttacagaataatcgttttttgtgatttattgatttggtcatttgattagatgtgtgatgttgttggtatggtccgtgtatgagcttagccccgtatagtctgtgtgagagtagtcccttgtttttccagcgaagcctatctctgttggtgtatgtcatgccacaggttagttggagaagtcatcccattgagaagtcatccccttgagaagtggccccgtgaagaagtgaagagggaaaccgtggagaagcccc

SEQ ID NO: 5844 - DNA, 442 bp, Diabrotica virgifera
  Clone ID: LIB150-017-Q1-E1-E7
cacacgcgtccgcccacgcgtccgcaatatttatgttatggaaatttcctaatataatatatgcttttacaacacatcaacaagtcatgagcttcattacatcgggtgctgatcttatgctagcaggcgttgtaaccccacatcccagtactaatttgccgaaatatggaaatgttctagagaatgaagtagtttatgtaaatttatctaacaatagggcagctgtagcagttggtgtggcaagtcaaagttctggagccatgaatttagcaaattgtagaggaaaatgtgtaaatatatatcatttttatggcgaccatctttgtactgttgaaggtttgcctaatttaccaatagcaacacttggttctcctacatggcttcggatggatagttatgataatgatttcccagctctgggcggcccaacaaaaacccattc

SEQ ID NO: 5845 - DNA, 321 bp, Diabrotica virgifera
  Clone ID: LIB150-017-Q1-E1-E8
cacgcatccgcagacgcgtccgcccacgcgtccgcaatatttatgttatggaaatttcgtaatggaatatatgcatttacaacacatcgacatgtcatgagcttcattacatcgcgtgctgatcttacactaggaggcgttgttgtctcacatctgagtagcagtttgccgagttatggaaatgttctagagactgagctcatttaagtaaatttatctattaatcgggcagctgtctcacttggtgtggcaactgaaagttcaggagtcatgaatttaggcatgttgtgcatgaaaatgtgtaaatatatatcattttta

SEQ ID NO: 5846 - DNA, 437 bp, Diabrotica virgifera
  Clone ID: LIB150-017-Q1-E1-E9
gaaagagcaaggtggtcgtgttcactaatcaatagttaaatttcaagttttgtattaaaaaaaagcaattgttagcatcatggaaggagaagcagcggccgagactaaagttgaatcaaccaacgaaaatacacaagaaaaaccaaataatttcaatcggggcgaacgccgtggaggcggtcatcaaagaggtggaagattcggacgaggtggccagaaccatggtggaaaccagcattttgaaaatagacgaggtagaggcaattatggaggtgttaatagaaaccacgcaaacaaagatgaaaacaatggtaatgacaatcgccaagaaggcgacggaaatcgccctggtggaagggatcgtgagggccgtgatgatcaaagaggagataatatgggacgaggacgaatgggaggacgcatgggacgcggtgctg

SEQ ID NO: 5847 - DNA, 439 bp, Diabrotica virgifera
  Clone ID: LIB150-017-Q1-E1-F11
cacacgcgtccgcacaaatttctcataaaattgtgatatcttttctaatacctcttatatcaatgaacttatttttgcaggccaaaatattttcttagaaagtaattttgtatcatctataaaaatttaattttgggaattcaattaaagactttaactggcaaattttaaaatgttaaaggttctagtcacgtatttagtctggacttgcactttatagcacttgtcgcagaaagcatctaacccccaaacacgtatggtgacgtcctatttgcagaaaatgcactataatatacgatagtaattatttattgtcctctttctggtgaaaacaggctttttgtaacatatattttttattgtttgtaataggttaaaatgtacagtagacacttatatttaaaataaatattattttttatctatcaatccttgttgt

SEQ ID NO: 5848 - DNA, 464 bp, Diabrotica virgifera
  unsure (1)..(464): unsure at all n locations
  Clone ID: LIB150-017-Q1-E1-F12
aagggtccaccaacccttcgggacttttaatagtttaaggaccggaggtacttaaaggacctattagacccaaaccacatttgaccacagggaaccatccatggattgactacctaaaattacccgtaaaatgcattggaataccatacgaccctacaaccagaaccaccagaactgacaacaaatgaagatgttaatataaatgcacaggaagttactcgaaaagctgaagaacagagaagctgcaggtaaagacggaataccaaacgaattactgtaatattgtaggaacaatgtcattgaggaacaatgacagaacagttaacagcattacataattattanacacaataaactactagaaaaatggagaacaagcgaaataatattttaaaaactgctatttaaaaaaggaaataaaaaacagccagaaatttacacaggtataaactgctaaatactac

SEQ ID NO: 5849 - DNA, 282 bp, Diabrotica virgifera
  Clone ID: LIB150-017-Q1-E1-F2
ggtcgacgacgcgtccgcagacgcatgggtacagaggggtcaaaacaaattcgaaatgaatggtttttggcggtgggggattgtaggaaccttccaaattgtacctcctgaacagtaaccctgttagtctttcgcgctcaaagagatcctttagtagccaacccaaaggatactggagcaaaaagttgacatggaaaaccgagtgggtaaaagtttggaagcaagagaaaaagctcaagtgggtttccgagtgggagaagaccaaagtactgcatgggaaga

SEQ ID NO: 5850 - DNA, 445 bp, Diabrotica virgifera
  unsure (1)..(445): unsure at all n locations
  Clone ID: LIB150-017-Q1-E1-F3
tatttattaggtaggaattgtcaaaataaaaatcatcaaaaactctagtttggaaaatgggaaggagaagtaggtcaaaatccccttttggttcaaggagacgggatcgcgatagagaaagggataaagaaagggacagagacagggatagggacaaagataaggagagacatangcggaaaagatcgagagatcggtcgcgagacagggaaagaagacgttattccacggaaagggatgatcacaggaagtattcccgttcaagatctagatctcggtctccagtggatagaagacgaaaaaataaagttccggaccgacctttgataaccgcagctgatctggaaggaaagagtgcagaggagcaagaaatgatgaaattaatgggattttgtaatttcgatacaacanaaggtaaaaaagttaatggaaatgacgtgggtga

SEQ ID NO: 5851 - DNA, 438 bp, Diabrotica virgifera
  unsure (1)..(438): unsure at all n locations
  Clone ID: LIB150-017-Q1-E1-F4
cataagctctaaatatcgcaacatgagtttcatcggttcaagcatcctcttggcgctagccctaggtttggccaacgctggttacgaacatggacatcaagacctaggcagccatgatttaggaggcggccatgatctcggaggcggtcatgaactcggaggacaagattacagcggttatgggggtggtcacggcggctggcaaccacatgttcaagaacaccaccaacacataccaactaataccattgagcatacccaagcggttgcagtacctgtagttaagaaagtangagtaccagttccacatccagtangagtaccagtacctcaggtcgtaaaagttccagtacctcaaccttacgccgtacatgtgccagtaccacagcccattgccgtnacaatctacaagctagtacctcaagaaatcgaaaagaa

SEQ ID NO: 5852 - DNA, 413 bp, Diabrotica virgifera
  Clone ID: LIB150-017-Q1-E1-F7
atcagggattattaattaataattatatatttattattttcgaatttaaaagagctaaaaaattaaaatttttattgtaaaataaatattttaaataatttttttgtaatgaaatgtaattcgtttttaaatatatctaagtttttaagaaataaattaaatttatttattaacactatatttataattaaatatttttatattattaatagtaaatatttttagggatgagcttaaaaagaaaattttagtaaaatttaatttttaaatacaaattaggattaaaaattttcatattttaaaatatgtaattatttattttagactattataattttaatttttaataaattttttatgaaaatataaatttaattaatttaaattaagtattgatgataatataagtatta

SEQ ID NO: 5853 - DNA, 382 bp, Diabrotica virgifera
  Clone ID: LIB150-017-Q1-E1-G11
taaaagttcttcccgaaaaacctattgatttaccaatagaggttccagagacacctttcgtgaaatctttattagccccagaaccacttagcgattcgaacactgttctgcaaaaagcagctccaaaacctgcccagaccttagacagtgtcttacaagaaactcagaacatcatcagagttggtcttaagaatttgagagactctttcaaaccaaacaaaggcgaattgggtcccactgctgaacaatgggctacgttggagaaacaagttgacgaatacttctcagaagaaaagcacaaactcgctattagacaatctcaaccagtagaaggtggatctacagcagcaccagtagcccaacagcctcaaaataactgggt

SEQ ID NO: 5854 - DNA, 348 bp, Diabrotica virgifera
  Clone ID: LIB150-017-Q1-E1-G6
tacaaagttaacaacaataaacagaataatttaatttgaaccgatttttttagtgcaaacaagtaattggacttcgtaagtcctaggttttcacccaaagtaatcgtcagtagaactgtaattcgatatttgaactcttcgtgtaactttgcgtcgatggatatacgattttactaagtttgagtcatttttactaaactttgggttatcattgtcacagaaatgacttcaaaaccggaactaaatattgaaactcaacttttcaatacgcttcgattgatgtgttacatgtactatttctgcgactataatggcacttctggttagaaccttttaacgggaatgata

SEQ ID NO: 5855 - DNA, 312 bp, Diabrotica virgifera
  Clone ID: LIB150-017-Q1-E1-G7
cacacgcgtccggggaatattcgtgtttggagctgcaaaaagtactgaggatattttcgaaaaatatttgcagatattatggttgttgtataatattatttattagttgttaagctattacctctgtacctaataaagctatttatgtttctcttttaaaaaaaaaaaaaaaaaaaaaaaaaaaaaaaaaaaaaaaaaaaaaaaaaaaaaaaaaaaaaaaaaaggaaaaagaacaaaaagataaaaaataaaaataaaaataaaagcaaaattaaaaaatcttcaaaaaatataacataaattcaattcaca

SEQ ID NO: 5856 - DNA, 455 bp, Diabrotica virgifera
  Clone ID: LIB150-017-Q1-E1-G8
catccgaacaaacaccgtcttcaagatgaaacgatcccaacaagttaccgtcactaaaaccactacgacatatgaagaatacgaatatgaaaccactttctccgtttcgaagttatcgaaacttgagaatttcgttttacctcctagaactactatcttagcagtgtctcagagcggaggagacaaggaagaagacaaaaagtatgtcgtcacgaatcacggaaaagctgatctttttgttgaggtgatacatctcaataaccaagatgatgctccacaatggtttgtagtccaaccagaccaaaccactgagatagatattgaggacaatcttgaacaaagcgtgttgaaagtgagcaacaacagttacgaacaggaagtgtcattttctgctaaaggtggtcacgttattgacgacttggaaaacaacatggaagaacttcttgactcagatg

SEQ ID NO: 5857 - DNA, 442 bp, Diabrotica virgifera
  Clone ID: LIB150-017-Q1-E1-H1
caaatgtataataaaaacgtaataggtaagaaaaatcttagtttaatgaaaaagaatttcgactcagactcatctacaaatagtactcgtaccgaagatgatgccgaaaaaacttctgtgtctgattctgactgtgatgatacagttatattcaaaaaggctgttagtacggtaagtcctacaaagagatattccttaagaagtagagcttcagtggacaaatcaatatctccgaagaaaacacctgtcaggaaaaaaactgctaaaacgccagtgaagaaggagaagaagactgtttccaaaggaaagaaaattgctaacactggtcaagatttagaaacagcaacaaatgttgaggaagtcagaactgtattacatgagttaaaaccaggtactgccatgaaaggaatgacaacatcacagacgtcagttttggaagatt

SEQ ID NO: 5858 - DNA, 440 bp, Diabrotica virgifera
  Clone ID: LIB150-017-Q1-E1-H10
gtcggcaacattcacctaaaatgaaatattttgttttgttggtaagcattgtcgccattacagcatccgacttacaaggtacagccgtagaccaatgtttatgcagagacgaactcactcaaatctacaatcaactcgtcgaagctaatgccgaattgaatgaggccaacgatgaaatgattcagctggactccgatatggaatacatggacaataggttcgaagcccagaacgaaaatttggaagaactcgaaagtgcacttaccatgcttcgttacatccaactccaaactctacaagagctttccagtcaagaccagattctcaattgcattgtcgtcactgttcaaaacatcgatgtccaggttaaaaatgaaacaacacatgtcaaccagcagacagttgatattgaagcactccagcagctaactaacgagatt

SEQ ID NO: 5859 - DNA, 220 bp, Diabrotica virgifera
  Clone ID: LIB150-017-Q1-E1-H11
tcttcaagaggaaacgatcccatcaagtgaccgtcactaaaagcactacgacatatggggaatacgagtatgacaccactttctccgtttcgaagttaacgaaacttgagaatttcgttttacctccgagaactacgatcgtagcagtgtctcagagtgggggagataacggaggatacaaaggctaagtcgtcaagaatcatcgggaatgggatctttt

SEQ ID NO: 5860 - DNA, 458 bp, Diabrotica virgifera
  Clone ID: LIB150-017-Q1-E1-H12
attccggggccagtcacgagtccgcatgttcttaacacattacgggccaagtcgctcatatatgagagacacacatattttgctatgggctacgtcacattttgaaatacgcgcacgtgtatactttatgaccgtggctatcaatggaccctgagactattctcccgagtaaagcgtggcacgcaatgttttaaatcatgaagggattccttttgattttttacatgtgcttcaggacggctcttccaatcggttattggtattaataccagtaactgcatagacacttcttcaaaagcgtagattctgtttcttgaatggcttaaattcaatcagccttcaataatttcttcaatttggaaacatcacttctaataaaattaatgaggtttactgttcaacatgtcatcgatggtgtcatttagtatactgtcaaacctgtttacttgtgagatttt

SEQ ID NO: 5861 - DNA, 446 bp, Diabrotica virgifera
  Clone ID: LIB150-017-Q1-E1-H2
gtccaccgacccgtccgcaggtataattgaaggtccaccaggtcccccaggacccccaggggccaaaggcgattccggagtgatgggacctccaggaatttccggcctaaacggagaaccaggacttcagggacctccaggtcttccggggtctacaggagacaaaggagataaaggagactacggtgatattgggccgccaggacttatgggacctccaggattgccgggacctcctggttatcctggacagaaaggagagaaaggagaaaaaggagactcgaagtacaaaaaactgagaaggcgacagggagacggcacgggagagttttctaccggagaattgattatgggacctccaggaccacctggtcctccaggagtaccaggcttacagggtcctccaggaatcaagggtgatcgaggtgcagacggactaaagggtg

SEQ ID NO: 5862 - DNA, 205 bp, Diabrotica virgifera
  Clone ID: LIB150-017-Q1-E1-H3
tatacagcacgtgtcggtgaaatcggtgctgttatagtaaaaaacaagcacaatggctcccaaacgtaataatatgattccaaatggccatttccacaaggattggcaacgattcgtcaagacttggtttaaccagcctgcccgtaaaattcgcagaaggaataatcgtattaagaaggctcgtgctattgcccctaagcctgct

SEQ ID NO: 5863 - DNA, 445 bp, Diabrotica virgifera
  Clone ID: LIB150-017-Q1-E1-H4
cacacgcgtccgctcgcgcctggcgtcagcccacgcgtccggttattgtgaaatcattcattattcgagaatgaatcctctaaaaggtttggtgtttttcctttaagttttgagcgataaaaatcccatgttattattggtctgcattttgaaagatccttgagttgtagttgacgattggtcaatagttttggccgaacgatcgagaagaaatgcatcgtttggacgcgagagagacgtgacgatgtaaagttagttctaaaagtacatcagctctgtaagcatctttttgttagaactcaaaaagtcgcactttgccggccaaaatggttttcttcttatagtaaaagaactaatggatttctaacatgtcaaggaatataatgacaatagtttcacggcattttaatggatatattattgtgaaacagttctattgttatgc

SEQ ID NO: 5864 - DNA, 439 bp, Diabrotica virgifera
  Clone ID: LIB150-017-Q1-E1-H7
cacacgcgtccgacaaaatacaatatgtatataaaaaggaatatgcatcctcgtctaacctgcgattctgagaaacgtgtttagctatttttagctcgtcagaaagaatttacttgaaggacgaggtaaagagaatatccttttgtatgttggttaattttctataagctataatctataaatttattgcatcgttttatgtttctacttaatatttaaggactaactcttgaaaaatttaaaaataaatcaaataataaccgtcagctattagtaaagaaaaagtggaaactgaaaaaaatatattatgaagaaacttagtatttggcaggatagcctttgtttttaacacagattcgagattctgcgaggcaaatagtttacgagaggagccaaatattccggtggaataactctaaaccagttttgaataatgggt

SEQ ID NO: 5865 - DNA, 431 bp, Diabrotica virgifera
  unsure (1)..(431): unsure at all n locations
  Clone ID: LIB150-018-Q1-E1-A2
gatagaaaatgaagtacttagtgttagttagtgtaatttttttattatccgacgtcaggaccgaaacgacgcccgtgtatggtggattgcagattttgacgaaggtgtttcggcagtatttgaagagtcagccagatgatgtcaaattgggagatggcgttcatattgtcagcgtcaagagtgaaaacgatgcgagggctagtgtggatgatggaaccgtcttaggggtcattgaacattaccttgaaaatcatgagttgagaattcgactgccggaactgatgccgggtgaacgatttggtanagcgtttaagacggcgatggaagaagtggatgccaaagatgaaagtactggaacaggcaaacgaggaaaatgtggtggacgaatgggaggagtcatgatcatcggtctaatgatgggcaaactacta

SEQ ID NO: 5866 - DNA, 267 bp, Diabrotica virgifera
  unsure (1)..(267): unsure at all n locations
  Clone ID: LIB150-018-Q1-E1-A4
ggagcagttcatacttttgatttcttacgatgtgaccaaaatattgtgttttccgttcttttattaaaagcataagctctatttccttgtttattctccgcaagacttctgagaatattctgagcattttacggtaacaccagaattcgaatgcttggattcttttttgtgctgcttctgtcattgttcaggctttaacacaatagagtacttaagtattctagttctcnaatgagataccctgggctggcagttggcanntagaac

SEQ ID NO: 5867 - DNA, 216 bp, Diabrotica virgifera
  unsure (1)..(216): unsure at all n locations
  Clone ID: LIB150-018-Q1-E1-A6
ttttatattattaataattaaatattttgagangatgactattaaaaataaaattttattaaaatttaatttttaaataaaaattaggattaaaaattttcatattttaaaatagnttattatttatttttatatattattatttttattttttataaattttttattaaaatataaatttaaattatttaaaatttagtaatgtagtaataatat

SEQ ID NO: 5868 - DNA, 200 bp, Diabrotica virgifera
  Clone ID: LIB150-018-Q1-E1-A7
aagctgcattacactaatctgaacgtcgtcgtaattttgtttcatttgtgggtaaagttaaaactcatcaacaaatgctaatgtatccatcagtggcaaccggagtcaatagtaagcgcgggattgcgcgaaatgacaactgagaatcatcaaaacgttgggagaataatttcaaattctcataactggtgcggaaatgt

SEQ ID NO: 5869 - DNA, 440 bp, Diabrotica virgifera
  Clone ID: LIB150-018-Q1-E1-B10
cagacgcgtggggacctttcatccacttctgccaagaaggtgagacaggagctagaggagaaactagaaacaaatctacaatctagaaagaaagaaattgacgatttggtaatggaattcgtcagttcaaagcaggacaagaagaagggcggtaagaagaaggcagaatctgaggaagaggaggaggaggaagaagaagaagaggaagaggaaccttctgaagatgagaaaaagaaaaaacgcgccttctttgctgctggcttcttaccagtggaggcaaagaaaacatcagaagatgaatctgccaacgaacagagcgatggcgattctgaagaagaatattcacccaaaaaggcaaaaccagtcaagacacgcaaacttccccccaagaagaagaacggttccgaatctgactcagatgaagactggggcaaaaagaa

SEQ ID NO: 5870 - DNA, 451 bp, Diabrotica virgifera
  Clone ID: LIB150-018-Q1-E1-B2
gtcgacggacccgtcgcacatgaaaagcattgcacaagcttttgcagatagccaacggtaaatacacaccaattggcaatgctcagaaagtctctacatctgtacgtaaatctgaaacattcggtcaataagaatcatgagttcgctattgttcttctgaatgaacatactgccacatgggcactacctttcactagtgagttgagagtagttctgattgtattgacatgatgacacagtgtgaagttgactatacatttagcatggatttagtttttgaagaaattttaccccacatttagatacctcaggatgaaatcgctccaccttatataattcgtactataatatgttacgggagatcatacacaataccagaaattaaattctcagattaaatgtgtgaaattgttggacaatccgtgttttaactgtgacgtactgatgaccc

SEQ ID NO: 5871 - DNA, 428 bp, Diabrotica virgifera
  Clone ID: LIB150-018-Q1-E1-B4
cagacgcatgggccgtcgtagcttgttctgtaattttgggaggattcttgctagcttctgcctacgtctcagctaatgcttcatgcaggcagttggagcatgaacttgagctcctcagcgaagctgcagacaggtttcagtccccattgcaacccgaagcgcttatccaagacccaccatcatccgtcaacgccaaacgtcaagtagaaactctcaatgttgaagagcaatcacctaccacaaaagaactaaccaaccatatcgacgatgactcctcctcttcttcgtcggagagcgagtcgaccgattccgaagatcttcctaccaaagaacccaaaggtgccaaagttccagtccagatggatatggaagagctgatttctcatttactcgagaaaaacaaaaatcaaaaatgaactgcgtagtgg

SEQ ID NO: 5872 - DNA, 371 bp, Diabrotica virgifera
  unsure (1)..(371): unsure at all n locations
  Clone ID: LIB150-018-Q1-E1-B5
aatatttttttttatttctattttttatttattaataatttaaagtagtttacgtttaattataaccaaaatattttaaaactaaaaaaactaatttaaaattcaatgtaaaagtataataaatttattttcttctttcgaccctacatctaattttaatttaacaataaacgtattagnaacagtattagatctattaattattccatctagatttgtataatcccctcgccttataattatttagtaatagacattattataacattacatagataaatttaaatgttttaaggtcaaattataaatcccgatgaagaacattaatttttatctcactagttaaattaattttatttaataatttgctt

SEQ ID NO: 5873 - DNA, 427 bp, Diabrotica virgifera
  Clone ID: LIB150-018-Q1-E1-B6
tatttcctgtgctcctgttgatgttctactcataatattaatatcatcagcataagcggccagttgaaccgttcggttggtcagtagatttcctcgtcctcgtaagtccaatttgaccactgataattagtgcttttaatatttgattgatgcaaaccatagcagctagatgtattttatagctcctgcattaacaccttggctgcgtcgactgtgttgtaatgcatggtgataaatacggtttaccatattttcaactaaaaatataaatatgtctaaatgcagccaaggtgttaattccacataccagtatttaacagtaaggaatagatagaaaatatccattttaccctgattgtaatacagtatatcctccgttaaccaaaacatcgtttaactgaaatgactgaaagtttcaataacttca

SEQ ID NO: 5874 - DNA, 451 bp, Diabrotica virgifera
  Clone ID: LIB150-018-Q1-E1-B7
ccgggtgcacccacgcatccggattgctagagttctagtagatttgcttatcggttgtatcttatcatatcgtttaacagctttatttaccgtatggctcatcggtttcccggccctgtgccatatcaccatctaggacgaccgcctcctcagagatatcaacaacagccccctaatcaaggaattcggcaatatgcacaacagattttccctcaacgacctggatacaatcctcgaccagcaaatataccatctaatggcggtacgatgattcatagacctgctggtgctccctattcaccattcagacgtgggattattccgccacagcaatgatttacaatgcctgcagacaataggactcacatgcaacacagaagtaatgaatacatccatactacatgtaagaagaacgataagctggcggttaatatcctgccacataaagtca

SEQ ID NO: 5875 - DNA, 441 bp, Diabrotica virgifera
  Clone ID: LIB150-018-Q1-E1-C11
aatccgcagatctgcatttttatttcaatacgaaggacagttgattggagtttctccatgatatattgttatatcttgcggatccccacagttggattgagtaactccatacagcctaatgttgtgatttatatatcaaaatttcgttatagatttaatattttattgggaaataagccacactttaacttaaaaatccttattgacgtttcgttttcgacttcagaaatggttatcgaaataaaatatggaagtggaaatcgatacgtcaagaaatttcattttttacttaagttgtggcttatttcacacatcaaataatgaattttataagatgccacaaagaaacagcttgagaacaatattagttttgtttccaatattttgtttcctatcataagcaaatataatttatttacccaagatattactcttttgact

SEQ ID NO: 5876 - DNA, 429 bp, Diabrotica virgifera
  Clone ID: LIB150-018-Q1-E1-C3
cagacgcatgggaaaatttgtcaaattttatatataaaaatatatacataattgcaaaatatgcatgaaaaatataaaatgttttaaccctgctgtcctgttcgggtctatttgacccaagaaataatttatttcgtatttgacagattattacgctgagtaacgatttggtgtttcgtgacgttattaccgaatatgaggtctttcaattgcatatgagataaacattcaacttcatgatttttttgataaaaatgaaattgttacctaaggtacgttcgggtcaatgtgacccgcggatttaaaccgttgagaattacctgtgtatgtgtgtttagttggcagtagtatatattatcagtacccgtgtgtttgtcagccggatacgtctgtacataaaaacatgtttctgcaagcgaaaacttgtaa

SEQ ID NO: 5877 - DNA, 428 bp, Diabrotica virgifera
  Clone ID: LIB150-018-Q1-E1-C9
cacacgcgtccggttcgctctcgtaaccattaccgtatctaagccaattggattgctgcattcgagccctctggtatatacctacaatgcaccattaatttacgctgtgcccgctgcggttcacgcaacctacatgaatgacaacatcatcataacattcgatgctgcctaatcaactcctgccatctatgcagatgcccttgtatataaatacatcgctccagtgcgctcgtcctgcagccgttatctacatctatcgaagtgatcacgacatcagtcctgtttatgccgcctaagcagcacactatcctgctatggccaactcagcacaagtttggagattaaaggattgacatactggtgataatttaggattatttgtttggtattgatttattatgcataataatattcagatctaagtatat

SEQ ID NO: 5878 - DNA, 433 bp, Diabrotica virgifera
  Clone ID: LIB150-018-Q1-E1-D12
cggacgcgtgggtggaaataacaatacttccgtgcgtttgtcaaatggtatagtgtgcgaaagatgacaacttcaacaatacaaaatgggaaagaaaaagaaacagctacacccacagaagtagaagtagaacaagaagatattatacaaaaatgtataggagttttaggaaggtggcatatttggttatgctttataatatttctagtcaaatttggtgtttcttggcaccaacttagtatagtatttttagctccacctattaaatattattgtatcaataatgcaacagaaacatgtttatccaattgtactcattatctatatgatacgtccatatttactaacaccatatccatggaatgggatcttgtgtgttcaaagtcatatttagtcagtcttactcagacgttaacaatgctgggaatcttag

SEQ ID NO: 5879 - DNA, 442 bp, Diabrotica virgifera
  Clone ID: LIB150-018-Q1-E1-D4
gcgtccgcaatgaatgtcaatagatgaaatccattttgcattttaaaaaacgtagcacagcgaccgagacctccatcttcgaaggctggctaggccgacactgagcaatgcaaatgcaggtgaaaggggtgggagagagagagggagagttgtaaggcaatgttgccagattgagcaatgcagatgcagcgaggcgaaagggttgggggagagagagagagggagagttgtaaggtaatgttgccagatttctcccagcccgtcacactctttctcagtgacatagggaaccttttttcacgaataaatttttaaaaattatcttgttttctccggttttcccggtttagttgttgatcacatgagacggagttagtaggaaaaaataaaaatataaattttagactttaattgcaaacagcacttccgagatgtcatttac

SEQ ID NO: 5880 - DNA, 423 bp, Diabrotica virgifera
  unsure (1)..(423): unsure at all n locations
  Clone ID: LIB150-018-Q1-E1-D5
cacacgcgtccgcccacgcgtccggattttgcctctgcaaattagatcataatgaaatcagtcacagtacctatttttctactggctttagctgtacaaacaagcttagcgggagtcatttccgatcagaactacaacaaccaacaaaactacgatcaggaaaagcaagaaacttttaaccatcaagaacattctgattacggatccaatgatataggggaccatgaagctcaaataagtcaacaagccacaggaggcgaacacggaggaggtgattatggtggtgaccacggtggatatggcgatcaacaaggctggacaggatactctggcgaagcaggccacgacggtggagctcaacaaagccatgcatctttggaaaaccttggaaaccttggcagccttatatcncatggtattaac

SEQ ID NO: 5881 - DNA, 434 bp, Diabrotica virgifera
  Clone ID: LIB150-018-Q1-E1-E10
aatattgtccaggcctctgcgccatatagcaagaccggaaataataacattttaacagccgcatttttagtgggagagatattatatcgcaatgggtgaaaatatttctcatgcatgttgttaaatgttgctatgtccttttcaactctagatcttatttcggttgtttcgtatttcgagttgacaactgttccaaggtaaaaaatatttttgaacttgggtattatacatttcatttcaaccaatcttttcactaaattattaatgattataatgtaaagtcatgcctacatccacatgtagttatttcaaggtttacttttactgtatgtattattagaatcccgtttttaggaatatcccagtttaaggaatacaaatttgaggtcccgaaactttttcatttactctttaagggggtaggtgcaaaatct

SEQ ID NO: 5882 - DNA, 436 bp, Diabrotica virgifera
  Clone ID: LIB150-018-Q1-E1-E11
aattaagaggctacaatgaatttcttgggagctctctgtatactacacctgattgcctttggttcagctggagtcatcagccctgtatcagagataatagaaggcccaagttccaaaaccactgtggttggtcctgatggcagcgttataactgcggttgcccaaggtgcaaaaattgtagcaaatggagaaacagctgttgtagccggacctgacactgcagctctcctgaaatcagcagatgaaccggctgtgctcgaatctaacattcaaccaattgcgttggttaagtcacccatcgctgtgcctgttgttgcatccaaaagtggtattttagagcatggacaattggtagctcatgaaaacaacattttggtaaaccatcatattgcatccgtagcagctcacagttctccaatattgaatgcaactcctt

SEQ ID NO: 5883 - DNA, 431 bp, Diabrotica virgifera
  Clone ID: LIB150-018-Q1-E1-E12
cggacgcgtgggcggacgcgtgggatccgcataacaccaaatggctcaattttcgtccagttatgcttattaaaaatccaaaaccggctgtaagaaagtggctaaaacgaggggctctggcgttattcgttatagaaggagcaagttttgttggaagctattttctttggtatagagtcaacacagatagagatacaagaaagtatttataccagaattatccatcagttttggaagcatactataaaattggagaaacatttgattcccaaaatcaaataagacaaattgatttggcttactggaataaggaatcttaatggcatctagacttgttagatcattattctggttagttgcttgtggaggtgtcagttatggtcttttaattttgactacaccaacagaagaagacatcagaaaaagaaaag

SEQ ID NO: 5884 - DNA, 432 bp, Diabrotica virgifera
  Clone ID: LIB150-018-Q1-E1-E6
gcagaagaatttgtggatcatcaacctaaaacggtgaggttgccattcggaatcaaccttaccacgaatcctaggttcgagaaattgaccggagaacgtatggttattgtttgtgaaagtggaaccatgcaaggtgctgaatcacctatgagaccaaaggaagaaagagaagacgattccgatgaagaagaccaagaaacgattatgattcaaccagtaatgatccccattccccaaagcccattcaacacccatatgccccagcaaatggcaccaatggctccacaacgactaatgggagaacaaatgcgtccaatgggagctccagtatttcatattgaaaacatgagaccacccatgatgcaccagcaaccaccttctcaaatgccagtacgccctccaatgcaaccacagatccaaatccaaatgcag

SEQ ID NO: 5885 - DNA, 437 bp, Diabrotica virgifera
  Clone ID: LIB150-018-Q1-E1-F11
cccacgcgtccgctgttttttctttgattgttgaatgataacaagtgtttttgaagttttgcaagtgcccgtgtaggggtgtgaatgaccgatttggatttttgattttttataatgaagatcattcttcttatcctgctagcgatatgtacgatacttagcgcagcggagtaccccagatacaaaggcaggcctccacctccacgacaacgtagggtaccaaccaatcaacagttctccaagaaatggcaccaaggaggtcctttaatacaaaatttgccacaaggtattccacaaggattcccgcaaggcatgcaaggagttcctccaggacacggccagttcggcttacgtgggccacctttaagacagagacccgtcaaccacataccggtcttaatggtgccgaacaatgttcctcaaataaaacatcataa

SEQ ID NO: 5886 - DNA, 309 bp, Diabrotica virgifera
  Clone ID: LIB150-018-Q1-E1-F12
gacatgtgtcgtataatccgtgtatattaatattatacacggattgtacaacttatgacggaggctcgaaacaaatgacaatcgatgaaaagccctattggagtgagatagtttgaattaaaatatttttcttctttgtaacgttatcgctacgtttaaaaggatattaaaatatttgtaggcgttttaatcgatatgttaaaatatttatagtagaaatttaaataaatatttaataagtgaaaaaaaaaacaaagaagtcaataaaaaaaaaaattgaaaaaaaagtaatccaaaaggattcccgca

SEQ ID NO: 5887 - DNA, 426 bp, Diabrotica virgifera
  Clone ID: LIB150-018-Q1-E1-F8
gagaaaaaggctgtagaaaatcccgatggggatgcactaaaaaatgtgcacaaaccaggagtaacctatatactatgatttgggaaatggagtactcagattctctatgtctaaaatgtgccacaaaaaagcattatatatattcattggcacgaaagtataagctagcaagaaacctcaaaagccccaggttattgaaaaaccaattggtggatagaaaaatggaggaaagagatttgttttggtcaataaacgtagagcatcctatcctacccaagacaaaattaacgccacgccatctaggagaacatttagccatcacacgacgtctattaaaactacaatcactccatgaacagttctcatccttttagctggttctcacatgggaaagacggttgtattccttaaacaactgtactctgg

SEQ ID NO: 5888 - DNA, 433 bp, Diabrotica virgifera
  unsure (1)..(433): unsure at all n locations
  Clone ID: LIB150-018-Q1-E1-G1
gtcaaacatggcattcanattagttgctttcgccgcattggtagcagtagctcgtgctggtgtcatcggagaagcctactctgcaccacttgcctatgcagctccagcagtagctaaggtagcctactcagccgctccagctgtatcatactcaagtgtgtcatcacctgtagcttacgcagcaccagctgttgctaaattagctgcacctgtatcttatgctgcaccagctttatcttacgctgcaccagtcgctaaagttgcctactcatcagctccagctgtctcttactccagtgtatccgcaccagtagcctacgccgctgccccagcctacgccaaagtagctgctccagtatcgtacgcagctccagctgtttcctacgccgctccagctctctcctatgccgccccagcccttaaagtagctgcc

SEQ ID NO: 5889 - DNA, 435 bp, Diabrotica virgifera
  Clone ID: LIB150-018-Q1-E1-G10
aataaaacatgttcttgaaagttttaattgccttccacgcggcggcagcactggtatcgatgtcgcaggcggtgccctccgacattcccgaaagccctttagcgtctccttgcccggaaacgtttacttatggaacgattgataaaccaggttattggacaggaaacctcatcttaagaccagatcatgacattagcggagtctgggtcaggctgatatttgataaggaagtggagaaagtgacactaaacagcgaagaattcataatcaaactctcggaggacagtaaaatggtcaaacttcaaagccccgatatgttattgaaagccgataatccaaaacttttggaagtcactgtaaactacaaaggatctgccgtccctagtctacaagaatatcgattgaatgcgagaacaatatgcccccagaaaaatc

SEQ ID NO: 5890 - DNA, 413 bp, Diabrotica virgifera
  Clone ID: LIB150-018-Q1-E1-G12
cgtcacttgcgtactgctggcatattactgcgtagtattaattctaagcggtagtgttttttcgttcatacattgttaataattacattattaatactaatttactataaatatgtcttatagtacgcgaagaagtactggatataataccccacaaacccagaacgtgggaaatgtcggccaacggagaccggtggttacaaataattttgtccaaggacaacaaataccaccacagcagcagcagcagcagcaggtacaacaaaataaaccaacaacaccagctactgcaagaccacaggctacaactccacaggcaggaattcagttcagggctcagcaacagacatcacaagcaaatcaacaagctgcgaccacacaagcagcagcatatgctgcaagactacatcagc

SEQ ID NO: 5891 - DNA, 433 bp, Diabrotica virgifera
  Clone ID: LIB150-018-Q1-E1-G3
gaacgtttgacctaccaacaaatcttcttgaatcgcctagccgaaagcactgaagcaactgaagtcgatactatttccattcaaagatgggttgtacaacaaaatattattaacgagcagatccagcaattgatccaacaagttttgtaccaacaaactcacgtaaggcaacaaatccaagtattaattcaacaaggacatgttatcccacaggaacttgtcctctaccaaagaattacctaccaacatgttgaaaaggttcctcaagttttgattaaacaattcgtatatcaacaaacctactacaaacagttgattcaggtcttggcacaacaaaaacacaccattccccaagaattggtttcccaatactttgctatttacacccaaatacttcaattgattcaacacggagatgctgtaccccaagaat

SEQ ID NO: 5892 - DNA, 431 bp, Diabrotica virgifera
  Clone ID: LIB150-018-Q1-E1-G6
gattctttgctgctactctttggaataacctttgaaaaatgttgcggcagttgatgttgctccttgtaggagctgttgcagtaatggcacaaagaaggttagctcttcctgatcccaggagttgtgcaaacagggtacgtcatgcaacatacagggacgctagaagagtaactcattcatatttcctcaattgggaacatggaccaacaaggggattagaagttgactggctcgatgctagaaacatttgcagaagacattgcatggatgccgtttccttggaaacacctcaagaaaatgaatttattaaacagaggatagctagaggcaatgttcgttacatctggacttctggtagaaaatgcaactttgctggttgcgaacgagctgatctacagccaccaaatatcaacggatggttctggtcagga

SEQ ID NO: 5893 - DNA, 53 bp, Diabrotica virgifera
  Clone ID: LIB150-018-Q1-E1-G9
aaaaaaaaaaaaaaaaaaaaaaaaaaaaaaaaaaaaaaaaaaaaaaaaaaaaa

SEQ ID NO: 5894 - DNA, 414 bp, Diabrotica virgifera
  Clone ID: LIB150-018-Q1-E1-H10
gattttacagcgcagtgatagtttgttgtggtgatgtgatagccaataattatgaggctgacctatgttgtttttatcctattggccgtagctcaaaaaataaaaggggcaatagaatccccctgtccaaaagtgtttgtttttgaaccagacaaatcaattgacgacagatggtatggactgatttcgttaaccacccaaaggagtataaaaggtattactttagaattggaatttgacaaatcgattatacagttagggaattggctaggcggagtaacatcggatgacgacaatactatatttactataaggaatgacaacaaagaagtaaacgccagtcaaacctataaagcagaaatttatgtagtttatgattcctactatgacttagaacctccacgattggtgaga

SEQ ID NO: 5895 - DNA, 221 bp, Diabrotica virgifera
  Clone ID: LIB150-018-Q1-E1-H11
cccacgcatccggattttacagcgcagtgatagtttgttgtggtgatgtgatagccaataattatgaggctgacctatgttgtttttatcctattggccgtagctcaaattatataaggggcaatagaatccccttgtccaaaagtgtttgtttttgaaccacacaattcaattgatgacagatggaatggacggatttctttaaccacccaaaggattac

SEQ ID NO: 5896 - DNA, 436 bp, Diabrotica virgifera
  Clone ID: LIB150-018-Q1-E1-H12
cattttcttaacacattgcgtgccacgtcgctcatatatgagagacacagatattttgccaggggccacgtcgcattttgatatacgcgtatgtgtatactttatgaccgtggatatcaatggcccctgagactattctcccgagtaaagcgtggcacgcaatgttttaaatcatgaaaggattccttttgattttttacatgtgcttcaggacggctcttccaatcggttattggtattaataccagtaactgcataaacacttcttcaaaagcgtagattctgtttcttgaatggcttaaattcaatcagccttcaataatttcttcaatttggaaacatcacttctaataaaattaatgaggtttaatgtacaacatgtaatcgatggtgtcatttattatacttccaaacctgtttacttgtgagattttta

SEQ ID NO: 5897 - DNA, 271 bp, Diabrotica virgifera
  Clone ID: LIB150-018-Q1-E1-H3
taaaaataaaattttataaaattaattttaaataaaaattaggattaaaaatttcatatttaaaataggttattatgtatttttagatattattatttttattttttataaagttttttagtaaaatataaatttagattatttaaatttactaagtagtataatattagtattaaaaaatggtatatttagtaaaaatataaggtttaataagtaattgtcaaaattttttctacgtgtttattaaaacagtcttttgttctattaaata

SEQ ID NO: 5898 - DNA, 432 bp, Diabrotica virgifera
  Clone ID: LIB150-018-Q1-E1-H5
catcggtctaataagcaaattgcctaagtcacatattgaaaattttacaggaaagacaaaaaacaaaaggaaaaaagtaaaaaagaggataataaaaaagtaaaggaacaaaagtaaaaaagagaaaattgcctaactccctgcaatacataattgaccaaaatgaattaaacaaaatatttacacaaactttctacttattatactatatccatattaataataatcaaaataatatatttatttacttacattttctaacgttttcaataaaaacaacttcagaaacactgacataggcaatattcgtataaatgggtaagaacgtttggacttcagcaaaattcgtttagcgaaattggcgcgaaataaaataataatggcgcttgtgggaaatgtcaggcggtagcttttaccgtctactactagatg

SEQ ID NO: 5899 - DNA, 430 bp, Diabrotica virgifera
  Clone ID: LIB150-018-Q1-E1-H7
cacacgcgtccgaatttttttaatatattttgcgagtttatatatctttaaaatttcctaagccgctcctgttcgcattgtaaaggttaggaaatttcctatttatttgtgtagcaataaccaactacgtagattgttattgaaaacatccattattcgagaatgaatcctctaaaaggttcagtgtttttcctttaagttttgagcgctaaaaatcccatgttattattggtctgcattttgaaagatccttgagttgtagttgacgattggtcaatagttttggccgaacgatcgagaagaaatgcatcgtttggacgcgagagagacgtgacgatgtaaagccagttctaaaagtacatcacttcagtaaacatctttttgttagaactcaaccaacagactcgtagaaagtcgcactttgccggca

SEQ ID NO: 5900 - DNA, 438 bp, Diabrotica virgifera
  Clone ID: LIB150-018-Q1-E1-H9
cacaaactgcagatgacgctgcggagtcagttggcgaagtaaaagagtctgttagtacatcatataacaatctacctaatgaaacagctcaggctcaactgcttccaatagaagtcgatgacatgcaacgaaatctagtccagactgaataacatatcaacaccgtgaacgaaaaactgcgagcagtttttgaaagcattgaagaactagcagcactccaatcggacactaaacgcagctctgatatgatcaaatcaaacttaaataagctgactcagcagatcgacttagctagagatatagccaataggattaaactatgagtaaaattctttactaatacgactttggtattaagaaatcctaagagtctagaggccttgagtacttcttcgaagttttcagggtacttcaaaactaatgaaaggcagggtctta

SEQ ID NO: 5901 - DNA, 369 bp, Diabrotica virgifera
  Clone ID: LIB150-019-Q1-E1-A3
cccacgcgaacgatttagttgaggataatcaaatattggttagtttcagcgagtaaaacttggttaatgaaaggtaaatggtattgtgcgagaatatttgatggtctatacggagaacagtttattttttgaccctgtgcttgaaggactattaattataaatgtatctccatattaatttcgaatttatgacatctacacaattacggtttttactgtcgactgtagactttggtcaattggtttgtgaggaaatgttactcgtttttcactatatcctgttttttaagatgtctcatcacttgatctaataacaatatagttacaattacatacttagatgttactggcaatagatagttttacgga

SEQ ID NO: 5902 - DNA, 455 bp, Diabrotica virgifera
  Clone ID: LIB150-019-Q1-E1-A4
cacagctttatcccacagataggtgtaagctacgagcaagaattactgcaaaggaaagaggaaaccattaaacaaggatcacaaatgcattgggtaaacgatcactctgacgaagatatcatcaagtatctgagatatggtaaaggacctctcagtactaccggtcttcagttgatcggttacctcaaaaccgaattctccagagacaagactgactaccccgatgttcagatattgattaagaaaactcatcccaaaggaggttgttaccacttcaagggagcaaacttaaaaaaagaactccaagacatcttctgcaaaccttacgaaggcttcaatgttgaaatagtcctcctacatccaaaatcgaaaggttttataaagctaaatgatgtcgatccataccatcaaccatacataaatcctatggccctctcagacgaagatgagtatga

SEQ ID NO: 5903 - DNA, 406 bp, Diabrotica virgifera
  Clone ID: LIB150-019-Q1-E1-A7
aagcactttcgtttagctcgtttaaaatttgtctttgagtttttactaaatatgagggtggaaatttttttgctaattcttattgcagctgtctgttattccattccgaccatacctgatttggatgactttgaagaactgaaaacaaaatgtgataagaggggaggaaatggcacatttgcaaaaatagagacttccatagatgacactcaaacttgtattgaagacctgatcgacatcgacaagtttgctgaagaacttgaagagtccaaaaagacatgatctatggatgacgtatttgccatatactgcagattacgccctgatgtcaggaaatgtataaaaatattttatgatgcccttgaacgatgcttagacgaagcagagcagaaaggtcgtaatttca

SEQ ID NO: 5904 - DNA, 410 bp, Diabrotica virgifera
  Clone ID: LIB150-019-Q1-E1-A8
acaaaatccagcaaacaccgtcttcaagatgaaacgatcccaacaagttaccgtcactaaaaccactacgacatatgaagaatacgaatatgaaaccactttctccgtttcgaagttatcgaaacttgagaatttcgttttacctcctagaactactatcttagcagtgtctcagagcggaggagacaaggaagaagacaaaaagtatgtcgtcacgaatcacggaaaagctgatctttttgttgaggtgatacatctcaataaccaagatgatgctccacaatggtttgtagtccaaccagaccaaaccactgagatagatattgaggacaatcttgaacaaagcgtgttgaaagtgagcaacaacagttacgaacaggaagtgtcatttttctgctaaaggtggtcac

SEQ ID NO: 5905 - DNA, 416 bp, Diabrotica virgifera
  Clone ID: LIB150-019-Q1-E1-B10
cccacgcgaccgcaaatatgaaaggaattgtgttgtgattactcaaatacattctcatgaatatcaagaattaccaacagtgatgccatctgtgggtgcgattaactgctgtatccatgaagatccgctggctgaacccgattccagtgaagagtctggggaagaatacacgttttatactccgtttaattttgacccacatgcacactgtcttggaaattatttgtttaatagaatgcatcaccatacacatcacatagcacaatataatgctgatactgacgatgaacaaacctatgcggaacttttacaacgatgtgtacacacagcctgccacctatcaaccagaggtttaatcaatgaccatgtcgctgagcattgttcttacaatcatatagcaaattcagtgccactca

SEQ ID NO: 5906 - DNA, 433 bp, Diabrotica virgifera
  Clone ID: LIB150-019-Q1-E1-B11
cgtccgggaatagaaaacggtcatgtttagcacattaccatcaccaaatccattattgtagcctgttcctgcaccatagcccgttgacgtcgatttgcaatataccagtgccagtgccagtcaaagcaccagtaccaatagatcgtccacatccagtacacgtgcctaaaccatatacggttcccgtagagaaaccactaccatgctcagtaaatccgatggtaccataccctgttatagtaccatactcagtacatcacccagtacctcatccagtacctgttcgaaatccagtatcaaacacagtccataagccaatgccatatacagttaacgtacccgtaatcgtaaacatgatagtctcagttattgtccacggtcatgacgatcatggcattggcagccgttttgatagtggttagcatggttttgg

SEQ ID NO: 5907 - DNA, 412 bp, Diabrotica virgifera
  Clone ID: LIB150-019-Q1-E1-B2
aactatcaatgtattaataaatttgtaatgttcattagtcatttaatattaaaatttttaggattacatgtcattattgcgtaatatagttttgcatttcaaagctagtcctattgaactggattctacttgttaggaaaaagaaatgattagaaatttcataaatcttttacaattttcaatattccatgaatgtctttttgcggtttcaaaatttcatttaaatcaaatttcaagacaatctatatttgctttatagctgcctttagttattaaatttgtactatattcctgatccgataaaattggtggtagataacgattgatttttaacattattaggtttgggctaagtatctactagtctgggtatgtctagcgttacaatgtataacgtatagtgcgaataacg

SEQ ID NO: 5908 - DNA, 399 bp, Diabrotica virgifera
  Clone ID: LIB150-019-Q1-E1-B3
gcgacacttacgtactgctggcatattactgcgtagtattaattctaagcggtagtgttttttcgttcatacattgttaataattacattattaatactaatttactataaatatgtcttagagtacgcgaagaagtactggatataataccccacaatcccagaacgtgggaaatgtcggccaacggagaccggtggttacaaataattttgtccaaggacaacatttaccaccacagcagcatcagcagcagcaggtacaacaaaataaaccaacaacaccagctactgcaagaccacaggctacaactccacaggcacgaattcagttcaaggctcagcaacatacaccacaagcaaatcaacaagctgcgatcacacaagcagcagcaaatgctg

SEQ ID NO: 5909 - DNA, 278 bp, Diabrotica virgifera
  Clone ID: LIB150-019-Q1-E1-B7
gaaatgcttggtccttgaaactaaaaattttatttatcagatttgatttttcaaagatttgtttcaattaataccgtgaaaatgaactgtaaagtgatttgtgtggtgcttagcggattgtttctgtttgaagctgccctcgctagtcctgttgtcgatgattctacaaataatcatattaattcggttcatccagaaaaatcaaccattgaagaatcacttttcaagaaactcaacgtgaaatgttccaatcaagatatcagttcctgcatgatgct

SEQ ID NO: 5910 - DNA, 121 bp, Diabrotica virgifera
  Clone ID: LIB150-019-Q1-E1-C11
gtccggtttgtttcgtgttgttttcaccagtttttcggtgggttgcgtgtgtgtcctttctttgccgctgtgttttgctgtgggcgtctgtgggtgggtttcactgtgggttctggggtct

SEQ ID NO: 5911 - DNA, 421 bp, Diabrotica virgifera
  Clone ID: LIB150-019-Q1-E1-C2
cttacattgtcttaagggaaaagcacttttttcatgtccaaatgcggtcgttttttttttcaactcatccattttgcgtctgaataacgccaaccatccttgcgaaattgtcacacggttgcgtttgtggtcgattgtgagcaaacgcggcacccaactggcagaaagctttctcatacccaagtgatattcagaattgaaaccactgagtcatgtgagatgcctatagcttccataatatctctcactttcaatctacgattggctaaaaccatatcgtgaattttttcaattgtttctgatgtagaaacctcaatcaaaacgtccggcatcttccgtgcttgtacggccacatcaaaattcagtaaaccacttctttaaacatggaaatgggaagtgcagaattcccataatatatctc

SEQ ID NO: 5912 - DNA, 83 bp, Diabrotica virgifera
  Clone ID: LIB150-019-Q1-E1-C3
tcgacgcaggcgtcagcccacgcttaagttcttacttattttagagtaatagtctcattctcagaccatgtattcacgtattt

SEQ ID NO: 5913 - DNA, 379 bp, Diabrotica virgifera
  Clone ID: LIB150-019-Q1-E1-C5
tgaaaatctagccaaaagctagtgttatagtcacatactcacaccatggcttctcgttttttgattgcttcattccttgtgttaacccttctaggactctgtttagcaggtggtcacggaggaggagaacacaaacgagtcatcatccacgtcccattcaaagtgaagcacattcaccacacccacacagtcgtcaagcacgtcggccatgaaggaggcggcggcggtggcggagaagaatacaaagtcatcggttactccggaggcatcgacgacggtgaagttgtagcccatggaggtggaggtggcggtgattttggcggacacggacacggatgggaaggtggaatcggaggaggcagcattggaggcggtcatg

SEQ ID NO: 5914 - DNA, 421 bp, Diabrotica virgifera
  unsure (1)..(421): unsure at all n locations
  Clone ID: LIB150-019-Q1-E1-C6
cccacgcgtccggaagaaattaataacattaatagtaagaatgaggccgccgtcgggatgagtgttcaggatgaggctccaaaaaagcctgatactttgtttttgtactttacagtgttatcaggtaccataccgttatttgtaagcggtacgtcaatggtatggatgtctccagtgctgccaactcttttatcaaatgacacagatctcaatcctttaaataaacctataacgactgtcgaaatatccctgctagcagcgttgccttgcctagtaggcctcatangatgtttgattattccaaaattcgccgatttcatcggaagagaatattttttgttactcatgggcgcgggtatgtttataacctacctaggaaaaggatttgcccatcacgttattcttttattaatatacaggt

SEQ ID NO: 5915 - DNA, 418 bp, Diabrotica virgifera
  Clone ID: LIB150-019-Q1-E1-C7
cggacgcgtgggcttgggtgaagaatgtgcgaaaacaatatacacgggaacatggggcataattgctccaggcatatatgtttatgcgataaaagtattcgaagatataaatctccctcttacgcaaggtatcttagtggcggaatttagttgtagtaactcaagatgttctttagcaattgttgcaaaatacccgatgaaacgaattagtgaattggaatctcggattaatcggacagaaatacgaggtttactagccaaccaaactaattccaaatataaaaaattatttatttacgcacttgaatataagaaaagcctttttgatgacgtaataaattttggaaatttttctgaatggtattattatcacaattctaaacatatattgtatgtatgggagaaaagcaattttttc

SEQ ID NO: 5916 - DNA, 98 bp, Diabrotica virgifera
  Clone ID: LIB150-019-Q1-E1-D10
atagagtaatctacttaaatcactacaagaattttccgattccacaaatttttgtatcaacaattatatacccaatccgttaacagacataatgccag

SEQ ID NO: 5917 - DNA, 444 bp, Diabrotica virgifera
  Clone ID: LIB150-019-Q1-E1-D12
gataaattcgaggttaaaacctgtgttttgtgaatttctctatcattgtatccacgtgcaatagctatatttgtacagtgggaaaaatgagggagtgcccatgaacgagcgtataaggcgcgctgtgttttcctgtcaccgtgtcatacaaaagattggccagcgcaagtacatgtaataattattattacatgtacttgcgctgggcaattttctttgtgacacggtgacaggaaggtgcagcgtgttttatatgttcgttcatgggtgttctttcatttttccgactgtatgattctttgatttgatttgtagcagactataataacaacaatttgcaaagattgggtggaaaacattcagaacaacatgtgtcttttaccatatgacattgtatgttttaataaatttggaagtatactgtgagcaaaatgaaagaaatga

SEQ ID NO: 5918 - DNA, 195 bp, Diabrotica virgifera
  Clone ID: LIB150-019-Q1-E1-D4
tttgttaatataagtagcgacaacttttatttgttgatcgctaattcgtactgtgagagaatattttatttttatacaagaaaactttattttttgtaccttgtgtctcacggattactacttaacaattatatatttattattttcggatttaaaagagctaacagattaaaatttttattgttacctcgatat

SEQ ID NO: 5919 - DNA, 323 bp, Diabrotica virgifera
  Clone ID: LIB150-019-Q1-E1-D5
atcacatactcacaccatggcgtcacgttttttgattgcatcaatccatgcgtaatgctttcgaggcatctgtttagcacgtggtcacgtgctgaggagtgtactcactagtcatcagccacgtcccattcatagtgaatcacattcagcatacccatacagtcctcgatcacgtctgccatgatcgaagcgctcggcagtggccgcgaacattatatcgtcatcagttactccgggagcatctaccactgtgtagttgtagaccatggatgtggaagtggatgtcattttggctgacactgacactgttgggaaggtggaat

SEQ ID NO: 5920 - DNA, 437 bp, Diabrotica virgifera
  Clone ID: LIB150-019-Q1-E1-E1
ctttcttttattataatacaactatcagaatagataagattttagtattacgttttactttaagtgttagataataatttttttaatagcatctgtaacctgatttagaataaatttatgtggatgtaaaaaaaaaaaaaaaaaaaaaaaaaaaaaaaaaaaaaaaaaaaaaaagaaaaaaaaaaaaaaaagaaaaaaaaaaaaaataaaaaaaaaaaaaaaaaaaaaaaacaaaaaaaaaaaaaaaaaaaaaaaaaaaaaagggggggccccccaaaaggttcaagccttaggaacccttgaagggaacttaaaacccctccaaaggggcccccaaatttaatttcaagggcggttttttaaaaacttgtaaacgggaaaaacccgggggttaccaagcttaacccccttgaaaaaaatccccttttcccaaaggg

SEQ ID NO: 5921 - DNA, 450 bp, Diabrotica virgifera
  Clone ID: LIB150-019-Q1-E1-E10
gttagcggttttacaatatggctagaaaaggcaataaattactacatgtggcgtttttaaatttaagaacctttctgtagttttaagaaacgtcttcgaatgcatttccaaagtgcgttattgacataaggtctgataaggtaattaatttatggggaattcagtttgttaaactgaacacaccaaaaacatattatggttagggacacatttcgttttgtaaaacttcttagcatctggtttgtatattaaatgtgaattttaaatgaccgttttaagaaaagttattaaaaaataaaattagctaaaagagtaattaaagcgtgtctccacaattgcaacgaatgaactccattcttgcattttttgagaaaagtagagcgaaccatataacgaccatatgcgcatggcaatatgtcttttataggaataaaatcgacaattttcata

SEQ ID NO: 5922 - DNA, 376 bp, Diabrotica virgifera
  Clone ID: LIB150-019-Q1-E1-E6
ccaacccgtcgggaattaccaaccataaatggtttggtccggtccccttgcggggttgcaaaaattcaaccttcggccctaaatttcaagcctttcaaaccattatacttaaacccaggtgcttgaaaaaaaggttaaaaggaattatggacaagacaattacagctaaaccaaaatttgaattcattcaacggaatccaaacaattttaccattgaaacccaaaaaaattgtacaaccggaggtaccttacaaccttgacaaattcggcaaattggaaaaaaccttcaacaccttattacccacagaaaaaattaccaaagtggtcctcaagccacaatttggtaacctgcaaaatttggaaggtaccttggaaa

SEQ ID NO: 5923 - DNA, 442 bp, Diabrotica virgifera
  unsure (1)..(442): unsure at all n locations
  Clone ID: LIB150-019-Q1-E1-E7
ctaagatcttagcattgtctcagagcggaggagataaggaagaagacaaaaagtatgtcgtcaccaatcacggaaaagctgatctttttgttgaggtagtacacctcaataaccaagatgatgctccacaatggtttgtggtccagccagaccaaaccactgagatagctattgaggacagtcttgaacaaagcgtgttgaaagtgagcaacaacagttacgaccaggaggtatcattttctgctgaaggtggtctcgttattgacgacttggaaaacaacattgaagaacttctagactcagacgaaacagaagttganatagtcgttctggaaaacttttctttaagcccaagaactgctgtcactgttttgagtcaaaatgttgaaggaagcgatgatcatcctggaaagtacactgtaactaaccttggtaaagctgc

SEQ ID NO: 5924 - DNA, 451 bp, Diabrotica virgifera
  unsure (1)..(451): unsure at all n locations
  Clone ID: LIB150-019-Q1-E1-E9
gataaattaaaaatccaatgtaaattttatatttgataaaatacgaaatattaaataccaaaactatgattgcatttaccagactagtatttgtagccttaattatagccactacatcagcaagcaccttagaacatgatggatcagtaaccattcgtcttcaacactctttaactttccaaaaccctcctgtttggactgaaagaggaaacataaccatagtgagtttgaggctagggcaggccacagtggaccaaaagccccttttgccagaagaaaagaaactgttaagggacttgtctgcaaaaaatagctactatcagatcaaagccatagttacagcaaatgatggatcacagaagtcttttatatccacattaaaagcttgtatgttggcagaatctgagctagatgatagactctccgtntctattgactatatgggtagagt

SEQ ID NO: 5925 - DNA, 438 bp, Diabrotica virgifera
  Clone ID: LIB150-019-Q1-E1-F11
cttagcagaaatatcttcaactatctttacatggttcattgctaaaataacagacataaatacctaaaaaatgaaaaatcttattttctttctgtacgcgattctggtgcccagtttaaacgctatccccgtagatgtcatccagagaaatattccagtggaagtgaggtatgaccagatcctcccgggaattgtatccagggagcaagttctaatgcacggaagaaggaacttagatgcaaaggtgcaattatcttcagacgaactgcctcaggtattgaaacatttaccgattccacttgaatctgatctcgttcctgaaattgttagcgaggaaaaagttcaggtgtcatcagaagttgaaaacaatgcagttaaatctttaattcaacctgaaggtcaagaaagtgttgaagttcctcacgaaaaacctattga

SEQ ID NO: 5926 - DNA, 443 bp, Diabrotica virgifera
  unsure (1)..(443): unsure at all n locations
  Clone ID: LIB150-019-Q1-E1-F5
cgatgcttaaaaatatttcttcggaaatagtattttacgaagaaaacccttcaaaggaacctagtgacataatattatctagttcagaagatagattgtcaaaaagagaatcatcttctaggagtatcataagccctcttggatcaaaagcggccttcgggaagccctcagctgttttgaaaacgtattatgaccttatattacggtttacatctttaaaacaaagaagcatttcatcaatagaagattggatgaaagaagtaagcacttcattgctcaaagatgaatcaaaggaaggtagcattccatggctcaaagatgaaagagcggagattggcattccatcaatcaaagatgagacagaagaagatagcagtccatggctcannagataaacaacggagattgggattccatcaatcaaaggtgaaacacagaaagat

SEQ ID NO: 5927 - DNA, 447 bp, Diabrotica virgifera
  Clone ID: LIB150-019-Q1-E1-F8
ccacgcgaccggtagtattttattttgtacctatgtagcaaatatttatgcttgtactagtttctcatatatatgcaatttatattgagctaaagatttaattgtaacagaagtaacgacaatcaaataagacagaacatataactaaatgctggtttaaattaccaatacttcaaacctttcaaagtgcttctcatatttaatgaatttttttagatttcttactcttttcattttgtcacctattgtgtaattatgtgattcaatatatttttcgaaatcttgttctggtcttttgtacggtttcttcattatacacttttattatactagtacactacagtactgattctagttactgagctagtttgtctggccataggactcgagctaccttcgtagatatctcatttgggttctctttaatagattaacatttctttttgc

SEQ ID NO: 5928 - DNA, 149 bp, Diabrotica virgifera
  Clone ID: LIB150-019-Q1-E1-F9
ccccattaatgcgcaacgcaacgtgctaatgaggcctcgcaatgtcacagcgcagcgtgctaatgaggcctcgccctaatgcgtttctgcctttaacaaacattcactaacaaaaacaccttgggccttggtaattgggtggaataata

SEQ ID NO: 5929 - DNA, 440 bp, Diabrotica virgifera
  Clone ID: LIB150-019-Q1-E1-G10
gtccgcagatctaaaagcatctttttgttagaactcaaaaagtcggactttgccggccaaaatggttttcttcttatagtaaaagaactaatggatttctaacatgtcaaggaatataatgacaatagtttcacggcattttaatggatatattattgtgaaacagttctattgttatgcagtttgatttgccggtaaaagaagtgcgtggtttcctggttcctgtcctttatgtagctgttgctatttttatgatgttttgatttgttcatgttccagtaagaaatgcccagatgatattatttggtatcgattttatccagttttgtgatgatttggatatcttccgctcccagccccgtctgaatggaaaattttgaagttccaagtgttgtgacatggatttttggtttaacaaagtagtagaatgtttaatttaa

SEQ ID NO: 5930 - DNA, 132 bp, Diabrotica virgifera
  Clone ID: LIB150-019-Q1-E1-G3
cgtccgccaagcgtacggttcgtttgtgaatttgttaattttgtatatgacaaaggcataatttaaatattctaaattctagaaatcgcgttatataatattttatttttataataaaaaaatttaattttt

SEQ ID NO: 5931 - DNA, 347 bp, Diabrotica virgifera
  Clone ID: LIB150-019-Q1-E1-G6
ctactccaagatgaaggtactcattcttctttccgttgttgccttgagcagctgcttaccagcatccagaaatcaacagtacgttgatgtagactacaacagctacaacgctcatcccgtctacaacttctggaggacttggaatcagcaacactatggacaagaaccatggaaccaatgggtacaatatggtgtccagaaccaacccggtaacttctggaggcagtacgtgcaacgcagcaaccaagctgaaaatgtcgatttaccttggatgtatcactcttgggatgtccaggatgtgcaaaacttaactcccgttcaacgtgttcaattgctactcaactacg

SEQ ID NO: 5932 - DNA, 206 bp, Diabrotica virgifera
  Clone ID: LIB150-019-Q1-E1-G7
aatatttttaagaaataaattaaatttatttattaacaatatgtttataattaaatatttttatattattaatattaaatatttttagggatgagcttaaaaataaaattttattaaaatttaatttttaaataaaaattaagattaaaaattttcataatttaaaatatgttaataattaattttaaataataataattttaatt

SEQ ID NO: 5933 - DNA, 119 bp, Diabrotica virgifera
  Clone ID: LIB150-019-Q1-E1-G8
cacgcgaccgccagcgcgtccgggtttatttatattcagtaaataaataaaaagtttacaattaatttcaatttttatcaaacattgttgtaaagtacgccttcatttacagtaaattc

SEQ ID NO: 5934 - DNA, 429 bp, Diabrotica virgifera
  Clone ID: LIB150-019-Q1-E1-G9
cagatctgaaagcatctttttgttagaactcaaaaagtcgcactttgccggccaaaatggttttcttcttatagtaaaagaactaatggatttctaacatgtcaaggaatataatgacaatagtttcacggcattttaatggatatattattgtgaaacagttctattgttatgcagtttgatttgccggtaaaagaagtgcgtggtttcctggttcctgtcctttatgtagctgttgctatttttatgatgttttgatttgttcatgttccagtaagaaatgcccagatgatattatttggtatcgattttatccagttttgtaatgatttgaatatcttcccctcccagccccgtctgaatggaaaattttgaagttccaagtgttgtgacatggatttttgttttaacaaggtatgataatgttta

SEQ ID NO: 5935 - DNA, 404 bp, Diabrotica virgifera
  Clone ID: LIB150-019-Q1-E1-H1
cccacgcgtacgctagatcatctttccctagtataccttaatgtatctgcctactacccaagtactggtaggcacgtggcattaggagttactggcaatgtaaggctactctgctctcaccgttcccagatttacattcgttcaagtccatactacccattaactgtcgacttcaccctcataagtccaaatgctcgaaccagaactctgcaaattgaagattccaggatcggtcagtagcttggttattccagcctccaatgtgtcaacagtcaaggtgtcaaccagtctgacgtacgtgctgatctattcagtcgatatcctggtattgttgattcacattccttctatcatttgttgtacattcttccacatttggtacatactcaattcagcaacaaaat

SEQ ID NO: 5936 - DNA, 282 bp, Diabrotica virgifera
  Clone ID: LIB150-019-Q1-E1-H11
tttatgtttgatcatttagtttatagtgagcgtttagagcaattttatttatagtaagaaaaataatattatgtcaataatattttagttttttactagtaatgtttattttttgtaccgtgtgtattagggattattaatgaagaggtattgttctattatgtacgtatttaggagagcatagatggtgagttttttaatgtgtacgttgtggtttaattatatttattgcatcaaaatgttaatcgtttatatcaatatcgtgattgattagttcataga

SEQ ID NO: 5937 - DNA, 157 bp, Diabrotica virgifera
  Clone ID: LIB150-019-Q1-E1-H2
acgcgtccgattattatatattttaacatactaaattattttttagtaaagttaaggaaaaattttattaaaggaaagttaattagaatggtggaaaaaaatttaattttaataaaagaaaaatttatttttggtaccttgggaaccagggattatt

SEQ ID NO: 5938 - DNA, 450 bp, Diabrotica virgifera
  Clone ID: LIB150-019-Q1-E1-H5
ccaacgcgtccggttttttaaagattttagacgttgttcataaagatttcttacatgtttcccttgtttttttttttcgattacctttgcccatcaaatctgctttggaatatgacctaatataaatcgttttgaaaccaaattttctaccttgatcgatacttcttggcatttgctgatggtcgttttagtttataatattcgtgtgtgtattacaagaatagagactaaattttctgtattacgcatttgggctctcgctatcaggttatcggatttgtattaatccgacttttaccgcaatcgtttgaataatacggtaatcttcgtaaaatcacttaatcgattttacgtagtaacaagtcttttactcaacacgtacacacgcacacacactgtggttactcacatcaatctgccactgatttttaggatgaatcataaccacat

SEQ ID NO: 5939 - DNA, 410 bp, Diabrotica virgifera
  unsure (1)..(410): unsure at all n locations
  Clone ID: LIB150-020-Q1-E1-A10
acccacgcgtccgcctttgcggtcgtcggaaggtgttcatgagtttgtacccatttttaaataatagatcaattaaagtcgacaaaacgtgattagtttattatgttagtgaaagaccggcacgcacagataggtcaatactttaattctaaactaaatggaattttagtcataacaataaaaaatcatcgaattataataaaatcaaaattgttattaaatcagtttcgattagtgtggtagctgtaaaacaattgcaatggtgtttaaaggtacattctttggggtgaggcatgttcaaatatttttacttttttggctatgcctgatgacatatgccttgagattcaacttatctgtagcaatagttgccatgacacanaagacctcagtcaatcctgatgtaccgt

SEQ ID NO: 5940 - DNA, 429 bp, Diabrotica virgifera
  unsure (1)..(429): unsure at all n locations
  Clone ID: LIB150-020-Q1-E1-A4
gacacgataattgctangacgggactttcctaaaaaaatgtccaaaataagtggggggtggacaaaaaaagggacaattttttgaagaaaacaagggtgatcaaaaaaccggagtgtcaatgtggaccaataagaactttgggtgtttaatggccaacaagtaatgagaaagtgataaataaacattcttaacaaattcttaaatagtttttagtataaaattaaaggaataaatctgaaggctcgtgtggtaaatacaataaattattttcttacataattattttttttttcgagaaaggaaatctcttccgcataacaagtcaaaaatgataaggctgaaataatttgcgattgtttgaaagcaatatttgcataatcaagtagtacgtatcttcaagttttgcgtgtaaacaaattttgtaaata

SEQ ID NO: 5941 - DNA, 420 bp, Diabrotica virgifera
  Clone ID: LIB150-020-Q1-E1-A5
atgtgatctctcaacaagttgagcaattcattcaacaaggacaacgtcttccccaagacttgctttcccaacaagtattagtctaccaacaagttcgccaattgattaaagttttgagcacccaacaacttaacatgatcaacttcatccaatacctcgttgaacaaggtaatcaagttgatcaacaattgtacgctgttcaaagaaatttttaccaacaagtccaaagacttgttcaacaggtagttcttcaacaatctcaaatcaaagaacaaatccaggtacttatccaacaagaacaaactgttccacaagaactagttttattccaacaattggcctaccaacaagttgaacaattcatccaagtattgatcaagcaattcatctaccaacaagctagccttagacaattagttc

SEQ ID NO: 5942 - DNA, 398 bp, Diabrotica virgifera
  Clone ID: LIB150-020-Q1-E1-A8
agtttttattttcattaaaacaataattaaaagtattatattatattaaattttcaaacaaaataagtttgctatgcttatatattttagaaaattaatctaaaatggcatttaacaagagcagttgttattttctgcaagcgagatgagaaagccttcattttgtagtagtagtgtagcgtattgacaagttttgcctaccacctttaaaattcttatcgaaaatgaataaacaatactacgtcgtcgtatttcattctatataagctgaaacgacagtcaagaacaaacacattgtcgtggtttggtctgtgaaacggtcagaaacgcaaaacaaaatatggcgtcaactaaggacaacttgagtgctgttctctatgggatcaatgacctaagat

SEQ ID NO: 5943 - DNA, 408 bp, Diabrotica virgifera
  Clone ID: LIB150-020-Q1-E1-A9
actcgtgtttttggtgtgacttttttttatcacgggttattttttcgtgtgttgcgctcatcgacaaaccacaagaatgaaacttatcgtaggattattattaatagccacagctctggcatacccagtagcggaaaatgaagaaaaactagcccaaccagtaattgcacaagacgcgaagccagcagagcaagaactaccactaccagaccaacttcttcccatatcagaaaaacttccccaaaaacaagaaccgttacctgccagcagcgattcttcatctgaatcttcctctgagagcagcgatgagtctggagaaaagaaatcatcctccgagtcctcctcgagcgagaaagaatccagcgaagtaaaaatccaagaaaagaaacttgccgaacctctcccaac

SEQ ID NO: 5944 - DNA, 419 bp, Diabrotica virgifera
  Clone ID: LIB150-020-Q1-E1-B1
acccacgagtccgcccacgcgtccggtaaattccaaattagtgatacgatgttgctccgatattttagtctttttattctgctaattcagagtggtttaactaatgattttcacgatcaggcagacaacgagtttgctgaattcgaggatttcgaagttgaagatgaacagatcatttctgaagaagtacaaagtgacacagaggggcctccagaacaagtgccagagaatgaggacgatccggatatggtagtcgatgatgacgattcagaattcgaacatttccaagatggagaagagttcgaaggctacgaattgaaagaagaaaatgtcgaatcagaaccaaaaataacaattgccaaagttccactcaacttccgccaaaactgggacagctactatctagaaatactcatgat

SEQ ID NO: 5945 - DNA, 367 bp, Diabrotica virgifera
  Clone ID: LIB150-020-Q1-E1-B10
acgagatatcttggaatccaatcaggactttagaccgttcaaacacacttcttccagcgagactgaatgcgaagtcagaccgattcttaagcagaacagtagggaggaaccggtcagacaaagactgtcgttttgtagtgaacacaccaacattagagatgaaccaagacccagaacttccagaaggtcgcatacgatttgtactgattttaacgtaggggattttaatttagacacaagagaaagggatgaaatgctcaataaaccgagacctttttcggtgcgcgatttggtgaaatcgtttgaaaccgattgctcaaccggggctatacccaaaagaagtagtttgaagaggaatagcgataga

SEQ ID NO: 5946 - DNA, 419 bp, Diabrotica virgifera
  Clone ID: LIB150-020-Q1-E1-B3
aaccacgagtccgcccacgcgtccggagacgccgatctccgaattttctcgcctttttgcccctcgaaaatccgaaaaaatggtttatgaaagcgatttttacacgaccaggaggccctatcgtgccactccttccgtttcgtcttacactatttcgggtgtgccttctcgacaagtcagggtattgccgggattagggaaggttcacgtaacgtatacatacgaccgcatcgtaccgtacgtggggcacaagcggcttacggtcgtaacggcccctcccagagtatggggaacgcgaccaagtgttcttcagcgcgaattcgaccgtatcgagaacaaaatccgtccttggaccggttattccgcgactaatcgctacctcaactccaactccgctgtgaaaatgattttccttcgag

SEQ ID NO: 5947 - DNA, 427 bp, Diabrotica virgifera
  Clone ID: LIB150-020-Q1-E1-B5
acccacgcgtccgcccacgcgtccggtcaagaatcacggaaaagctgatctttttgttgaggtaatacatctcaataaccaagatgatgctccacaatggtttgtagtccagccagaccaaaccactgagatagatattgaggacaatcttgaacaaagcgtgttgaaagtaagcaacaacagttacgaacaggaagtatcattttctgctaaaggtggtcacgttattgacgacttggaaaacaacatggaagaacttcttgactcagacgaaacagaaactgaaatggtcgttctggaaaacttttctttaagcccaagaactgctgtcactgttttgagtcaaaatgttgaaggaagcaatgaacatcctggaaagtatactgtaactaaccttggaaaagctgctttcgatattgagttgaag

SEQ ID NO: 5948 - DNA, 420 bp, Diabrotica virgifera
  Clone ID: LIB150-020-Q1-E1-B7
actaaacccaacaaacaccgccttcaacatgaaacgatcccagcaagttacggtcactgaaaccaccccaggatattcagtggaaaagatgtattataaagaatacaaatatgaaaccgctttctccatttcgcagttatcgaaactggagaatttcgttttacctcctagaactactatcttagcattatctcagaacggaggagacaaggaagaagacaaaaagtatgtcgtcaagaatcacggaaaagctgatctttttgttgaggtaatacatctcaataaccaagatgatgctccacaatggtttgtagtccagccagaccaaaccactgagatagatattgaggacaatcttgaacaaagcgtgttgaaagtaagcaacaacagttacgaacaggaagtatcattttctgctaa

SEQ ID NO: 5949 - DNA, 414 bp, Diabrotica virgifera
  Clone ID: LIB150-020-Q1-E1-B9
aatgaactaatatcttcctttagaactctcgtcatgttttcaaactataggttagccttacagaggctcactcgctctgaagttgttcaaaaaataatagaatcttgccccagcctcttggaagatccagcagctatagccttaattcaagaccctgagttaatgttttacctatcaactccagagcaaggaaatgaaattatagaaaaacacccagtgctacttgaagcaggaagttatattgttgcccaggttcaacaggaacaagccagcttaaatccaaaccaagccggtaccagcacaggatattcttattctttagaagccctttcagatgatgatgaagaaatggattcaagttccgacactagtttttcacagaaccccttaacaaggaatacttcattcaatgct

SEQ ID NO: 5950 - DNA, 416 bp, Diabrotica virgifera
  Clone ID: LIB150-020-Q1-E1-C11
actaattgaaaacaccttatttaattttacagtatacttaaaaaccataaaatacatcttcgtacattgtcttcagttatttaatagtaactattaagtgctctactcagtggcaacctcacctttactttcagtttatcctttcattataaaacataacaaattcttcttttgtatcgataagtcctggtccttgtgcaatgttatagtccccaagaattttttattgtgttattattattagaatcctgttttgcattacttattatttttaatataatagatctttagcctatgatcatcatttcatcacagacatcttgttttattgtgctgctgacacttctagtccatattttaactctatacagtaatatagtaaacaaattatatataccctattccatgaatatgtg

SEQ ID NO: 5951 - DNA, 429 bp, Diabrotica virgifera
  unsure (1)..(429): unsure at all n locations
  Clone ID: LIB150-020-Q1-E1-C2
atctagacgttctttctatttttgaatctgtgcttctgaattttttcttccattaaaaaaaccgcaaaaaatggcaaaattggtgattttgttggcatgtgttgctgtatttaatgccgtaagcgcacttgattgctacacttgcaccgacgatgcctgcaaaaaagatgtaaaagaaatgcaaaaagttacgtgtggtaaacccgctgaccaaaatcaagaatccgtttgccaaaaagtaacatacaaaggcaaggatggcaaggaacacatcgaaagaaaatgtgcctatgctcccaagaacggagaagctcagtgtcncgcatccataaacaaagctgatgtaactgacctaaaatgcccatcctgtaaagctgatctttgcaactcagctaccaccatcaacttcagcctaacagcattcgctgc

SEQ ID NO: 5952 - DNA, 260 bp, Diabrotica virgifera
  unsure (1)..(260): unsure at all n locations
  Clone ID: LIB150-020-Q1-E1-C4
ctgtcgacgtcaccctcagaggtcaaaatgctcaaacagaactctgcanattgatgaacccagaacggccaacaacttggttattccaacctccaaggtgtcaacaaccaaagtgtcaaccaagctgatgttcttgctgaatctttcagtcaatatgagggtattgtagatgaccagaccttctacagtttgttgaacaaacttcaacatttggtacaagctggagtcatcaacagagtagtcttggatgttgtaagaaa

SEQ ID NO: 5953 - DNA, 433 bp, Diabrotica virgifera
  unsure (1)..(433): unsure at all n locations
  Clone ID: LIB150-020-Q1-E1-D1
ggtcgagcacgcgtccgaccacacgtccgggggttcagccacatccagcanaggggttcgtgcgctagacgttctacggtgagctgttcanaatttttacagtgttgcattgtttcttttcattttagttgtactagttttatgcaaaagtttttttcttttaatttatttaatcattaaattatttgaaacccatttctttagcaatttactgtttataatttcctgtcacaaatattggcaatatcattaaagtaatctactttaaataaaatagaaaaaaatacagaatagaacagaacagaatagaaaacgctagagcaaattttaacaaaatgagaaaagtgctctgcacaagagatttgaagttggagctaagtgttagtttggctaggtgctacgtgttctcgactttattttatgtaatggaagc

SEQ ID NO: 5954 - DNA, 374 bp, Diabrotica virgifera
  Clone ID: LIB150-020-Q1-E1-D11
accacgcgtccggttagaacatgaagtacttagtgttagttagtgtaatttttttattatccgacgtcaggaccgaaacgacgcccgtgtatggtggattgcagattttgacgaaggtgtttcggcagtatttgaagagtcagccagatgatgtcaaattgggagatggcgttcatattgtcagcgtcaagagtgaaaacgatgcgagggctagtgtggatgatggaaccgtcttaggggtcattgaacattaccttgaaaatcatgagttgagaattcgactgccggaactgatgccgggtgaaggatttggtagagcgtttaagacggcgatggaagaagtggatgccaaagatgaaagtactggaagaggc

SEQ ID NO: 5955 - DNA, 382 bp, Diabrotica virgifera
  Clone ID: LIB150-020-Q1-E1-D2
atgatcacgagcgccgcacttttgtttctgtgcttctgaattttttcttctattattttcatcgtaaaatttggtaaatttggtgattttgttggtatgcgttgcttttttaatgctgtaagcgcacttgattgctatactttgaaagattttgaccgtttaattgaagaaaaagaaatgcacaaaatacgggtggaatttacgctgaccaaaatcaagaatcggtttttagcaaggaaggtacaaatgcaaagatggcacagaagacatgtttagacaatgtgccaaagctctattaaaagcaaagttcagtgacccgcatttaccggtttttctgatgtaactgacgtggattgctcaacctgtaaagctgatatttgca

SEQ ID NO: 5956 - DNA, 420 bp, Diabrotica virgifera
  Clone ID: LIB150-020-Q1-E1-D4
cgtccaaatgttttcttatgttaattttgaaacaccctgtaggaaggacaaggtacaaattaggtatttcaggattgacaacattataccatgtcaaatgttacaatgataaaaccaatgaatggtataaacctaccgatatgaatatctacagatcagccttatcagcctgtgttattgatggattaccaaatgttcatgattatatacacaaacatagagataaactcatggaggaaaaacgacaaaagatgatagcattagaaaatcatcgaaatcttgtgaatgatcaaaataacaacaacaatcatgacactatagctgcagcagtgaacgcaaacatgcaacaactcaacatcctacaacaactaaatggtcatctaaatccagctctaacaccagcccatgttcccgatccgc

SEQ ID NO: 5957 - DNA, 418 bp, Diabrotica virgifera
  unsure (1)..(418): unsure at all n locations
  Clone ID: LIB150-020-Q1-E1-D6
atgtttttggtgtgactttttttatcacgggttattttttcgtgtgttgcgctcatcgacaaaccacaagaatgaaacttatcgtaggattattattaatagccacagctctggcatacccagtagcggaaaatgaagaaaaactagcccaaccagtaattgcacaagacgcgaagccagcagagcaagaactaccactaccagaccaacttcttcccatatcagaaaaacttccccaaaaacaagaaccgttacctgccagcagcgattcttcatcagaatcttcctctgagagcagcgatgagtctggagaaaagaaatcatcctccgagtcctcctcgagcgagaaagaatccagcgaagtaaaaatccaagaaaagaaacttgccgaacctctcccagctatcanagagccaat

SEQ ID NO: 5958 - DNA, 395 bp, Diabrotica virgifera
  Clone ID: LIB150-020-Q1-E1-E12
accacgcgtccgctttttgagagggaggatggctcaaatattattatttgatttgttttcaagcagtctctgcaaagaggtttgagtcacctctcaacgtccatctcaaaacagatgcgccctggactataatacaaaaaccgaaaattaccagctgaaaaaatgtatatacagagtgatcaaaacttttttctgtaaaatttacctaaaatacatttattaataagcttcaacaataataaatgttcaataaaaaaattttttttagctcttatacagtatgtctgcgaaacttggaacgtattgataactttttttaatatcagttttacgaaaaaagttattctttataaaatactctgcatcgtatataacataagatgcaaccatcaaat

SEQ ID NO: 5959 - DNA, 431 bp, Diabrotica virgifera
  Clone ID: LIB150-020-Q1-E1-E2
acccacacgtccgcccacgcgtccggtgaaatgccgatggatataaggcgaaaaaaacttggcatcaaccttttagttagattgtatgaaaaaaaggcaagtttaatttccaaaatacatcaactgtttatagcagacttgacagaaaaatattggataaaaaagaaaactctaaatatggtagatttatattcagaaatgacaatatatgataaacaactttataaatatgacataaacccaaattataatattgactttaatagtatggaacaagttcaggtatactttttaacggactatagcaagttgcctatatctttaagaaaattagtgtttatctccgacagttcacagatgttcaaagattattgtatgctatatacagatgcatcaaaaaatattgaaagtgtgggatgtgcctattggga

SEQ ID NO: 5960 - DNA, 422 bp, Diabrotica virgifera
  Clone ID: LIB150-020-Q1-E1-E5
agacatgcttggtccttgaaactaaaaattttatttatcagatttgatttttcaaagatttgtttcaattaataccgtgaaaatgaactgtaaagtgatttgtgtggtgcttagcggattgtttctgtttgaagctgccctcgctagtcctgttgtcgatgattctacaaataatcatattaattcggttcatccagaaaaatcaaccattgaagaatcacttttcaagaaactcaacgtgaaatgttccaatcaagatatcagttcctgcatgatgctgaagttggtaaactatttcaacaggctactaaagaagtcgtatattgaactaagtgacattgaaatcacacagacctcaactgaaaaccgttaacgtagaaacgtccaaaggtttaaattaaatttgagaaaatgggagaaga

SEQ ID NO: 5961 - DNA, 412 bp, Diabrotica virgifera
  Clone ID: LIB150-020-Q1-E1-E8
acttatatgactgtatttgctgctggtttaatgtaaaaattagataaaataacacttatttctacaatgtctcgatattgttctatagcttcatgtcagaagttaacaagatcaattaaaaattcattgaacttgagaaatgattataaggaagtagttcaaatatgtttgcagagtaagaatgtaaagaatacgtccagcttttggaagataatattgaaaaatattgcgaaagtcaaatcaaataattcttcagaggccgttagtgttttttccaacaatattgctgatcagcggaatgatattaacaggaagactaataatccagaactattacacatagaaattcaaaaactatgcagtaatctccaaaagcatatttcgcagaataagccactagcatggtccacag

SEQ ID NO: 5962 - DNA, 346 bp, Diabrotica virgifera
  Clone ID: LIB150-020-Q1-E1-E9
acggacgcgtgggcggatgcgtgggccagcatgagacaagcagtcctggttctagccataataagcatttcaccatgcgcccgcctcgactacctacctccaggacgcggtactgcatgtggtggtggaccaggtggttacccataggccgtagcgcctgaaactggcggcggtagaggcagcggttatcaaggtggacccggatgtggatatcaatgtggttccggaggaggataccaatgtggttccggatgtggatatcaaagaggccattgaagcgcaagcggtggttatcaaggcgggtcaggaagtggaagctatcaacgtggttctggacgtgggtatc

SEQ ID NO: 5963 - DNA, 424 bp, Diabrotica virgifera
  Clone ID: LIB150-020-Q1-E1-F1
accacaagtccgcccacgcgtccggtgaaatgccgatggatataatgcgaaaataacttggcatcaaccttttagttagattgtatgaaaaaaaggcaagtttaatttccaaaatacatcaactgtttatagcagacttgacagaaaaatattggataaaaaagaaaactctaaatatggtagatttatattcagaaatgacaatatatgataaacaactttataaatatgacataaacccaaattataatattgactttaatagtatggaacaagttcaggtatactttttaagggactatagcaagttgcctatatctttaagaaaattagtgtttatctccgacaattcacagatgttcacagattattgtatgctatatacagatgcatcatcaaatattgaatgtgtgggatgtgccta

SEQ ID NO: 5964 - DNA, 375 bp, Diabrotica virgifera
  Clone ID: LIB150-020-Q1-E1-F12
acggacgcgtgggcggacgcgtgggccagcaaacaccgtcttcaagatgaaacgatcccaacaagttaccgtcactaaaaccactacgacatatgaagaatacgaatatgaaaccactttctccgtttcgaagttatcgaaacttgagaatttcgttttacctcctagaactactatcttagcagtgtctcagagcggaggagacaaggaagaagacaaaaagtatgtcgtcacgaatcacggaaaagctgatctttttgttgaggtgatacatctcaataaccaagatgatgctccacaatggtttgtagtccaaccagaccaaaccactgagatagatattgaggacaatcttgaacaaagcgtgttgaaagt

SEQ ID NO: 5965 - DNA, 424 bp, Diabrotica virgifera
  Clone ID: LIB150-020-Q1-E1-F5
accacgcgtccgctaaatccagcaaacaccgtcttcaagatgaaacgatcccaacaagttaccgtcactaaaaccactacgacatatgaagaatacgaatatgaaaccactttctccgtttcgaagttatcgaaacttgagaatttcgttttacctcctagaactactatcttagcagtgtctcagagcggaggagacaaggaagaagacaaaaagtatgtcgtcacgaatcacggaaaagctgatctttttgttgaggtgatacatctcaataaccaagatgatgctccacaatggtttgtagtccaaccagaccaaaccactgagatagatattgaggacaatcttgaacaaagcgtgttgaaagtgagcaacaacagttacgaacaggaagtgtcattttctgctaaaggtggtcacgtta

SEQ ID NO: 5966 - DNA, 219 bp, Diabrotica virgifera
  Clone ID: LIB150-020-Q1-E1-F8
agtcaaggtatagtcatagcactagcaattgtgtttgaatgtgtagctagaacattgggtccaagatgttagcctatcagcttcacagcgcaatttttgcttatgttttgtgaaagcgttgatcctgagtccgactggtactataatgacgttttcattcggagccatatacatgggaagaggagcatgtccgcatactacattttcaggttccataga

SEQ ID NO: 5967 - DNA, 398 bp, Diabrotica virgifera
  Clone ID: LIB150-020-Q1-E1-G10
aagttgttgctcataaaatctgggccccctaaaaagaaacatttttgtaatataaagggggttcgttgaataaataccccgaaaatgtcaagtatgttaaatataattattaaaagtgtaccccgatcaactcttcggcatatactaaaatctgtagaaaagggtattcctgtggtaactgcaaatcatagatgtgttattcaaggggagcagataatccgaaaatatggtattaatattaatagttcccacactttaagatgcagaaagtctacttctagtagtagatattttcaaacatccaatgcctgctgggacgtacaacttgtaaaagtgccaccttttgcggactctataacagaaggagatgttaaactcgaaaagaaagttggcgacta

SEQ ID NO: 5968 - DNA, 408 bp, Diabrotica virgifera
  Clone ID: LIB150-020-Q1-E1-G12
cccacgcgtccgcggacgcgtgggatttcaaagagaaggtgaaacattgtattaaaattaaagtgaagtaaaataaagtagaacaatagcattgtgaatcgttgagaaacagttgaaattcgaacaagtgatctatcattttcattatggcgacagaatacgtgcgtttcagcccaaacgcatttctaaattcgtttaatgcaaaactagaacaaccagtccgacaacatctcaaaaatgtatacgcctgtttggccatgtccacaatgtctgctgcccttggcgcagcagtccatctcttcaccaacatcatgcaagcaggatttctatcagcaataggagctttggtattcttcttcctcttagtaaacacacccgatgacaatggcaaatcaatgacgacaagag

SEQ ID NO: 5969 - DNA, 414 bp, Diabrotica virgifera
  Clone ID: LIB150-020-Q1-E1-G3
accacacgtccgtctaaatatacgaaatggtttcagtgaaaatggttttaaaatggttttgcgttttagggttagtgactgcggcgaatgcatactcaacgaaagattcgaaagctattaatcccaaagatataaatcaatggaacattgtacaaattgtccctaccaatagtcagtccaacaacaattctccaccatatgctgcacctccagggttcgtttggattcaagcacctgcttcaaattttgcaacttctttaggaggaagccactctaactctaactccgaaacaaaactaccaaattatggtagtaataacccaataacaagtccagttacggaaggagtttctggatcaggtttaaacaaactttgcctacaaccaaaagggcaatttcccagtaaatcttgca

SEQ ID NO: 5970 - DNA, 307 bp, Diabrotica virgifera
  Clone ID: LIB150-020-Q1-E1-G6
acacgaccatgtccttgacaatggtggcgacttggaacagaccttgattggaagcagctgtaaactgaatcagatcaaaagggtattgatcggtcttggaaactgccagtgtagaaaaccagatactgacgaagcaaacacagaaggttattagagtttttaaatatgatacaatacacctgtaaatataaatggactattccttaatacgaccttttcaataaacaccaaccacataaaaaaaaaaaaaaaaaaaaaaaaaaaaaaaaaaaagataaaaaaaaaagaaaaaaataaaagataaaaa

SEQ ID NO: 5971 - DNA, 424 bp, Diabrotica virgifera
  Clone ID: LIB150-020-Q1-E1-G7
agtacaaaagaaatatctacagaaactgaatctgttccagaaacaacaactttactgtcatatccctacccagatgcatcaacaccagagatcgaaacgtctaaagatgttgatgaaaatgaggtttttgccagtgattccccaactttgcctgctaaacgaaaacgatcaaaaaatagcttcaagcagttaaatagttacaaacacagacccagatctacttacacctcggattataatgagtacctttctggaaagaatagaaaattagccagtggaataggagattcaaagagagatccaataagaagaacaagatccgtggtagactacgtaattgctagatactacgatgactatcactcaaacaaccatcataatttggaaccctatgtaccacaaatgagacccagcttcttaatac

SEQ ID NO: 5972 - DNA, 419 bp, Diabrotica virgifera
  Clone ID: LIB150-020-Q1-E1-G8
aacgaagtatatcgtcaagctaaagtttgcctcggcagcagagcggattacataaaaacgaccgtgagacaattttttaatgagtctggactcagtgctattcgccaaattgattataaagaagcctgtaaagtttggcccgaagttcataactgcattaaccctcttgtgagttccattaaacaatgtttgaaaagcgatgtacaaaaaatgtttgatacattccttgaattcatcgacgtgtcccaaagtttcttctgcgacaacaatgcggaccgtatatcgagtttagtcagcgatggctctgtacaatgtttcagcttagtagataaagatcttaaagaatgtcaaactaactttaagaagaaactaggagactcaataaacgctattaatatatggggggacgtcgattcgta

SEQ ID NO: 5973 - DNA, 437 bp, Diabrotica virgifera
  unsure (1)..(437): unsure at all n locations
  Clone ID: LIB150-020-Q1-E1-H1
ggtcgagcccgcgtccgaccacaagtccgcccacgcgtccgtgctattatcaccngccaaggtggaagagtagttcgagacattgaaagaaaaatcaaacaacttgtgtctgatgaaaaatcaataatgatggtgaatgatttccatctggcacctgcatcatctgtagttgtcatgaatcaagttggtagatataaccgaagacccgtgtacccagctggacatcgcaaactccaacatgttgtagttcgtagacttaaacaccatcctggacttacatcaggacgttttgcacgtaaaccagcagtatcccgtcctcgtaaacaatcaggtagcccagcaggtttaggacgtcgtccattccgtcgtccatcttgcaggccaatgatacgaccagcccatctttcaagtcaaggtggtcaacatccagcgcaaca

SEQ ID NO: 5974 - DNA, 401 bp, Diabrotica virgifera
  Clone ID: LIB150-020-Q1-E1-H2
aagaagattttattgctgttacaaggtattttgcttctaggtcaatggatattgatctgtgcatacctattatacaccacgtttcagagtacttatataatgaactgggattaatacaatattataaccattacaagacacattttggactgaattgactattttttattaaggtgtcataacttaaatttttattgttaaaatctgtgagtctattcagcgatatgcggttattagcaacttctctgagatatgcagaaaatctgtatgatatttgatcatacaatgttttgtacctctggatattttgagcttctccaatgtgataactacagtactttactagggattacattattatacaaagtggcgtttaaaaccgttcaagttcccgtccgact

SEQ ID NO: 5975 - DNA, 426 bp, Diabrotica virgifera
  Clone ID: LIB150-020-Q1-E1-H5
agtcaaaactaggaatgaaaattctacaatcggtacacccacttgatgcgtagcaaaattactggaaattaccgtagtaaaagaataaaagaagtaaactcgacctgtaaacttcattttaaaaatcaagtagtctagtctcgacgttcatctatctctttctttctgaatactttccctgtctgtgctctgcgcagatgtgcaaaatttcgaaagacatttctggtgttcacgagtaatatgacaaatattattttatatttgatgtatggatggaatccatacatggattccatccaatacaatggtatttgatggaatttattcattaatgtactagttctcattcgttttattggaactctgatgttgcaaaagatgcagaactcaaaaaatagctttattataaatagccgtagtacatag

SEQ ID NO: 5976 - DNA, 376 bp, Diabrotica virgifera
  Clone ID: LIB150-020-Q1-E1-H7
acttatttcccattgaaaatagttgattagaaacatgccacaaggaaataacttcagaacaacattaatcctaatagttttgaaattaaacgttgacttaagaaaatttgttgcatatgcggaaaattttcgtctggtcatcaggcggggagttattgtacagtaaaattgtggcttatttaccatttaaaatagttgattataaaaatgccacaaggaaatagcttcagaacaacattaatcctaatatatagtcttgaaattatgtgttactcgagaaaatttgttgcatatgaggtaaatattcgtctggtcatcaggcggggagttatgtaataggatttcaaatttatgtacaatgttggtcaagtgtgac

SEQ ID NO: 5977 - DNA, 428 bp, Diabrotica virgifera
  unsure (1)..(428): unsure at all n locations
  Clone ID: LIB150-020-Q1-E1-H8
aaattagcttaccatcaaaacctcattacacgtgaagttgaacaatacattgttaaaggacaagtagttccccaacagctcgtttaccaacagagattggtttaccaacaagttcatgaagtaattgaacgtttgacctaccaacaaatcttcttgaatcgcctagccgaaagcactgaagcaactgaagtcgatactatttccattcaaagatgggttgtacaacaaaatattattaacgagcagatccagcanttgatccaacaagttttgtaccaacaaactcacgtaaggcaacaaatccaagttataattcaacaaggacatgttatcccacangaacttgtcctctaccanagaattacctaccaacatgttgaaaggtttcttcaagttttgattaaacaattcgtatatcaacaaaccta

SEQ ID NO: 5978 - DNA, 407 bp, Diabrotica virgifera
  Clone ID: LIB150-020-Q1-E1-H9
acccacgcgtccgcccacgcgtccggtttgttcatcttcaccactatggcattttttaagctagctggtttgtttttgtgtatagtcgcgtctatcagtgcgttacccacggcacacgatgaagcgcgcggtaattcagttcaaaccgaacacgatcttttggatgccgtttacaacgactgccttaaaaaagactctatgtcttgtctgaagtataaagtttttaatttcgtggacaagatgatcggcaacagggaaacaattacagtgatggatggtgttcagttcgtcaaaactcccggtggtgaacaggatggtgctccacgcgctattagcagtgacgacactatcgaatctgtcattttcaacaggattacatcgttcttggggtcccatactttgaaaat

SEQ ID NO: 5979 - DNA, 328 bp, Diabrotica virgifera
  Clone ID: LIB150-021-Q1-E1-A1
cggacgcgtgggcgagaccggccacatctcgaaaacataccatacatttgtaaatttgtatttgccaccatgcatttcgttatttaccagttgttgataactcactctccgaaaacgtcaggagccaccatgttgaagtaagtgccaatcagtgtgtttccggagcaaaaagaaatccacagtttacagaaaatcaaaacaagaaaagagaagagaagacttttagtatttttttgggaaatatataatatggttcaaattgataagttcgacaccatggatagagtacaaccaccaaaacaattttttggaaagaggcatgtgcagt

SEQ ID NO: 5980 - DNA, 526 bp, Diabrotica virgifera
  Clone ID: LIB150-021-Q1-E1-A11
cccaagcgtaagcccacgcgtccggttacgttccttgcccagtagttgagtgacacccaaaggtcaccagcgaccgataagtgataccacaaacaccattgctcccttacttcttttagtcgtgattatggtgttttcattcaaactttactaccctgcgtgactaatgtaaatagtgtgtgatgtccttgttttgattcgattgattgtttgtgcgcaccggcttctcaatgacattctttttcaaacgatatgatgttgtctacatcgaccgaaactcgaggatgaaacggctaaggcgacaaatcggccagatatgtctccaagtcatgggtctacccctcattggagccggcgttttcaccttcgtgttcttcgaggctatctacgaattcattcttgccgaagccctcaaattcagacccgaatcacgaccgtataaagcgtggagcaacaacgaccctccattcagcatggacatcttccggttcaattgggcaaatcccgaacaaatctataccatttc

SEQ ID NO: 5981 - DNA, 366 bp, Diabrotica virgifera
  Clone ID: LIB150-021-Q1-E1-A2
agaaatacatatatttatttgtcaattaaaaaaacacataaaacacgactaatatattacggaaagagatttagtgattgttgtagacgcctttatttattctccaatgatatttaatttttttttgtagtgagtacctgtatcaacacgatttattaaaattccattctcttccaatagaaccacaataagaaaccgcttatagatgcttttcatacataatataagtacacaaagtaaagtactatttaaatcttaaaatctttaagactgtatataactttaacttaatctttacgactttggtccaaatagtaattccactaaaattaaaggttaattttaaaaccagtaattggttaatta

SEQ ID NO: 5982 - DNA, 443 bp, Diabrotica virgifera
  unsure (1)..(443): unsure at all n locations
  Clone ID: LIB150-021-Q1-E1-A4
gggtcgacnacgcgtccgatgaacggcaacctttattacaatttgatttaccctaagggcttaccggtttaaatataaattagtaattattaattaattattggattgccaatataaaacatttattattttcacaattcgttctctaaacttcgtttctacatttaaatatttgatactggattattagttcaccggtttttaaaaaatggaggaaacagaagcaagtactggcaggaaaactcgctctagtgcagcaaaaacaacgcctgctgttaccaaaaaagaaaaaccgggaccactatcaagaanaacacgtaagaaaggttgtgctaatggaattaaaattttctgatgaaaaattaattgaaactgttcaaaaccctgtatcagaaacaatggaaactactgaagaaagcaaccaaagcgaaaatcagattgac

SEQ ID NO: 5983 - DNA, 371 bp, Diabrotica virgifera
  Clone ID: LIB150-021-Q1-E1-A7
aaaaatacttactctgtcgcgttgaggcaacaggattatatttacgtaaaaagtaacgaaaaatcaagaaacatgatgaaatgattattacgacagtggcgtacattctaagggagaaaagggggaaaaagaagtatatatccctattgcatgcctctagtaacagctggaaactatcttttaacactagttaaagtattcttacatgtgtaaactgtttttgacttaaaaacacataacgcttggggaactgctggtaagaagaggaaccacttggaatgatgcaagacgaatggcaagaaataaaaaagaatggataaaatatgtatactagtagtggtatactgactgccacacatcattagatgata

SEQ ID NO: 5984 - DNA, 394 bp, Diabrotica virgifera
  Clone ID: LIB150-021-Q1-E1-A8
gccgtgcttgtttcagaccattccgggtggcagcggtccattttattgacctttagagctcactgagatggatttgctgtcagcccactcctatgctgagcacgacttggaggaaaatgtagaggattgtacatttaattaccctattgcatgccgctaataacttcaggatcctcgccttgagcacgtattaacgtaatcttatgtatgtggacagtgtttaaattgctgtctctttggcgtgttcaagtgcaggtaagcaatttgacctgttcggattacacatgtaccattgctagaattggttaaatgtggctaaaatatgtcttccaataatggtatactgactggcacacatcattagatgataataaaaatggctcctggttatcgc

SEQ ID NO: 5985 - DNA, 515 bp, Diabrotica virgifera
  Clone ID: LIB150-021-Q1-E1-B10
gaaataagccacaatttaacttaaaaaatgagtgttattaaacgtcaacaaaatcattttataagttaaattgtggtttatttcccatttagaataataaactacatctcaaaggcgtcaattcttctatctgccgttctatcttaagatagtcaatatctgatacaacgctgactgaaaatcacattaactgagatatattttctgttccatagatattataagagagaaagagagagagagagaaagaaagagaaagaaagagagagagagagaaagaaaaaaaaaagagagagagagacaaaatcgccatattggtatgaaaaaatattcttttacagtttctaatacctcaatgatttaataaaaaaaattcgtcgtcatacagtataagacagaccttgaaaataggtttttaacaacacctaaccacatatataacactaaattttagtaatgtcatataaaaaaataattccttaactagtatttaacaagaattattgataaattac

SEQ ID NO: 5986 - DNA, 536 bp, Diabrotica virgifera
  Clone ID: LIB150-021-Q1-E1-B12
aaattgctgaatttcttttagcgcttttagtatattatggaatctatgagatttttaacattgtttgtaaatatgtggacgacgagcatgtatgtcgtgtcacatttagtatgcacctatagatgatttttgtagatgcacaactagttattttaaatatgttattttacaactacacagttgagtccgcgattctttacccgtgcgtcaataatacctggcgagattaaacacatactttttaaccaacatcaatcccctccaagcatgaaattaatgacaaaccagctgccgtctgttaataagttaaaacacatgttatttttatgaacgatctagactcaatgcattgaaaagagataggtacaaagaaagacgattggggatgttttcacatattctaagtacaatttctgacgttttggtttgtttacttttgtggctgtcagtttgttaaagtttttgctgttattttgtcgaatttttgcattttgatgttttttataatttacaaacagttgttttcacaactaatt

SEQ ID NO: 5987 - DNA, 95 bp, Diabrotica virgifera
  Clone ID: LIB150-021-Q1-E1-B2
tttcgtacaattcctagcgtacgctgtccattttattgacgtttatgtctcatcgcggtcgttttgcttgcagaccatcccttgccaatcatcac

SEQ ID NO: 5988 - DNA, 253 bp, Diabrotica virgifera
  Clone ID: LIB150-021-Q1-E1-B4
agtcaacctccggacctcctgacgcacattcgaccatgacttatgattccagccgtcttcaacaaagcctcttgccatggtttccatgaagaccaaactttacgagatgcagcttgcgactcaccatggggatgattaagcccattcgatgctgggtcactaattgcacgcaactggtcgtgctgaaagtgtcaattgtgaagtacgttgatcatgactacattgcccctcatgttcaaagtggtctcatcac

SEQ ID NO: 5989 - DNA, 397 bp, Diabrotica virgifera
  Clone ID: LIB150-021-Q1-E1-B6
gattaatattccaaatgaaagaaatgtgtttttagacttaatatttacaaatgtttgtgatttacaagtagcaaaagcctcagatccgatttttaaaaatagttatcatcacataagttacacttacaatattagtttgtgtgaacatcgaggtaagtcattagaatatactgaattttatcatgattttgtaaatgcagactatgaaggtctcaataactatctttcaatgataccttgggaagaccatttgaatttgtcaaatgttgatgatgctttaacagaattttacaacatacttaatatgtcactatcattgtttgtaccggtgaaaagatttaaaacttctagttatccaaaatggtttgatgccaacttgcgttatttagttgtacag

SEQ ID NO: 5990 - DNA, 418 bp, Diabrotica virgifera
  Clone ID: LIB150-021-Q1-E1-B7
cggacgcgtgggtggacattttatgtcaatgctgaattagtgaagtgaatagtgttaaaaatatcttaaagtgattttagacttattttttacgcaaattaatatatttaagagtcggtttacttacttacatattattttttagtgtttaattacgatttaataaggctacagtgcagttttattttctaggtcattaaaaatgaatgatacagaattagcatcaattccacctccatcaggtaccatcgacaatccaccgttgcctccagaagcaccttccagttcaccgccgcctccgccagctacagaacatcctcaaacacccaatatgtttttacctaaccaaaattgggctaattacaataattatatgaattactatcaacaatatgctcaattttatccatatctcttt

SEQ ID NO: 5991 - DNA, 280 bp, Diabrotica virgifera
  unsure (1)..(280): unsure at all n locations
  Clone ID: LIB150-021-Q1-E1-B9
cgcgtcagcggaaacgtgggttactattctagtttgctcgttttttgtncggtttatgtcttttgccctttttggctgcttggcttcgttgcctccgtcttttgtgctctgttgctctggttggggggtgtccggtctgtctccatccgttatgcgattgctgtttgatttgctgtctctcatcatctaacttcgactatgagactcagtagttactgacatatttgtaaataattgactacattgggttataatcatggactgatccgtcggttacctg

SEQ ID NO: 5992 - DNA, 247 bp, Diabrotica virgifera
  Clone ID: LIB150-021-Q1-E1-C10
ggacaaggcacagtgctattgacttacgcatcagattggcaagctgaaaaagctatcaaaaatcttgataaagctagaattgatggaaggatgatcgacgccagattgtacttctaaattagaacattaagatctttttttactattattttaaattatgtttagttttgaggtgccttggtgcaaatattattgtgttactcaatcaattaagtgtggttggcaatcaaaataaaggaatagtttt

SEQ ID NO: 5993 - DNA, 239 bp, Diabrotica virgifera
  Clone ID: LIB150-021-Q1-E1-C11
cccaagcgtacgataaaaaaaaaataaaaaaaaaaaaaaaaaaaaaaaaaaaaaataaaaaagaagaaagaaatgggtaaatataaaaagaaagaggatcaaaaacaggatgtaactgtaaatttgttaagagtggatgtgatgttaaaaaaactgtcttaatttgccttagttttaattgagagtttatgcatttaagcttgtgttactgagtaagatctgggtgtacgatattgatt

SEQ ID NO: 5994 - DNA, 411 bp, Diabrotica virgifera
  Clone ID: LIB150-021-Q1-E1-C3
ctgctccaagatgaaggtacacattcttctttccgttgttgccttgagcagctgcttaccagcatcgagaaatcaacaatacgttgatgtagactacaacagctacaacgctcatcgcgtctacagcatcaggaggacttggaatcagcaacactatggacaagaaccatggaaccaatgggtacaatatggtgtcgagaaccaacccggtaactactggatgcagtacgtgcaacgcaacacccaagctgaaaatgtcgatttaccttggatgtatcactcttgggatgtccacgatgtgcaaaacttaactcccgttcaacgtgttcagttgcaactcaactacgtcagacttcaccaacaatggtaccaatggactcatgatgtaactgccaatgtacgtcttcagaa

SEQ ID NO: 5995 - DNA, 364 bp, Diabrotica virgifera
  Clone ID: LIB150-021-Q1-E1-C4
aatacaacggttttcatgatacataacgatacgttcacgccaaacgtcagagcataatcaaaagtgtcagtgttccagagtacatatacacattttaccgccaaatgaataatgacactaccaccatcttacgaagttggtagtaaacatctatgtgacacttttcctggtaaaagtatagaattatttgggttgtgccacttttcttccgaacgagcgaatgtgttaaaatattattaattaacatatgtgtttaagaactaaaaattgtaacgtttttgctaaatgtgtttggtgtattaaaaagttggtttgccaacaaaattgtccgaaattaatcaaaaaggtatgaagttaacacttt

SEQ ID NO: 5996 - DNA, 373 bp, Diabrotica virgifera
  Clone ID: LIB150-021-Q1-E1-C6
atttttgcaacaatgttctcgaaaaaatatctgacttttctgtcggtattgtgtatagctattgccgtgttcgcggacgacgaaatacctgaacctaagtcaaaaagtgaatacaaaaaatctttgtcaagagactgtgcaactagttattcgacgacatgtttaaaattggacatagtgtcatgggtcgataagttaaacgaggaaaataattatagtgttctaccgggagtttcggtgataaaggaagagcaaagtgataaaagttcgacggcagatatggtgtctgaattaacacgagactttcccaatgatcccgaagcccgcctggacgcgttcctcttgaaaaaagtgacttcttaattaaacagtc

SEQ ID NO: 5997 - DNA, 406 bp, Diabrotica virgifera
  Clone ID: LIB150-021-Q1-E1-C8
atttattttaaaataataattaattttttagtaaaagtaattaccaaattttattgaaagatatgtaattaccaatgttcagagaagaatcttaattttaccaaccaaacctttaattattggaccttgtgtatcacggactaatagtgcctcagtaaatatctactaatttccaattcacaacagctcaaattttacgatttttaatgctacagaaatattttacataacttttatgtaatgaaatgtcaatcgtctttaaatatatctaattttttaagctattaactagctttaattactaacaataggtttcatacttaatatgtttagaatattacgtataaatacttttaaggatgaacttaaccatacaattttaataaaaattaacttttaaatccaa

SEQ ID NO: 5998 - DNA, 426 bp, Diabrotica virgifera
  Clone ID: LIB150-021-Q1-E1-D2
acaagcgtccgcaaaaattttcgtaaaatggaattggaagaacaattggatgaagaccttttggtttaattaaattttacaaacacattcctaagaagaattcaaaatgaagagctatcaaaaagagcacaagtgtgggtgcaaaaattaatccgcgaaccatgccaaaggctacagaaaaagagatgcagaaatatataattaaccaaccttccggtaagaatgcaaaatgggcctccagaaaaaccaattaaggcacccgcaagaaatactggtatactaaaccccaataaattgttgggaccaatcccggaaacggttaaattaccgtcttggctaaatgatccagaattagcccccacaagaattcaaacttcggaaggcaaaggaaaacgaggaaaaacttaggtagcaacccgaacatta

SEQ ID NO: 5999 - DNA, 341 bp, Diabrotica virgifera
  Clone ID: LIB150-021-Q1-E1-D4
attagttctcttttctttagttgcactcagcgttgctctaccaacactccttggtagaaccgtaagagtcacagaagatggaactgtatctctcttcgactctagaggataccaactcgtaatcctcaagagtgttaccgatcccagacaagtcgaggttgttctcagaagtccaaacacaagaacccatatgttccaagttggggaaccactgagaactggagaagctatcgaccgtcgtaccctcgctggtgtttcagtttaccaaaactacaaccaagctgatattcttactgatatttttcgtcagtatgaaggtactcctgacgacaccaaatact

SEQ ID NO: 6000 - DNA, 189 bp, Diabrotica virgifera
  Clone ID: LIB150-021-Q1-E1-D5
acccacgcgtccgcccacgcgtccgcttaagtctgttcttaatctacgtacaggttcttatttttttcgaagtcatgagatagtgaattggtggtaaagtttattaagagtactacaaggttgtaatttaaaaattaaaaaggaacatggactacaatttaggataaatcttaaaagttttattaacca

SEQ ID NO: 6001 - DNA, 57 bp, Diabrotica virgifera
  Clone ID: LIB150-021-Q1-E1-D7
acccacgcatccactacacctccggtctctgcttttcatatttcagttcttaatcgt

SEQ ID NO: 6002 - DNA, 237 bp, Diabrotica virgifera
  Clone ID: LIB150-021-Q1-E1-E1
ccacgcgtccaatttaatagcgtttgtcacgtaaggacttaacgctcccagtttttgctagttgcttgtggtcatacgagactggtcaaactagagtgtctaaggaaatacattgacagacttttgaaccgaattacgaaaacactgaagaaagtagtgtctatgatttttagccatagtctagtgacattagtagtaagatagtaagattttacgcttatggacgctttgtgacat

SEQ ID NO: 6003 - DNA, 495 bp, Diabrotica virgifera
  unsure (1)..(495): unsure at all n locations
  Clone ID: LIB150-021-Q1-E1-E11
attaatttttatacgcatacaatacctacacttttgtggaattagttaatatgtttacttagttaatattaatcgatatctgtttatcttatctttaaaaatgtataaataactggtaggtctacacaagaatataataatatattgataaaatcaaaatcgcacctgccggaaacatgaaaaccgcttacagtatccaaactatattccaagatttgttaaaaacaattcaacanaacaacgaagtagacaacatctcgaaaatattctccaaaataactacgaaccatgaaagggtcaactttcgtattgaactgttaaaaaaatatcaaatatcgtgcgagtttgtgaaagataaaaaatgtgataaattttccgtaaacttgagggaacaaggaattccaaattttaagggaaagctattacaagaagcgctcgaattaaatacgcaaagtttagcaaatgctgaagaaaactcggaaaatttttcaaaag

SEQ ID NO: 6004 - DNA, 361 bp, Diabrotica virgifera
  Clone ID: LIB150-021-Q1-E1-E3
cccacgcgtccgggaataggtcaggtatagtacccaaaatggcgggtgataatttcaaataaagttaaggcttttagttaacgcctccagttcagtagtgagaggaaaatacaaactgttttctggagtaaggattgcagtaactctaatggaacatcaataaaatcacacccgcttgtataacagttctttgcagtcgaagggttatatacaacgataacttaagtaccagaggatatcaatccgatattaatgtgtaaagcgtcaacgcccttccggtaaggatttatggaagaatatcaacgaaccgcaagcccttaatccttggcgtaacgctcaaggcgatttccaaaacgattaa

SEQ ID NO: 6005 - DNA, 428 bp, Diabrotica virgifera
  Clone ID: LIB150-021-Q1-E1-E4
agaaaaatcaacatgaagattacctattttattgtatttgtgcttgcccttttcgcaacaggaatattccaagcagaagcaggaaatgtcctctctaaaccagtcaccgaaaaaccaggcaaaggaggcaaaaaaacacggaggcaaacattaataaatagccttattttaatatgagttattagtttatattaattcattttaaagttttaccttacaaacacaataaaaatgtaattaaattgaaaaaaaaaaaaaaaaaaaaaaaaaaaaaaaaaaaaaaaaaaaaaaaaaaaaaaaaaaaaaaaaaaaaaaaaaaaaaagggggggccccccaaagggttcaaacttaacttacccttcaaggcaagttaaaacccctccaaaagggcccccaaatttaatttcacgggccttcgtttaaaaag

SEQ ID NO: 6006 - DNA, 411 bp, Diabrotica virgifera
  Clone ID: LIB150-021-Q1-E1-E5
actgattgacgtttcaaagccggctgttgtttttgtttggtttctttggtttcatgtttcacattgtttttgttgttcagagtgattaatacaattgtgacagtttaaattgttgcttcagaatagagagaaaaatgattccgctgttacttctgttgataccgtattgttctggtctaagaatggatatagttacacattcatctgatgaagtcactaactctaaagagcttcatccactatctgatgaattcattaactccatcaatgcagcaaaatccacatggactgcaggaagaaattttgctcaggacaaatcgatggactatatcattaaattgatgggggtattacctgaccataagaactatatgcctcctgtattgacacataaactagaagctctagaaa

SEQ ID NO: 6007 - DNA, 407 bp, Diabrotica virgifera
  Clone ID: LIB150-021-Q1-E1-E7
cttagtctcagcatccgttatggcttgcaaattgtagaagcctcgtaggtgttaccagaataggttcccattgttttcagtctggtaggatgtagagtaacatttttggatgttgttttatgtgctattagattgaaaacttagttttttttaagtaaacaattgattaacttgctcaagtttattactatttacatacacagacgattttatattgtcttgtttacttattacgagtattttggttttccgtatgttcagatccagacttgcttctttataactctcaacgacactgtcaagtaatgtttgcttatcttcttgagtagaagctccgcatatcgcaaattattgatgacttcaccgttcataataattatttcttcttgtttttcagaaagtgcatg

SEQ ID NO: 6008 - DNA, 219 bp, Diabrotica virgifera
  Clone ID: LIB150-021-Q1-E1-E8
acttagtcacagcatccgttatggcttgcaaattgtacaagcctcgtaagtgttagcataatacgttcccattgtattcagtctggtaggatgtctagtaacatttttggatgtagtgttaggtgctagtagattgaaaacttagttttttttacataaactagtgttcatcttgctcaactatactactatgtacagacacacattacttcatactgt

SEQ ID NO: 6009 - DNA, 162 bp, Diabrotica virgifera
  Clone ID: LIB150-021-Q1-E1-E9
cccaagcgtacgcccacgcgtccgcggacgcgtggaaaaaaaaaaaaaaaaaaaaaaaaaaaaaaaaaaaaaaaaaaaaaaaaaaaaaagggaaggggctctagcgcgataagatttaggtttacgtgcacgtgaattcaaagtccttccacatcgatcacc

SEQ ID NO: 6010 - DNA, 414 bp, Diabrotica virgifera
  Clone ID: LIB150-021-Q1-E1-F5
acggacgcgtgggttctaaactagttttgttcatgagatataattgtgttaaaattcgttttctagttaattatgttttagcacctgttatttataaatcatcacttttatcatacagcataatggcagttactggatctagtaaaatagacctactaataaaccggctggatgttgctgaaacacgttctaaacggttgaattccgaagtgagaagtataagaaaagaaattgctgatttaagaagaactctttctggacctaataatcctggcgttttcccaaaaaacgggaacgggggtaacaccaattgaattagttccggtaaatggttgtccagttactaaaaaatttaaggaatccttaactgaagaagatggttatacaatagtttttacagacggtgcttgcaaa

SEQ ID NO: 6011 - DNA, 282 bp, Diabrotica virgifera
  Clone ID: LIB150-021-Q1-E1-F6
accgttttggaagttatcaacacaagccacactgaagattggaattgagctgtgagttcaaaagactcagatgtattaggctcaattccaatctaccgttttggaagttatcaacacaagccacactgaagatgcagtttttagagctgaaggaggagatgttattgaagatcttgaggatttagttagaaatattgatgagcaaaaagaaactgttgttactcatattctaacaactttggagagcttccatttagtctcacgttcgtccgtcactgcttt

SEQ ID NO: 6012 - DNA, 298 bp, Diabrotica virgifera
  unsure (1)..(298): unsure at all n locations
  Clone ID: LIB150-021-Q1-E1-F8
ggagtgtaaacggattttacactgtttaatgttctcttcgtgaaataattagtccgttctaaatgttgtattagtgaagtgttttaatgaaatcagctttcgatttctaaattggattagtcccagctagcaaaatggcttctggagacacaatcgaaactattcaaactatggatacttttcaaatgacaaatatgaatagctccaaggatattccaggatttcgtgaatcatcagatacggaagaaattgatgataaagacgataactcggtggcgttcaaaagcgtacangacat

SEQ ID NO: 6013 - DNA, 631 bp, Diabrotica virgifera
  Clone ID: LIB150-021-Q1-E1-F9
cccacgcgtaagcccacgcgtccgcaaatatgtggtgattagagatagtgattgttgcctcaataggaggtgtgaatgttagctgaaatgcacatatttttggtaaaagactttttttttaattaatgacagtattgcactccatcgaggcaaattagatgtaacgtggctaaaaagagaaaagaaagtatatataagtggatttttgtaagatatatttcaggactgcacataaagagatgtatgctactataatagtcattcgtaatgttcgaaatctgacaacaccgccttacacatcaactctccccttctctcatcctaccattttcgcctcgctgcattactcagtgtcggtctagcagctgtaaccgactgtgttcatgacatgtcctttgggcggttttcaaaataattactgctaacaactaaattcaactgctataattctaaatatttggaaaataaacgtcacctaaaatgtcaaatctggcgaacaggaaggaaactagcaattatagcctcaaactacacaatcctacgtaagtcttgaacaccaaactatcttggaatgtaccattttaaatagaggaaatagttttttctttctcaataaagagaccatattttc

SEQ ID NO: 6014 - DNA, 571 bp, Diabrotica virgifera
  Clone ID: LIB150-021-Q1-E1-G12
gttgaaatgagaagatttcagagaataattttcaatcataacataactcaaaaaaacttaaaacattaaattttcggactttggctgcccttaattttgattattggttattcaaatgtcattcttttgaaaacatgtcaaatatcgttttttgagataaagtggtatacagtgagcacgtcatggttggaataaattcattttttagtgaatgggcgatttttggaataaatttccaagcaaggtccatttttaattttaatttaagaatttttggcataaatatcaaaataatgatgtcatccaactgggcgttatgacatacctaatcaataatttttttaaatgagagtatgggttgtgtgatggcgtaattggaaggttaattaaatccaaattcagtaatataaatgttaacataattacttaaacaaggtgtacaaagaaattttttcaaaataaattaacaggttccacgttgatggcagacatgtgagccgcatgtaagccttcaccaatgtgccgacgtcgcgcaagtatgctaatgattatacacattttaaatatgtaa

SEQ ID NO: 6015 - DNA, 372 bp, Diabrotica virgifera
  Clone ID: LIB150-021-Q1-E1-G2
atctagtaaagatatttattataacccataaaaatgggcaaatccgaaaagttttcaataagtgggtttaagtgagaaaagtaaaagaaatcgttaacattaataatcactttttacaatcatatttcagttaggttttgcgaaaatatttgcatactttctcttacgaccttgttctaaaaaataaacaataagaaggaaaaattataaaaaatatattggacttttacttgatggtatgtacaacctagtgggagtcgttaccaaatttgtgatattacttaggaaaatgtaaaagagcttattacgttgtattcgtaagtccttttaagttattatgattgagatattgatataccaatgccatgactg

SEQ ID NO: 6016 - DNA, 257 bp, Diabrotica virgifera
  Clone ID: LIB150-021-Q1-E1-G3
aagatagcgagcggccccctttttttttttttttaatttttaagaatttttattttatatttataaaaaagttatttttgtaccgttcaacgaaacacagtgataaacaatttttctgttaatacagacacgatcattgtgggaccgttgtgtatcacgtatcagaaaatcctgatcatatacatattatgcccgaagttaaaattcctaaaaacatatggttcttataggtggtggaatattttaactaatttttt

SEQ ID NO: 6017 - DNA, 420 bp, Diabrotica virgifera
  Clone ID: LIB150-021-Q1-E1-G7
atccgcccacgcgtccgcggacgcgtgggtttagtgcttcctcctgttttttattatattcttatcatcttatcgtaaatagttaatccacgtgtgcgttgatcgtaatccttcattcgtttattactactgaagctgaaacatataaaattaccataaatataaaatcatgttcaatccaactgaaataaaacaagaggttgatgagtttgagacaacttgcaaaaaagaaatggaggacgaagtagatgaagacaaagttctacaggatacctttaaagctgaaattaaggatgaacctaccagtgaaagtgtaaattatgatgcatttgattatgtagatgtcaaggaatgccatataaaagatgaaatcaagcaagatgatggtgtctcttgtaaagatatgaaaactgatgccag

SEQ ID NO: 6018 - DNA, 424 bp, Diabrotica virgifera
  Clone ID: LIB150-021-Q1-E1-G8
actgactgcaaataatgagggggctgaaagtgcgggttttgtgatgaaatttggtgtgtggggttggaatgatatttggaacaacttgttcaagtaactttttcttatatctgtaatgcaaagcaaaatatcggtaatttaccgtgtttttggattcgcagtaggccacttttagaattaaaaaaaaattcagttgagtatcttaaaaaatgtgaaccttcaacctctatggactgcaaaagttaaaatctgtatttattttgatatgcatatctacttacagagatagatttgttaacaaataaacgacacaaactttggtaacacacttttacaatttgactaactacttttaaaatgatatgatattatgaattatgatgatattataaaatgtaaataaaaaatggtcaaaaaatgggga

SEQ ID NO: 6019 - DNA, 69 bp, Diabrotica virgifera
  Clone ID: LIB150-021-Q1-E1-G9
tgcgacctcgatgttggctttgggtttgtggttggtgttgcggctttgttgttgggtctgttcgtcttt

SEQ ID NO: 6020 - DNA, 325 bp, Diabrotica virgifera
  unsure (1)..(325): unsure at all n locations
  Clone ID: LIB150-021-Q1-E1-H11
aattaattcacattgtattcatttaaatccttagaagcaaaaatccaataatggccctatcaccatggttgaagtccccttttacagacttaacgggatctctagtaaatcaccagtggtacggagaatgtgctgatatggaattaaaagttttagactgtctagatgcctatggattggacaggggcttaaaaaaatgtgatgatctgattgaagacttcagagagtgtgctttaaaaacaaaacagttcaaaagaatgtacgccatgcganacgaaaggcaccgtcaacattttgctggtgagagaacatcagagaaataata

SEQ ID NO: 6021 - DNA, 580 bp, Diabrotica virgifera
  Clone ID: LIB150-021-Q1-E1-H12
aagaagcctaattatcgtttaaccaaggaagaactcgagagagaatttggaaagaagtaaaccctagtaacccactgtatcctatatccaacatgaattctactataactttcgaaaacacaaatgaaaaagctaacaaactaaatcttttaaccaagagagaagtggagcggcaactgaatctgcaaaaacgtaaagacaacaaggattctcttgtagcaggtaacgaaaaattggagtttttcgaaactctattcgcagaaaaacggtcatacatagaaaacatgatagatctgtctaaaagtgtcccagtgaatgaactccctgatcatttcaatgaaattttaaaagaaatagtaactttacaaaaatatgtagcagcttcgagtatttttattaggaattatgatatgcaaaaatgtcagaatattttacaggaattaacagtaagaacgaaacaagtagaagacgaattgcctaccaaaaagaaattttcctttaaaaacaaagttaaacaaaaggcacaaaacagcgaaattaaaagttaaagtatagacgatgtcgattttaaaccaaaaat

SEQ ID NO: 6022 - DNA, 391 bp, Diabrotica virgifera
  Clone ID: LIB150-021-Q1-E1-H3
ggtcgaaaatccgggtccgaccacgcgtccgaatcaacacatttcattggtttcataattcaaccggattaacaaatttccgaacctttaaccgacgataaacagtatttaacacacacttttttagtacctaagtttctcatacttcggaccattatacatgtatttatcacatgttgagataatgtaacgtgtactcacctactacgtactaggtaattcatcgtctacatatcacacaaatctgatcgagtctcacgattttgtgacgtaccagtaggaagagatatgtatctaggcctaaagaacccaatacaatgtatttttaacatgtttaaggaaaatccggtactaaaaatcaggtaactagccaatctaactatgggccagt

SEQ ID NO: 6023 - DNA, 409 bp, Diabrotica virgifera
  Clone ID: LIB150-021-Q1-E1-H6
aggcagcaccgtcgctatgtttgtaacgcttgtggtgaaactttcgtgaaaaataaagaaagcaagttgtcaaattgagaaagtagttttgatatcaaaggacacaaaacgtaatggatgaaaaatccgaacatggcgatcaaaccgcggagatacacgatccagtagtcgggtccttggacgaaggaatggatatacggatggacccggaagccgacgtttcggcagtggattcagcggaaaacgcgggaactagccaagacacagaaacaccagaagtggccgaaccaaacattgagtctgctgttgggaacgatgataatactctaatttctgagttaaatgatgttagtctgtctgctgcagcaacgagtaatgagacagattcctttttagactcatttacatc

SEQ ID NO: 6024 - DNA, 388 bp, Diabrotica virgifera
  Clone ID: LIB150-021-Q1-E1-H7
aaccaggcagcaccgtcgctatgtttgtaacgcttgtggtgaaactttcgtgaaaaataaagaaagcaagttgtcaaattgagaaagtagttttgatatcaaaggacacaaaacgtaatggatgaaaaatccgaacatggcgatcaaaccgcggagatacacgatccagtagtcgggtccttggacgaacgaatggatatacggatggacccggaagccgacgtttccgcagtggattcagcggaaaacgcgggaactagccaagacacagaaacaccagaagtggccgaaccaaacattgagtctgctgttgggaacgatgataatactctaatttctgagttaaatgatgttagtctgtctgctgcagcaacgagtaatgagacag

SEQ ID NO: 6025 - DNA, 466 bp, Diabrotica virgifera
  Clone ID: LIB150-021-Q1-E1-H9
ccacacgtcaagacgtcgtagtagtttccagtctcaggaactgtttgattagtacagactgttagtgttcaaggatttgtttatattaagtgttcaacttgcatccggatacaaacaaatggtaggtataaaaaacctagagttattaatgatttctgtgttacataagattttttaatatacatcataacaatttgaattaactattaatacgcaaagtgaaaatttttttttctacgagcgtgcaaaaatgtctgctttcgcccacgcattttagtttagaaagtttcacttttccgcacgcgtgttacttttccgcacgcggtttttacttttccgcacgcgtgttaatttagatatgttaatattaatatggccttaaagtaattataatacatgcaataaactaatatttagatattatttactaatttatttcaaatataacttattgtgttcctgtttt

SEQ ID NO: 6026 - DNA, 437 bp, Diabrotica virgifera
  Clone ID: LIB150-022-Q1-E1-A12
aacggacgcgtgggcggacgcgtgggcttaccaagaataacatctaaaatgaaatacatctactttttgttcatttatttcttggttgccttagcaaaggcagaagaaactgttagcttagaaggaaaactcccaaaatgtgagtgtagggatataatcgatgagatcttgtgcaagctaacagaaaactcagaaaaggtcctcaaaattcaagccaaactagccaaagtagtgaaagaaaccaatgaaattctaacagaagctaaagaaaactcagcccaagtgaaagaaatcgtctctgttagcaccttgcttaaatctcaagtcaactctacggtcacagtcgttactgccaataccgcagctatcattcaaattaaaaatcaagtccacgaccatgtccttgacaatggtggcgacttggaacagaccttgat

SEQ ID NO: 6027 - DNA, 436 bp, Diabrotica virgifera
  Clone ID: LIB150-022-Q1-E1-A2
gaacttatacaaaaataaactcccagcttaaactatagcacagaaagcaagtgacatggatttgaacgttatttttcgcggtttttagatcaattccataagtaaaaatctcagccaacagaaagtacgaatacagaaagcatatttcttacaatatttgtaaatatttcaatagtttctgaagccaacatatgtttttaacgtgttcccaaaataggaacgttggaaatttaaaaaggttaaaggagctaaatactattatttgaacttcctctgtgtttgaatatgttgttaactattacctagcacttttcctgtccactaatcactaaacaaaatatctgtagtaatttctctaacccattatgtattttgcatgtccacagcacgtttaactaacactaacagaacgtttttagctataacaactcttgct

SEQ ID NO: 6028 - DNA, 429 bp, Diabrotica virgifera
  unsure (1)..(429): unsure at all n locations
  Clone ID: LIB150-022-Q1-E1-A4
caaacgcgtccgattataactctcctataccaatcactaaggacgaagatgtataaaaatcactgccaatagctttaattaagaaatttaatanaaatatatgacaactacacgtgaaactgattaaaaagcgataaaaaaatttagaatttaaaaatattcagtaatcctaatattttgataataataatcctattttgacaacggaatccgatttggatgtcgaaacgttaataaaatcattttttttagtaaaattgtggcttatttcccattgaaaatagttgattagaaacatgccacaaggaaataacttcagaacaacattaatcctaatagttttgaaattaaacgttgacttaagaaaatttgttgcatatgcggaaaattttcgtctggtcatcaagcggggagttattgtacagtaaa

SEQ ID NO: 6029 - DNA, 419 bp, Diabrotica virgifera
  Clone ID: LIB150-022-Q1-E1-A5
cccacgagtccgcacacgcgtccgggaggattaggattaggaggaggattaggtggaggaggaggtggtggtgctactattactaccataaacagagcagtacctgttcctgtacctcaaccttatccagttactgtcaatagaccagttccagttccagtaccacaacctgtcgaagttccagtccccagaccagttcaagttccagttccagttgctcaacctgttgaagttcccagaccgtaccctgttgtagtaaatcgtccagtacctgtagccgttccgactccagtacgtgtaccagttccacaacccgtcgctgttccagtgccacaaccttatccagttacagtaccacaacctgttccagttagggtaccccaaactattgtagtaccagttgctcaacccattgttgt

SEQ ID NO: 6030 - DNA, 177 bp, Diabrotica virgifera
  Clone ID: LIB150-022-Q1-E1-A6
tatagatccccaatcggaagctatccgtcaagcagtaggaagtctcaaagataagaaaaaggatgaaaagtctgaagacaaacaaaagaagtagtaggaccattcatagtagttttttcatttacatatttacgtacatttatatttaatttcaattaataaaatattggtatgctt

SEQ ID NO: 6031 - DNA, 232 bp, Diabrotica virgifera
  Clone ID: LIB150-022-Q1-E1-A7
gtgttgttctttttttttttttttttttttgcgtgtttgggtgggccgggggcggggggggtgcgggggggggggtgtcgccggccggcgggggggggggcgggcgggggggcgcccggggggggcccggcgtggtcggcgggcggggcgctggggtgcgcctggcggggggggcccgggcggggcggcggggttggcggggggggcctggcgggggccggtcggggggggg

SEQ ID NO: 6032 - DNA, 429 bp, Diabrotica virgifera
  Clone ID: LIB150-022-Q1-E1-A8
cagacgcgtgggtgcaccgaccacattaaggctatcttgagattgaggcctggttgaagtgaatattttcgttgcaccgtgtgtcaaactcgatttaaacctcacttaatttaagttttcttaagccgccgaatttgacggcttaaattgggtgaggtttaaatggagtttgacatacggtgcagcgaaggtatttactttgagcgggccttaatcttaagctagccttaatattatagtcggtgcaaatggcccataaagttcagttttatcggttaccatcaaatatatcaaatcttctttttaaaaatccctcagatcttatcgaatcaagtcaaacgcatcctatatagagtgttatattaggaaggtggcagtttttgccacttggccaagttttcgcaagctgtaaattttcggcactttgtg

SEQ ID NO: 6033 - DNA, 448 bp, Diabrotica virgifera
  Clone ID: LIB150-022-Q1-E1-A9
acgcgtacgataaagttcaagcagccaaagctgcccattttgcagctcatgcagcagctaaataccagagtgctccttgggctcaatctggatacgcttctcacaacgctcttcccgcagatacacccgaagtagctgctgccaagttacaacactaccacgactacgctgtcgctgctcaaagaaatagcgttcatggttatgctccagctgtagctattggacatggccaaccagtagatacacctgaagttcaatacgctaaagctgcccattttgctgcccatgctgaagctgctgcccgttcctacggacacggacactacagaagacgccgtggaatctacgattttcacatccccgttattgaccacaatggtgttccagtagaaactcctgaagtacaagctgccaaagcccaccactttgctgaatattccaaagtatt

SEQ ID NO: 6034 - DNA, 352 bp, Diabrotica virgifera
  Clone ID: LIB150-022-Q1-E1-B1
cataagcaacagcctcaacaatatcatacaaagtgacagcaattgttgccttcttggtcgcatcccaagccgtagttaattctcgagctctctcgggcgaactccaggtccatttgaactccaataccaatccaagttccaatacaagtttgcagattcttttaacggttaatttaagggacaaattgaaaggcaaattggaaggccaattagaaggccattatcccgttaataatcccatgggaaaccttgccgtatccgttacaatggtgaataagccgacggatttcccaatagaatccaaactactctcaaagtaactcccgctcttaacacagcacttaatcaagtc

SEQ ID NO: 6035 - DNA, 431 bp, Diabrotica virgifera
  Clone ID: LIB150-022-Q1-E1-B2
caaacgcgtccgcccacgcgtccgcccacgcgtccgattgtcgacatagtcttggctgacctcattgggatgtcgcccgtgcagaggtttacccatgcaggtgcgcattttttcgtctttagtgaggtgatttatgcgcatttctggttccctcagtttaatcggtgttgtgtcatctactgcgcaaatagcgcgatgtagagtagatgtctcagcttgcctctgaaaataagttcttaaattagcaatttctttatctaattgctcacctatatccataagtcctcttcctcctagattccgtggtaatgtcgttcgttctactgcacttttaggatggtgtttttgtgcctttgtgaggtgtgttcttacttttcgctgaagattctctatgtccgtttttgtccacttaacaatgccaaacgaatagc

SEQ ID NO: 6036 - DNA, 395 bp, Diabrotica virgifera
  unsure (1)..(395): unsure at all n locations
  Clone ID: LIB150-022-Q1-E1-B3
gtccgcacacgcgaccgaaaagtaatangcgaaagtaataaaaaaacaggaatagacataaagtaataacgaaagaggtaaacacacatgtaataagaaaaaagtaataaagaacagtgataaacaacagtaataaaaggagtaataacgcaaagtagtaacccaacaggtaaaacaaaggtaatacatcagaagtaataaaaaaaaagtagtaaaaaaaagtatctaaaaaatagtacgaaaaaaaaagtaataaaaaaaagtaatacaaaaagtaatagcacacaggaatacaaaaaggtattaacatccaagtaaaaaataggtattacaaacaagtattaaacacaagtaataaaaaaaggtattaaaaaaaggtaataaaggaaggtagt

SEQ ID NO: 6037 - DNA, 415 bp, Diabrotica virgifera
  Clone ID: LIB150-022-Q1-E1-B4
gacaaaaatgtacaattcagaatacctttgtaaagatgaagagtttaataattttatggtaaaagttagtgaagtaaataatattgtacaaaaattggcttcaaaagataaacaaatacaagaaattggcaacatagaagcgcaaagatatcttaatgacgatggacagaatttgaatgtagacgataatgtagaattaaaagttaaaaatgcaagaacactgattaacaagaaagttctagaaaatgagcaaaaagatccaaatagcatgtcacaagaagcatttatgaaagaagttgaaaaagatgctgataagaggtacaaagataagttggtaaggaaagaaaaaatggaaacctttaaaaaacaagccacgcttgcattcagaagaagggaatttgaaaaggcattaact

SEQ ID NO: 6038 - DNA, 452 bp, Diabrotica virgifera
  Clone ID: LIB150-022-Q1-E1-B5
cccgggcccgtgggtacgaggaaatggtaaagtaatgaaggtcaaccaggacaaaggatgacgtttgtatttcagtatcactgtttttgatttattttgttcaacaattttgaaaattcttagacgttatgtctatttgtactaaaatagcttgctgagattttgtgaattattgagaaaatatgaattatttaacctggttacacctggccagtgtaaacgggtttatttctgatttatatatgaagattttttaaaagtatttgtaataaataatatatgagcaaaaacagcaagtttagcacacatttaagttgttttgtcgatattgggatccaaaaatttcaattaatttcagagtattgcaccatatgacgttaacatcgtaatccaatatggcgactaaggtgcggttcgccatcttttcgagattcgagacgtagtaatagatc

SEQ ID NO: 6039 - DNA, 418 bp, Diabrotica virgifera
  Clone ID: LIB150-022-Q1-E1-B6
cacacgcgtccgcccacgcgtccggggtgacgacggaagaaaatttcatatattttttatattatctatagtaatctgtaatattacgaaatgctagacctgtttatttacagactaatctagagatccacgttagtatatatgtttgtatacagtgatgagcgcactaatgaccggaaaaatagcgcaaacgatggaaaacatatgaagttatgagataaaaagagatgaacttagtggaggtgttaactttggcgatggtaacttgtagattgacagtatattgattgtttccaacctttagacgtattggacgaatttgagaaatgccactgccacagtgacagttttagttgacatactcctctgatacgtctaaaagtgggaaacaatcaatataatgccaatttatgtgtta

SEQ ID NO: 6040 - DNA, 428 bp, Diabrotica virgifera
  Clone ID: LIB150-022-Q1-E1-B7
ggaaattttaagaattttggatttgtcacaaattcgagaaggtattaaattaaaaggtggattgaaatttgcttgtgacgaaccaacataccaacaactactggtagcagtaagcaatataagagtattaggttggccactaaaaatattgaatattaaagaattgcctgtttatacgaaaatattgataattttgaaaggcattccagaagatccacaaaaagttcttgaaaagttagaggttgacaacaacaagataacgaccaaaaattggcacttaattcaccgtgaggtcaaagaggattcgcaacggatctttttttccattgaccaagagagcgtaaaagtgttagaaaccattgattacaaacctctttttaacaatgaaagagtcaaattacatattatggctaagaaaaagcatgaga

SEQ ID NO: 6041 - DNA, 340 bp, Diabrotica virgifera
  Clone ID: LIB150-022-Q1-E1-B8
tttgtaccttgagttttgggaatattaattacatatgttccccattgctatctacaatatatattcagcttataggtttgattttgtgtcatatgtcataatcttgggacaatttgccggtatatcatcatcgacagagggcgatatatcatattgtttgttcattgtagttgttgttgttaaagaattctatttttattagttctcatgcttattttgtgtatttcgtatctttatattcgagcgctgttaaatgtagtatcatcagcgatatacctgtatttaatgttaagtcggatgcgttttcagatatgtgtctattttcagatgttcaatttag

SEQ ID NO: 6042 - DNA, 434 bp, Diabrotica virgifera
  Clone ID: LIB150-022-Q1-E1-C2
caattttactttttttagaatattatatttcaaatagtaatgacatacttccccagcgccctctatatatataattctgctaacaaatttgaaaaagtgtcatatgtcaaattcttggtacacagtaccggcacatctccatctactgaggccgaaataataaattgttggatcatattagttttaattgttaaaaattcttttttttttagttctcacgcttattttgttcatttcgcagctaaatattcaagcaaaattaaatgtattatagtctgcgacatgcctgtatttcacgttaagtcaaatgccttttgagatatgtgtttattttcagatgttcaataaagcctataaatttagtaaaattgatattttgatcggcaccaacaagtttcatacagtttgtgaggttttgttataaaaagctgaat

SEQ ID NO: 6043 - DNA, 424 bp, Diabrotica virgifera
  Clone ID: LIB150-022-Q1-E1-C8
gaacaaaacagaagaccccaaaaaagcgaaaaaaagaagaaaatggtgcaaattcagacggtgaggatttagatgaggaagaagaagaggccattgaagaagaggaagacacgggcgaagaagacgtagttgaaggggatgatgaagaaatagaggctgaagatgaagaggatgtagagggcgagggtgtagaagaagaagaggatgatgacgcataataaagtgggtgccgtcaaaccctgtgaactttacttggcggactatctcagtgcaaagtctcgagttactttgtggacattttattttcattttcaattagtcgttgttcagtgcgccttaaacgccaggatgttccacgtcgccaacgttgttataacttcattcatataatacaccatccatcgacacatccttcatcatttta

SEQ ID NO: 6044 - DNA, 444 bp, Diabrotica virgifera
  unsure (1)..(444): unsure at all n locations
  Clone ID: LIB150-022-Q1-E1-C9
cttatacacgcataagcaaacttaataagtatttacaaaaccgattgacaaccaacgattcaaaccattatcgttggtattatatattattggttatacatatattattatcgttggttaaaatcgtcaagatgaagttgctttttgttttgtcttgtgttttgtttgttcaaagtgcaaagaaattgccttcttttgtcgaagtatgtcctcgagataataaggaggcatcagaatgtctagcacgaaacgtgaagaatctaacaccaatgcttgggaagggaataccggaactttttatacctccgttagcaccacttgtcttacagtcagctgaaatagcaactagtccaagttttacatgtagtttanagaacgctaaagtatacaacttggattccatagtaatgactgatgtcttcataaattttgacacaaaatcgt

SEQ ID NO: 6045 - DNA, 434 bp, Diabrotica virgifera
  Clone ID: LIB150-022-Q1-E1-D1
cacaaatagaaattcagctgcaaaggagtctacttcatttaatagattcagtaccccaaatcgatcaataaaaacgaaaagtcctgtagaaactgaaagttttggatctcgaactttagaagctcaagaatacagtacaaccaagggtaaatcgccaaacaaattcctaaaaagtagagaagctgaaaacctgaataaatccttagaaaggggctcaactggtaatagcaacaagtcaagtaaatccagtaaaaatagttcaagttcttctaaatctgtatgtgctattaagacgaaacaaagcgcagaatcaaaagaactactttcaagaccacgtactttttctgagacagcaaattcccctagtgcagagcccaagaagaaactaactaatagtaattcctttaggtcctttcttaagccttccgcgttga

SEQ ID NO: 6046 - DNA, 442 bp, Diabrotica virgifera
  Clone ID: LIB150-022-Q1-E1-D12
agcttcttacaccggaggaattggcaacgctacagaactctggaagaaagacaccctagatgttttcctacaactagacgaacttttcgggaaaaactacaaatctacgacgaatgcgtttactatgttcggaagatatgacgacgaacatgacttactgttccacgatgtgacagagaagttgagaactgtaccgacccttaaagaaaacgatccaatgccgtttgtgtacgaaacctctttaaatagtgaccgtcaatgtttgatgtctggttcgagtaatactagatttacattttcattgtttttatttgtgacttgtttatatttagtttattccgttaagaatgttttactgtgagtcgacaatggcagcgcattgggcactatagataataaaagtttacaaggaaggcgagcgtctgttcgttttgcgattgtt

SEQ ID NO: 6047 - DNA, 93 bp, Diabrotica virgifera
  Clone ID: LIB150-022-Q1-E1-D2
attgatctgcatccgagtctgtgtcatggaccatttgcaatgccctatgtcggtttccgcccacgctgtgtcctgttctaacggtgagttttg

SEQ ID NO: 6048 - DNA, 434 bp, Diabrotica virgifera
  unsure (1)..(434): unsure at all n locations
  Clone ID: LIB150-022-Q1-E1-D4
gaaaagccctattggtttgttttttgtttcgttttcataatattatgataataactataatgatagctaatttattacattcctccgtttgttgaaataactaaacatttattgtgtcattttttgtttcctaaacaaaggcagaataagtatacaaaattttggattgaagaagtggtcttttaaacaccagcagttcccttctaccacagagagaataccccaaccaacgggtattctgtgcttctacatcttaactgaaggcagatggcccactagattattatatggttgcaaagttattttccaacttcatacaaacagtgagtgtgttgtatttatgtcncctatttaatagtttttgtcaaatttcaatatttttattcagttgatttgtataatatggagtttaacatcgaaatttgaagaaaatt

SEQ ID NO: 6049 - DNA, 393 bp, Diabrotica virgifera
  Clone ID: LIB150-022-Q1-E1-D6
gagcaatgatgagcctccaatactgtggattggtccttttggcaggccttttgttggtttccgcccaccctggaaccgactctaaggttgaagccaaggtatcttcagtagccgagaagaaacaggaaaaacgtggtcttcttgatctaggctacggtgggggacacgactttggaggaggacttgaacttggagggcatggtttggatttgggtggacatggtggtttcgacggaggatatggtggagggttaggtggagggtatggtggattagacgaaggtcatgttaagcacattaccatcaccaaagaagttaaagtacctgttcctgcaccatatcccgtacacatcgaaaagaaaataccagttccagtgccagtcaaagtacctg

SEQ ID NO: 6050 - DNA, 429 bp, Diabrotica virgifera
  Clone ID: LIB150-022-Q1-E1-E1
cattttcttaactacacgcttaatttagtagtcttcttactgatcatcatcacatgggttaaatagttctgtataggcactgcttttccttcggttaatctgtttgacttttttctatttcttggttaatgttcttattcatttttaaatcctgttaacagaatatttccaactttatttatttcctttcgttttttatttctatgtagctttaactcttgcttactcgacatgcatctcagttaaattgttgacaaacctgttttctttgatatatcctattagattttctagcagttgtattaaatttaagtactattctccgtcctctttgttcctgatttcttgaccatttttacactatattgattcattccggcagttctgcaataaatatattatttttttacctttaacctctacatgaaa

SEQ ID NO: 6051 - DNA, 445 bp, Diabrotica virgifera
  Clone ID: LIB150-022-Q1-E1-E10
aggttatttctttttatttttgtgttggattagtactgtattagactgatatttatgtactattttaacttctttctcggtcttttttattaacttttctattattagtatactaattttctttgtatattttatgattattctttctttacttttgtacttccaataatgcttaatttcattgctttatttcttctttttttactaattacatacatacttatataggtttatcttattgcatagtttttacactttaatattgctgtatatattatacccttttttcttcctctattgcccctgtagtttattaaaatctactcttaaggggaaaggcgcaaaatgtcgcttgcaaaaattttcaatgtgttttaaatgtattcattattttcgaatcctgagagggctaatgggtatttttgaaaaatttgaacgcaaaatg

SEQ ID NO: 6052 - DNA, 167 bp, Diabrotica virgifera
  Clone ID: LIB150-022-Q1-E1-E3
acgcgtggttgtggttctcgcgcctggtgttacatcccaggtagtgttccttttattcgaagtttaatttcgagcagttgcatttggtttatttccagacaatcaggatgggtaaagaaaagagtcagattaacagtcgttggcattggacacgtaaattctggtaa

SEQ ID NO: 6053 - DNA, 427 bp, Diabrotica virgifera
  Clone ID: LIB150-022-Q1-E1-E6
aaatgaagtgtctagttcttctttccctagtaacccttagtgtagctgcctactacccaagtactggtaggcaggtgacagtaggagtagctggaaatgtgaaactagtcggctctcaaggttcccagattgacattcgtagaagtccttacaacccaagaactgtcgacgtcaccctcagaagtccaaatgctccaaccagaactctgcaaattgatgaagccaggaacggccaacaacttggttattccaacctccaaggtgtcaacaaccaaggtgtacaaggtgttagtgacattgtctctctgcaaggactctctggttatggcaacttccaaggacaatcaagagtatattccccactcaaagagatcttaaagaatagagtacaaggaaggagcttcaatcaacaatggttgaacaattc

SEQ ID NO: 6054 - DNA, 450 bp, Diabrotica virgifera
  Clone ID: LIB150-022-Q1-E1-E9
agcaaagaccttgtctctttttcgtgataattttcacggaaataggcatggtattcgtagggtgcagcaaaatagtgctaaaatttgttgattgacgaaggaccgacgtgttttttacacacttgtttaaccaaaaactcaagattccaccgaaaacctttatcgaacccagagggtggctaccgaagggtcgtaacttggacgaagctagcccagatactagcagccttcttttaccctacaactggaaaattttcctaaacggcgaaccgccttggcagtgctgacaaaaatctaggagatactaagtcacacctaccttaataaacctgtgtgaatctgagcacaggctgcctccttgcttatttcatcgaaaatattcaactgtatttgacaaagacaccttataaccaaccaaaaacaaaatgaaaattccaagtgttgaagaac

SEQ ID NO: 6055 - DNA, 415 bp, Diabrotica virgifera
  Clone ID: LIB150-022-Q1-E1-F2
cacacgcatccgtctagaactacttcaagaatgtctgcaagagcttggttcctttggtgtctcctagctttggcttcagtttttggagttaatggcggaggacatggtggccaccatcacgtagtattcaaaatcccagaacacattcacaccgtcaaacacacacataccgtctataaaaccatccatcatcatacaaaaggtcacgaagagcctcacagccatgggggaaaaccattccattggcactgaagaaatttcacagttgaaatttagataagataattttttgcaagctttaattatggggtaacattccagtatgatttttttttcaaaacctatagattttctatatataagtaatatggaaaactgctgaggtcgccaaactaaaagcaaaacgcttcgggat

SEQ ID NO: 6056 - DNA, 438 bp, Diabrotica virgifera
  Clone ID: LIB150-022-Q1-E1-F3
cacacgcgtccgaaaaagaagaacaatcccgccttgcaacaagtgggacacccagtacctgaggaagacgtagatgaagaagatgaggaggtagatgaagatgaagacgagtaaacctgtaagataacctctctcgttttaagtcgccttctcattcctctattgtaaatatacatgttagcaagtgtattaatcaagttctcattttttattttttacccgaaacgaaaatgtgtgtacttacaaaactgacagtgtgtgagtgaccgacagatatccgcctttcattcatatttttttatttttttaatctgtcatatcctcaagggcattagcttacattgtaataaactgatgtgtaacggatacttttttgtaatttgtaaaaaaagcaactagaccactgacttgtattttaacatttattaacgactgaac

SEQ ID NO: 6057 - DNA, 432 bp, Diabrotica virgifera
  Clone ID: LIB150-022-Q1-E1-F5
cacacgcgtccgatgaatggtagctgacaatttcggaaatgcgtcacttggccaaaataatcttcgaaatcatcagaagacatttctgcatgaaactctttcgtagagtttgaaataaattccaacaaatcgtttatctcctgcaatatgagtgatattcaaccgaagacgtttaccagttggaaattttaatccagtagccaaacgttaagtacatttctgacgagcatatgaaacctgtttatcatgccaatatattctacttttcttacaaaatgtacttcattaatccatttcatccagataaaaaatattacctttccttatgaaaaaatattattaggtgatattaaatttcacctacaaattatttgttctttctatataagtacaaattttctatcgtgcttcacccaaataaagtctaatttg

SEQ ID NO: 6058 - DNA, 415 bp, Diabrotica virgifera
  Clone ID: LIB150-022-Q1-E1-F6
gccgggcaacaaagatagaatttgtttgatttgttgatgttttctattttgatgacgatttccgaagtggaggtcgaagcgtaaaatatatataatttcaaacttaaattgtggctttattcccaaagaaaatagtaaattacaaggaaatagcttccgaacaatatttacaaatatagataccgttgatgtatattcgaatcgtagtccgttcgttgcaatcaacacaatagtgccttgtaacagtaagtacataattttagtacaagttattacatatgaagatgcgaaaaagattcataagccatctctttcatcgtacatatgtgtcatatgtcatgtcactttagacgaatatggcctatcaaggaccaacacgtcgtttaataattatatttaattacaacattgatat

SEQ ID NO: 6059 - DNA, 430 bp, Diabrotica virgifera
  unsure (1)..(430): unsure at all n locations
  Clone ID: LIB150-022-Q1-E1-F7
caaacctttaaagataaagaatataggatacatgttcatagtttcatttgtgatgctccagctcgagcctttataaaatgtataaaatcgcacaacggttattcagggtgtgataaatgtactgaagaaggagactactttaaacataggatgatttttaataacattttggcaccaaggagatcggatcagtaatttttgctaaaatctgatcagaatcatcatactggaatttcacctttggaagtcttaaatataggattggtttcaaaatttccaattgactctatgcattgtttatacttaggtgttatgaaaaaacttcttctcacatggatatgtggtgacttgcgtgttcggttatgtggtanggatgttacaaacatatcagaaaacttagttttttatggaaaatttgttgtctcagagt

SEQ ID NO: 6060 - DNA, 152 bp, Diabrotica virgifera
  Clone ID: LIB150-022-Q1-E1-F8
acccacgagtccgaaaaaaaaaaaaaaaaaaaaaaaaaaaaaaaaaaaaaaaaaaaaaaaaaaaaaaaaaaaaaaaaaaaaagaaaaaaaaacaaaaagaaaaaaaaaataagtaggggggccgctcaggtggttcctgtcttatttaggct

SEQ ID NO: 6061 - DNA, 288 bp, Diabrotica virgifera
  Clone ID: LIB150-022-Q1-E1-G1
gtccgcattgtgtaccatgtcctttcagagcgttggttaccatcatagctatgtaaattttatttactaccatccgaactagcttgcttgtatcaataccatagtaacgttcacaagttcttcaagcatgcagttcttcttcgtcctggagggcgtttgccggtcatttacccgtgcataagatggtgtagcgacctataggtgggatcttctacgacatgtccgaaataggctagctgtcgtttgtacgtgtcagatatgggatatagttttggtatagtgagaaga

SEQ ID NO: 6062 - DNA, 457 bp, Diabrotica virgifera
  Clone ID: LIB150-022-Q1-E1-G10
ccacgcgtcagaatttatttaaatgtgcaattaacaattcttccaccgtccgatttccatctaattcatattttctatcattgcaaaagtccataaacgctttccatacaaattttttactgtaaacagtattctttggtatatttgattcgataatttcattaatattctcatcagtattacaaccaaatcgtgacattttgaaatattgaatatttgaaatgtcaaaatcgaaatgaaacgaaatgtaggtatccatagctacatgattgagtgaaaacagcccatgggatctgttttcagtataatgttggttttattggttgtattcaatcagatgaccacaaattaattgatttcattggatttctaattgagcaaaaaaatttcaaaaaaattatcagtagtaactgcacaagagctctaaaattctatattaattttagagttcgagtgc

SEQ ID NO: 6063 - DNA, 209 bp, Diabrotica virgifera
  Clone ID: LIB150-022-Q1-E1-G11
cgaactcttggacggtctccaccgaccaacgcggtagagcaaatcagcacattggcgtatatttgacaattgtagtgcaatgtatgcagttgtgtaaaatagagcataccgcagaccactaacagtgacgtcaccgatcgatacatcagcgccagattattgccgcaaatcgtcagcaaacttatataaacattatcttccatgttcca

SEQ ID NO: 6064 - DNA, 132 bp, Diabrotica virgifera
  Clone ID: LIB150-022-Q1-E1-G2
gcttcctgccgttgtttgttctgttttgtggtctctttgttgctctctttgcccgcggtcgcggctgggcgggttggccgtggggattgtgcgtgtttggcggggtcgtggggttcgctggtccggcgtgct

SEQ ID NO: 6065 - DNA, 424 bp, Diabrotica virgifera
  Clone ID: LIB150-022-Q1-E1-G3
cactatttcaaattaagtcattaaaaataatgtcaatattttaataacacggtttgattattttttagacactcaagtaagtttagagaatattttaactgtagtcttgagaaaatgtagttaaaatgtagttgtttttgcgtattagttggacatagtccagtcaacatacttttgatctctataaacgcgacgaacaagatgaattttgctgagaatgtcaattttgagattccaaaaaagtttgccgctgctacccccgggcttccccctaaaactttcctcgtagggggaacccttctataagataaaatgtttggtttcaaacaagaagtgcagctgagataattttgaacaaaaatgtcaaaattggcactttttgggtagaatgaacagttctctcataaataatgcttgaagcgac

SEQ ID NO: 6066 - DNA, 399 bp, Diabrotica virgifera
  Clone ID: LIB150-022-Q1-E1-H1
atcgtgttttactgtagctagatattatagattggcaattctttggattaattaactttagatttattaggaaatatgttgatgatacataagagtttaatacatttcaggattgacgtaaacttagtatttttctaaatacttctgtttacagtaccttcaggattcttaatttaccaacttgattgcatgtggctacattaccttttatatgcacaataaatgtcctgcgcacacaattgttatgttttaaaactattgtctgaaaccgattgcactctcgactggttttcaactaatttttcaattgttaatttaatacaattacatcggttgggctggagctatctgcacaatatttttcatatgtcaatcagcacgtagacttttagtttgaaa

SEQ ID NO: 6067 - DNA, 434 bp, Diabrotica virgifera
  Clone ID: LIB150-022-Q1-E1-H3
acgcgtccgcaatctttatgcgttattttgccggttattagcgcgctcatcactgtatttccttaaagagatacatcttttcctttgtgctttttcttcaatcgtctgatattactctctgtctcagtctctacacaatttttcaatgtataatcgttgtataacatttaatttcaaggagaaaaatgtaaaccatgtaaaataaatgtaaaaaaggtcctacttgtaatttaaccaacaaggtaagtagtcgacctattctttctatacttcttagtagatctcataggttattcttaaatgctaccatctaaggaatgagaaaaattatgaataataattaaagagaagcgacaacagttcacagccttccctaattcctgttaacaatttgaattttttgaatccgagtttttagtcatttgatgatactg

SEQ ID NO: 6068 - DNA, 400 bp, Diabrotica virgifera
  Clone ID: LIB150-022-Q1-E1-H4
tcagtaattttaaaatatcttcagttctaatgattggataaagttttaccaaacatccttttgtaggttttttaagaaacaaattttgcattttgtaaaaattatttatattgtattagtttacgaattagaatcagttaaacaattaaattgttatataacaaattattatctattaaattgattatccctcattgtttgactgctgcccaaaaaaagatggaatatttactgtttaatttgaaataatatgaaatgtatgtataataactagataaatgcaccttcgcagtaaatacagattatagtgtaatgtctatttgacaagcctacgtcctttaatttcgtcctccaaatttcactaattgtataaatatacccgtccagaagatacaaaggg

SEQ ID NO: 6069 - DNA, 412 bp, Diabrotica virgifera
  Clone ID: LIB150-022-Q1-E1-H5
caagatcctgtattactgatgtaggataagacaaattggtaaaaatttggtttatttaatttttgtaaaattaggaaaagtgttgttgattcaaggagtttaagacaatacaactttgaggaaaacttagtaagtttctaaatacttctgaacacggtaccttctgaatacttaaaaaatcatcttgtttgcatttggctacaaccctagatatgcacaactaaagtcctgcgcccacgacggaagtgttttaaaactacggtctgaaaccgattgcactcgcaactggttttcaactagttttcaaccgttatttgaaagcagttgcgtcgtgggggctggacctaactgcgcattatttttactatcccagtctgcacgtatatttttattttgtaattaagcttgtgta

SEQ ID NO: 6070 - DNA, 451 bp, Diabrotica virgifera
  Clone ID: LIB150-022-Q1-E1-H9
cccacgcgtccgctcacacgatcatcatgaaggccttgattgtccttagcgtttgcttttgcttaactctagctgccgaatccgagaaaaaggaagtaacgcaggagagtaaaaaacaagagaaacgcggtctttacggccttggtgatcatggtggaggattcggcctaggcggccacgattttggaggcggccatgattttggaggcggtgattacggaggtcatcaagaacaccacgaacacgtaaaaacggtcgtagttgaaaagaaaattccaactccttacgaagtagtcaagcatgtgccttacaccgtagaaaagaaagtaccatacgaggtcaaagtaccagtaccacaaccttacgaggtgtacaaaaaagtaccatatccagtaaaggaaattattaaggtgcctgtaatcgtaccacaaccgtacgaagttattaaaaa

SEQ ID NO: 6071 - DNA, 437 bp, Diabrotica virgifera
  Clone ID: LIB150-023-Q1-E1-A1
aattaatttcattaaatctatctaaaaaaatggaaatatttaatgaagcccagcggcaaaactcaaagtttaaatcagtgtggaatcaaattgatgcagatccaaaaacgagtgatagacttctatcaacatattcacctgatgaaaggttagcaatttatgattattgtgtacaaagtacacaaggtccaccagtaccagaagaaattagtatgagcattaaagaatcaaacagaaaagaagatacaacacccactgaagaggaggcattaaaaaaacaacgtgatgccaaacgacgcccagttaaatataaatctgtacataccagccgcaacaaaagttatatagaagttatgagggaagttattcaaaatcaaacagatatgtacaaggattatttaattgaaaagcaaaaagaagaagaggcaattgagcgt

SEQ ID NO: 6072 - DNA, 448 bp, Diabrotica virgifera
  Clone ID: LIB150-023-Q1-E1-A11
gcgggtcgatacaagcctctagattgagacgaaatatatgttgatttttactttttttacaaaaaaattcggtattttgacttgtgaatgatgccaaagactcaaaaatcgttaaaactaaaaatctcgactacgttacttcgagaaactcatacgtcaattaaatatttttgaattttttatttcacatgatccaatgccgatgtccaacgcaaaatccatttttgttaaaagtctgtaaaaatttgccacagttggcttatttttgaatattttgccttgaaacttttttgaatattctttgtaatgtactgaatatgtatattaatttaatttagacataatataataaacatattcaaaaaagatgtgcttgaaatgttgattcaaaccataaccctctccccttaacatacgtgtgatatattggctctctaataaaatttat

SEQ ID NO: 6073 - DNA, 439 bp, Diabrotica virgifera
  Clone ID: LIB150-023-Q1-E1-A12
gtgggtcgatacaagactctagagtgagtcgtagtattgacagtaaaataatactgatcgacttccttaaactcattcgagacgattcagaagaagtcttagatgctctagttccgaatataggacctattctggtcatgtttacttctgtgggtgttttgtcaagagataagacgactcaagcaacacttgatattggtagaggtctgttgaaatgtcaagtagagatctatagtaactataattggcggaggaggatggcgtttttagtacagttggaagatttgccgacgtgtatgccaagcgattttattcaccaacattttacacctcttgttctgaaattgtcactggaatcgagagcaagaccggtcaggacgcaggcagctaggacactactgatttttcttagatataacgtaaaagaaaatcacagaaa

SEQ ID NO: 6074 - DNA, 434 bp, Diabrotica virgifera
  Clone ID: LIB150-023-Q1-E1-A2
gcccaagaaaatgggagaagaagaacaattgtatgaagtattgatgaacaaagcttttaactttattaaaactagatccctgaaatggaaggtgctagatggagccgatcttgttttggccggcggatctgacaaagatggaagcctcaatctcggtctctccttgaagcctaatactgccggtattgaagaaggtcgtaaaaagaagaataaggatggtggaatgaacgctcttatggctgcagctgtgatgaagattggtctgttgaaggctttagcttttaaagctttagtgttgttggtcggaaaagctctgcttgtaagcaagctcgcccttgtattggccagtatcatcggtttgaagaagcttctcagtggaggcgagaaacacgtcacatacgaagtagtcgctcaaccccatcaacagcaccacg

SEQ ID NO: 6075 - DNA, 444 bp, Diabrotica virgifera
  Clone ID: LIB150-023-Q1-E1-A4
gggtcatcccacgcgtccgaacacgcgtccgcaaacgcgtccgatccccgtagtgtggcggacctttgaaagacaccgaagcacgaagacacatcaatagaaaatacatcatgaagacggtgttagttctaccagttttcttctgtttagtgaacagtgcaccaaaattaaggcttacaccccaattcatagcaccgccttctttactgacgttgcccagtaacgccactagtataagaactgatatcagtgactcatttcactgtgaaggaagagactatggatactatgctgacgtagaaaacgactgccaactgttccatgtgtgcttgccagtgacgtactcagatggaagaaatcaaactttcaggtggagttttatctgtccggaggaaacagttttcaaccaggaaatgttcacatgcactagagcagatgaagcca

SEQ ID NO: 6076 - DNA, 427 bp, Diabrotica virgifera
  Clone ID: LIB150-023-Q1-E1-A5
accacgcgtccgaaaacatatcctgtcattaaattttatcttttattcaaaattacaatggttattatctaaactagtctaaaaatgtcctattatttaacataatgcaaaataaatataccacgaaacctgatactgctatagagaaaaacaaacaactattacttcaattggaaatggatgacgaggtaaaacaaattataaattatccagaaaaatacgccgatacatttttggacgttactgttataaaaccggttaataacaaggagttcactagagaaaagaaagtaatgtctggtaatcaagtaaagcagttcattacttccatgaatttaaatgaagatctactaccgtctactcatgaagaaaaatgctcaggtgatagtcgtagaacttcaaatcaatctccaccaaacagcagaaa

SEQ ID NO: 6077 - DNA, 418 bp, Diabrotica virgifera
  Clone ID: LIB150-023-Q1-E1-A6
accacgcgtcagggtttgaacaagcaagtagatcagcctatccaatcattggtatatcaccagaatgtgatctctcaacaagttgagcaattcattcaacggggataacgtcgtccccaatacttgctttcccaacaagtattaggcgaccaacaagttcgccaattgattaaagttttgagcacccaggaactgaacatgatcaacttcatctaatagtacgttgaacaatgtaatcaagttgatcaacaaatgtacgctgttcatcaaaatttttaccagcaagtccacatacttgttcatcaggtagttcttcaccaatctcagatcaaggatgaaatccaggttcttatccagtaggaacatactgttccacaagaacgagttttattccaacaattgggccaccatcaagttg

SEQ ID NO: 6078 - DNA, 52 bp, Diabrotica virgifera
  Clone ID: LIB150-023-Q1-E1-A7
gtttgtcgttgctactccctgtagtgagtcgtattattttgtctgttcgttt

SEQ ID NO: 6079 - DNA, 424 bp, Diabrotica virgifera
  Clone ID: LIB150-023-Q1-E1-A8
aaatagatttgcgagaagtactgaaaataataatttaattaataatttagtattcacgttaacaattatgtctcttaaatatcaaactctcttgtatgtggttacttaatttaagttttttcaactataaaatgtaaatttttttatgttaattaataattattattgacatatacctatttataacctacgatatagacaacagtggtagtttccccacttctttttaatttgacgaacaaaggacatcacaccaatataattcatttatatccaaatataatcataataatgtaatttttacacattccaacttacctattatataatatgtattcctctttcatttccagagttcaatagtagcatttcaaagaacaatggtatagttagcaggaataattgtgttttgggaaacgacaac

SEQ ID NO: 6080 - DNA, 435 bp, Diabrotica virgifera
  unsure (1)..(435): unsure at all n locations
  Clone ID: LIB150-023-Q1-E1-B1
cacgcctgcccacctcttcgtgaaaattttttattgactaagaatattaattatgggtcatagagcagcagtattcttaactttaaagttaaacggcctacatacgttccgaccgtgccatccgacatgactgaactccccgaccatccttgtcggggtcagctctaaacacatcctgaccaaactatccgacaaaacaagttccacgttccaaccattactacaggcctgtcgggctgtcggaatatcacggttgtacaaccagataggtcgaccgaccattatatataacttttttgtcgtgccaaaaacattacacacaccccaaccgtcgggcccaacgttgtcggtcatgacatttgtgtgatttaaggttgatttatcttangaagggacgtggacagcacggctgccttgcagggcatgttgaagaat

SEQ ID NO: 6081 - DNA, 356 bp, Diabrotica virgifera
  Clone ID: LIB150-023-Q1-E1-B10
aaagactcttcggctattgaggattacacatacgtctcatcatccatgtcccattcactctgatacactacttcaccacacccacatagtcttcatacacgtccgacatgaaggaagtcgtggtagtggcggccaattttatcacgtcatcggttagtccggatgcatcgataacagttaagttgtatcccaaggttgtccaagtggtggtgaatttgtcagtcacagacacagttggtacagttggatcagcagatgcatcaatgtgtgcagtcatcgaatctagatcgggcactcaagtagatatagcgtacatctaacgcacctcactttctaactggtggaatcttcttcct

SEQ ID NO: 6082 - DNA, 376 bp, Diabrotica virgifera
  Clone ID: LIB150-023-Q1-E1-B11
gttaaacatcaggagtatgtcgattgctacattgattatacaaagcttcggtattttgacatgggaatgaagacagtgactcagtggatcagttatgtgtaaaaatctcgacatacgttacgtcgagaaacacagacgtcaagtagatattttcgacttctatactgcacatgatcaactgacgatgtcgatcacaaactcaatctatgctaatagtcagttcaactttgccacagttggcttaatttcgacaaatgtgccgtgaaacatttgtgaatattcattgacatgtccagcatgtgtcgactcaggtaattatattgcatattataattgacatattcaagagtgatgtgcactgtaatgatgattgata

SEQ ID NO: 6083 - DNA, 402 bp, Diabrotica virgifera
  unsure (1)..(402): unsure at all n locations
  Clone ID: LIB150-023-Q1-E1-B12
gtaagtgcccatttagttgtgatgttgatttggtcgtgctgttgattgtatgggcatgtaccatttcatacatcgtagtgtatttaacttgtaaccccatatgtatactggtattgtatgtgtcgtagaacagaattgtatgttattttagcgtacgaactgtattgtattgatattgtacccatgatgaaagcattgatttgaatttttttgaagatattgatgatatatatagacaaacagttgaataaataagtaacgtacaatttttttgaaaattttgattacacgtaacgttaactattttgaatattgagtccaattatgggatgtaacagtatgttgtactttttgcatgtantcctatagattaacacttttttacagtactaccgttttttg

SEQ ID NO: 6084 - DNA, 451 bp, Diabrotica virgifera
  Clone ID: LIB150-023-Q1-E1-B4
ctcgcgggtcattacacgcgtccgaaatgagtctagtaatttgggtaaaaccaggggtaataataggcggttgaagcgtagcactgaccctgttacctttcttgtataccgtaggcactagatatagcagactaccctgctataatcccaaagccgctttagcggtataaaacgggagactattataataacagatacagataatagattttttttaattactgtgatgcatgctgtattctttcagtttcggctcaggaaatattatttgttaacttcctcagaaattgtgtgcagataataagttaatacaatctaaccccaatttttaatatacacaggaatcgacacgttttttttatattatttcataaaaatttttacacacctacttaaaacgagtcttttaatagtgaattagtgatgctgccaaatatttatgaacccgatt

SEQ ID NO: 6085 - DNA, 425 bp, Diabrotica virgifera
  Clone ID: LIB150-023-Q1-E1-B5
ggcaaaactcaattcaacattacttttcaaaaccaaactcaggcgatgttggtcctcaacagaatgctggtgatagccagaaaaaactgtatgaggaaattgaacgacagaggtatcaacaagaacagcttagacagttctatcaacaaaatcctgatattaaacattcagctgtagatgatgccagaaactcccaacagcctagttttaaccaggaataccagaaaccaactataaccaacagtgtctcaaaggagatatacgtaacaacaacttccacgaccacaacccctgctccctcaactcctccaacgacaaccaaggatccaaagatattggaagcgcaacttccagatgaagttcctgaagacttaagacagcaattgttgtcgtctggtatattaaaccatgccgatatttctgtg

SEQ ID NO: 6086 - DNA, 423 bp, Diabrotica virgifera
  Clone ID: LIB150-023-Q1-E1-B6
aaatttgtaccatcagttctttttgtaacatacaaattcacaatgaagtttctcgtactttttgccttagtactctactgctctacacaagttttaggaggtccttgtgatggtgtacagtgcagtcctccaaactgtggacttggtgctcgtccagtagtgaaaccaggtgattgttgcgccacttgccaaggattcggtaacccaaaatgtgaaggtatacaatgcggtgtaccaaactgccctcctggatctatattgaagctcaaagatggtgcttgttgtccctcatgtgagccattcggtaatccactgtcacattaaggatagagattgttgtgcaacctaccaaccacttggtaggtaactaataataaatcaaggaaatattgcaactactggaaaaaatgacctatggaaaat

SEQ ID NO: 6087 - DNA, 424 bp, Diabrotica virgifera
  Clone ID: LIB150-023-Q1-E1-B8
accacgcgtccggcggcgcgaaaacatttgaaaatcgacgatatcagtcaaaaagtttgggtcccagaggcagctgcccccgatcactttttgtgttactgtgttggtgcaagtgaaggttattggtgcaatattgaaaattgcgtgctcataattggatttaaataaggatgtcacagcttccatccatttggtttctccttctaggaaccctattgggtacgacgacgggtcaatcaaatctcctggatggagttatcaagctacttcaagatggcgacaaccagatacagaaggaaccacccgacatgccggaatacgagatgctgaaagagtatgattttatcatagttggagcaggaacagctggatgtacattagccaatcggttgagtgaaaaccctgactggaatgtcctacttat

SEQ ID NO: 6088 - DNA, 458 bp, Diabrotica virgifera
  Clone ID: LIB150-023-Q1-E1-C10
cccgggtcgatacacgactctaaagtgactcgggttataaatgcattcgaagacgtttcttaaaactacagaaaggttctgagcttttaaaacgccagatgtagtaatttattgccttttctagccagattgtaaaaccgcaaacatgatgaccgtgctgtggtctccgcagtatcgtcacggcaggcacgcagttcagacgcaccgtcgctgccctcaaacaataaacaaccctcttatgagacgaataagcacgccttttaaccaaaaataaaataaatatcactgttcgttatttacacttatttttaattgattccgttaacacccacaccatcggaacatatgacacactcttaatatgacaactaaagaatttttttttaattgtttatctttaattatcactttaagttattatgcggcgttaggaactctcgcgttacgaaatgtcttgt

SEQ ID NO: 6089 - DNA, 448 bp, Diabrotica virgifera
  Clone ID: LIB150-023-Q1-E1-C11
cgggtcgatacaaacgtctagaataacactaggtgttgacagtaaaataatactgatcgacttccttaaactcattcgagacgattcagaagaagtcttagatgctctagttccgaatataggacctattctggtcatgtttacttctgtgggtgttttgtcaagagataagacgactcaagcaacacttgatattggtagaggtctgttgaaatgtcaagtagagatctatagtaactataattggcggaggaggatggcgtttttagtacagttggaagatttgccgacgtgtatgccaagcgattttattcaccaacattttacacctcttgttctgaaattgtcactggaatcgagagcaagaccggtcaggacgcaggcagctaggacactactgatttttcttagatataacgtaaaagaaaatcacagaaagtggataaga

SEQ ID NO: 6090 - DNA, 430 bp, Diabrotica virgifera
  Clone ID: LIB150-023-Q1-E1-C12
gttgccttccagtaactgctgcactacagtttgctgcaaaccacttcatccgctatttgtattttacccaacatagtattgtagattttaggacctaaactgagatgcgttcattggaaagatccgaggtaatcgttgtcgaaagctgaccatccaccccccaaaaaatatggcaattggttacgaggtgacacctaaaggcgcgcaaagtttggaaaaaagacgaaatacagtcaagtggagaatttgtattgtagcaatctgtagctattacctccaaaaagtgaatggtgatgctggtatgtctgctgtttgatacaaaaaccaaactcgtatgacgagttgcctttttggtacatccggtagcgctataataacgatttggcttttggtcaaatcgaatcttatggtgctgtttttggtcgagctg

SEQ ID NO: 6091 - DNA, 457 bp, Diabrotica virgifera
  Clone ID: LIB150-023-Q1-E1-C2
ctcacgggtcattacacgccgccaaagtaactccaataataacggtaatggtcacggcaatggtaacggtaatggccgcagcaatggcaacggtaacgggaatggcaacggtaacggaaatggcaacggaaacggaaaaccaggtgcttcatatcttcctccttcaaatggaaatggcaacggaaacggcaacggttataaaaacggaaacggtaacggaaatggcaatggtaggccaagtggaacatatggaccaccgtctaatacatacggcctaccagtaaacggaaatggcaacggtaacggtaatggaaacggaaacggtaatggacatagtaacggaaacggtaatggaaatggtaatggaaacggcaatggcaaactaaatggattatatggaccaccttctgctacatatgggccaccttccaatacatatgggcaacctgcaaatgga

SEQ ID NO: 6092 - DNA, 382 bp, Diabrotica virgifera
  Clone ID: LIB150-023-Q1-E1-C3
aagacgcttacggaatagcttaaaaggataatttaattattatttaaagtttagataaattttatgtagagatagttacatagtatagtgtgagaatatattaattttaagaaagtaaaatttatattttgtaccttgttgtatcatggattataaattaataataataaatttatagaaatgcggatttaaatgagcttaaaaattatgagttttaaggtaaaatatatatgttaaataattgatttgggcagcaatgttatcacctgttaaatataaccaagtctttatgaaatacattaaatttcactattgcccactgattaatttgtatggacgcggaaattagaacgtgcaaatgtatcaagggatgagctttttt

SEQ ID NO: 6093 - DNA, 69 bp, Diabrotica virgifera
  Clone ID: LIB150-023-Q1-E1-C6
catgttggttttgtttgttgttttcgtctttttggggatctgtttgggggttcggttgggtgggggggg

SEQ ID NO: 6094 - DNA, 445 bp, Diabrotica virgifera
  Clone ID: LIB150-023-Q1-E1-C7
gcgcgggtcgatacaagcctctaaattcaatcatatgagatgtaacaggcgtaacgctatgttatttcacaatatggagaagatctactacttcttcatttgtgacgagatctaccagcgaaatttcaaaaattgtcctcgagatggacatttcaaacttttttaggttctatgatcttaatttaacttccatcaacaataagatttactgtttttgattaaatagttaatctagcaaagatagaccagcaggtacttccttaaatctagtaatggtcagcgtttacatagaccaataatagtttattaagcttttttcggtcaactttttaagtcttgtttttaaaggaatgtttgtataacattttaaacctttgtaaaacatgtaccattaatgttgcccttctactcctttataaaaataattgttaaaataacttataaa

SEQ ID NO: 6095 - DNA, 282 bp, Diabrotica virgifera
  unsure (1)..(282): unsure at all n locations
  Clone ID: LIB150-023-Q1-E1-C8
ctgtgncaggtgtnggcgctattgttatgtcatactcaggtcaacatctatgtctcctacatatgatgcctctcttgacgatggagggttcacatatggtccttgagatatacattggagagtttttgaggttcaatagtattaattaatgttacatcagtatttatatttgctgtttatgtctacataggtattctcgccccttcggattagtttgtcgatcgatggacacaccaccagtcaacgtctataaatgacactaattccctagtcatcgttctt

SEQ ID NO: 6096 - DNA, 409 bp, Diabrotica virgifera
  Clone ID: LIB150-023-Q1-E1-D10
gaacaacactaggtgttgacagtaaaataatactgatcgacttccttaaactcattcgagacgattcagaagaagtcttagatgctctagttccgaatataggacctattctggtcatgtttacttctgtgggtgttttgtcaagagataagacgactcaagcaacacttgatattggtagaggtctgttgaaatgtcaagtagagatctatagtaactataattggcggaggaggatggcgtttttagtacagttggaagatttgccgacgtgtatgccaagcgattttattcaccaacattttacacctcttgttctgaaattgtcactggaatcgagagcaagaccggtcaggacgcaggcagctaggacactactgatttttcctagatataacgtaaaagaaaa

SEQ ID NO: 6097 - DNA, 218 bp, Diabrotica virgifera
  unsure (1)..(218): unsure at all n locations
  Clone ID: LIB150-023-Q1-E1-D12
tgagtcgtattaaacncagttattcattactcatcaacttccttaccatcaccctctactatttcctcaacatcatattttggctaattcctaagactagggggatgcggtccatttataactcggcaagtgttatctcgacatttcagcccactcgtacaacacttagttatgatagttgcccatcgatgtctcgatgtgaggtctagttgattata

SEQ ID NO: 6098 - DNA, 233 bp, Diabrotica virgifera
  Clone ID: LIB150-023-Q1-E1-D5
atacaactccctgtagtgagtcgtattattttagaatatgtatagaactcttttattggtggttcgatagttatgactgttggaaattaattgatttgtacccaatatgtcttgagtttttggggggtgtcgtgcttggagttgtagctaattattagtcatttattattttcgatatttttacgtcgatagttatttcgatttctattgtgagatagatattttactgaatt

SEQ ID NO: 6099 - DNA, 446 bp, Diabrotica virgifera
  Clone ID: LIB150-023-Q1-E1-D6
ctcgtaggtcaatacaagactctaaattgagtcgtattatattttgacagcggcatccgatttggacgtcgaaacgttgataaaattatttttttagtaaaattgtggcttatttccctttaagcaacataatagtaaaatattacatgcgtacggaggccttagcattctccattatctccagtgtatatttagattactccatctatacattaatcaagtttcttcttttatggcattaataaacaataattatgaacaattaaaaaatatgattaaacgcgcaactaccttttataaaataatagaatattgtttatagaacattgtttaagtagtagtgctcttgaaagatttctgaaatgcacattaattatcaggtacccactatttttgaaatgttggtatattttttcattttagattattagcaatgtttattattt

SEQ ID NO: 6100 - DNA, 412 bp, Diabrotica virgifera
  Clone ID: LIB150-023-Q1-E1-D8
aaaaaaatatgccaaaataatgaaaataataaaaaaattaataaaaagtaatcacgtaaacaaaaatgtctcttatataccaacctctcttgtaaatggttacttaaaatatgttttttcaactatataatgtatatttttttatgttaattattatttattattgccatatacctatttataacctacgataaaaacaacagtggtactttccccccttctttttaatttcacgaacgaaggacaaaacaccaaaataattcttttatagccaaatataatcaaaataatgttattttttcacatatcaagttaaatattataaaatatttattcctctttcctttccggatttgaataataaaaattcatagtacaatggtttatttaataaaaaaaattgtgttttggg

SEQ ID NO: 6101 - DNA, 437 bp, Diabrotica virgifera
  Clone ID: LIB150-023-Q1-E1-E10
aaaaactggaagaagtagagaatcctcaccacacccaagagcctttactgaaatagatactagtaaaattcaaaatgtacgaagaagtgactctcctgatgtcaaagcagtagatcaaaaagtcgaagaaacatttattcatagaaatgtgtctgaagaagtagtcgaaacgaaagaatctttacctaaaataagagaatcaaagcagatttctccagttgaaatcggtacatttatcgaagaagaaagatccgctatattaaaggaaaatgatcacgtcgtcgatagttcttgggtcataatagaagaggaagaacttagttatataccagaagtaatacgacctgtcatttggttgaacagaacagatagatgcagatactactgaaaaagatgaacctacacaagttaaacctgaagatagtttacctgaagat

SEQ ID NO: 6102 - DNA, 415 bp, Diabrotica virgifera
  Clone ID: LIB150-023-Q1-E1-E11
gaacaacactaggtgttgacagtaaaataatactgatcgacttccttaaactcattcgagacgattcagaagaagtcttagatgctctagttccgaatataggacctattctggtcatgtttacttctgtgggtgttttgtcaagagataagacgactcatgcaacacttgatattggtagaggtctgttgaaatgtcaagtagagatctatagtaactataattggcggaggaggatggcgtttttagtacagttggaagatttgccgacgtgtatgccaagcgattttattcaccaacattttacacctcttgttctgaaattgtcactggaatcgagagcaagaccggtcaggacgcaggcagctatgacactactgatttttcttagatataacgtaaaagaaaatcacag

SEQ ID NO: 6103 - DNA, 270 bp, Diabrotica virgifera
  Clone ID: LIB150-023-Q1-E1-E12
tgagtcgtattaaaaacaatgactcactacaggtagacgtccttagactctattcgacactaatattcacaatgcccaaatgctctgactctcctgagtatggggtagtgggttcaagtgtacttgagacattgattcgtcaaaatatgtcagaacacatactcgacttgatagaggcattagcttgtctaatatgatctcatacagatttctccagttgataactgtacattgatcattgcgtatttatccgctttagtaaatgtgcat

SEQ ID NO: 6104 - DNA, 87 bp, Diabrotica virgifera
  Clone ID: LIB150-023-Q1-E1-E3
ttgaacctcgtacgtgtgcaatgatgagcctccaatactgtggattggtccttttggcctgtcttttgttggtttcctcccatcctg

SEQ ID NO: 6105 - DNA, 447 bp, Diabrotica virgifera
  Clone ID: LIB150-023-Q1-E1-E4
cgggtctattccacgcggccgaacacgcgtccgcacacgcgtccgcatctcaaccgaagactgcaattcctccagacctattacggcgctgatttaataatggcacccagcagaattcagactaaagaacacgctcagaatttggtctccgacgttcaaaactttggaaatcttcatgctgtgtttgcactttcgcagtcgatgagtatttctgctactgagagcgagtctgttgaacttctcgaaaaggctttggaaagaatcgcgcctaaagctatattgattaattttgtaaaatcagcatcaggattgtgttatatcagaggacctgaatatcctacatacaatattaacgtcgagagtgaagaagatgttaaagacgctatagtttttctggataaagttttatgctaccagataagtaacctgtcgttaagaagagataca

SEQ ID NO: 6106 - DNA, 106 bp, Diabrotica virgifera
  Clone ID: LIB150-023-Q1-E1-E5
actactccctgaggtgagtcgtattaactagtcttaggctgtcgtccgctaatttctttctgactccctcgagtttttttgtgagctccccgttttctgagtccct

SEQ ID NO: 6107 - DNA, 447 bp, Diabrotica virgifera
  Clone ID: LIB150-023-Q1-E1-E8
tcgtttgacaatacaactccctaaagtgagtcgtattaataatgaaaataataaaaaaattaataaaaagtaatcacgtaaacaaaaatgtctcttatataccaacctctcttgtaaatggttacttaaaatatggtttttcaactatataatgtatatttttttatgttaattattatttattattgccatatacctatttataacctacgataaaaacaacagtggtactttccccccttctttttaatttcacgaacgaatgacaaaacaccaaaataattcttttatagccaaatataatcaaaataatgttattttttcacatatcaagttaaatattataaaatatttattcctctttcctttccggatttgaataataaaaattcatagtacaatggtttatttaataaaataaattgtgttttgggaaacggacaaaaa

SEQ ID NO: 6108 - DNA, 376 bp, Diabrotica virgifera
  Clone ID: LIB150-023-Q1-E1-F11
acgcgtccgcccacgcgtccggagaaaagaaatcatcctccgagtcctcctcgagcgagaaagaatccagcgaagtaaaaatccaagaagggaaacttgccgaacctctcccagctatcaaagagccaattaaggaagaagtgaggccaatcgatccacttcttgttttgaaaccatctgaaccagctcaaccagatgttttaccagaagaacctaaactaatagatcccgtagtgccccaaattgctgctaaagcgatcccagccgaaccagaagagaaacctctagctctgccaactctagttgctgaagaaaaaccagctgagcaagctccaaaattggtcgccactgaaataaaagaagacaaaatcttact

SEQ ID NO: 6109 - DNA, 448 bp, Diabrotica virgifera
  Clone ID: LIB150-023-Q1-E1-F12
cgggtcgatacaaaagtctagaactgttcataataagcaaaaatatgattttaactaataatgtattctacattacattcatttagagaaatataattcttagtccaaaaatacaagaaaatgactattgtgtctaaattgtagtggtaagtatttactccaaatttttagtaatgagaaaatgaaaaatattatcctacagtgtaatcaagaattagatccatactcataatcactaacgtcggtattttcattagtgtggcagtattaatgcctcttgccatgtttccaaaactgccctgtctctgtaaccgttatgttcaatatagttatcatagtttgcatattccccaaaaatgtttaatgcgattgaaattacaatgaaggataagggggtagtcaacacgttatgtccaaaactatgtataatcctttccttttttttttt

SEQ ID NO: 6110 - DNA, 438 bp, Diabrotica virgifera
  Clone ID: LIB150-023-Q1-E1-F2
aacacgcgtccgcactatccccgtagatgtcatccagagaaatattccagtagaagtgaggtatgaccagatcctcccaggaattgtatccagggagcaagttctaatgcacggaagaaggaacttagatgcaaaggtgcaattatcttcagacgaactgcctcaggtattgaaacatttaccgattccacttgaatctgatctcgttcctgaaattgttagcgaggaaaaagttcaggtggcatcagaagtcgaaaacaatccagttaaatctttaattcaacctgaagatcaagaaagtgttgaagttcttcccgaaaaacctattgatttaccaatagaggttccagagacacctttcgtgaaatctttattagccccagaaccacttagcgattcgaacactgttctgcaaaaagcagctccaaaaactgccca

SEQ ID NO: 6111 - DNA, 416 bp, Diabrotica virgifera
  Clone ID: LIB150-023-Q1-E1-F5
atcagataccgaaccaaacactagagtgagatttaatgagcacaaggagaaggaacgagaacgtgcgtttgatacagaagacgcatctagaggtcctcttagtggaataactaggcttgcagactcacccagggtaatgaaaaaaatgcaggaacatgaaagtggcaaaaccaagaaaaaggaagaacccacccctgcccctgtccaacctaaagttgtgccaaaaaggcctcctccgccagccgtaaggcaagttagtgaagatgacgaaatagctagaattaagaaacaaaataaaggggctactacgtcgacggatacaacgacagagacagtgaggcctgctactgaagaaagacagcggaaaacaccagcccctgaggctgtctccagcgccgaagaaagtgaggagtctg

SEQ ID NO: 6112 - DNA, 426 bp, Diabrotica virgifera
  Clone ID: LIB150-023-Q1-E1-F6
aaagtcacttgggttagtacgcaaatcaacttatccgcgctcgacaaaacgaaacagttcgcgttatcaatatcaacgtggatccaccatattgttagaaaaacctatctcgcgcaaaagaaaattaatttcgggatccagttctgatgctgtgccgttcccatgaccattgtcagttatgttagcatgaagttcagctatcactatacttggaacagggagattgtgttcaattcacaaaaacttgttaaaagacgctgaaaaccattggggaatacctccaaagccacccttcaagacgactgctcgattttttacacctagaactaataacttttttgtgtttgtttgttggtgaaccctagccctacgctgaatgatgtctatctgttacgaacccttccttctcgatgataaaatactacc

SEQ ID NO: 6113 - DNA, 174 bp, Diabrotica virgifera
  Clone ID: LIB150-023-Q1-E1-F9
tgagtcgtattaaaaaatccgactcacttcgggtagtcgtgccaacaagttgcgtgcacatccattcctaacaaacatttacttgcttacattcccgggcgggttagggcaaaaagtcggttaaatacttcagttcataagttccgttacgagaacgccatcccaaaatttatt

SEQ ID NO: 6114 - DNA, 420 bp, Diabrotica virgifera
  Clone ID: LIB150-023-Q1-E1-G10
gggtcgatacaaaactctaaacacacgcctgctaaacccaacaaacaccgccttcaacatgaaacgatcccagcaagttacggtcactgaaaccaccccaggatattcagtggaaaagatgtattataaagaatacaaatatgaaaccgctttctccatttcgcagttatcgaaactggagaatttcgttttacctcctagaactactatcttagcattatctcagaacggaggagacaaggaagaagacaaaaagtatgtcgtcaagaatcacggaaaagctgatctttttgttgaggtaatacatctcaataaccaagatgatgctccacaatggtttgtagtccagccagaccaaaccactgagatagatattgaggacaatcttgaacaaagcgtgttgaaagtaagcaacaacag

SEQ ID NO: 6115 - DNA, 393 bp, Diabrotica virgifera
  Clone ID: LIB150-023-Q1-E1-G11
tacaagaccctaaagtgacgtcgtgattaagcgtccgtaaaaatccgatttttttgtggggtttttgttacaaggattttttaattttaaatattatgagtacatatgaaatcagtaaatcttcgttactaagtttaaaagcagagatattaagaaaacatcaggaattaagcaaagccaaagttgagaatgatgtaaaaatacagacattaaacaaaagtcctttagaaataagaaataaaggggtagaagcatgggatagaaatgaccaaagtgatgtagatcaagatctattaaaacaatctaggtcagttttagaacacaaagccgctttatatgagaaactctcatctggagatgtttcggaaaatgataaggaaagaaataaattat

SEQ ID NO: 6116 - DNA, 398 bp, Diabrotica virgifera
  Clone ID: LIB150-023-Q1-E1-G2
gtgactcgtgaaagggaatcatttcaagtgccagattggaaagaggttcaagttccggcttggaagcaaatttggattccaatctggaaggaagttcaagtgcctgcttgggaagaaatcgaagttcctgattgggagaagtcatatgcaccataatgggtaaaacaaggaatccacggagagcactatttgggcaaggacgaccacggcagtgaatatacagctcatgacatctggaagaagaaactcatctggaaacctgtctggaacaaggtgtggcggacagaaaagaagcaaatctgggttcctcaaaagaagatggagtgggagtccgaatgggaacacatctgggaaaccgagaaaaaacagatatggagaacagagaaagtacagatttg

SEQ ID NO: 6117 - DNA, 407 bp, Diabrotica virgifera
  Clone ID: LIB150-023-Q1-E1-G3
gcgtccggaacaagagtagagtgggcgcttccattttacaacttttatattttattctttgaaaaagtaatttattatttgggagtccacaccgagaatcagttttctgttcttatctaaaatatcaagacaactaaaccgtttcgaaagtaaataattttaacatgagggattcgccagattctgcaacaaaaagaagcaggagcagaagcactaatagtagtgccagtagaaaaagtcgaagcagaagtgcttctagtggctcaaggtctcgttcaagaagccgtagtagtgaaatcgatggatttagattacacattggcgatattggtgacgagatcagaaggtctgatttggaaaaagttttttctgtgtatggccctcttaaagaagtctggatgactaac

SEQ ID NO: 6118 - DNA, 174 bp, Diabrotica virgifera
  Clone ID: LIB150-023-Q1-E1-G6
atacaacaccctgacgtgagtcgtattaaatcggcggattcatgtagggtcaggttccgtcgtgggatcagatttggagtgcatgctggaaagaagtgcatgtacatgctgggacttaaatgggatttcctgaatgtgagaagtcaaatagagcagttgtgggttgaagaaggg

SEQ ID NO: 6119 - DNA, 449 bp, Diabrotica virgifera
  Clone ID: LIB150-023-Q1-E1-G8
ctcgcgggtcaatacaagtctctaaactgagtcgcaataaacaatatatgtcagaaaaagttctttaacttcccttaaaaagttgtctaaatctaaaaattcctttaattcttacacagtattaaaaacaatcagtagtgacactctcgccggcgccattgaagtttttgaaatctcgttttgtagaggcagccatcttgttatctgtcatatgaggtaaaaagttacgaccggactggctcaatgaaaaatctttctggtaaattactaaatgccctattgtaggacttacgcccggtttcataatcagcttaaagtgaacattaactaaagttcactttaacgttgacatttacccatatgaattgcattgataaaggtaccaacttaaaatttaaagtccacattaactgattatgaaaccgagagttacggttagaaatattgga

SEQ ID NO: 6120 - DNA, 409 bp, Diabrotica virgifera
  Clone ID: LIB150-023-Q1-E1-G9
aacacgcgtccgctaaacccaacaaacaccgccttcaacatgaaacgatcccagcaagttacggtcactgaaaccaccccaggatattcagtggaaaagatgtattataaagaatacaaatatgaaaccgctttctccatttcgcagttatcgaaactggagaatttcgttttacctcctagaactactatcttagcattatctcagaacggaggagacaaggaagaagacaaaaagtatgtcgtcaagaatcacggaaaagctgatctttttgttgaggtaatacatctcaataaccaagatgatgctccacaatggtttgtagtccagccagaccaaaccactgagatagatattgaggacaatcttgaacaaagcgtgttgaaagtaagcaacaacagttacgaac

SEQ ID NO: 6121 - DNA, 450 bp, Diabrotica virgifera
  Clone ID: LIB150-023-Q1-E1-H1
tcgcgggtcattacacgcggccagaaatgcgcccgttataaacaagttaaaaatttgctaccaatcaagacaaaaaggggcataattcctatgcaaactttggaaccaatccaagatgaacaagatgaagaagcttcagatgtcaataatgaagaagaggtaattgaagaaactgaacctgaaggaaacaatttttctctagaatctacaggatttgatacaggtgaaccaatttcagcagctcagctattagcataaagaaacgaagtcataaacaaaatgaaaattcacattggaacattaagttctggtttattagaaaacccagaggagaaggtcttgaatttacgaacgttgctgtccttgatggatgaagaagctgcgcaactttacataacagttaaaaaattgatcactgtatctttgttggaagtgttcaaagatatatta

SEQ ID NO: 6122 - DNA, 134 bp, Diabrotica virgifera
  Clone ID: LIB150-023-Q1-E1-H2
cgcgtgggtttatatttttgatacgttatttgctgttttgtcgagtcagactgtcaaataaatcatacaggtctaaaaaaacacataacaattcggaaactgttcggcaaaaaaaaaaatccaaaaacctgcac

SEQ ID NO: 6123 - DNA, 433 bp, Diabrotica virgifera
  Clone ID: LIB150-023-Q1-E1-H3
aactgctccaagatgaaggtactcattcttctttccgttgttgccttgagcagctgcttaccagcatccagaaatcaacaatacgttgatgtagactacaacagctacaacgctcatcccgtctacaacttctggaggacttggaatcagcaacactatggacaagaaccatggaaccaatgggtacaatatggtgtccagaaccaacccggtaactactggaggcagtacgtgcaacgcagcaaccaagctgaaaatgtcgatttatcttggatgtatcactcttgggatgtccaggatgtgcaaaacttaactcccgttcaacgtgttcagttgctactcaactacgtcagacttcaccaacaatggaaccaatggactcatgatgtaactgccaatgaacgtcttcagaatatgttgtatcaacaccttc

SEQ ID NO: 6124 - DNA, 446 bp, Diabrotica virgifera
  Clone ID: LIB150-023-Q1-E1-H4
ccgggcctagcacacgcgggccagactactatcccaacaagatagcacccaagaatattcagtggagacgacgacataggaaacatacgaatatgaaaccactttctctgtctcggagacatcgaaactagatgatttcgttttagcccctagaactacgatcttagcattgtctcagagcggcggagataaggaagaagacaaaaagtatgtcgtcaccaatcacggaaaagctgatccttttgttgaggtagtacacctcaagaaccaagatgatgctccacaatggtttgtggtccagccagaccaaaccactgagatagctattgaggacagtcttgaacaaagcgtgttgaaagtgagcaacagcagttacgaacaggaagtatcattttctgctgaacgtggtaacgttattgacgacatgggaaacagcattcaaggac

SEQ ID NO: 6125 - DNA, 425 bp, Diabrotica virgifera
  Clone ID: LIB150-023-Q1-E1-H6
cgcgggtcaacacacgcgtccatgttgaagttcttcacgaataagctattgatttaccaagagaggttccagagacacctttcgtgaaatctttattgtccccagaaccacttagcgattcgaacactgttctgcaaaaagcagctccaaaacctgcccaggaggttagacactgtcgtgataaagactcagaacatcagcagagttggtcttaagactttgagagactctttcaaaccaaacacaggggaattgggtctcactgctgaacactgggctacgttggacatacacgttgataaatacctcgcagaagataagcatatcctcgctagtagacaatctcaagcagtacaaagtggttccacagccaaaccattagcccaacaggctcgaaataagtgggtccagaatatcgttaatgg

SEQ ID NO: 6126 - DNA, 422 bp, Diabrotica virgifera
  Clone ID: LIB150-023-Q1-E1-H7
aaacagtcttatgaaatgaacatcttatttaaattagtaattttctctttaaacttcatttgtaaagcttcttgatccatgttttcagtaacattttttgaaatacttatctttaatcgtaaacggcccttagatggtcaatattatttcacaataaattagtggctgggtcttgtgctatcaacatatgggataaaaagacagcaagttgtatcgctattgcgttgtagcttcaaaaagtaagaaaaaaaataaacacaggtggataaaggaatggcaaaaaaagaaataactatactcaagaaaatttggcgtggagtgattttaaaaactttctgggactagatagtacattctttgatgaactattaagaatgattatacctgaaattcaaaaaagggatccagtgatgcgagatgct

SEQ ID NO: 6127 - DNA, 414 bp, Diabrotica virgifera
  Clone ID: LIB150-024-Q1-E1-A9
acgaaaaaccagccaaaattgtgtcttccgaaaacgagcggagaaaatcgggagaaaaaagaaaaagtgggggaaaaccgtatggtaaaggtgatagtccagtggtggcagcagttttggacgacgtcaagagaatcaaagtcgctggtccaaaggagggcagactgtacccaaatctatcagacattgaagcaactacagagaccgaacctgaaacatacacgaggtcaccatcgcctgacaacagcaacagcagttttgagacaagtaataattcggacgatcctaacactagttttggtcgcgaaattatacaggcagtgtgtaagaatcagacgccacagaaaagggcgatttttgatgagagtactgccagcgatgtatccagtatattagacgatatggacaattatc

SEQ ID NO: 6128 - DNA, 346 bp, Diabrotica virgifera
  Clone ID: LIB150-024-Q1-E1-B11
actcgcgggtcgatacaagcctctaaagtgactcgggctaagttgtgtggtgctcctggacctctttgtcatcaactagtttttttttaaatctccttaaccatgtctgacgaagaagaagtttactccgaagaagaggaggaggaagaagtcgttgaaacgactaccaccactaccaccaaagtccgaggaaggaccggagatcaaaattcaacaaacgttcagattaagaagagatcagatcccgatgaaaagcttcccaagtacacaaaagatggggcaaacaaagttgcaagggagaagaagaccttaaggaactccagggaaaacaagcgaaacgccaaat

SEQ ID NO: 6129 - DNA, 444 bp, Diabrotica virgifera
  Clone ID: LIB150-024-Q1-E1-B12
tcatgggacgttacaagactctaaagtgagtcgtattaattaatttcttgaaaggtgttcaacagaaatatggctggtcaaggatttttattcaaaacattcaatgttttcaatagcagaattatatctgcaaataggttaaatgtggcaaatttccaaacccccaccaggaccataaaaacagagactaaggaaagactcaaatccttaaatattcctgaaaagccgaagaaacctttaacgccctattttcagtatgttaatcaaaagcgaagtactatagttaaggaaaatcccaatatacttcccaaagatgtattaagaaaactctcagaagaatggaaacaagtgactgaagaagaaaaggagaaactgaaggaaaagtatcaaaaagaagcagagatatatgataaagacatattaaaatttaatacagctttaact

SEQ ID NO: 6130 - DNA, 432 bp, Diabrotica virgifera
  Clone ID: LIB150-024-Q1-E1-B3
accacgcatccgccacgcgtccgcaatgatgagcctctaatactgtggattggtccttttggcatgtcttttgttggtttccgcccaccctggaaccgactctaaggctgaagccaaggtatcttcagtagccgagaataaacaggaaaaacgtggtcttcttgatctacgctactgtgggggacacgactttggaggaggacttgaacttggagggcatggtttggatttgggtggacatggtggttttgactgaggatatggccgaaggttatgtggagggtatggtggattagacgaaggtcatgttaagcacattaccatcaccaaagaagttaatgtacctgttcctgcagcatatcccgtacacatcgattagaaaataccagtatcagtgccagtcaaagtacctgtaccagtagatcgtccata

SEQ ID NO: 6131 - DNA, 423 bp, Diabrotica virgifera
  Clone ID: LIB150-024-Q1-E1-B7
atgctccaagatgaaggtactcattcttctttccgttgttgccttgagcagctgcttaccagcatccagaaatcaacaatacgttgatgtagactacaacagctacaacgctcatcccgtctacaacttctggaggacttggaatcagcaacactatggacaagaaccatggaaccaatgggtacaatatggtgtccagaaccaacccggtaactactggaggcagtacgtgcaacgcagcaaccaagctgaaaatgtcgatttaccttggatgtatcactcttgggatgtccaggatgtgcaaaacttaactcccgttcaacgtgttcagttgctactcaactacgtcagacttcaccaacaatggaaccaatggactcatgatgtaactgccaatgaacgtcctcagaatatgttgtatca

SEQ ID NO: 6132 - DNA, 420 bp, Diabrotica virgifera
  Clone ID: LIB150-024-Q1-E1-B9
taaccacgcgtctgctcaaaatatcacaaaaatgattacgtgatttcgccactaaagtttatgaattgcaatcttcttgaattttacgaaacatttttgtttctaattatttttattagatttattttagagttgctgattatatttttggctaaattttgtcataatactagttacgtgcaatattttgctattagaatgtagaaacaatgtgcctttcgcgatttacattgtttggcctttcaaaacgattgaaatattttacttcgccactttacacatatctgtaaacataaaatcgtagtaagactgcacattagaacgcaataatcaatcagtttttatagaaatcagcacatgaatttattgacttttgtgtaaatatcagaggaatgtcaagtacgactaacggatgaactc

SEQ ID NO: 6133 - DNA, 385 bp, Diabrotica virgifera
  Clone ID: LIB150-024-Q1-E1-C1
cccgacccgtccgaactgacaccttatatgagattcatttacggtctaagttcctttgacagtccagttgctacaatcgcttactcatgcgtgatcaaatcataatgtcacacaatattctggggtcagccggcacagttgcatcgcgaatagatggtggatcaaggcggaaatattagtaacgaggtcactatgcgtgtcgacattagactaccacagcaacttacgggtttagctgtccttaacgctatttccatccgttggcgctcggtcaccaacatccgtttttaaacacaccccatgatttaggtatcagcagccaattagacaatgagctaattgcaactgactagctgtgcgccatatcagtgattgagcttaccag

SEQ ID NO: 6134 - DNA, 262 bp, Diabrotica virgifera
  Clone ID: LIB150-024-Q1-E1-C10
gagtcgtattaaacttgacgacgcacacagcggagtctttctgtcattcaattctcgctaatgtggcaggtaagcactgtgttaagtctcatgcatgggagcacatgtactactccacatcgtgtgtggtcacacaggctgctgtttatattttagcatacctctgtgatacatcacagcactcaatacatcccgtccctaacctgcgatatgcaagccatgcttccaaagtacactgttgatgtactcgattagaagatgg

SEQ ID NO: 6135 - DNA, 186 bp, Diabrotica virgifera
  Clone ID: LIB150-024-Q1-E1-C12
acaagcctctaaagtgagtcgtattatgttttcgataccttatcgaattaatttggtgctcatggtatttcagaaattttggttgttgtcgatctggtgacgactcaacagaggagcccaggtgattcgtataaagatcttagtgttcgctttggtactgtgtggattttgctgtggaagtggaca

SEQ ID NO: 6136 - DNA, 410 bp, Diabrotica virgifera
  Clone ID: LIB150-024-Q1-E1-C2
acccctctagagtgagtcctattatgagactccccttttgatgaatatacatttccgatatcgtttctatagtcgaaaagactagtttggttattttagaatctaatgtaatatttttcagttgattctgaaatgctctcttgaacttgagaatcaataaatagtctacagggataagcttggttaataaagaggttgccttatcacaaacaatctattttccgcatatattgggaacgagcatcgatgaatgaagtggtgcgttttttcctacacctgttatgcttttggcgatgtaatttattgactttcattaaaatgattgtagctttgtttcatccacctatgattatgcgtttcaatgattcacgttaccatttatccctccaataagctcctaatttgcctga

SEQ ID NO: 6137 - DNA, 451 bp, Diabrotica virgifera
  Clone ID: LIB150-024-Q1-E1-C5
gatacaagactctaaacagacgtcctgctaacgcgtccggtaaatccagaagaaaaaccagaaggtgaaaagaaagccaaatcagaagagcccaaacccgaagagcagaaggtacaaaaagttgaagaagccaaaccaagcgaaggaaaatctttagagcaacaaccagctgaaattaaacctgtcgaattagtaccagtagcagaagaaaaaccaattgaaggacccaaactaccagaaggtaaattagagaagcttccactgccagaaaaacctctggaagagcccaagccaaccgacgcagcgaaaatcgaagaacccaaatccgcagaagagaaactacccgaaccaagtgcgtccagttcttgaactgtatttccatgatcgtggaaatttcccaagaatgactgatgaggttcgctggcgcttttgttcacaacacacttaattt

SEQ ID NO: 6138 - DNA, 378 bp, Diabrotica virgifera
  Clone ID: LIB150-024-Q1-E1-C9
acaacaccctaaactgagtcgtattatgattgatatggtctacagccaaaaatttctgtcattcaattttgggtaatgtggtaggtaggcaatgtgttaataaacatgcatgggactacatttactactccacaaagtgtgtggtcacacagtctgctgtttatattttatcatacctctgtgatacaccacaccactcaatacatcccgtccctaacctgcgataagaaagccatgcttccaaaaagaactgttgaaatagaaaattataagatggaatgaatattttacatagtaataggaacaaaatatttaaaagaaaatgcaaaacaaggttatcgaacacaacaatttgtttttttaaacacactttcgtcc

SEQ ID NO: 6139 - DNA, 430 bp, Diabrotica virgifera
  Clone ID: LIB150-024-Q1-E1-D1
tacacccctctagagtgagtcgtagtatggtattggggttcagtcgccttacacgcttcgccacggagacaatgcgtcattacgtgcgaagatcgactaactaaactgattaaacttttgacatttttgaattaaatcagcatagtttgatctgaattgaaattagttagaattgaaataatacaacaaaacgtagagtcagaattcaatatattaggtgaatattgatggtaatcaaattatgtgaataaaagtattacatatactatgtattttggtacgttcaaataggtaggtacctacctatgaaattttttattaggatacgtactgatacatttaacaaataatacgtacctgttgctttgaaagaccatataaatatcactacagttataaacatgtttgtttctgtcctcacgacaataaa

SEQ ID NO: 6140 - DNA, 434 bp, Diabrotica virgifera
  Clone ID: LIB150-024-Q1-E1-D10
tcgcgggtcgatacaagcctctagattgagtcgaaatacgaagtgatattattttcttatataattatgaataaaactgtagatattgataactaaacaactcattctatagattatcgtgacttagaaactatcgtgacaattactaaggaattaactagtttattattattgttttgttgcaacttgccaaggttcgttcgtaaataaattaacagagcgcacaagaaacaagtagtttcaaatcggtagcggaaaatgtcttttctaaagaaaatcgtgtttcctttgtatgtcgggtttgtgatattaaatgtctattctttgagactgcaactcgcgttgaatgaagtttctgagaggcctaacggggagatgttcagccatctgaaggtgtaccactattttttcctgaccaattggaattttatgct

SEQ ID NO: 6141 - DNA, 150 bp, Diabrotica virgifera
  unsure (1)..(150): unsure at all n locations
  Clone ID: LIB150-024-Q1-E1-D12
taangnggtagaganntnanaganggtggaggngagaaaggggaagaattgangagagaggaagtanagtttagtattgggaggtgttaggaatggggtagggaaaggtgttagatgtagtgtatggggagatatattaatgtgttgtgg

SEQ ID NO: 6142 - DNA, 424 bp, Diabrotica virgifera
  Clone ID: LIB150-024-Q1-E1-D4
gtccgcacaggtactatgttaatactaaactggtattagtgaaattcgcaatggggacgttatgaaaagaacaccatcaaggtttacctctcgttaaacttgatgtatgtatttgtctaagaaagtgtaaatttgtgcaatttgtgcctcgtttttattttctccgggtttttggtggtacatatacggaaaagttaatgtaaaaaggaagtcaaaatgcatttattgctaatagctggtgatttatcactttttcttggcacagtatattttgtattaagtatattcgtggaaaaatcatataatggtatctctgccaaaacgcagttgctctacatgatagtctgtactacaagatatttcgatgattccagcttgtttgtatgggttattaattttttctcaagctttgctttctttttaa

SEQ ID NO: 6143 - DNA, 428 bp, Diabrotica virgifera
  Clone ID: LIB150-024-Q1-E1-D5
agaggaacaaagatgtagaatattatgattaaaactcaagagttggtgatacgaaagtattgaccactggaattttattgaaaggtacccaatatgtcttttgtataaaaaatatgactaagttaaaattttatcgattttttattcgatatttttttagattattttaaatcgataattatatcgattaaaaatgtaagatagactataaaccaaattgggtcatggcctcctgcaattttcgcccacattgtcgatcacgtgtcgctgatctttaaattctgactgtgtatcaattatcgcattgttctctcatttaatgttcttggttgtattttagtgcacagtgttcttctttacaatctgtccttctaattatatactacatggcttgtccatgggactaaggagattagcgaactctggtg

SEQ ID NO: 6144 - DNA, 365 bp, Diabrotica virgifera
  Clone ID: LIB150-024-Q1-E1-D8
taaatttagtcgtgttaccgtttggctctacacaacggattcctaaattgtcagtacctacaatgtctccatacattggtccgtactgtctaagctttggactcggtacatggttggttgctcctgaatgactttaagatactgtcaatttctgatgtgtgcttggttatctcatgtacatttgctcatagctttactggaactcttttgaatgtagccaaggttaagtatcattcgttcaatatataactgtcaagagacagttgctgtctgtcattctcaaatgatgcaatatttttcacgattaacatgtagtagttgatcaggtacagaatctttaaataattttgggcttgattattgtt

SEQ ID NO: 6145 - DNA, 258 bp, Diabrotica virgifera
  Clone ID: LIB150-024-Q1-E1-E10
atgcctgattagcactgtgaatcggttgaaaaattaatttattgagatttatcccgctaatgaaatctcataataatatttttcccgctgaggccactcttacatattttattactcaagctttaacttctgctattgtattgttttcagtcttttagctttaaattcttcagattttattttaagatcttgaattttaagatataatttaatcctaaattcagctttaatagcacaacttggagcagccccctttca

SEQ ID NO: 6146 - DNA, 394 bp, Diabrotica virgifera
  Clone ID: LIB150-024-Q1-E1-E2
aacacgcatccgctcacacgtcagcccacgcgtccgcagtcgtcaggtggattaaataaataattcatgaaagttaaaaatacgtgtagtattatttcaagctgttggtaaatcaaaatcaaaatagtaataattattctgaataatgatcgtgtccagttggtaatgatgacaagtaaaaagtggcataaggatttttctagaatcataaataaagaattacatcaggtgatctaaaaacgagatgaccattattgaggggatacgcgacgaagttacacatttttttattgcaatgattgttaatgtcataggaactgttgcttggtggactactaacatatctgaacaaatgtatattaagactgtagtgttactataaagaagaagacat

SEQ ID NO: 6147 - DNA, 393 bp, Diabrotica virgifera
  Clone ID: LIB150-024-Q1-E1-E5
aagtccctccaatattattctgtcttcctctaattttttctgactccctccagtttttttattacctcccctttttctgagtccctccaatttttctgggtcctctaagttttcttgactcgctctaatttttcctcgctccttctcattctgtgatgaagtgcttgtctgtacaaaattggcagcgaacgtccattgctccacaggaatgctcagtgactgcgtcttcatcatccagcattacttctacgccttcttgcaagcgactttgtgcaagattcaccctttggttgcttatatttctttaagaagcaagttgtcgattttttttcgctgttcaggtgtctctcgttgcgattgctcctttcgcatctgtacctcccgagccaatct

SEQ ID NO: 6148 - DNA, 442 bp, Diabrotica virgifera
  Clone ID: LIB150-024-Q1-E1-E8
tcgcgggtcgatacacgactctaaattgagtcatactaggtacacaaccaattttttttaaaatgtataaacttctcgttctcgctatggtcctctacaccgtcagcgctggtgtcattctagaccacaaacctgccgtcattgtacaccatggagctacatctcatcaaaacagcaactcgctttcagtccaccctgttcctgttgttgctcacaaagtggccgttgctcatgttgctcatgctccagtaatcgcacatgctccaattgctgttgctcacgcacccgtagccgttgcacatgctcctgtcctacatcatgctgtgcttcatcattagggtctacgattgaagcatcgaagcatgcaaagagatgagcaacgattttatttatttatgtatattatgtaatatagaatttaaaatatgaaatccaatatttt

SEQ ID NO: 6149 - DNA, 420 bp, Diabrotica virgifera
  Clone ID: LIB150-024-Q1-E1-E9
aaatttggatgcattcgtgagaatgtcttttgtgcccacctaaactttggtataagatttgttttaagctgttttaagcttgaatttacattttgactttttttattttattaggctatatttgaaatattaaggtagagagaaaacaattagaggaggctgtgcaatgtaaatgtttcagttagataatttggccactttcatacaatatcagtaatttcttgaaagcattctaagtaaaatgtatgaagcctttagcatcacctacaagtgatactgcaataaagaagggaaagagtatctattggaggtatggttattgtaaagtcctttcgcctatattttcttcttccaaatcacgctatattgcgtctgacgccaagctactggagatcctcccatacgtcaccagctctttcg

SEQ ID NO: 6150 - DNA, 122 bp, Diabrotica virgifera
  Clone ID: LIB150-024-Q1-E1-F10
gtttttcgttacaattctctatagtgagtcgtattaagtcgtgggttgcagcgtgtgtttcctatgtctttgcgcggtggcgtcttccgctgctcgctcgtcgtcttcttcgtgatctgagc

SEQ ID NO: 6151 - DNA, 454 bp, Diabrotica virgifera
  unsure (1)..(454): unsure at all n locations
  Clone ID: LIB150-024-Q1-E1-F4
gtccatacacccctctaaactgagatcaaatactactggacatttctgcccacaacgcgttcctggttacggcatcantaaatatcaaatggaatacaaatcaaatggggaaaacggcgaattttttttgagaaattttganaaaactaatgaatccagtcatcatttccagaaaaaataaaccaataactaaaggctcttacgaactggtaaaaatgttacgagcaggaacaagtagacaagatggaaatgctagtgaaccgtctattaaatctaaccccgcctgctaaacgaacacgctgtaaacttgccgtaaaaacgatcacaagactaattattatgttatattatatcacaaacatatttgtaaaatccattctttttaatactgtcccagttgtaaactgaattaaaattttgtagataaattgtactaagccttttttgaagaaaa

SEQ ID NO: 6152 - DNA, 167 bp, Diabrotica virgifera
  unsure (1)..(167): unsure at all n locations
  Clone ID: LIB150-024-Q1-E1-F7
gtgagtcgtattaaanngntactttcgagtgaaggtacggaggtaggttactgattgatagttaactagcctcgggcgagagtaattgaccttgatggaccagcaattgatttatcgtcccgttgcgtatcacggaggagggattacttcgtatatatgtactaatt

SEQ ID NO: 6153 - DNA, 429 bp, Diabrotica virgifera
  Clone ID: LIB150-024-Q1-E1-F9
tacaactccctgatgtgagtcgtattacgttggaataggtaacatttgtgatatgtctgttgttgggggatcagttgacaatgccatctacgcttaatacaaccgacctgcggttacttacatggaccattataaattcaaatctatcttgtttactcacagtcacaagtctgcaccatggcattgtctccacatcaactggggattcatcgctgcgtatgtcgatgaggttcgtgctaacaacttgacaggaggatgaactttgaatctaatctaagacaacattatactcgattcctcaaatttggttaacacaagctactctttgaatacatttgcagttgattttagtacttacccaacgcaattcaaagcctatctcggttcgtaaacagtcttcagtcaatcgtgaacaaagtctggttgcac

SEQ ID NO: 6154 - DNA, 355 bp, Diabrotica virgifera
  Clone ID: LIB150-024-Q1-E1-G10
ctcgcgtttcgacacaagcctctaaagtgactcgtgtaactttaagtagcagcatttgcatcatatcagcgtagaattgtgataaaagagtttgaataaagagagtggcagtaatttctgatgggtatacacattgccaatagtaactgtattacaactagcttaagaatgtcatcaccagtcgcagtacatagcgataatctaataaatggtggctacgttagatgatcaagccaaatctgtgcctacatatcgtctaaaaatacgtcaagtcagtcagcggtcatcaagtcagagtacatcttgtaagaattgatagactgtaactcatctcgagttctactatcaacacgtt

SEQ ID NO: 6155 - DNA, 224 bp, Diabrotica virgifera
  Clone ID: LIB150-024-Q1-E1-G11
tgagtcgtattaagatgtacgactcactttagggagtcgtgggtagtataatgaacaatagttggaatcataagagtgagtgtgagacggttaggattaggaaatgctgctttaacatttgtgaaagataatctggtgacatgcttaccagtcctggtatggaacgggaagctattaaaggacggcaacgtgtaatgatcaaggcaagactgagagtacagacc

SEQ ID NO: 6156 - DNA, 425 bp, Diabrotica virgifera
  Clone ID: LIB150-024-Q1-E1-G3
aatttttataacttataaatgtcctttttgtattagcgtcatggcaaccactgttagtatttaaccctttcagctccgctgtaatatgtccagcatcatgacgcacttacgcgtcaaatacactggccaatagtcatctttggacgcgcgtatgcgtcaccgtagctgaaagagttaagtctctgtaatttctccaattttcgtttacccaaaaactgatctataatgaatttgggtacttgactggaaagtgtgatcgaaattattcttctctcaaagaaattgtatgctgtcagtttgagataggttaatgacattaataacggaaaggattagcatttaaacacgttgatgcaatatacttataataacttgtaagagtatgtgtaattttatgaaaatagtagttttcaggtaacagttat

SEQ ID NO: 6157 - DNA, 349 bp, Diabrotica virgifera
  Clone ID: LIB150-024-Q1-E1-G6
acgcgtgggaaagtagatctgaatgtacacaactttgtaggtttgccggaagatttgccagaagtgaaagcagtacttgaattgatgtgtgaacgggagataaaacgaggagccgataaaaacgaggttatgtcattcaagttccattacttagggtagattgtaggacaagtcttaccagtaaggcagcgacaaactgcgaaaaaggatgaaggcgaggacgataaaaagttggatatgactgaactttttacgaggaaattgctaagacctggcatagacggacagttggagttcatggatgcatttttaaaacagtgtatcagagaatttccttaaagggattgca

SEQ ID NO: 6158 - DNA, 371 bp, Diabrotica virgifera
  Clone ID: LIB150-024-Q1-E1-G9
acagatctggttccgtgtgaaaaattcgggaatttttttaaactggaagaattcatgacacatattgtaaaatggttgtggaccaaattatttcatggtactaaaatggcagtagttcaatcaaattacattcaaaatataccttcttttggatgtgtagaccaacctgacaacggctccaaaacaacaagagaatcattagtagaagtgtcttcatcacgtccacgccaagaagactactcagtatatgagaacagactggcatctttcactaactggcccaacacccaagtgtcaagagaatcattagctcgagctggttttatatatacaggtcaagatgacatcgttatctgccctatttgttagat

SEQ ID NO: 6159 - DNA, 426 bp, Diabrotica virgifera
  Clone ID: LIB150-024-Q1-E1-H12
cctaaagagacgtcgtagtagacatcactgaaaatgacaagcctagtgttagtgttgttgtttgcgatatgtgcttacgcacaggacaatttcgaaaataccggcgttagattagcactgaaaatatacgatgactgcacaaaagccgatggattatcaccgtgtttaaaaagaaaagctatcacttttctagacagactgagccgtatggataaattcgcactaactgacggagttacggtacaaaaggcatccgatgcagtcgctgaaggtccagcccttaccgaagaacaacttgacaacacactttccaggtcctctgacgccaaagatgcagctttaacaaacatgctttttgaaaaagttggcagctttatcggatccagatcacttgaagtaactcttccaaaaattcaagcatcggac

SEQ ID NO: 6160 - DNA, 370 bp, Diabrotica virgifera
  Clone ID: LIB150-024-Q1-E1-H3
atcacgatgaaggaaggttggtagatgtaaattttgtgctacaaatgtttttgggggagtaattatctaatccaagtatgggagatactaaagaactgctaagacttatatagaccatgatgaataagtatcaaggtacatttttgacattcgacagtctgaagatggacattgttagacatacagtggatatttgatgtgacgtgtgcaaacctgactataaataagaagttggcaatagtatatacgacgaagatcaatttaccagacattatagaaccttcctcatatctgagaaacaacagaaactctttgatgacatttgcggagattttaagacagaccaacccaattcagacctatatgggtt

SEQ ID NO: 6161 - DNA, 280 bp, Diabrotica virgifera
  Clone ID: LIB150-024-Q1-E1-H4
tttaaaagtcatacttaagtcaaattacagtacatactattatattcacgaatatactcagttccgttttgttcgcggaagcacacaggtctgatgcatatcaagtagactggtgtaggacgtattaatccggtatcgttacattcgtttgatatatccaaataatcgctctcataaattcaaactcatattcttccacgtttaagttgggtgatcaatgggaaacattaaacattcttttgggatgaccaaaccatctctctcttgacatcaatcagat

SEQ ID NO: 6162 - DNA, 419 bp, Diabrotica virgifera
  Clone ID: LIB150-024-Q1-E1-H5
acgccggaggtggaactggattcggaggtggaagcggtattggaggtggcattggaggcggtattggaggtggtattggaggtggtattggaggaggaatcggcggaggaatcggagaagatgatggccaatacaggccagagctgtatgaaagacctcaacaacagttaatccaactaccctcccaccaaagagcttcctacccagcacctttggcagtctctcccactccaagttcgaatgctttagaagaaaaggactacttcgacgagcctggtaaggcacacagtttcggaagtggatatatatttgaattcggagggtagaaattatttatatttaggatattagtattatttttacaatttgtgtgatcgttgtgaggtgtatgttactattacgaaataaattttttgtac

SEQ ID NO: 6163 - DNA, 428 bp, Diabrotica virgifera
  Clone ID: LIB150-024-Q1-E1-H6
accacgcgtccgatttatttatattttaactgtagttaaagctacaccaaagatcaaaccttgcgacgatccaaacgaaagcataaacggagtcgggacagttctatttactccagccgatgtctataaacaatgctggtctctagaggaaatagctatattgacgaccaggatgatactagaagacttactgccagacgtaacagttttcaacatagacagcaacgcttttgttgacgatatagttagttatttccggttgttaattgaagttgtgaagacagccaccactggtcgaaagaaacgagtgactcttctagcgttaactgatctacttggagggtacttgcagtatgctgttttacccctggcccggtatgcgttctatgctggttttaattgattacacagcatgggaaaactaatcc

SEQ ID NO: 6164 - DNA, 430 bp, Diabrotica virgifera
  Clone ID: LIB150-024-Q1-E1-H7
gggtcgacacacgagtctataattagtttcgaaattaaaagagctaaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataatattagtattaaaaaattgtatatttagtaaaaatatat

SEQ ID NO: 6165 - DNA, 415 bp, Diabrotica virgifera
  Clone ID: LIB150-024-Q1-E1-H8
tccgatcgtattcctttttacttttgtctgtttgtagttgtatccatgtcttccttactgtttatctttttttccagctgtttccgacattcatcgtcataccatgtttttgctctcttctgcctactccttccaaaaatcttgtcagctgtcttggttattatttcggcagtcgtttcccacagcctttctatatcattgtaaactgtttcagagttcaaggtttgttcaagttgttctatatattttttatgtttctcggtgttctgcatttcgtccatgttccattgtgggttcattgttttcttgtatttgtggctagatattctgcattttacttttgctgtgactaagtaatgatctgtgtctccgtctattcctctgaggcttcttacgtctatgatattgttcccat

SEQ ID NO: 6166 - DNA, 418 bp, Diabrotica virgifera
  Clone ID: LIB150-024-Q1-E1-H9
acagtgtacatgttatgtgtggtccacatcagcattgtgagagtttttaatcagcgcgttgtcaaaatatgttttcaaagttacgtgtcgttctttcgttgggagatgtcgtactgtaccaaaaaatttcttggaatcagtaaagaaaaattgacaaaaatttcgtgtttttgacaagttgtttctttatccaaaattttctcacaaatagtgtacgtacacatcgtgtttttacagaaatttggcaaaatttgaggtgttacactctaataagggctatatacatctcaacatctcgataatatatacagtgttgcacagtatagcaatttttatccttgtacataacattttgttgcatatattccttttcctgcttctgtgacctaatcagaaagtagatgcagtgtttttgttg

SEQ ID NO: 6167 - DNA, 346 bp, Diabrotica virgifera
  Clone ID: LIB150-025-Q1-E1-A11
agactttatggtcttatgttgttgtcacacataccccctcccccttgttagtcttgttttgattttagcccttgttgttgtcatatacccctttgtctagccctgtcttgtttgaatgagttgttgaagtaagttgttggtgagattttgtctcactgaagtgtttagactggattgtctaaatcctcgttttgcagaaccgttgccgaaatgtcccgtgaaactcgctaggtgttagcagagtttgggcagatgtttatctgtcaaacatcaactttttagtttttgtgaaccgctcgcggttaggcaacgaggtgacaaggctgtgtctgccctggtatgtcac

SEQ ID NO: 6168 - DNA, 421 bp, Diabrotica virgifera
  Clone ID: LIB150-025-Q1-E1-A12
ttacaatactctatagtgagtcgtattaattcttctgcatcaacttttgtttttttttatatatatattcagtactgtaatggtttttaattttttatatattaaatgtatatttatctccttctagaattttgaaaatttttttttgaaattttagcaccttttaagttgtaacttgttaactattacatttattatttaataacattgttttaggttatcttttttattttgtatttgttcattgttgaacttctccccagaacttacctctcggggtaaaggcaaatacagcggttttaaccaaaagtttttttaagagttggaattacgttatgtgaaatatatattttgtagaacaaatatgcagatcaaggtctatctgtagtccttacttgattttatagaagtcgatagacaa

SEQ ID NO: 6169 - DNA, 51 bp, Diabrotica virgifera
  Clone ID: LIB150-025-Q1-E1-A2
caccctgaggtgagtcgtattaaactctgcgattaggtaagatgtgcacgt

SEQ ID NO: 6170 - DNA, 218 bp, Diabrotica virgifera
  Clone ID: LIB150-025-Q1-E1-A3
acacgcgtctaaaatgagtcgtattataaaatgacgttatggagctgaagttacattaaattgtcgttcagggattctccatataagttcgttaaactgcatcactgatttcggaaaatatatccagtactgaacattttatatcaaggaacggggttgcaatggaatatactgagttttaacaaaagttgcggatttcagtattgaaatgctcaaca

SEQ ID NO: 6171 - DNA, 414 bp, Diabrotica virgifera
  Clone ID: LIB150-025-Q1-E1-A6
gggtcgatacacgcgtctaaacagatgctgtatagggttaaggtcgggtgagcaatcaggccactccataacagtgatagcttctgcttcaagaaagtgtgtagtcaatctgctggtatatggaggtgcagtatcatgcatgaaaattaaattttctcgattgctcctctccagaacctaactatatgttcgagaaccaaatcatcatacctgcgagttgttaaaattgattggatgaaaattaaatttttttacagatcataataccgtcccagaatatgacacttcctcatttatatgtgtggacagatctggtaatctccgtcctttctggtcttccacatattcgaaatcttgggcacgaatccttttttagtgttttcactgaaacacttatacctgtaacttccaaaa

SEQ ID NO: 6172 - DNA, 307 bp, Diabrotica virgifera
  Clone ID: LIB150-025-Q1-E1-B10
ttgcaccaccctatagtgaatcgtattacgtcttaggtcaccatcgcacatcagatggcaaaccaactagctgcggccacacaatgcgcagcacacgctgaaagactgtaccagcaggcacaagctcaggggtgattacatggtgcgggttatccgatggatggcgctaatggttcatagacagctgaggtgggtgacatgccattttgggccaacaaggactggttccaaagtgaccaggacagaatgagtatgtccggacagtgttagatgagacaaaatgttacagcccaagaatgctggtaag

SEQ ID NO: 6173 - DNA, 394 bp, Diabrotica virgifera
  Clone ID: LIB150-025-Q1-E1-B11
tcgtgggccgatacaagcctctatactgacgtcgtgctaaatctcaacagctcaacatgaacgcaatgattgctctcacttttgccgctatggtagcaaccgcttccgcatcccaccttggtctaggttggggattgggacatgccggtatcgtcaacccacacgccctcagcccaattggaccctctggaatcgtcactggagccggcgcagctggtccctctggagtcgtaactggagctggagctgtaggacccgctggagtagtcaacggacatggagctgtaggaccaactggtcccaacggacatggtgctatccttgctggtcccggagctttaggtttgggattgggtgttgctggtcatgctcttagcccagtaggtccttctgg

SEQ ID NO: 6174 - DNA, 269 bp, Diabrotica virgifera
  Clone ID: LIB150-025-Q1-E1-B3
ctaaaatgagtcgtattaaagagtttcactatggtttaatatttcgatttcgtttccaatgttttcatggcaagtcaggttcgtagtacaattgcattggcgtctcaacaacgacgcctatcagtacaaaatgttacaaatggcgacatcgccacaatttactcgctatttgctcagatactccgacgaaatcattacgggaaatatcccgagcatcgatcacgtcatcaactttgtgttagaaatacgaatagaattggctcccagga

SEQ ID NO: 6175 - DNA, 438 bp, Diabrotica virgifera
  Clone ID: LIB150-025-Q1-E1-B6
atattgtctctatgtatgtggctctatacgggcatttggaactaatgtaccttttgccaagccaaaaagtttttattgaattttacgtgtaattaatggtatacagccagctacaggaaattcttccatgtgacttcatgtgacttttgattgacttttatatcagatattagacgataatggtttgggtcgatatgtcgttattgtgttgactctcttcctgaatctcttatttactggactataaacaatctgatttctgatatcatccattcatacgtatacatttttgtcgccattctctgatgtcctatcactctcgacgactacatacagggtgtttcattgagaattgtccatacagttgctggaaggaccttggcacgaagtacgaggattggacttataacacctggataaaatgtggttccttaccgg

SEQ ID NO: 6176 - DNA, 423 bp, Diabrotica virgifera
  Clone ID: LIB150-025-Q1-E1-B7
atgctccaagatgaaggtactcattcttctttccgttgttgccttgagcagctgcttaccagcatccagaaatcaacaatacgttgatgtagactacaacagctacaacgctcatcccgtctacaacttctggaggacttggaatcagcaacactatggacaagaaccatggaaccaatgggtacaatatggtgtccagaaccaacccggtaactactggaggcagtacgtgcaacgcagcaaccaagctgaaaatgtcgatttaccttggatgtatcactcttgggatgtccaggatgtgcaaaacttaactcccgttcaacgtgttcagttgctactcaactacgtcagacttcaccaacaatggaaccaatggactcatgatgtaactgccaatgaacgtcttcagaatatgttgtatca

SEQ ID NO: 6177 - DNA, 363 bp, Diabrotica virgifera
  Clone ID: LIB150-025-Q1-E1-C12
agtgagtcgtattacggttcttgagtcacagggaggagtcctggtaacatacatctctcatttttgcgacttcatttaagctgacttactgatatgtgtaatgctgaatacatagtttggatactttgtttgcggtgctttgataatcgtttttcggtagatctattttgctagggcataaatgcctgtaaattattcagtttcggattacctccccaggtatttatcgcgagacgacacagtttttttacggatgctcctgaaacgttgtgtttcattgaattaatgttttgattggagattaggattatcatttttcaggagtaatcctacggtatgatatattcttacattttatcattt

(The sequence listing continues in the following parts.)

What is claimed is:

1. A nucleic acid molecule complementary to all or part of a sequence selected from the group consisting of SEQ ID NO:1684, SEQ ID NO:1685, SEQ ID NO:1686 and SEQ ID NO:1687, wherein the expression of the nucleic acid molecule as antisense RNA blocks the expression of *D. v. virgifera* V-ATPASE, and wherein the nucleic acid molecule hybridizes to a sequence selected from the group consisting of SEQ ID NO:1684, SEQ ID NO:1685, SEQ ID NO:1686 and SEQ ID NO:1687 under wash conditions of 0.2×SSC at 65° C., and wherein the nucleic acid molecule is operably linked to a heterologous promoter that causes transcription of DNA in plant cells.

2. The nucleic acid molecule of claim 1, wherein the nucleic acid molecule is complementary to all of SEQ ID NO:1684.

3. The nucleic acid molecule of claim 1, wherein the nucleic acid molecule is complementary to all of SEQ ID NO:1685.

4. The nucleic acid molecule of claim 1, wherein the nucleic acid molecule is complementary to all of SEQ ID NO:1686.

5. The nucleic acid molecule of claim 1, wherein the nucleic acid molecule is complementary to all of SEQ ID NO:1687.

6. The nucleic acid molecule of claim 1, wherein the nucleic acid molecule comprises a fragment of from about 15 to about 250 nucleotide residues complementary to a sequence selected from the group consisting of SEQ ID NO:1684, SEQ ID NO:1685, SEQ ID NO:1686 and SEQ ID NO:1687.

7. A construct comprising the nucleic acid molecule of claim 1.

8. A transgenic plant comprising the nucleic acid molecule of claim 1.

9. The transgenic plant of claim 8, which is a corn plant.

10. A cell comprising the nucleic acid molecule of claim 1.

11. The cell of claim 10, wherein the cell is an *Agrobacterium* sp., *E. coli* or plant cell.

12. The cell of claim 11, wherein the cell is a corn plant cell.

* * * * *

UNITED STATES PATENT AND TRADEMARK OFFICE
CERTIFICATE OF CORRECTION

PATENT NO. : 7,612,194 B2 Page 1 of 1
APPLICATION NO. : 10/205189
DATED : November 3, 2009
INVENTOR(S) : Andersen et al.

It is certified that error appears in the above-identified patent and that said Letters Patent is hereby corrected as shown below:

On the cover page,

[*] Notice: Subject to any disclaimer, the term of this patent is extended or adjusted under 35 USC 154(b) by 473 days Delete the phrase "by 473 days" and insert -- by 677 days --

Signed and Sealed this

Tenth Day of August, 2010

David J. Kappos
*Director of the United States Patent and Trademark Office*